(12) United States Patent
Khvorova et al.

(10) Patent No.: US 7,691,997 B2
(45) Date of Patent: Apr. 6, 2010

(54) FUNCTIONAL AND HYPERFUNCTIONAL SIRNA

(75) Inventors: Anastasia Khvorova, Boulder, CO (US); Angela Reynolds, Littleton, CO (US); Devin Leake, Denver, CO (US); William Marshall, Boulder, CO (US); Stephen Scaringe, Lafayette, CO (US); Steven Read, Denver, CO (US)

(73) Assignee: Dharmacon, Inc., Lafayette, CO (US)

( * ) Notice: Subject to any disclaimer, the term of this patent is extended or adjusted under 35 U.S.C. 154(b) by 837 days.

(21) Appl. No.: 11/101,244

(22) Filed: Apr. 7, 2005

(65) Prior Publication Data

US 2005/0246794 A1 Nov. 3, 2005

Related U.S. Application Data

(63) Continuation of application No. PCT/US03/036787, filed on Nov. 14, 2003, and a continuation of application No. 10/714,333, filed on Nov. 14, 2003.

(60) Provisional application No. 60/426,137, filed on Nov. 14, 2002, provisional application No. 60/502,050, filed on Sep. 10, 2003.

(51) Int. Cl.
- *C07H 21/04* (2006.01)
- *A01N 43/04* (2006.01)
- *A61K 31/70* (2006.01)

(52) U.S. Cl. .................... 536/24.5; 514/44
(58) Field of Classification Search ............ None
See application file for complete search history.

(56) References Cited

U.S. PATENT DOCUMENTS

| | | | |
|---|---|---|---|
| 6,001,992 | A | 12/1999 | Ackermann et al. |
| 6,111,086 | A | 8/2000 | Scaringe |
| 6,172,216 | B1 | 1/2001 | Bennett et al. |
| 6,506,559 | B1 | 1/2003 | Fire et al. |
| 6,965,025 | B2 | 11/2005 | Gaarde |
| 6,994,979 | B2 | 2/2006 | Reed et al. |
| 7,022,831 | B1 | 4/2006 | Reed et al. |
| 2002/0081578 | A1 | 6/2002 | Plowman et al. |
| 2002/0086321 | A1 | 7/2002 | Craig |
| 2002/0086356 | A1 | 7/2002 | Tuschl et al. |
| 2002/0150945 | A1 | 10/2002 | Finney et al. |
| 2003/0087259 | A1 | 5/2003 | Clancy et al. |

(Continued)

FOREIGN PATENT DOCUMENTS

WO    WO/00/20645    4/2000

(Continued)

OTHER PUBLICATIONS

Promega siRNA Target Designer (See Search Results for GenBank Accession No. NM_002755), www.promega.com/siRNADesigner/program/, Jul. 7, 2003.*

(Continued)

*Primary Examiner*—Sean McGarry
*Assistant Examiner*—Terra Cotta Gibbs
(74) *Attorney, Agent, or Firm*—Kalow & Springut, LLP; Scott D. Locke, Esq.

(57) ABSTRACT

Efficient sequence specific gene silencing is possible through the use of siRNA technology. By selecting particular siRNAs by rationale design, one can maximize the generation of an effective gene silencing reagent, as well as methods for silencing genes.

20 Claims, 28 Drawing Sheets

U.S. PATENT DOCUMENTS

| | | | |
|---|---|---|---|
| 2003/0105051 | A1 | 6/2003 | McSwiggen |
| 2003/0143732 | A1 | 7/2003 | Fosnaugh et al. |
| 2003/0157030 | A1 | 8/2003 | Davis et al. |
| 2003/0228597 | A1 | 12/2003 | Cowsert et al. |
| 2004/0006365 | A1 | 1/2004 | Brady et al. |
| 2004/0029275 | A1 | 2/2004 | Brown et al. |
| 2004/0054155 | A1 | 3/2004 | Woolf et al. |
| 2004/0063654 | A1 | 4/2004 | Davis et al. |
| 2004/0180357 | A1 | 9/2004 | Reich et al. |
| 2004/0204380 | A1 | 10/2004 | Ackermann et al. |
| 2004/0248299 | A1 | 12/2004 | Khvorova et al. |
| 2004/0259247 | A1 | 12/2004 | Tuschl et al. |
| 2005/0048529 | A1 | 3/2005 | McSwiggen |
| 2005/0130181 | A1 | 6/2005 | McSwiggen |
| 2005/0176025 | A1 | 8/2005 | McSwiggen |
| 2005/0181382 | A1 | 8/2005 | Zamore et al. |
| 2005/0186586 | A1 | 8/2005 | Zamore et al. |
| 2005/0227935 | A1 | 10/2005 | McSwiggen et al. |
| 2005/0239731 | A1* | 10/2005 | McSwiggen et al. ......... 514/44 |
| 2005/0245475 | A1 | 11/2005 | Khvorova et al. |
| 2006/0286575 | A1 | 12/2006 | Farrell |
| 2007/0031844 | A1 | 2/2007 | Khvorova et al. |
| 2007/0254850 | A1 | 11/2007 | Lieberman et al. |

FOREIGN PATENT DOCUMENTS

| | | |
|---|---|---|
| WO | WO/00/21559 | 4/2000 |
| WO | WO/00/76497 | 12/2000 |
| WO | WO/02/44321 | 6/2002 |
| WO | WO/03/035869 | 5/2003 |
| WO | WO/03/035870 | 5/2003 |
| WO | WO/03/64625 A2 | 8/2003 |
| WO | WO/03/070897 | 8/2003 |
| WO | WO/03/070969 | 8/2003 |
| WO | WO/03/072704 | 9/2003 |
| WO | WO/2004/031237 | 4/2004 |
| WO | WO/2004/046324 | 6/2004 |
| WO | WO/2004/090105 | 10/2004 |
| WO | WO/2005/001043 | 1/2005 |
| WO | WO/2005/078095 | 8/2005 |
| WO | WO/00/5117991 | 12/2005 |
| WO | WO/2006/015389 | 2/2006 |
| WO | WO/2006/110813 | 10/2006 |

OTHER PUBLICATIONS

Elbashir et al. (The EMBO Journal, 2001 vol. 20:6877-6888).*
Khvorova, et al., Functional siRNAs and miRNAs Exhibit Strand Bias, Cell, vol. 115, 209-216, Oct. 17, 2003, Cell Press.
Reynolds, et al., Rational siRNA Design for RNA Interference, vol. 22, No. 3, Mar. 2004, Nature Biotechnology.
Kasif, et al., A Computational Framework for Optimal Masking in the Synthesis of Oligonucleotide Microarrays; Nucleic Acids Research, 2000, vol. 28, No. 21, 4113-4124, c2000 Oxford University Press.
Amarzguioui. Secondary structure prediction and in vitro accessibility of mRNA as tools in the selection of target sites for ribozymes (2000) vol. 29, No. 21, 4113-4124.
Caplen. dsRNA-mediated gene silencing in cultured Drosophila cells: a tissue culture model for analysis of RNA interference. (2000).
Chalk, siRNAdb: a database of siRNA sequences (2004).
Caplen, RNAi as a gene therapy approach (2003).
siRNA Design for RNA Interference (RNAi) Experiments, http://web.archive.org/ web/20010101000000-20021231235959/http://www.ambion.com/techlib/misc/siRNA_design.html. Accessed on Mar. 6, 2008.
CHI, Genome wide view of gene silencing by small interfering RNAs (2003).
Ekholm, et al.(2004) Deregulation of Cyclin E in Human Cells Interferes with Prereplication Complex Assembly. The Journal of Cell Biology. vol. 165, pp. 789-800.
Elbashir et al. (2002) Analysis of Gene Function in Somatic Mammalian Cells Using Small Interfering RNAs. Methods. 26:199-213.
European Patent Office, Office Action dated Nov. 15, 2007.
Far, R-K, The activity of siRNA in mammalian cells is related to structural target accessibility: a comparison with antisense oligonucleotides (2003).
Futami et al. (2002) Induction of Apoptosis in Hela Cells with siRNA Expression Vector Targeted Against BLC-2. Nucleic Acids Research Supplement No. 2:251-2.
International Search Report for PCT/US03/36787 (2005).
Kalra, Central administration of antisense oligodeoxynucleotides to neuropeptide Y (NPY) mRNA reveals the critical role of newly synthesized NPY in regulation of LHRH release, Regulatory Peptides (1995) 215-220.
Kretscmer-Kazemei, The Activity of siRNA in mammalian cells is related to structural target accessibility: a comparison with antisense oligonucleoitdes (2003).
Kumar, High-Throughput Selection of Effective RNAi Probes for Gene Silencing (2003).
Levenkova, Gene specific siRNA selector (2004).
Marathi, RAD1, a Human Structural Homolog of the Schizosaccharomyces pombe RAD1 Cell Cycle Checkpoint Gene, Genomcs 54, 344-347 (1998).
Naito, siDirect: highly effective, target specific siRNA design software for mammalian RNA interference (2004).
Semizarov, Specificity of short interfereing RNA determined through gene expression signatures (2003).
Truss, HuSida—The Human siRNA database: an open-access database for published functional siRNA sequences and technical details of efficient transfer into recipient cells (2005).
Walton, et al. (1999) Prediction of Antisense Oligonucleotide Binding Affinity to a Structured RNA Target. Biotechnol. Bioengineering, v.65(1):1-9. (Abstract Only).
Yuan, A47, siRNA Selection Server: an automated siRNA oligonucleotide prediction server (2004).
Promega siRNA Target Designer-Version 1.51, http:///www.promega.com/siRNADesigner/program/default.asp. Accessed Jun. 24, 2008.
siRNA Converter, http://web.archive.org/web/20020101-20021231re_/http://www.ambion.com/techlib/misc/
siRNA_finder.html. Accessed Mar. 6, 2008. (siRNA Target Finder).
Tan et al. (2006) Functional Cooperation Between Fact and MCM Helicase Facilitates Initiation of Chromatin DNA Replication. The EMBO Journal, vol. 25, pp. 3975-3985.
Vickers, Efficient Reduction of Target RNAs by Small Interfereing RNA and Rnase H-dependent Antisense Agents, J. Biol. Chem. vol. 278, No. 9, 7108-7118 (2003).
Zhang, Physical and Functional Interationc between Myeloid Cell Leukemia 1 Protein (MCL1) ad Fortilin, J. Biol. Chem. 37430-37438 (2002).
Iliakis et al. (1990) Induction and Repair of DNA Strand Breaks in Radiation-resistant Cells Obtained by Transformation of Primary Rat Embryo Cells with the Oncogenes H-ras and v-myc. Cancer Research, 50, pp. 6575-6579.
Lindgren, et al. (2002) Contribution of Known and Unknown Susceptibility Genes to Early-Onset Diabetes in Scandinavia, Diabetes vol. 51, 1609-1617.
Murphy, et al. (2000) Synucleins are Developmentally Expressed, and Alpha-Synuclein Regulates the Size of the Presynaptic Vesicular Pool in Primary Hippocampal Neurons. The Journal of Neuroscience, vol. 20(9):3214-20.
Amarzguioui M et al, Tolerance for mutations and chemical modifications in a siRNA Nucleic Acids Research vol. 31, No. 2, Jan. 15, 2003 pp. 589-595, XP002270887 ISSN: 0305-1048.
NCBI Sequence Viewer v2.0 for NM-004438, http://www.ncbi.nlm.nih.gov/entrez/viewer.fcgi? db=nuccore&id=45439363, accessed on Jul. 3, 2008.
Olie et al, A Novel Antisense Oligonucleotide Targeting Survivin Expression Induces Apoptosis and Sensitizes Lung Cancer Cells to Chemotherapy, Cancer Research 2000, vol. 60: pp. 2805-2809.
Pan, et al. (2005) Calmodulin-dependent protein kinase IV regulates nuclear export of Cabin1 during T-cell activation, The EMBO Journal, 24, 2104-2113.

Betrand (2002) Comparison of Antisense Oligonucleotides and siRNAs in cell culture and in vivo, Biotechnical and Biophysicial Research Communication 296:1000-1004.

Rabert et al. (1998) A Tetrodextrin-Resistant Voltage-gated Sodium Channel from Human Dorsal Root Ganglia, hPN3/SCN10A. Pain, 78, pp. 107-114.

Ross, et al. (2001) Inhibition of Kirsten-ras Expression in Human Colorectal Cancer Using Rationally Selected Kirsten-ras Antisense Oligonucleotides, Molecular Cancer Therapeutics vol. 1, 29-41.

Shi et al. (2001) Gremlin negatively Modulates BMP-4 Induction of Embryonic Mouse Lung Branching Morphogenesis. Am J Physiol Lung Cell Mol Physiol, 280, pp. L1030-L1039.

Dodelet et al. (2000) Eph Receptors and Ephrin Ligands: embryogenesis to tumorigenesis. Oncogene 19:5614-5619.

Sorensen, et al. (2003) Gene Silencing by Systemic Delivery of Synthetic siRNAs in Adult Mice, J. Mol. Biol. 327, 761-766.

Elbashir et al. (2001) Duplexes of 21-Nucleotide RNAs Mediate RNA Interference in Cultured Mammalian Cells. Nature vol. 411, pp. 494-498.

Tsuji, et al. (2006) Essential Role of Phosphoolylation of MCM2 by Cdc7/Dbf4 in the Initiation of DNA Replication in Mammalian Cells. Molecular Biology of the Cell, vol. 17, pp. 4459-4472.

Tuschl, et al. (2001) The siRNA User Guide. Max Planck Institute for Biophysical Chemistry, pp. 1, 3 and 5, http:// www.mpibpc.gwdg.de/abteilungen/100/105/siRNAuserguide.pdf.

Tuschl et al. (2003) The siRNA User Guide. 6 pages.

Feng, et al. (2003) Inhibiting the Expression of DNA Replication-Initiation Proteins Induces Apoptosis in Human Cancer Cells. Cancer Research, vol. 63, pp. 7356-7364.

Ui-Tei, Guidelines for the selection of highly effective siRNA sequences for mammalian and chick RNA interference, Nucleic Acids Research, Feb. 2004, vol. 32, No. 3 pp. 936-948.

Vankayalapati, et al. (2003) Targeting Aurora2 Kinase in Oncogenesis: A Structural Bioinformatics Approach to Target Validation and Rational Drug Design. Molecular Cancer Therapeutics, v.2:283:94.

Hammond et al., Post-transcriptional gene silencing by double-stranded RNA, Nature Reviews, 2001, vol. 2, 110-119) MacMilan Magazines Ltd.

Wang, et al., (2006) Dexamethasone Represses Signaling through the Mammalian Target of Rapamycin in Muscle Cells by Enhancing Expression of REDD1. The Journal of Biological Chemistry vol. 281, No. 51, pp. 39128-39134.

Yao et al. (2000) Nature Cell Biology 2:484-491.

Zender et al., siRNA based strategies for inhibition of apoptotic pathways in vivo—analytical and therapeutic implications, Jan. 2004, vol. 9, pp. 51-54.

Zhang, Physical and Functional Interaction between Myeloid Cell Leukemia 1 Protein (MCL1) ad Fortilin, J. Biol. Chem. 37430-37438 (2002).

Ho, Nucleic Acids Research, vol. 24: 1901-1907 (1996).

Genbank Accession Z15005.1 (1993).

Genbank Accession No. NM_138578, http://www.ncbi.nlm.nih.gov/entrez/viewer.fcgi?db=nuccore&id=20336334. Accessed on Aug. 11, 2008.

Genbank Accession No. NM_002645.2, http://www.ncbi.nlm.nih.gov/entrez/viewer.fcgi?db=nuccore&id=157671928. Accessed on Jul. 31, 2008.

Human Neuropeptide Y Blast results, http://www.ncbi.nlm.nih.gov/blast, accessed on Mar. 18, 2008.

Holen, et al. (2002) Positional Effects of Shorts Interfering RNAs Targeting the Human Coagulation Trigger Tissue Factor. Nucleic Acids Research, vol. 30, No. 8, pp. 1757-1766.

Cherry, Michael J. (1995) Computer Manipulation of DNA and Protein Sequences. Current Protocols in Molecular Biology. 7.7.1-7.7.23.

Bass, B.L., (2001) The Short Answer, Nature V.411:428-29.

Laitala et al., Inhibition of Bone Resorption in Vitro by Antisense RNA and DNA Molecules Targeted against Carbonic Anhydrase II or Two Subuntis of Vacuolar H + ATPase, Journal of Clinical Investigation 1994, vol. 93, pp. 2311-2318.

Lapidot-Lifson, et al. (1992) Cloning and Antisense Oligodeoxynucleotide Inhibition of a Human Homolog of cdc2 required in Hematopoiesis, Proc. Natl. Acad. Sci. vol. 89, pp. 579-583.

Miller, V M et al., "Allele-specific silencing of dominant disease genes" Proceedings of the National Acadamy of Sciences of USA, vol. 100, No. 12, Jun. 10, 2003, pp. 7195-7200 , XP002276730.

Fox, et al. (1995) cDNA Cloning and Tissue Distribution of Five Human EPH-like Receptor Protein-tyrosine kinases, Oncogene; 10(5): 897-905.

siDesign Center for "gene name: src," http://www.dharmacon.com/DesignCenter/DesignCenterPage.aspx, accessed on May 13, 2008.

Tuschl, Expanding small RNA interference (May 2002), Nature Biotechnology, vol. 20, pp. 446-448.

El Touny, et al. (2006) Identification of Both Myt-I and Wee-I as Necessary Mediators of the P2I-Independent Inactivation of the Cdc-2/Cyclin BI complex and Growth Inhibition of TRAMP Cancer Cells by Genistein. The Prostate, vol. 66:1542-1555.

Dottori, et al. (1998) EphA4 (Sek1) receptor tyrosine kinase is required for the development of the corticospinal tract, Proc. Natl. Acad. Sci. vol. 95, pp. 13248-13253, Neurobiology.

Brown et al. (1997) Identification and cDNA Cloning of a Novel Mammalian C2 Domain-Containing Phosphoinositide 3-kinase, HsC2-PI3K, Biochemical and Biophysical Research Communications. 233, 537-544.

Cahill et al. (1999) Genomics. 58:181-187.

Chinault, Overlap Hybridization Screening: Isolation and Characterization of Overlapping DNA Framgments Surroungin the leu2 Gene on Yeast Chromosome III (1979), 5(2):111-26.

Daniel et al., Specific association of Type I with Ran GTPase in lipopolysacchardie-mediated differentiation, Oncogene 2001, vol. 20: 2618-2625.

Domin et al.(1997) Cloning of Human Phosphoinositide 3-Kinase with a C2 Domain that Displays Reduced Sensitivity to the Inhibitor Wortmannin, Biochem. J., v.325:139-47.

* cited by examiner

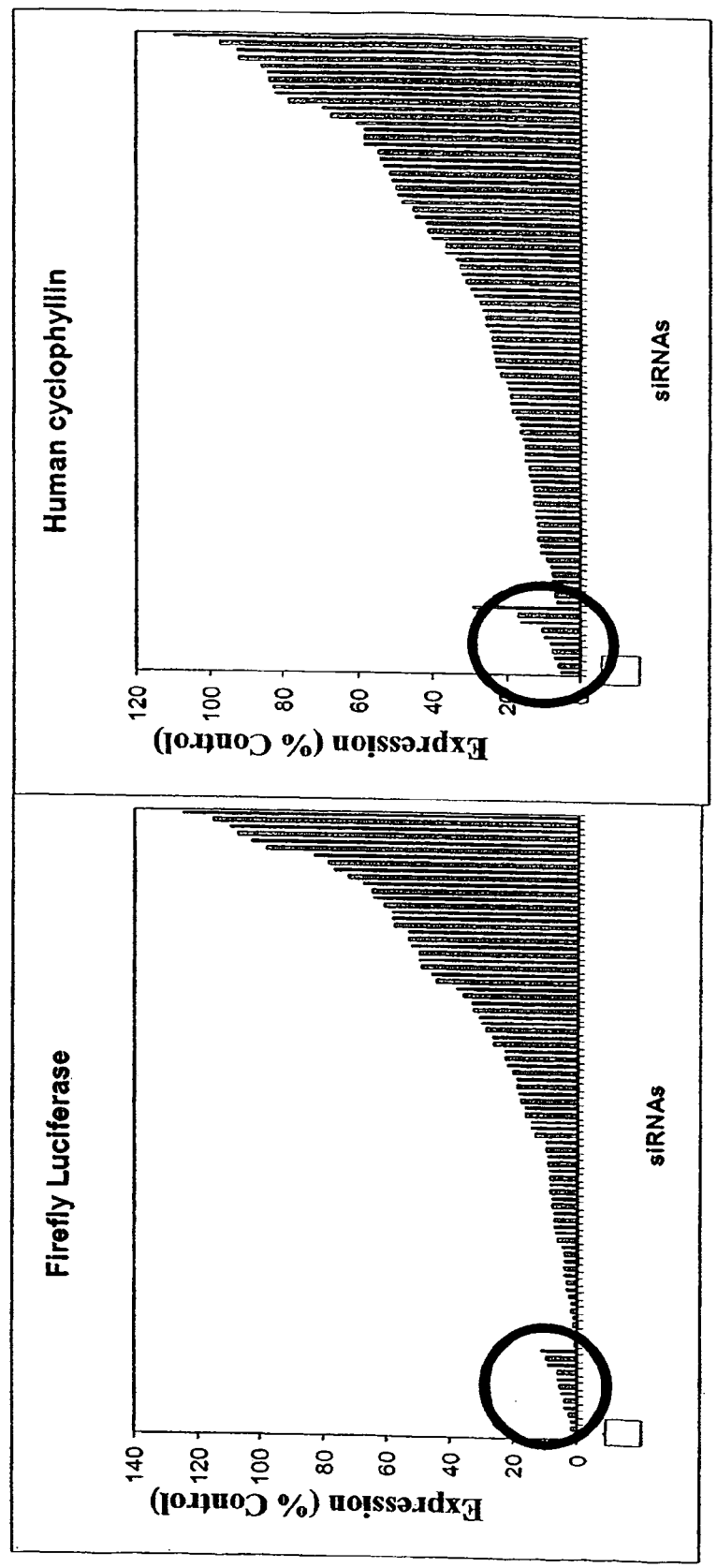

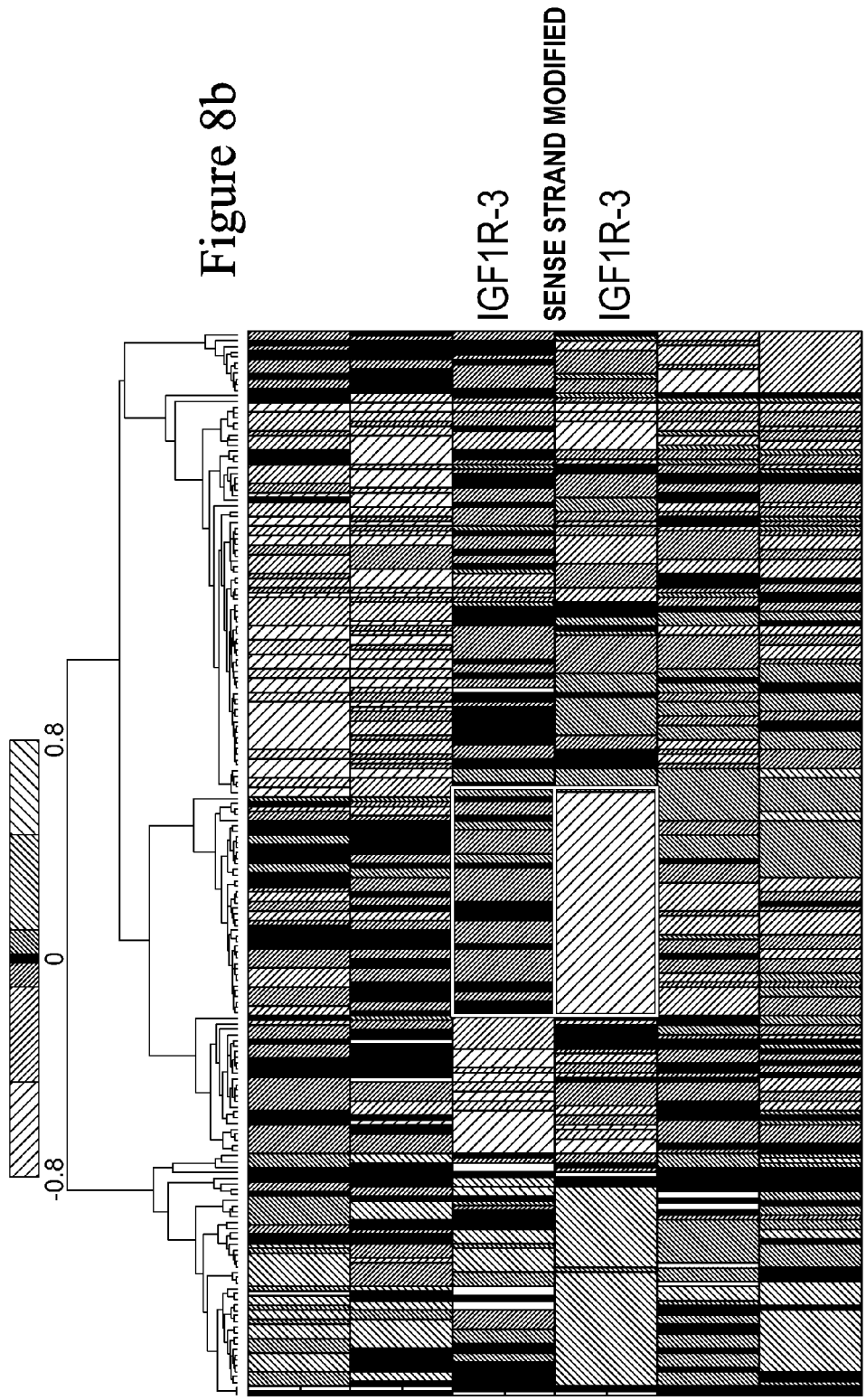

Figure 10a-f

Figure 13 Sequences of top Bcl2

| | |
|---|---|
| siRNA 1 | GGGAGAUAGUGAUGAAGUA |
| siRNA 2 | GAAGUACAUCCAUUAUAAG |
| siRNA 3 | GUACGACAACCGGGAGAUA |
| siRNA 4 | AGAUAGUGAUGAAGUACAU |
| siRNA 5 | UGAAGACUCUGCUCAGUUU |
| siRNA 6 | GCAUGCGGCCUCUGUUUGA |
| siRNA 7 | UGCGGCCUCUGUUUGAUUU |
| siRNA 8 | GAGAUAGUGAUGAAGUACA |
| siRNA 9 | GGAGAUAGUGAUGAAGUAC |
| siRNA 10 | GAAGACUCUGCUCAGUUUG |

FUNCTIONAL AND HYPERFUNCTIONAL SIRNA

CROSS REFERENCE TO RELATED APPLICATIONS

This application is a continuation of international patent application No. PCT/US2003/036787, entitled "Functional and Hyperfunctional siRNA, international filing date Nov. 14, 2003; this application is a continuation of U.S. patent application Ser. No. 10/713,333, entitled "and Hyperfunctional siRNA," filed Nov. 14, 2003, which claims the benefit of the filing date of U.S. Provisional Application Ser. No. 60/426,137, filed Nov. 14, 2002, entitled "Combinatorial Pooling Approach for siRNA Induced Gene Silencing and Methods for Selecting siRNA," and U.S. Provisional Application Ser. No. 60/502,050, filed Sep. 10, 2003, entitled "Methods for Selecting siRNA," the entire disclosures of which are hereby incorporated by reference into the present disclosure.

INCORPORATED BY REFERENCE OF SEQUENCE LISTING SUBMITTED ON COMPACT DISC

Applicant incorporates by reference herein the sequence listing submitted on CD-ROM in parent application Ser. No. 10/714,333, a copy of which is provided herewith on a disc entitled "Sequence Listing Copy 1 of 1 (Paper Copy)," in a filed entitled "13499US.txt" with a size of 226,365 kb, date of creation 25 Jun. 2004.

Reference to Tables Submitted in Electronic Form

Applicants hereby incorporate by reference the material submitted herewith, in duplicate on the compact disks labeled DOCKET 13499; PATENT APPLICATION, DISK 1 of 1, COPY 1 of 2; and DOCKET 13499, PATENT APPLICATION, DISK 1 of 1, COPY 2 of 2; which copies are identical, in files entitled Table__12.txt, date of creation Jun. 26, 2003, with a size of 31,045 kb; Table__13.txt, date of creation Nov. 13, 2003, with a size of 78,451 kb; Table__14.txt, date of creation Nov. 13, 2003, with a size of 454 kb; and Table__15.txt date of creation Nov. 13, 2003, with a size of 1,690 kb.

Field of Invention

The present invention relates to RNA interference ("RNAi").

Background of the Invention

Relatively recently, researchers observed that double stranded RNA ("dsRNA") could be used to inhibit protein expression. This ability to silence a gene has broad potential for treating human diseases, and many researchers and commercial entities are currently investing considerable resources in developing therapies based on this technology.

Double stranded RNA induced gene silencing can occur on at least three different levels: (i) transcription inactivation, which refers to RNA guided DNA or histone methylation; (ii) siRNA induced mRNA degradation; and (iii) mRNA induced transcriptional attenuation.

It is generally considered that the major mechanism of RNA induced silencing (RNA interference, or RNAi) in mammalian cells is mRNA degradation. Initial attempts to use RNAi in mammalian cells focused on the use of long strands of dsRNA. However, these attempts to induce RNAi met with limited success, due in part to the induction of the interferon response, which results in a general, as opposed to a target-specific, inhibition of protein synthesis. Thus, long dsRNA is not a viable option for RNAi in mammalian systems.

More recently it has been shown that when short (18-30 bp) RNA duplexes are introduced into mammalian cells in culture, sequence-specific inhibition of target mRNA can be realized without inducing an interferon response. Certain of these short dsRNAs, referred to as small inhibitory RNAs ("siRNAs"), can act catalytically at sub-molar concentrations to cleave greater than 95% of the target mRNA in the cell A description of the mechanisms for siRNA activity, as well as some of its applications are described in Provost et al., *Ribonuclease Activity and RNA Binding of Recombinant Human Dicer*, E.M.B.O. J., 2002 Nov. 1; 21(21): 5864-5874; Tabara et al., *The dsRNA Binding Protein RDE-4 Interacts with RDE-1, DCR-1 and a DexH-box Helicase to Direct RNAi in C. elegans*, Cell 2002, Jun. 28; 109(7):861-71; Ketting et al., *Dicer Functions in RNA Interference and in Synthesis of Small RNA Involved in Developmental Timing in C. elegans*; Martinez et al., *Single-Stranded Antisense siRNAs Guide Target RNA Cleavage in RNAi*, Cell 2002, Sept. 6; 110(5):563; Hutvagner & Zamore, *A microRNA in a multiple-turnover RNAi enzyme complex*, Science 2002, 297:2056.

From a mechanistic perspective, introduction of long double stranded RNA into plants and invertebrate cells is broken down into siRNA by a Type III endonuclease known as Dicer. Sharp, *RNA interference—2001*, Genes Dev. 2001, 15:485. Dicer, a ribonuclease-III-like enzyme, processes the dsRNA into 19-23 base pair short interfering RNAs with characteristic two base 3' overhangs. Bernstein, Caudy, Hammond, & Hannon, *Role for a bidentate ribonuclease in the initiation step of RNA interference*, Nature 2001, 409:363. The siRNAs are then incorporated into an RNA-induced silencing complex (RISC) where one or more helicases unwind the siRNA duplex, enabling the complementary antisense strand to guide target recognition. Nykanen, Haley, & Zamore, *ATP requirements and small interfering RNA structure in the RNA interference pathway*, Cell 2001, 107:309. Upon binding to the appropriate target mRNA, one or more endonucleases within the RISC cleaves the target to induce silencing. Elbashir, Lendeckel, & Tuschl, *RNA interference is mediated by 21- and 22-nucleotide RNAs*, Genes Dev 2001, 15:188, FIG. 1.

The interference effect can be long lasting and may be detectable after many cell divisions. Moreover, RNAi exhibits sequence specificity. Kisielow, M. et al. (2002) *Isoform-specific knockdown and expression of adaptor protein ShcA using small interfering RNA*, J. of Biochemistry 363: 1-5. Thus, the RNAi machinery can specifically knock down one type of transcript, while not affecting closely related mRNA. These properties make siRNA a potentially valuable tool for inhibiting gene expression and studying gene function and drug target validation. Moreover, siRNAs are potentially useful as therapeutic agents against: (1) diseases that are caused by over-expression or misexpression of genes; and (2) diseases brought about by expression of genes that contain mutations.

Successful siRNA-dependent gene silencing depends on a number of factors. One of the most contentious issues in RNAi is the question of the necessity of siRNA design, i.e., considering the sequence of the siRNA used. Early work in *C. elegans* and plants circumvented the issue of design by introducing long dsRNA (see, for instance, Fire, A. et al. (1998) *Nature* 391:806-811). In this primitive organism, long dsRNA molecules are cleaved into siRNA by Dicer, thus generating a diverse population of duplexes that can potentially cover the entire transcript. While some fraction of these molecules are non-functional (i.e. induce little or no silencing) one or more have the potential to be highly functional, thereby silencing the gene of interest and alleviating the need for siRNA design. Unfortunately, due to the interferon response, this same approach is unavailable for mammalian systems. While this effect can be circumvented by bypassing the Dicer cleavage step and directly introducing siRNA, this tactic carries with it the risk that the chosen siRNA sequence maybe non-functional or semi-functional.

A number of researches have expressed the view that siRNA design is not a crucial element of RNAi. On the other hand, others in the field have begun to explore the possibility that RNAi can be made more efficient by paying attention to the design of the siRNA. Unfortunately, none of the reported methods have provided a satisfactory scheme for reliably selecting siRNA with acceptable levels of functionality. Accordingly, there is a need to develop rational criteria by which to select siRNA with an acceptable level of functionality, and to identify siRNA that have this improved level of functionality, as well as to identify siRNAs that are hyperfunctional.

SUMMARY OF THE INVENTION

The present invention is directed to increasing the efficiency of RNAi, particularly in mammalian systems. Accordingly, the present invention provides kits, siRNAs and methods for increasing siRNA efficacy.

According to one embodiment, the present invention provides a kit for gene silencing, wherein said kit is comprised of a pool of at least two siRNA duplexes, each of which is comprised of a sequence that is complementary to a portion of the sequence of one or more target messenger RNA.

According to a second embodiment, the present invention provides a method for optimizing RNA interference by using one or more siRNAs that are optimized according to a formula (or algorithm) selected from:

Relative functionality of siRNA$=-(GC/3)+(AU_{15\text{-}19})-Tm_{20°C.}*3-(G_{13})*3-(C_{19})+(A_{19})*2+(A_3)+(U_{10})+(A_{14})-(U_5)-(A_{11})$     Formula I Relative functionality of siRNA$=-(GC/3)-(AU_{15\text{-}19})*3-(G_{13})*3-(C_{19})+(A_{19})*2+(A_3)$     Formula II Relative functionality of siRNA$=-(GC/3)+(AU_{15\text{-}19})-(Tm_{20°C.})*3$     Formula III Relative functionality of siRNA$=-GC/2+(AU_{15\text{-}19})/2-(Tm_{20°C.})*2-(G_{13})*3-(C_{19})+(A_{19})*2+(A_3)+(U_{10})+(A_{14})-(U_5)-(A_{11})$     Formula IV Relative functionality of siRNA$=-(G_{13})*3-(C_{19})+(A_{19})*2+(A_3)+(U_{10})+(A_{14})-(U_5)-(A_{11})$     Formula V Relative functionality of siRNA$=-(G_{13})*3-(C_{19})+(A_{19})*2+(A_3)$     Formula VI Relative functionality of siRNA$=-(GC/2)+(AU_{15\text{-}19})/2-(Tm_{20°C.})*1-(G_{13})*3-(C_{19})+(A_{19})*3+(A_3)*3+(U_{10})/2+(A_{14})/2-(U_5)/2-(A_{11})/2$     Formula VII wherein in Formulas I-VII:

$Tm_{20°C.}=1$ if the Tm is greater than 20° C.;

$A_{19}=1$ if A is the base at position 19 on the sense strand, otherwise its value is 0;

$AU_{15\text{-}19}=0\text{-}5$ depending on the number of A or U bases on the sense strand at positions 15-19;

$G_{13}=1$ if G is the base at position 13 on the sense strand, otherwise its value is 0;

$C_{19}=1$ if C is the base at position 19 of the sense strand, otherwise its value is 0;

GC=the number of G and C bases in the entire sense strand;

$A_3=1$ if A is the base at position 3 on the sense strand, otherwise its value is 0;

$A_{11}=1$ if A is the base at position 11 on the sense strand, otherwise its value is 0;

$A_{14}=1$ if A is the base at position 14 on the sense strand, otherwise its value is 0;

$U_{10}=1$ if U is the base at position 10 on the sense strand, otherwise its value is 0;

$U_5=1$ if U is the base at position 5 on the sense strand, otherwise its value is 0; or Relative functionality of siRNA$=(-14)*G_{13}-13*A_1-12*U_7-11*U_2-10*A_{11}-10*U_4-10*C_3-10*C_5-10*C_6-9*A_{10}-9*U_9*C_{18}8-*G_{10}-7*U_1-7*U_{16}-7*C_{17}-7*C_{19}+7*U_{17}+8*A_2+8*A_4+8*A_5+8*C_4+9*G_8+10*A_7+10*U_{18}+11*A_{19}+11*C_9+15*G_1+18*A_3+19*U_{10}-Tm-3*(GC_{total})-6*(GC_{15\text{-}19})-30*X$; and     Formula VIII Relative functionality of siRNA$=(14.1)*A_3+(14.9)*A_6+(17.6)*A_{13}+(24.7)*A_{19}+(14.2)*U_{10}+(10.5)*C_9+(23.9)*G_1+(16.3)*G_2+(-12.3)*A_{11}+(-19.3)*U_1+(-12.1)*U_2+(-11)*U_3+(-15.2)*U_{15}+(-11.3)*U_{16}+(-11.8)*C_3+(-17.4)*C_6+(-10.5)*C_7+(-13.7)*G_{13}+(-25.9)*G_{19}-Tm-3*(GC_{total})-6*(GC_{15\text{-}19})-30*X$     Formula IX wherein $A_1=1$ if A is the base at position 1 of the sense strand, otherwise its value is 0;

$A_2=1$ if A is the base at position 2 of the sense strand, otherwise its value is 0;

$A_3=1$ if A is the base at position 3 of the sense strand, otherwise its value is 0;

$A_4=1$ if A is the base at position 4 of the sense strand, otherwise its value is 0;

$A_5=1$ if A is the base at position 5 of the sense strand, otherwise its value is 0;

$A_6=1$ if A is the base at position 6 of the sense strand, otherwise its value is 0;

$A_7=1$ if A is the base at position 7 of the sense strand, otherwise its value is 0;

$A_{10}=1$ if A is the base at position 10 of the sense strand, otherwise its value is 0;

$A_{11}=1$ if A is the base at position 11 of the sense strand, otherwise its value is 0;

$A_{13}=1$ if A is the base at position 13 of the sense strand, otherwise its value is 0;

$A_{19}=1$ if A is the base at position 19 of the sense strand, otherwise if another base is present or the sense strand is only 18 base pairs in length, its value is 0;

$C_3=1$ if C is the base at position 3 of the sense strand, otherwise its value is 0;

$C_4=1$ if C is the base at position 4 of the sense strand, otherwise its value is 0;

$C_5=1$ if C is the base at position 5 of the sense strand, otherwise its value is 0;

$C_6=1$ if C is the base at position 6 of the sense strand, otherwise its value is 0;

$C_7=1$ if C is the base at position 7 of the sense strand, otherwise its value is 0;

$C_9=1$ if C is the base at position 9 of the sense strand, otherwise its value is 0;

$C_{17}=1$ if C is the base at position 17 of the sense strand, otherwise its value is 0;

$C_{18}=1$ if C is the base at position 18 of the sense strand, otherwise its value is 0;

$C_{19}=1$ if C is the base at position 19 of the sense strand, otherwise if another base is present or the sense strand is only 18 base pairs in length, its value is 0;

$G_1=1$ if G is the base at position 1 on the sense strand, otherwise its value is 0;

$G_2=1$ if G is the base at position 2 of the sense strand, otherwise its value is 0;

$G_8=1$ if C is the base at position 8 on the sense strand, otherwise its value is 0;

$G_{10}=1$ if G is the base at position 10 on the sense strand, otherwise its value is 0;

$G_{13}=1$ if G is the base at position 13 on the sense strand, otherwise its value is 0;

$G_{19}=1$ if G is the base at position 19 of the sense strand, otherwise if another base is present or the sense strand is only 18 base pairs in length, its value is 0;

$U_1=1$ if U is the base at position 1 on the sense strand, otherwise its value is 0;

$U_2=1$ if U is the base at position 2 on the sense strand, otherwise its value is 0;

$U_3=1$ if U is the base at position 3 on the sense strand, otherwise its value is 0;

$U_4=1$ if U is the base at position 4 on the sense strand, otherwise its value is 0;

$U_7=1$ if U is the base at position 7 on the sense strand, otherwise its value is 0;

$U_9=1$ if U is the base at position 9 on the sense strand, otherwise its value is 0;

$U_{10}=1$ if U is the base at position 10 on the sense strand, otherwise its value is 0;

$U_{15}=1$ if U is the base at position 15 on the sense strand, otherwise its value is 0;

$U_{16}=1$ if U is the base at position 16 on the sense strand, otherwise its value is 0;

$U_{17}=1$ if U is the base at position 17 on the sense strand, otherwise its value is 0;

$U_{18}=1$ if U is the base at position 18 on the sense strand, otherwise its value is 0;

$GC_{15-19}$ the number of G and C bases within positions 15-19 of the sense strand or within positions 15-18 if the sense strand is only 18 base pairs in length;

$GC_{total}$=the number of G and C bases in the sense strand;

Tm=100 if the targeting site contains an inverted repeat longer than 4 base pairs, otherwise its value is 0; and X=the number of times that the same nucleotide repeats four or more times in a row.

According to a third embodiment, the present invention is directed to a kit comprised of at least one siRNA that contains a sequence that is optimized according to one of the formulas above. Preferably the kit contains at least two optimized siRNA, each of which comprises a duplex, wherein one strand of each duplex comprises at least eighteen contiguous bases that are complementary to a region of a target messenger RNA. For mammalian systems, the siRNA preferably comprises between 18 and 30 nucleotide base pairs.

The ability to use the above algorithms, which are not sequence or species specific, allows for the cost-effective selection of optimized siRNAs for specific target sequences. Accordingly, there will be both greater efficiency and reliability in the use of siRNA technologies.

According to a fourth embodiment, the present invention provides a method for developing an siRNA algorithm for selecting functional and hyperfunctional siRNAs for a given sequence. The method comprises:

(a) selecting a set of siRNAs;
(b) measuring the gene silencing ability of each siRNA from said set;
(c) determining the relative functionality of each siRNA;
(d) determining the amount of improved functionality by the presence or absence of at least one variable selected from the group consisting of the total GC content, melting temperature of the siRNA, GC content at positions 15-19, the presence or absence of a particular nucleotide at a particular position and the number of times that the same nucleotide repeats within a given sequence; and
(e) developing an algorithm using the information of step (d).

According to this embodiment, preferably the set of siRNAs comprises at least 90 siRNAs from at least one gene, more preferably at least 180 siRNAs from at least two different genes, and most preferably at least 270 and 360 siRNAs from at least three and four different genes, respectively. Additionally, in step (d) the determination is made with preferably at least two, more preferably at least three, even more preferably at least four, and most preferably all of the variables. The resulting algorithm is not target sequence specific.

In a fifth embodiment, the present invention provides rationally designed siRNAs identified using the formulas above.

In a sixth embodiment, the present invention is directed to hyperfunctional siRNA.

For a better understanding of the present invention together with other and further advantages and embodiments, reference is made to the following description taken in conjunction with the examples, the scope of which is set forth in the appended claims.

BRIEF DESCRIPTION OF THE FIGURES

FIGS. 5A and 5B are representations of firefly luciferase and cyclophilin siRNA panels sorted according to functionality and predicted values using Formula VIII. The siRNA found within the circle represent those that have Formula VIII values (SMARTscores™) above zero. SiRNA outside the indicated area have calculated Formula VIII values that are below zero. Y-axis is "Expression (% Control)." Each position on the X-axis represents a unique siRNA.

FIG. 8b is an expression profile showing a comparison of sense strand off-target effects for IGF1R-3 and 2'-O-methyl IGF1R-3. Sense strand off-targets (lower white box) are not induced when the 5' end of the sense strand is modified with 2'-O-methyl groups (top white box)

FIG. 13 is the sequence of the top ten Bcl2 siRNAs as determined by Formula VIII. Sequences are listed 5' to 3'.

FIG. 16 is a histogram demonstrating the inhibition of target gene expression by pools of 2 and 3 siRNAs duplexes taken from the walk described in FIG. 15. The Y-axis represents the percent expression relative to control. The X-axis represents the position of the first siRNA in paired pools, or trios of siRNA. For instance, the first paired pool contains siRNA 1 and 3. The second paired pool contains siRNA 3 and 5. Pool 3 (of paired pools) contains siRNA 5 and 7, and so on.

DETAILED DESCRIPTION

Definitions

Figure 1:
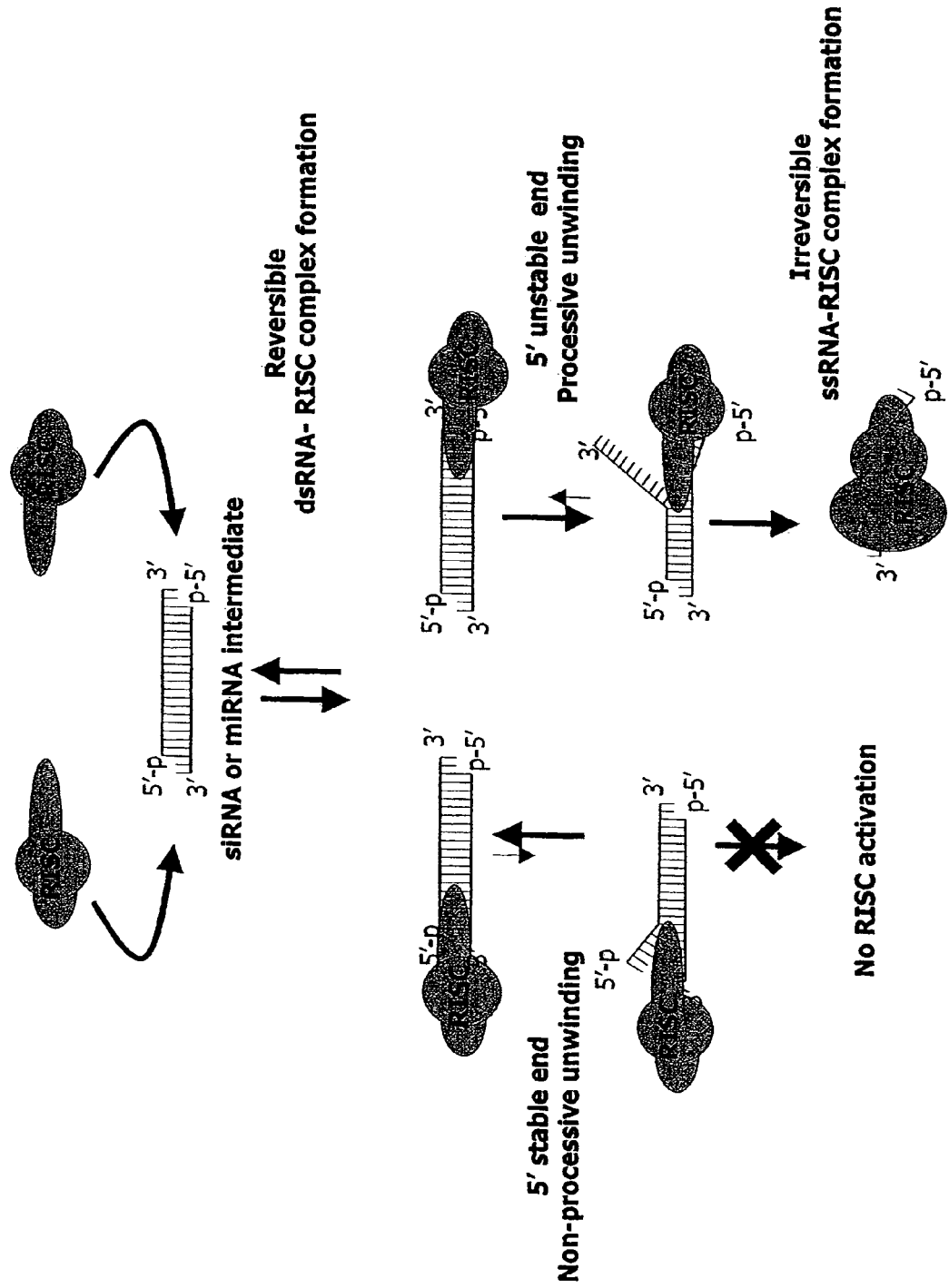
FIG. 1 shows a model for siRNA-RISC interactions. RISC has the ability to interact with either end of the siRNA or miRNA molecule. Following binding, the duplex is unwound, and the relevant target is identified, cleaved, and released

Unless stated otherwise, the following terms and phrases have the meanings provided below:

siRNA

The term "siRNA" refers to small inhibitory RNA duplexes that induce the RNA interference (RNAi) pathway. These molecules can vary in length (generally between 18-30 basepairS) and contain varying degrees of complementarity to their target mRNA in the antisense strand. Some, but not all, siRNA have unpaired overhanging bases on the 5' or 3' end of the sense strand and/or the antisense strand. The term "siRNA" includes duplexes of two separate strands, as well as single strands that can form hairpin structures comprising a duplex region.

SiRNA may be divided into five (5) groups (non-functional, semi-functional, functional, highly functional, and hyper-functional) based on the level or degree of silencing that they induce in cultured cell lines. As used herein, these definitions are based on a set of conditions where the siRNA is transfected into said cell line at a concentration of 100 nM and the level of silencing is tested at a time of roughly 24 hours after transfection, and not exceeding 72 hours after transfection. In this context, "non-functional siRNA" are defined as those siRNA that induce less than 50% (<50%) target silencing "Semi-functional siRNA" induce 50-79% target silencing. "Functional siRNA" are molecules that induce 80-95% gene silencing. "Highly-functional siRNA" are molecules that induce greater than 95% gene silencing. "Hyperfunctional siRNA" are a special class of molecules. For purposes of this document, hyperfunctional siRNA are defined as those molecules that: (1) induce greater than 95% silencing of a specific target when they are transfected at subnanomolar concentrations (i.e., less than one nanomolar); and/or (2) induce functional (or better) levels of silencing for greater than 96 hours. These relative functionalities (though not intended to be absolutes) may be used to compare siRNAs to a particular target for applications such as functional genomics, target identification and therapeutics.

miRNA

The term "miRNA" refers to microRNA.

Gene Silencing

The phrase "gene silencing" refers to a process by which the expression of a specific gene product is lessened or attenuated. Gene silencing can take place by a variety of pathways. Unless specified otherwise, as used herin, gene silencing refers to decreases in gene product expression that results from RNA interference (RNAi), a defined, though partially characterized pathway whereby small inhibitory RNA (siRNA) act in concert with host proteins (e.g. the RNA induced silencing complex, RISC) to degrade messenger RNA (mRNA) in a sequence-dependent fashion. The level of gene silencing can be measured by a variety of means, including, but not limited to, measurement of transcript levels by Northern Blot Analysis, B-DNA techniques, transcription-sensitive reporter constructs, expression profiling (e.g. DNA chips), and related technologies. Alternatively, the level of silencing can be measured by assessing the level of the protein encoded by a specific gene. This can be accomplished by performing a number of studies including Western Analysis, measuring the levels of expression of a reporter protein that has e.g. fluorescent properties (e.g. GFP) or enzymatic activity (e.g. alkaline phosphatases), or several other procedures.

Transfection

The term "transfection" refers to a process by which agents are introduced into a cell. The list of agents that can be transfected is large and includes, but is not limited to, siRNA, sense and/or anti-sense sequences, DNA encoding one or more genes and organized into an expression plasmid, proteins, protein fragments, and more. There are multiple methods for transfecting agents into a cell including, but not limited to, electroporation, calcium phosphate-based transfections, DEAE-dextran-based transfections, lipid-based transfections, molecular conjugate-based transfections (e.g. polylysine-DNA conjugates), microinjection and others.

Target

The term "target" is used in a variety of different forms throughout this document and is defined by the context in which it is used. "Target mRNA" refers to a messenger RNA to which a given siRNA can be directed against. "Target sequence" and "target site" refer to a sequence within the mRNA to which the sense strand of an siRNA shows varying degrees of homology and the antisense strand exhibits varying degrees of complementarity. The term "siRNA target" can refer to the gene, mRNA, or protein against which an siRNA is directed. Similarly "target silencing" can refer to the state of a gene, or the corresponding mRNA or protein.

Off-target Silencing and Off-target Interference

The phrases "off-target-silencing" and "off-target interference" are defined as degradation of mRNA other than the intended target mRNA due to overlapping and/or partial homology with secondary mRNA messages.

SMARTscore™

The term "SMARTscore™" refers to a number determined by applying any of the Formulas I-Formula IX to a given siRNA sequence. The term "SMART-selected" or "rationally selected" or "rational selection" refers to siRNA that have been selected on the basis of their SMARTscores™.

Complementary

The term "complementary" refers to the ability of polynucleotides to form base pairs with one another. Base pairs are typically formed by hydrogen bonds between nucleotide units in antiparallel polynucleotide strands. Complementary polynucleotide strands can base pair in the Watson-Crick manner (e.g., A to T, A to U, C to G), or in any other manner that allows for the formation of duplexes. As persons skilled in the art are aware, when using RNA as opposed to DNA, uracil rather than thymine is the base that is considered to be complementary to adenosine. However; when a U is denoted in the context of the present invention, the ability to substitute a T is implied, unless otherwise stated.

Perfect complementarity or 100% complementarity refers to the situation in which each nucleotide unit of one polynucleotide strand can hydrogen bond with a nucleotide unit of a second polynucleotide strand. Less than perfect complementarity refers to the situation in which some, but not all, nucleotide units of two strands can hydrogen bond with each other. For example, for two 20-mers, if only two base pairs on each strand can hydrogen bond with each other, the polynucleotide strands exhibit 10% complementarity. In the same example, if 18 base pairs on each strand can hydrogen bond with each other, the polynucteotide strands exhibit 90% complementarity. "Substantial complementarity" refers to polynucleotide strands exhibiting 79% or greater complementarity, excluding regions of the polynucleotide strands, such as overhangs, that are selected so as to be noncomplementary. ("Substantial similarity" refers to polynucleotide strands exhibiting 79% or greater similarity, excluding regions of the polynucleotide strands, such as overhangs, that are selected so as not to be similar.) Thus, for example, two polynucleotides of 29 nucleotide units each, wherein each comprises a di-dT at the 3' terminus such that the duplex region spans 27 bases, and wherein 26 of the 27 bases of the duplex region on each strand are complementary, are substantially complementary since they are 96.3% complementary when excluding the di-dT overhangs.

Deoxynucleotide

The term "deoxynucleotide" refers to a nucleotide or polynucleotide lacking a hydroxyl group (OH group) at the 2' and/or 3' position of a sugar moiety. Instead, it has a hydrogen bonded to the 2' and/or 3' carbon. Within an RNA molecule that comprises one or more deoxynucleotides, "deoxynucleotide" refers to the lack of an OH group at the 2' position of the sugar moiety having instead a hydrogen bonded directly to the 2' carbon.

Deoxyribonucleotide

The terms "deoxyribonucleotide" and "DNA" refer to a nucleotide or polynucleotide comprising at least one sugar moiety that has an H, rather than an OH, at its 2' and/or 3' position.

Substantially Similar

The phrase "substantially similar" refers to a similarity of at least 90% with respect to the identity of the bases of the sequence.

Duplex Region

The phrase "duplex region" refers to the region in two complementary or substantially complementary polynucleotides that form base pairs with one another, either by Watson-Crick base pairing or any other manner that allows for a stabilized duplex between polynucleotide strands that are complementary or substantially complementary. For example, a polynucleotide strand having 21 nucleotide units can base pair with another polynucleotide of 21 nucleotide units, yet only 19 bases on each strand are complementary or substantially complementary, such that the "duplex region" has 19 base pairs. The remaining bases may, for example, exist as 5' and 3' overhangs. Further, within the duplex region, 100% complementarity is not required; substantial complementarity is allowable within a duplex region. Substantial complementarity refers to 79% or greater complementarity. For example, a mismatch in a duplex region consisting of 19 base pairs results in 94.7% complementarity, rendering the duplex region substantially complementary.

Nucleotide

The term "nucleotide" refers to a ribonucleotide or a deoxyribonucleotide or modified form thereof, as well as an analog thereof. Nucleotides include species that comprise purines, e.g., adenine, hypoxanthine, guanine, and their derivatives and analogs, as well as pyrimidines, e.g., cytosine, uracil, thymine, and their derivatives and analogs.

Nucleotide analogs include nucleotides having modifications in the chemical structure of the base, sugar and/or phosphate, including, but not limited to, 5-position pyrimidine modifications, 8-position purine modifications, modifications at cytosine exocyclic amines, and substitution of 5-bromo-uracil; and 2'-position sugar modifications, including but not limited to, sugar-modified ribonucleotides in which the 2'-OH is replaced by a group such as an H, OR, R, halo, SH, SR, $NH_2$, NHR, $NR_2$, or CN, wherein R is an alkyl moiety. Nucleotide analogs are also meant to include nucleotides with bases such as inosine, queuosine, xanthine, sugars such as 2'-methyl ribose, non-natural phosphodiester linkages such as methylphosphonates, phosphorothioates and peptides.

Modified bases refer to nucleotide bases such as, for example, adenine, guanine, cytosine, thymine, uracil, xanthine, inosine, and queuosine that have been modified by the replacement or addition of one or more atoms or groups. Some examples of types of modifications that can comprise nucleotides that are modified with respect to the base moieties include but are not limited to, alkylated, halogenated, thiolated, aminated, amidated, or acetylated bases, individually or in combination. More specific examples include, for example, 5-propynyluridine, 5-propynylcytidine, 6-methyladenine, 6-methylguanine, N,N,-dimethyladenine, 2-propyladenine, 2-propylguanine, 2-aminoadenine, 1-methylinosine, 3-methyluridine, 5-methylcytidine, 5-methyluridine and other nucleotides having a modification at the 5 position, 5-(2-amino)propyl uridine, 5-halocytidine, 5-halouridine, 4-acetylcytidine, 1-methyladenosine, 2-methyladenosine, 3-methylcytidine, 6-methyluridine, 2-methylguanosine, 7-methylguanosine, 2,2-dimethylguanosine, 5-methylaminoethyluridine, 5-methyloxyuridine, deazanucleotides such as 7-deaza-adenosine, 6-azouridine, 6-azocytidine, 6-azothymidine, 5-methyl-2-thiouridine, other thio bases such as 2-thiouridine and 4-thiouridine and 2-thiocytidine, dihydrouridine, pseudouridine, queuosine, archaeosine, naphthyl and substituted naphthyl groups, any O- and N-alkylated purines and pyrimidines such as N6-methyladenosine, 5-methylcarbonylmethyluridine, uridine 5-oxyacetic acid, pyridine4-one, pyridine-2-one, phenyl and-modified phenyl groups such as aminophenol or 2,4,6-trimethoxy benzene, modified cytosines that act as G-clamp nucleotides, 8-substituted adenines and guanines, 5-substituted uracils and thymines, azapyrimidines, carboxyhydroxyalkyl nucleotides, carboxyalkylaminoalkyl nucleotides, and alkylcarbonylalkylated nucleotides. Modified nucleotides also include those nucleotides that are modified with respect to the sugar moiety, as well as nucleotides having sugars or analogs thereof that are not ribosyl. For example, the sugar moieties may be, or be based on, mannoses, arabinoses, glucopyranoses, galactopyranoses, 4'-thioribose, and other sugars, heterocycles, or carbocycles.

The term nucleotide is also meant to include what are known in the art as universal bases. By way of example, universal bases include but are not limited to 3-nitropyrrole, 5-nitroindole, or nebularine. The term "nucleotide" is also meant to include the N3' to P5' phosphoramidate, resulting from the substitution of a ribosyl 3' oxygen with an amine group.

Further, the term nucleotide also includes those species that have a detectable label, such as for example a radioactive or fluorescent moiety, or mass label attached to the nucleotide.

Polynucleotide

The term "polynucleotide" refers to polymers of nucleotides, and includes but is not limited to DNA, RNA, DNA/RNA hybrids including polynucleotide chains of regularly and/or irregularly alternating deoxyribosyl moieties and ribosyl moieties (i.e., wherein alternate nucleotide units have an —OH, then and —H, then an —OH, then an —H, and so on at the 2' position of a sugar moiety), and modifications of these kinds of polynucleotides, wherein the attachment of various entities or moieties to the nucleotide units at any position are included.

Polyribonucleotide

The term "polyribonucleotide" refers to a polynucleotide comprising two or more modified or unmodified ribonucleotides and/or their analogs. The term "polyribonucleotide" is used interchangeably with the term "oligoribonucleotide."

Ribonucleotide and Ribonucleic Acid

The term "ribonucleotide" and the phrase "ribonucleic acid" (RNA), refer to a modified or unmodified nucleotide or polynucleotide comprising at least one ribonucleotide unit. A ribonucleotide unit comprises an hydroxyl group attached to the 2' position of a ribosyl moiety that has a nitrogenous base attached in N-glycosidic linkage at the 1' position of a ribosyl moiety, and a moiety that either allows for linkage to another nucleotide or precludes linkage.

DETAILED DESCRIPTION OF THE INVENTION

The present invention is directed to improving the efficiency of gene silencing by siRNA. Through the inclusion of multiple siRNA sequences that are targeted to a particular gene and/or selecting an siRNA sequence based on certain defined criteria, improved efficiency may be achieved.

The present invention will now be described in connection with preferred embodiments These embodiments are presented in order to aid in an understanding of the present invention and are not intended, and should not be construed, to limit the invention in any way. All alternatives, modifications and equivalents that may become apparent to those of ordinary skill upon reading this disclosure are included within the spirit and scope of the present invention.

Furthermore, this disclosure is not a primer on RNA interference. Basic concepts known to persons skilled in the art have not been set forth in detail.

Optimizing siRNA

According to one embodiment, the present invention provides a method for improving the effectiveness of gene silencing for use to silence a particular gene through the selection of an optimal siRNA. An siRNA selected according to this method may be used individually, or in conjunction with the first embodiment, i.e., with one or more other siRNAs, each of which may or may not be selected by this criteria in order to maximize their efficiency.

The degree to which it is possible to select an siRNA for a given mRNA that maximizes these criteria will depend on the sequence of the mRNA itself. However, the selection criteria will be independent of the target sequence. According to this method, an siRNA is selected for a given gene by using a rational design. That said, rational design can be described in a variety of ways. Rational design is, in simplest terms, the application of a proven set of criteria that enhance the probability of identifying a functional or hyperfunctional siRNA. In one method, rationally designed siRNA can be identified by maximizing one or more of the following criteria:

1. A low GC content, preferably between about 30-52%.
2. At least 2, preferably at least 3 A or U bases at positions 15-19 of the siRNA on the sense strand.
3. An A base at position 19 of the sense strand.
4. An A base at position 3 of the sense strand.
5. A U base at position 10 of the sense strand.
6. An A base at position 14 of the sense strand.
7. A base other than C at position 19 of the sense strand.
8. A base other than G at position 13 of the sense strand.
9. A Tm, which refers to the character of the internal repeat that results in inter- or intramolecular structures for one strand of the duplex, that is preferably not stable at greater than 50° C., more preferably not stable at greater than 37° C., even more preferably not stable at greater than 30° C. and most preferably not stable at greater than 20° C.
10. A base other than U at position 5 of the sense strand.
11. A base other than A at position 11 of the sense strand.

Criteria 5, 6, 10 and 11 are minor criteria, but are nonetheless desirable. Accordingly, preferably an siRNA will satisfy as many of the aforementioned criteria as possible, more preferably at least 1-4 and 7-9, and most preferably all of the criteria With respect to the criteria, GC content, as well as a high number of AU in positions 15-19, may be important for easement of the unwinding of double stranded siRNA duplex. Duplex unwinding has been shown to be crucial for siRNA functionality in vivo.

With respect to criterion 9, the internal structure is measured in terms of the melting temperature of the single strand of siRNA, which is the temperature at which 50% of the molecules will become denatured. With respect to criteria 2-8 and 10-11, the positions refer to sequence positions on the sense strand, which is the strand that is identical to the mRNA.

In one preferred embodiment, at least criteria 1 and 8 are satisfied. In another preferred embodiment, at least criteria 7 and 8 are satisfied. In still another preferred embodiment, at least criteria 1, 8 and 9 are satisfied.

It should be noted that all of the aforementioned criteria regarding sequence position specifics are with respect to the 5' end of the sense strand. Reference is made to the sense strand, because most databases contain information that describes the information of the mRNA. Because according to the present invention a chain can be from 18 to 30 bases in length, and the aforementioned criteria assumes a chain 19 base pairs in length, it is important to keep the aforementioned criteria applicable to the correct bases.

When there are only 18 bases, the base pair that is not present is the base pair that is located at the 3' of the sense strand. When there are twenty to thirty bases present, then additional bases are added at the 5' end of the sense chain and occupy positions −1 to −11. Accordingly, with respect to SEQ. ID NO. 0001. NNANANNNNUCNAANNNNA and SEQ. ID NO. 0028. GUCNNANANNNNUCNAANNNNA, both would have A at position 3, A at position 5, U at position 10, C at position 11, A and position 13, A and position 14 and A at position 19. However, SEQ. ID NO. 0028 would also have C at position −1, U at position −2 and G at position −3.

For a 19 base pair siRNA, an optimal sequence of one of the strands may be represented below, where N is any base, A, C, G, or U:

```
SEQ. ID NO. 0001    NNANANNNNUCNAANNNNA.
SEQ. ID NO. 0002    NNANANNNNUGNAANNNNA.
SEQ. ID NO. 0003    NNANANNNNUUNAANNNNA.
SEQ. ID NO. 0004    NNANANNNNUNCNANNNNA.
SEQ. ID NO. 0005    NNANANNNNUGNCANNNNA.
SEQ. ID NO. 0006    NNANANNNNUUNCANNNNA.
SEQ. ID NO. 0007    NNANANNNNUCNUANNNNA.
```

-continued

| SEQ. ID NO. 0008 | NNANANNNNUGNUANNNNA. |
| SEQ. ID NO. 0009 | NNANANNNNUUNUANNNNA. |
| SEQ. ID NO. 0010 | NNANCNNNNUCNAANNNNA. |
| SEQ. ID NO. 0011 | NNANCNNNNUGNAANNNNA. |
| SEQ. ID NO. 0012 | NNANCNNNNUUNAANNNNA. |
| SEQ. ID NO. 0013 | NNANCNNNNUCNANNNNA. |
| SEQ. ID NO. 0014 | NNANCNNNNUGNCANNNNA. |
| SEQ. ID NO. 0015 | NNANCNNNNUUNCANNNNA. |
| SEQ. ID NO. 0016 | NANCNNNNUCNUANNNNA. |
| SEQ. ID NO. 0017 | NNANCNNNNUGNUANNNNA. |
| SEQ. ID NO. 0018 | NNANCNNNNUUNUANNNNA. |
| SEQ. ID NO. 0019 | NNANGNNNNUCNAANNNNA. |
| SEQ. ID NO. 0020 | NNANGNNNNUGNAANNNNA. |
| SEQ. ID NO. 0021 | NNANGNNNNUUNAANNNNA. |
| SEQ. ID NO. 0022 | NNANGNNNNUCNCANNNNA. |
| SEQ. ID NO. 0023 | NNANGNNNNUGNCANNNNA. |
| SEQ. ID NO. 0024 | NNANGNNNNUUNCANNNNA. |
| SEQ. ID NO. 0025 | NNANGNNNNUCNUANNNNA. |
| SEQ. ID NO. 0026 | NNANGNNNNUGNUANNNNA. |
| SEQ. ID NO. 0027 | NNANGNNNNUNUANNNNA. |

In one embodiment, the sequence used as an siRNA is selected by choosing the siRNA that score highest according to one of the following seven algorithms that are represented by Formulas I-VII:

Relative functionality of siRNA=$-(GC/3)+(AU_{15\text{-}19})-(Tm_{20^\circ C.})*3-(G_{13})*3-(C_{19})+(A_{19})*2+(A_3)+(U_{10})+(A_{14})-(U_5)-(A_{11})$  Formula I Relative functionality of siRNA=$-(GC/3)-(AU_{15\text{-}19})*3-(G_{13})*3-(C_{19})+(A_19)*2+(A_3)$  Formula II Relative functionality of siRNA=$-(GC/3)+(AU_{15\text{-}19})-(Tm_{20^\circ C.})*3$  Formula III Relative functionality of siRNA=$-GC/2+(AU_{15\text{-}19})/2-(Tm_{20^\circ C.})*2-(G_{13})*3-(C_{19})+(A_{19})*2+(A_3)+(U_{10})+(A_{14})-(U_5)-(A_{11})$  Formula IV Relative functionality of siRNA=$-(G_{13})*3-(C_{19})+(A_{19})*2+(A_3)+(U_{10})+(A_{14})-(U_5)-(A_{11})$  Formula V Relative functionality of siRNA=$-(G_{13})*3-(C_{19})+(A_{19})*2+(A_3)$  Formula VI Relative functionality of siRNA=$-(GC/2)+(AU_{15\text{-}19})/2-(Tm_{20^\circ C.})*1-(G_{13})*3-(C_{19})+(A_{19})*3+(A_3)*3+(U_{10})/2+(A_{14})/2-(U_5)/2-(A_{11})/2$  Formula VII In Formulas I-VII:

wherein $A_{19}=1$ if A is the base at position 19 on the sense strand, otherwise its value is 0, $AU_{15\text{-}19}=0\text{-}5$ depending on the number of A or U bases on the sense strand at positions 15-19;

$G_{13}=1$ if G is the base at position 13 on the sense strand, otherwise its value is 0;

$C_{19}=1$ if C is the base at position 19 of the sense strand, otherwise its value is 0;

GC=the number of G and C bases in the entire sense strand;

$Tm_{20^\circ C.}=1$ if the Tm is greater than 20° C.;

$A_3=1$ if A is the base at position 3 on the sense strand, otherwise its value is 0;

$U_{10}=1$ if U is the base at position 10 on the sense strand, otherwise its value is 0;

$A_{14}=1$ if A is the base at position 14 on the sense strand, otherwise its value is 0;

$U_5=1$ if U is the base at position 5 on the sense strand, otherwise its value is 0; and $A_{11}=1$ if A is the base at position 11 of the sense strand, otherwise its value is 0.

Formulas I-VII provide relative information regarding functionality. When the values for two sequences are compared for a given formula, the relative functionality is ascertained; a higher positive number indicates a greater functionality. For example, in many applications a value of 5 or greater is beneficial.

Additionally, in many applications, more than one of these formulas would provide useful information as to the relative functionality of potential siRNA sequences. However, it is beneficial to have more than one type of formula, because not every formula will be able to help to differentiate among potential siRNA sequences. For example, in particularly high GC mRNAs, formulas that take that parameter into account would not be useful and application of formulas that lack GC elements (e.g., formulas V and VI) might provide greater insights into duplex functionality. Similarly, formula II might by used in situations where hairpin structures are not observed in duplexes, and formula IV might be applicable for sequences that have higher AU content. Thus, one may consider a particular sequence in light of more than one or even all of these algorithms to obtain the best differentiation among sequences. In some instances, application of a given algorithim may identify an unusually large number of potential siRNA sequences, and in those cases, it may be appropriate to re-analyze that sequence with a second algorithm that is, for instance, more stringent. Alternatively, it is conceivable that analysis of a sequence with a given formula yields no acceptable siRNA sequences (i.e. low SMARTscores™). In this instance, it may be appropriate to re-analyze that sequences with a second algorithm that is, for instance, less stringent. In still other instances, analysis of a single sequence with two separate formulas may give rise to conflicting results (i.e. one formula generates a set of siRNA with high SMARTscores™ while the other formula identifies a set of siRNA with low SMARTscores™). In these instances, it may be necessary to determine which weighted factor(s) (e.g. GC content) are contributing to the discrepancy and assessing the sequence to decide whether these factors should or should not be included. Alternatively, the sequence could be analyzed by a third, fourth, or fifth algorithm to identify a set of rationally designed siRNA.

The above-referenced criteria are particularly advantageous when used in combination with pooling techniques as depicted in Table I:

TABLE I

| | Functional Probability | | | | | |
|---|---|---|---|---|---|---|
| | Oligos | | | Pools | | |
| Criteria | >95% | >80% | <70% | >95% | >80% | <70% |
| Current | 33.0 | 50.0 | 23.0 | 79.5 | 97.3 | 0.3 |
| New | 50.0 | 88.5 | 8.0 | 93.8 | 99.98 | 0.005 |
| (GC) | 28.0 | 58.9 | 36.0 | 72.8 | 97.1 | 1.6 |

The term "current" refers to Tuschl's conventional siRNA parameters (Elbashir, S. M. et al. (2002) "Analysis of gene function in somatic mammalian cells using small interfering RNAs" Methods 26: 199-213). "New" refers to the design parameters described in Formulas I-VII "GC" refers to criteria that select siRNA solely on the basis of GC content.

As Table I indicates, when more functional siRNA duplexes are chosen, siRNAs that produce <70% silencing drops from 23% to 8% and the number of siRNA duplexes that produce >80% silencing rises from 50% to 88.5%. Further, of the siRNA duplexes with >80% silencing, a larger portion of these siRNAs actually silence >95% of the target expression (the new criteria increases the portion from 33% to 50%.) Using this new criteria in pooled siRNAs, shows that, with pooling, the amount of silencing >95% increases from 79.5% to 93.8% and essentially eliminates any siRNA pool from silencing less than 70%.

Table II similarly shows the particularly beneficial results of pooling in combination with the aforementioned criteria. However, Table II, which takes into account each of the aforementioned variables, demonstrates even a greater degree of improvement in functionality.

TABLE II

| | Functional Probability | | | | | |
|---|---|---|---|---|---|---|
| | Oligos | | | Pools | | |
| | Functional | Average | Non-functional | Functional | Average | Non-functional |
| Random | 20 | 40 | 50 | 67 | 97 | 3 |
| Criteria 1 | 52 | 99 | 0.1 | 97 | 93 | 0.0040 |
| Criteria 4 | 89 | 99 | 0.1 | 99 | 99 | 0.0000 |

The terms "functional," "Average," and "Non-functional" refer to siRNA that exhibit >80%, >50%, and <50% functionality, respectively. Criteria 1 and 4 refer to specific criteria described above.

The above-described algorithms may be used with or without a computer program that allows for the inputting of the sequence of the mRNA and automatically outputs the optimal siRNA. The computer program may, for example, be accessible from a local terminal or personal computer, over an internal network or over the Internet.

In addition to the formulas above, more detailed algorithms may be used for selecting siRNA. Preferably, at least one RNA duplex of between 18 and 30 base pairs is selected such that it is optimized according a formula selected from:

$$(-14)*G_{13}-13*A_1-12*U_7-11*U_2-10*A_{11}-10*U_4-10*C_3-10*C_5-10*C_6-9*A_{10}-9*U_9-9*C_{18}-8*G_{10}-7*U_1-7*U_{16}-7*C_{17}-7*C_{19}+7*U_{17}+8*A_2+8*A_4+8*A_5+8*C_4+9*G_8+10*A_7+10*U_{18}+11*A_{19}+11*C_9+15*G_1+18*A_3+19*U_{10}-Tm-3*(GC_{total})-6*(GC_{15-19})-30*X;$$

and Formula VIII:

$$(14.1)*A_3+(14.9)*A_6+(17.6)*A_{13}+(24.7)*A_{19}+(14.2)*U_{10}+(10.5)*C_9+(23.9)*G_1+(16.3)*G_2+(-12.3)*A_{11}+(-19.3)*U_1+(-12.1)*U_2+(-11)*U_3+(-15.2)*U_{15}+(-11.3)*U_{16}+(-11.8)*C_3+(-17.4)*C_6+(-10.5)*C_7+(-13.7)*G_{13}+(-25.9)*G_{19}-Tm-3*(GC_{total})-6*(GC_{15-19})-30*X$$

Formula IX wherein $A_1$=1 if A is the base at position 1 of the sense strand, otherwise its value is 0;

$A_2$=1 if A is the base at position 2 of the sense strand, otherwise its value is 0;

$A_3$=1 if A is the base at position 3 of the sense strand, otherwise its value is 0;

$A_4$=1 if A is the base at position 4 of the sense strand, otherwise its value is 0;

$A_5$=1 if A is the base at position 5 of the sense strand, otherwise its value is 0;

$A_6$=1 if A is the base at position 6 of the sense strand, otherwise its value is 0;

$A_7$=1 if A is the base at position 7 of the sense strand, otherwise its value is 0;

$A_{10}$=1 if A is the base at position 10 of the sense strand, otherwise its value is 0;

$A_{11}$=1 if A is the base at position 11 of the sense strand, otherwise its value is 0;

$A_{13}$=1 if A is the base at position 13 of the sense strand, otherwise its value is 0;

$A_{19=1}$ if A is the base at position 19 of the sense strand, otherwise if another base is present or the sense strand is only 18 base pairs in length, its value is 0;

$C_3$=1 if C is the base at position 3 of the sense strand, otherwise its value is 0;

$C_4$=1 if C is the base at position 4 of the sense strand, otherwise its value is 0;

$C_5$=1 if C is the base at position 5 of the sense strand, otherwise its value is 0;

$C_6$=1 if C is the base at position 6 of the sense strand, otherwise its value is 0;

$C_7$=1 if C is the base at position 7 of the sense strand, otherwise its value is 0;

$C_9$=1 if C is the base at position 9 of the sense strand, otherwise its value is 0;

$C_{17}$=1 if C is the base at position 17 of the sense strand, otherwise its value is 0;

$C_{18}$=1 if C is the base at position 18 of the sense strand, otherwise its value is 0;

$C_{19}$=1 if C is the base at position 19 of the sense strand, otherwise if another base is present or the sense strand is only 18 base pairs in length, its value is 0;

$G_1$=1 if G is the base at position 1 on the sense strand, otherwise its value is 0;

$G_2$=1 if G is the base at position 2 of the sense strand, otherwise its value is 0;

$G_8$=1 if G is the base at position 8 on the sense strand, otherwise its value is 0;

$C_{10}$=1 if G is the base at position 10 on the sense strand, otherwise its value is 0;

$G_{13}$=1 if G is the base at position 13 on the sense strand, otherwise its value is 0;

$G_{19}$=1 if G is the base at position 19 of the sense strand, otherwise if another base is present or the sense strand is only 18 base pairs in length, its value is 0;

$U_1$=1 if U is the base at position 1 on the sense strand, otherwise its value is 0;

$U_2$=1 if U is the base at position 2 on the sense strand, otherwise its value is 0;

$U_3$=1 if U is the base at position 3 on the sense strand, otherwise its value is 0;

$U_4$=1 if U is the base at position 4 on the sense strand, otherwise its value is 0;

$U_7$=1 if U is the base at position 7 on the sense strand, otherwise its value is 0;

$U_9$=1 if U is the base at position 9 on the sense strand, otherwise its value is 0;

$U_{10}$=1 if U is the base at position 10 on the sense strand, otherwise its value is 0;

$U_{15}$=1 if U is the base at position 15 on the sense strand, otherwise its value is 0;

$U_{16}$=1 if U is the base at position 16 on the sense strand, otherwise its value is 0;

$U_{17}$=1 if U is the base at position 17 on the sense strand, otherwise its value is 0;

$U_{18=1}$ if U is the base at position 18 on the sense strand, otherwise its value is 0;

$GC_{15-19}$=the number of G and C bases within positions 15-19 of the sense strand, or within positions 15-18 if the sense strand is only 18 base pairs in length;

$GC_{total}$=the number of G and C bases in the sense strand;

Tm=100 if the siRNA oligo has the internal repeat longer then 4 base pairs, otherwise its value is 0; and X=the number of times that the same nucleotide repeats four or more times in a row.

The above formulas VIII and A, as well as formulas I-VII, provide methods for selecting siRNA in order to increase the efficiency of gene silencing. A subset of variables of any of the formulas may be used, though when fewer variables are used, the optimization hierarchy becomes less reliable.

With respect to the variables of the above-referenced formulas, a single letter of A or C or G or U followed by a subscript refers to a binary condition. The binary condition is that either the particular base is present at that particular position (wherein the value is "1") or the base is not present (wherein the value is "0"). Because position 19 is optional, i.e. there might be only 18 base pairs, when there are only 18 base pairs, any base with a subscript of 19 in the formulas above would have a zero value for that parameter. Before or after each variable is a number followed by *, which indicates that the value of the variable is to be multiplied or weighed by that number.

The numbers preceding the variables A, or G, or C, or U in Formulas VIII and IX (or after the variables in Formula I-VII) were determined by comparing the difference in the frequency of individual bases at different positions in functional siRNA and total siRNA. Specifically, the frequency in which a given base was observed at a particular position in functional groups was compared with the frequency that that same base was observed in the total, randomly selected siRNA set. If the absolute value of the difference between the functional and total values was found to be greater than 6%, that parameter was included in the equation. Thus for instance, if the frequency of finding a "G" at position 13 ($G_{13}$) is found to be 6% in a given functional group, and the frequency of $G_{13}$ in the total population of siRNAs is 20%, the difference between the two values is 6%−20%=−14%. As the absolute value is greater than six (6), this factor (−14) is included in the equation. Thus in Formula VIII, in cases where the siRNA under study has a G in position 13, the accrued value is (−14)*(1)=−14. In contrast, when a base other than G is found at position 13, the accrued value is (−14)*(0)=0.

When developing a means to optimize siRNAs, the inventors observed that a bias toward low internal thermodynamic stability of the duplex at the 5'-antisense (AS) end is characteristic of naturally occurring miRNA precursors. The inventors extended this observation to siRNAs for which functionality had been assessed in tissue culture.

With respect to the parameter $GC_{15-19}$, a value of 0-5 will be ascribed depending on the number of G or C bases at positions 15 to 19. If there are only 18 base pairs, the value is between 0 and 4.

With respect to the criterion $GC_{total}$ content, a number from 0-30 will be ascribed, which correlates to the total number of G and C nucleotides on the sense strand, excluding overhangs. Without wishing to be bound by any one theory, it is postulated that the significance of the GC content (as well as AU content at positions 15-19, which is a parameter for formulas III-VII) relates to the easement of the unwinding of a double-stranded siRNA duplex. Duplex unwinding is believed to be crucial for siRNA functionality in vivo and overall low internal stability, especially low internal stability of the first unwound base pair is believed to be important to maintain sufficient processivity of RISC complex-induced duplex unwinding. If the duplex has 19 base pairs, those at positions 15-19 on the sense strand will unwind first if the molecule exhibits a sufficiently low internal stability at that position. As persons skilled in the art are aware, RISC is a complex of approximately twelve proteins; Dicer is one, but not the only, helicase within this complex. Accordingly, although the GC parameters are believed to relate to activity with Dicer, they are also important for activity with other RISC proteins.

The value of the parameter Tm is 0 when there are no internal repeats longer than (or equal to) four base pairs present in the siRNA duplex; otherwise the value is 1. Thus for example, if the sequence ACGUACGU, or any other four nucleotide (or more) palindrome exists within the structure, the value will be one (1). Alternatively if the structure ACGGACG, or any other 3 nucleotide (or less) palindrome exists, the value will be zero (0).

The variable "X" refers to the number of times that the same nucleotide occurs contiguously in a stretch of four or more units. If there are, for example, four contiguous As in one part of the sequence and elsewhere in the sequence four contiguous Cs, X=2. Further, if there are two separate contiguous stretches of four of the same nucleotides or eight or more of the same nucleotides in a row, then X=2. However, X does not increase for five, six or seven contiguous nucleotides.

Again, when applying Formula VIII or Formula IX to a given mRNA, (the "target RNA" or "target molecule"), one may use a computer program to evaluate the criteria for every sequence of 18-30 base pairs or only sequences of a fixed length, e.g., 19 base pairs. Preferably the computer program is designed such that it provides a report ranking of all of the potential siRNAs between 18 and 30 base pairs, ranked according to which sequences generate the highest value. A higher value refers to a more efficient siRNA for a particular target gene. The computer program that may be used, may be developed in any computer language that is known to be useful for scoring nucleotide sequences, or it may be developed with the assistance of commercially available product such as Microsoft's product .net. Additionally, rather than run every sequence through one and/or another formula, one may compare a subset of the sequences, which may be desirable if for example only a subset are available. For instance, it may be desirable to first perform a BLAST (Basic Local Alignment Search Tool) search and to identify sequences that have no homology to other targets. Alternatively, it may be desirable to scan the sequence and to identify regions of moderate GC context, then perform relevant calculations using one of the above-described formulas on these regions. These calculations can be done manually or with the aid of a computer.

As with Formulas I-VII, either Formula VIII or Formula IX may be used for a given mRNA target sequence. However, it is possible that according to one or the other formula more than one siRNA will have the same value. Accordingly, it is beneficial to have a second formula by which to differentiate sequences. Formula IX was derived in a similar fashion as Formula VIII, yet used a larger data set and thus yields sequences with higher statistical correlations to highly functional duplexes. The sequence that has the highest value ascribed to it may be referred to as a "first optimized duplex." The sequence that has the second highest value ascribed to it may be referred to as a "second optimized duplex." Similarly, the sequences that have the third and fourth highest values ascribed to them may be referred to as a third optimized duplex and a fourth optimized duplex, respectively. When more than one sequence has the same value, each of them may, for example, be referred to as first optimized duplex sequences or co-first optimized duplexes.

SiRNA sequences identified using Formula VIII are contained within the enclosed compact disks. The data included on the enclosed compact disks is described more fully below. The sequences identified by Formula VIII that are disclosed in the compacts disks may be used in gene silencing applications.

It should be noted that for Formulas VIII and IX all of the aforementioned criteria are identified as positions on the sense strand when oriented in the 5' to 3' direction as they are identified in connection with Formulas I-VII unless otherwise specified.

Formulas I-IX, may be used to select or to evaluate one, or more than one, siRNA in order to optimize silencing Preferably, at least two optimized siRNAs that have been selected according to at least one of these formulas are used to silence a gene, more preferably at least three and most preferably at least four. The siRNAs may be used individually or together in a pool or kit. Further, they may be applied to a cell simultaneously or separately. Preferably, the at least two siRNAs are applied simultaneously. Pools are particularly beneficial for many research applications. However, for therapeutics, it may be more desirable to employ a single hyperfunctional siRNA as described elsewhere in this application.

When planning to conduct gene silencing, and it is necessary to choose between two or more siRNAs, one should do so by comparing the relative values when the siRNA are subjected to one of the formulas above. In general a higher scored siRNA should be used.

Useful applications include, but are not limited to, target validation, gene functional analysis, research and drug discovery, gene therapy and therapeutics. Methods for using siRNA in these applications are well known to persons of skill in the art.

Because the ability of siRNA to function is dependent on the sequence of the RNA and not the species into which it is introduced, the present invention is applicable across a broad range of species, including but not limited to all mammalian species, such as humans, dogs, horses, cats, cows, nice, hamsters, chimpanzees and gorillas, as well as other species and organisms such as bacteria, viruses, insects, plants and C. elegans.

The present invention is also applicable for use for silencing a broad range of genes, including but not limited to the roughly 45,000 genes of a human genome, and has particular relevance in cases where those genes are associated with diseases such as diabetes, Alzheimer's, cancer, as well as all genes in the genomes of the aforementioned organisms.

The siRNA selected according to the aforementioned criteria or one of the aforementioned algorithms are also, for example, useful in the simultaneous screening and functional analysis of multiple genes and gene families using high throughput strategies, as well as in direct gene suppression or silencing.

Development of the Algorithms

To identify siRNA sequence features that promote functionality and to quantify the importance of certain currently accepted conventional factors—such as G/C content and target site accessibility—the inventors synthesized an siRNA panel consisting of 270 siRNAs targeting three genes, Human Cyclophilin, Firefly Luciferase, and Human DBI. In all three cases, siRNAs were directed against specific regions of each gene. For Human Cyclophilin and Firefly Luciferase, ninety siRNAs were directed against a 199 bp segment of each respective mRNA. For DBI, 90 siRNAs were directed against a smaller, 109 base pair region of the mRNA. The sequences to which the siRNAs were directed are provided below.

It should be noted that in certain sequences, "t" is present. This is because many databases contain information in this manner. However, the t denotes a uracil residue in mRNA and siRNA. Any algorithm will, unless otherwise specified, process a t in a sequence as a u.

```
                                         SEQ. ID NO. 29
Human cyclophilin: 193-39, M60857:
gttccaaaaacagtggataattttgtggccttagctacaggagagaaagg
atttggctacaaaaacagcaaattccatcgtgtaatcaaggacttcatga
tccagggcggagacttcaccaggggagatggcacaggaggaaagagcatc
tacggtgagcgcttccccgatgagaacttcaaactgaagcactacgggcc
tggctggg
```

```
                                         SEQ. ID NO. 30
Firefly luciferase: 1434-1631, U47298 (pGL3,
Promega):
tgaacttcccgccgccgttgttgttttggagcacggaaagacgatgacgg
aaaaagagatcgtggattacgtcgccagtcaagtaacaaccgcgaaaaag
ttgcgcggaggagttgtgtttgtggacgaagtaccgaaaggtcttaccgg
aaaactcgacgcaagaaaaatcagagagatcctcataaaggccaagaagg
```

```
                                         SEQ. ID NO. 0031
DBI, NM 020548 (202-310) (every position):
acgggcaaggccaagtgggatgcctggaatgagctgaaagggacttccaa
ggaagatgccatgaaagcttacatcaacaaagtagaagagctaaagaaaa
aatacggg
```

A list of the siRNAs appears in Table III (see Examples Section, Example II)

The set of duplexes was analyzed to identify correlations between siRNA functionality and other biophysical or thermodynamic properties. When the siRNA panel was analyzed in functional and non-functional subgroups, certain nucleotides were much more abundant at certain positions in functional or non-functional groups. More specifically, the frequency of each nucleotide at each position in highly functional siRNA duplexes was compared with that of non-functional duplexes in order to assess the preference for or against any given nucleotide at every position. These analyses were used to determine important criteria to be included in the siRNA algorithms (Formulas VIII and IX).

The data set was also analyzed for distinguishing biophysical properties of siRNAs in the functional group, such as optimal percent of GC content, propensity for internal structures and regional thermodynamic stability. Of the presented criteria, several are involved in duplex recognition, RISC activation/duplex unwinding, and target cleavage catalysis.

Figure 2:
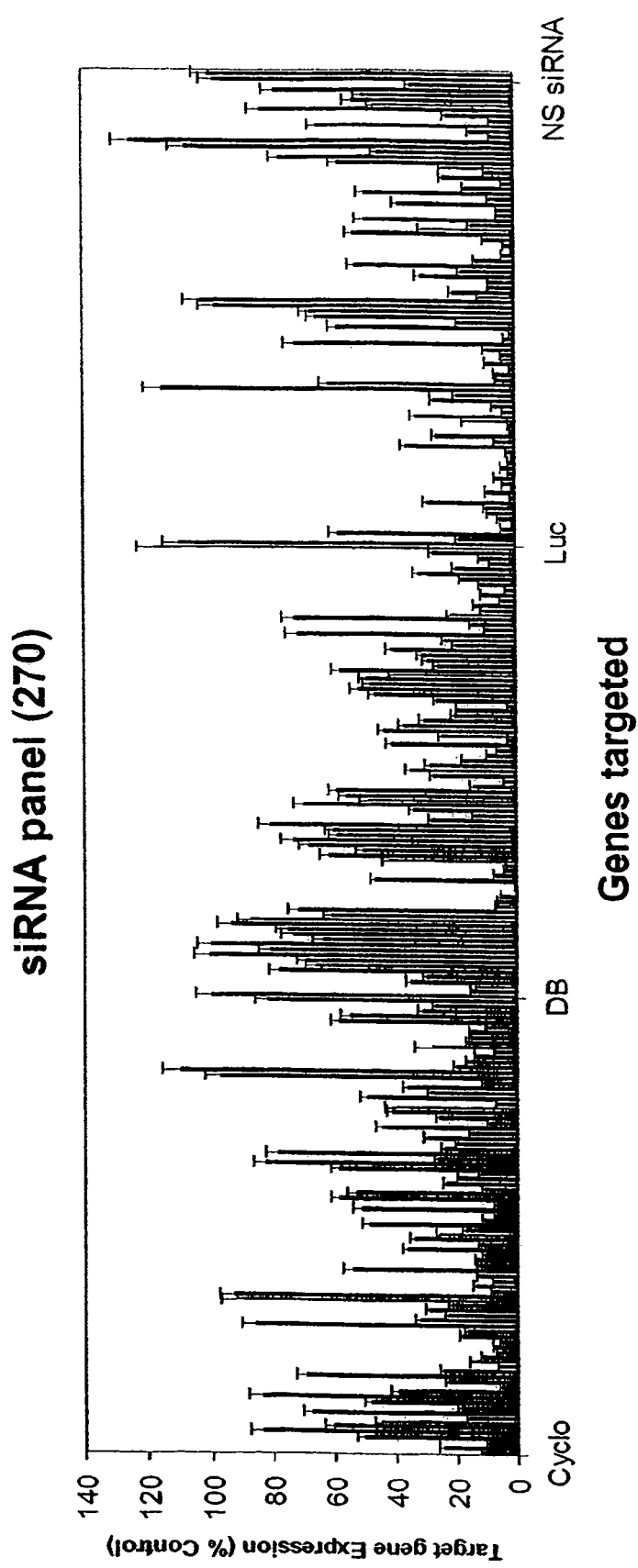
FIG. 2 is a representation of the functionality of two hundred and-seventy siRNA duplexes that were generated to target human cyclophilin, human diazepam-binding inhibitor (DB), and firefly luciferase.

The original data set that was the source of the statistically derived criteria is shown in FIG. 2. Additionally, this figure shows that random selection yields siRNA duplexes with unpredictable and widely varying silencing potencies as measured in tissue culture using HEK293 cells. In the figure, duplexes are plotted such that each x-axis tick-mark represents an individual siRNA, with each subsequent siRNA differing in target position by two nucleotides for Human Cyclophilin and Firefly Luciferase, and by one-nucleotide for Human DBI. Furthermore, the y-axis denotes the level of target expression remaining after transfection of the duplex into cells and subsequent silencing of the target.

Figure 3A:
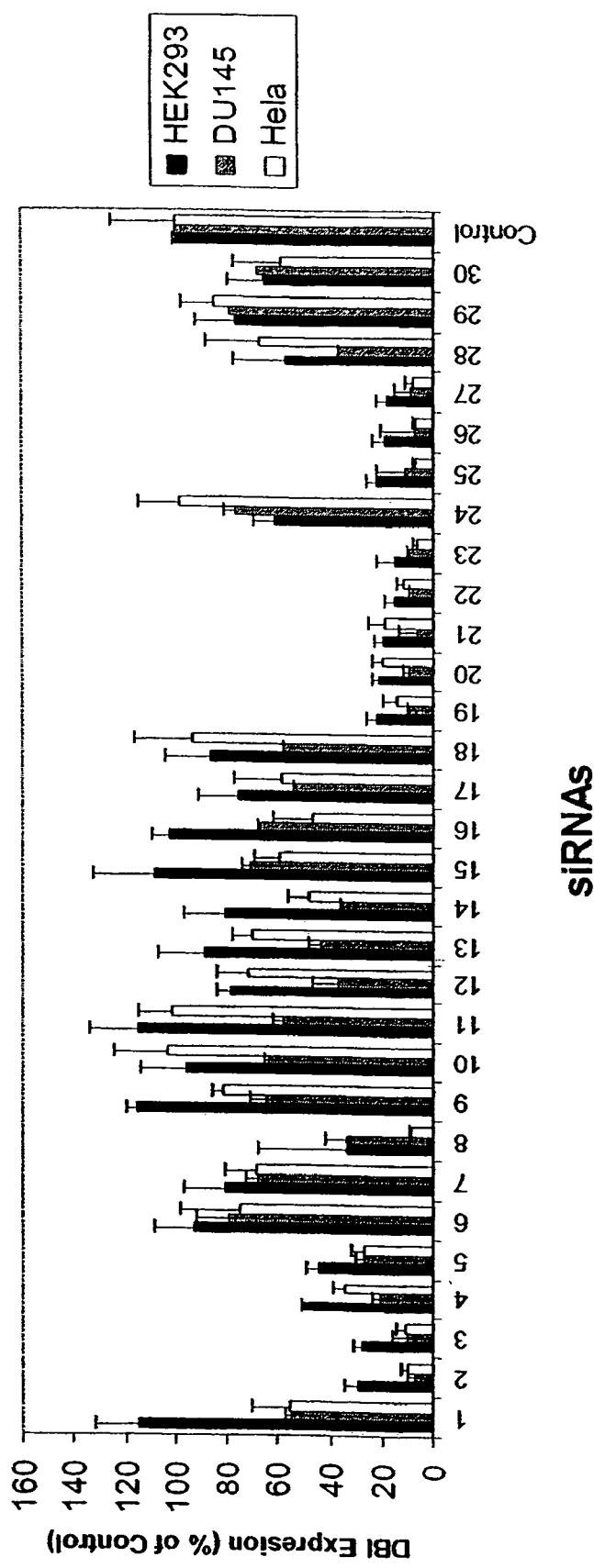
FIG. 3a is a representation of the silencing effect of 30 siRNAs in three different cells lines, HEK293, DU145, and Hela.

SiRNA identified and optimized in this document work equally well in a wide range of cell types. FIG. 3a shows the evaluation of thirty siRNAs targeting the DBI gene in three cell lines derived from different tissues. Each DBI siRNA displays very similar functionality in HEK293 (ATCC, CRL-1573, human embryonic kidney), HeLa (ATCC, CCL-2, cervical epithelial adenocarcinoma) and DU145 (HTB-81, prostate) cells as deterimined by the B-DNA assay. Thus, siRNA functionality is determined by the primary sequence of the siRNA and not by the intracellular environment. Additionally, it should be noted that although the present invention provides for a determination of the functionality of siRNA for a given target, the same siRNA may silence more than one gene. For example, the complementary sequence of the silencing siRNA maybe present in more than one gene. Accordingly, in these circumstances, it may be desirable not to use the siRNA with highest SMARTscore™. In such circumstances, it may be desirable to use the siRNA with the next highest SMARTscore™.

Figure 3B:
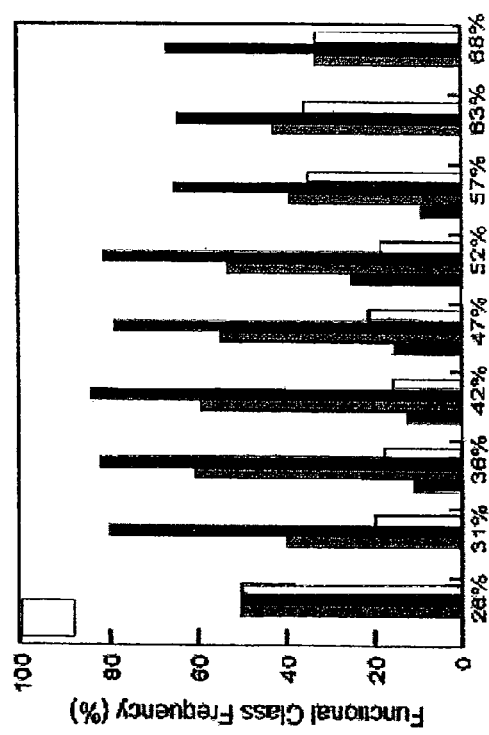
FIG. 3b shows the frequency of different functional groups (>95% silencing (black), >80% silencing (gray), >50% silencing (dark gray), and <50% silencing (white)) based on GC content. In cases where a given bar is absent from a particular GC percentage, no siRNA were identified for that particular group.

To determine the relevance of G/C content in siRNA function, the G/C content of each duplex in the panel was calculated and the functional classes of siRNAs (<F50, ≧F50, ≧F80, ≧F95 where F refers to the percent gene silencing) were sorted accordingly. The majority of the highly-functional siRNAs (≧F95) fell within the G/C content range of 36%-52% (FIG. 3B). Twice as many non-functional (<F50) duplexes fell within the high G/C content groups (>57% GC content) compared to the 36%-52% group. The group with extremely low GC content (26% or less) contained a higher proportion of non-functional siRNAs and no highly-functional siRNAs. The G/C content range of 30%-52% was therefore selected as Criterion I for siRNA functionality, consistent with the observation that a G/C range 30%-70% promotes efficient RNAi targeting. Application of this criterion alone provided only a marginal increase in the probability of selecting functional siRNAs from the panel: selection of F50 and F95 siRNAs was improved by 3.6% and 2.2%, respectively. The siRNA panel presented here permitted a more systematic analysis and quantification of the importance of this criterion than that used previously.

A relative measure of local internal stability is the A/U base pair (bp) content; therefore, the frequency of A/U bp was determined for each of the five terminal positions of the duplex (5' sense (S)/5' antisense (AS)) of all siRNAs in the panel. Duplexes were then categorized by the number of A/U bp in positions 1-5 and 15-19 of the sense strand. The thermodynamic flexibility of the duplex 5'-end (positions 1-5; S) did not appear to correlate appreciably with silencing potency, while that of the 3'-end (positions 15-19; S) correlated with efficient silencing. No duplexes lacking A/U bp in positions 15-19 were functional. The presence of one A/U bp in this region conferred some degree of functionality, but the presence of three or more A/Us was preferable and therefore defined as Criterion II. When applied to the test panel, only a marginal increase in the probability of functional siRNA selection was achieved: a 1.8% and 2.3% increase for F50 and F95 duplexes, respectively (Table IV).

Figure 3C:
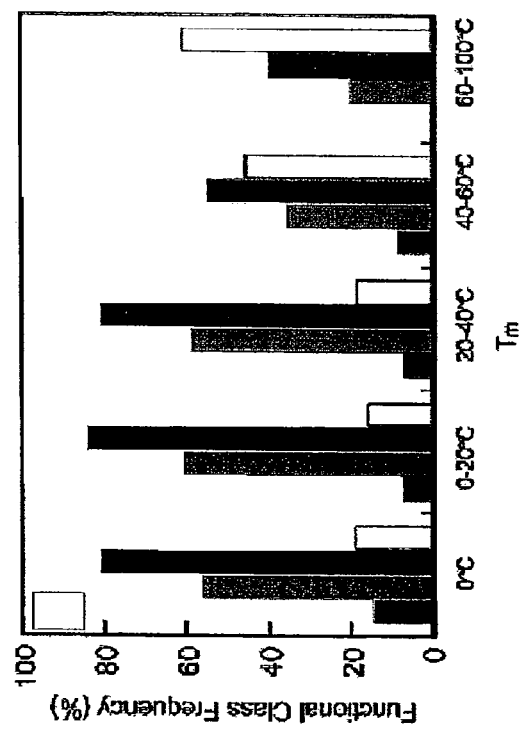
FIG. 3c shows the frequency of different functional groups based on melting temperature (Tm). Again, each group has four different divisions: >95% (black), >80% (gray), >50% (dark gray), and <50% (white) silencing.

The complementary strands of siRNAs that contain internal repeats or palindromes may form internal fold-back structures. These hairpin-like structures exist in equilibrium with the duplexed form effectively reducing the concentration of functional duplexes. The propensity to form internal hairpins and their relative stability can be estimated by predicted melting temperatures. High Tm reflects a tendency to form hairpin structures. Lower Tm values indicate a lesser tendency to form hairpins. When the functional classes of siRNAs were sorted by $T_m$ (FIG. 3c), the following trends were identified: duplexes lacking stable internal repeats were the most potent silencers (no F95 duplex with predicted hairpin structure $T_m$>60° C.). In contrast, about 60% of the duplexes in the groups having internal hairpins with calculated $T_m$ values less than 20° C. were F80. Thus, the stability of internal repeats is inversely proportional to the silencing effect and defines Criterion III (predicted hairpin structure $T_m \leq 20°$ C.).

Sequence-based Determinants of siRNA Functionality

Figure 4:
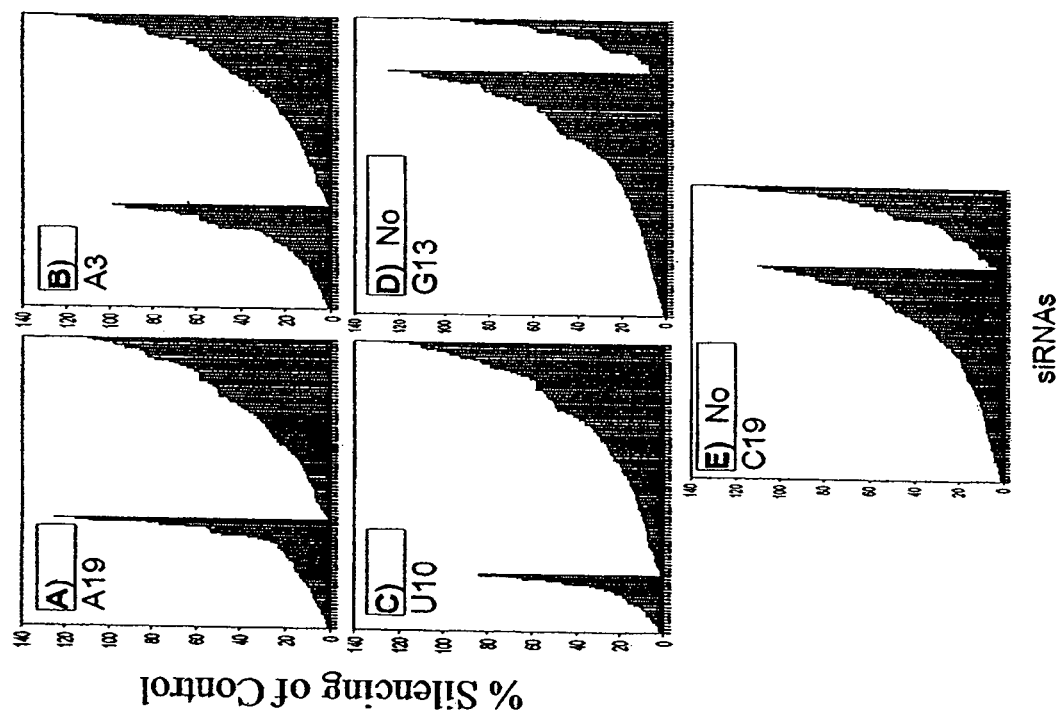
FIG. 4 is a representation of a statistical analysis that revealed correlations between silencing and five sequence-related properties of siRNA: (A) an A at position 19 of the sense strand, (B) an A at position 3 of the sense strand, (C) a U at position 10 of the sense strand, (D) a base other than G at position 13 of the sense strand, and (E) a base other than C at position 19 of the sense strand. All variables were correlated with siRNA silencing of firefly luciferase and human cyclophilin. SiRNAs satisfying the criterion are grouped on the left (Selected) while those that do not, are grouped on the right (Eliminated). Y-axis is "% Silencing of Control." Each position on the X-axis represents a unique siRNA.

When the siRNA panel was sorted into functional and non-functional groups, the frequency of a specific nucleotide at each position in a functional siRNA duplex was compared with that of a nonfunctional duplex in order to assess the preference for or against a certain nucleotide. FIG. 4 shows the results of these queries and the subsequent resorting of the data set (from FIG. 2). The data is separated into two sets: those duplexes that meet the criteria, a specific nucleotide in a certain position—grouped on the left (Selected) and those that do not—grouped on the right (Eliminated). The duplexes are further sorted from most functional to, least functional with the y-axis of FIG. 4a-e representing the % expression i.e. the amount of silencing that is elicited by the duplex (Note: each position on the X-axis represents a different duplex). Statistical analysis revealed correlations between silencing and several sequence-related properties of siRNAs. FIG. 4 and Table IV show quantitative analysis for the following five sequence-related properties of siRNA: (A) an A at position 19 of the sense strand; (B) an A at position 3 of the sense strand; (C) a U at position 10 of the sense strand; (D) a base other than G at position 13 of the sense strand; and (E) a base other than C at position 19 of the sense strand.

When the siRNAs in the panel were evaluated for the presence of an A at position 19 of the sense strand, the percentage of non-functional duplexes decreased from 20% to 11.8%, and the percentage of F95 duplexes increased from 21.7% to 29.4% (Table IV). Thus, the presence of an A in this position defined Criterion IV.

Another sequence-related property correlated with silencing was the presence of an A in position 3 of the sense strand (FIG. 4b). Of the siRNAs with A3, 34.4% were F95, compared with 21.7% randomly selected siRNAs. The presence of a U base in position 10 of the sense strand exhibited an even greater impact (FIG. 4c). Of the duplexes in this group, 41.7% were F95. These properties became criteria V and VI, respectively.

Two negative sequence-related criteria that were identified also appear on FIG. 4. The absence of a G at position 13 of the sense strand, conferred a marginal increase in selecting functional duplexes (FIG. 4d). Similarly, lack of a C at position 19 of the sense strand also correlated with functionality (FIG. 4e). Thus, among functional duplexes, position 19 was most likely occupied by A, and rarely occupied by C. These rules were defined as criteria VII and VIII, respectively.

Application of each criterion individually provided marginal but statistically significant increases in the probability of selecting a potent siRNA. Although the results were informative, the inventors sought to maximize potency and therefore consider multiple criteria or parameters. Optimization is particularly important when developing therapeutics. Interestingly, the probability of selecting a functional siRNA based on each thermodynamic criteria was 2%-4% higher than random, but 4%-8% higher for the sequence-related determinates. Presumably, these sequence-related increases reflect the complexity of the RNAi mechanism and the multitude of protein-RNA interactions that are involved in RNAi-mediated silencing.

TABLE IV

| Criterion | | % Functional | Improvement over Random |
|---|---|---|---|
| I. 30%–52% G/C content | <F50 | 16.4% | −3.6% |
| | ≧F50 | 83.6% | 3.6% |
| | ≧F80 | 60.4% | 4.3% |
| | ≧F95 | 23.9% | 2.2% |
| II. At least 3 A/U bases | <F50 | 18.2% | −1.8% |
| at positions 15–19 of | ≧F50 | 81.8% | 1.8% |
| the sense strand | ≧F80 | 59.7% | 3.6% |
| | ≧F95 | 24.0% | 2.3% |
| III. Absence of internal | <F50 | 16.7% | −3.3% |
| repeats, as measured by | ≧F50 | 83.3% | 3.3% |
| $T_m$ of secondary | ≧F80 | 61.1% | 5.0% |
| structure ≦20° C. | ≧F95 | 24.6% | 2.9% |
| IV. An A base at position | <F50 | 11.8% | −8.2% |
| 19 of the sense strand | ≧F50 | 88.2% | 8.2% |
| | ≧F80 | 75.0% | 18.9% |
| | ≧F95 | 29.4% | 7.7% |
| V. An A base at position | <F50 | 17.2% | −2.8% |
| 3 of the sense strand | ≧F50 | 82.8% | 2.8% |
| | ≧F80 | 62.5% | 6.4% |
| | ≧F95 | 34.4% | 12.7% |
| VI. A U base at position | <F50 | 13.9% | −6.1% |
| 10 of the sense strand | ≧F50 | 86.1% | 6.1% |
| | ≧F80 | 69.4% | 13.3% |
| | ≧F95 | 41.7% | 20% |
| VII. A base other than C | <F50 | 18.8% | −1.2% |
| at position 19 of the | ≧F50 | 81.2% | 1.2% |
| sense strand | ≧F80 | 59.7% | 3.6% |
| | ≧F95 | 24.2% | 2.5% |
| VIII. A base other than | <F50 | 15.2% | −4.8% |
| G at position 13 of the | ≧F50 | 84.8% | 4.8% |
| sense strand | ≧F80 | 61.4% | 5.3% |
| | ≧F95 | 26.5% | 4.8% |

The siRNA Selection Algorithm

In an effort to improve selection further, all identified criteria, including but not limited to those listed in Table IV were combined into the algorithms embodied in Formula VIII and Formula IX. Each siRNA was then assigned a score (referred to as a SMARTscore™) according to the values derived from the formulas. Duplexes that scored higher than 0 or 20, for Formulas VIII and IX, respectively, effectively selected a set of functional siRNAs and excluded all non-functional siRNAs.

Conversely, all duplexes scoring lower than 0 and 20 according to formulas VIII and IX, respectively, contained some functional siRNAs but included all non-functional siRNAs. A graphical representation of this selection is shown in FIG. 5.

The methods for obtaining the seven criteria embodied in Table IV are illustrative of the results of the process used to develop the information for Formulas VIII and IX. Thus similar techniques were used to establish the other variables and their multipliers. As described above, basic statistical methods were use to determine the relative values for these multipliers.

To determine the value for "Improvement over Random" the difference in the frequency of a given attribute (e.g. GC content, base preference) at a particular position is determined between individual functional groups (e.g. <F50) and the total siRNA population studied (e.g. 270 siRNA molecules selected randomly). Thus, for instance, in Criterion I (30%-52% GC content) members of the <F50 group were observed to have GC contents between 30-52% in 16.4% of the cases. In contrast, the total group of 270 siRNAs had GC contents in this range, 20% of the time. Thus for this particular attribute, there is a small negative correlation between 30%-52% GC content and this functional group (i.e. 16.4%–20%=−3.6%). Similarly, for Criterion VI, (a "U" at position 10 of the sense strand), the >F95 group contained a "U" at this position 41.7% of the time. In contrast, the total group of 270 siRNAs had a "U" at this position 21.7% of the time, thus the improvement over random is calculated to be 20% (or 41.7%−21.7%).

Identifying the Average Internal Stability Profile of Strong siRNA

In order to identify an internal stability profile that is characteristic of strong siRNA, 270 different siRNAs derived from the cyclophilin B, the diazepam binding inhibitor (DBI), and the luciferase gene were individually transfected into HEK293 cells and tested for their ability to induce RNAi of the respective gene. Based on their performance in the in vivo assay, the sequences were then subdivided into three groups, (i) >95% silencing; (ii) 80-95% silencing, and (iii) less than 50% silencing. Sequences exhibiting 51-84% silencing were eliminated from further consideration to reduce the difficulties in identifying relevant thermodynamic patterns.

Following the division of siRNA into three groups, a statistical analysis was performed on each member of each group to determine the average internal stability profile (AISP) of the siRNA. To accomplish this the Oligo 5.0 Primer Analysis Software and other related statistical packages (e.g. Excel) were exploited to determine the internal stability of pentamers using the nearest neighbor method described by Freier et al., (1986) *Improved free-energy parameters for predictions of RNA duplex stability*, Proc Natl. Acad. Sci. U. S. A. 83(24): 9373-7. Values for each group at each position were then averaged, and the resulting data were graphed on a linear coordinate system with the Y-axis expressing the ΔG (free energy) values in kcal/mole and the X-axis identifying the position of the base relative to the 5' end.

Figure 6A:
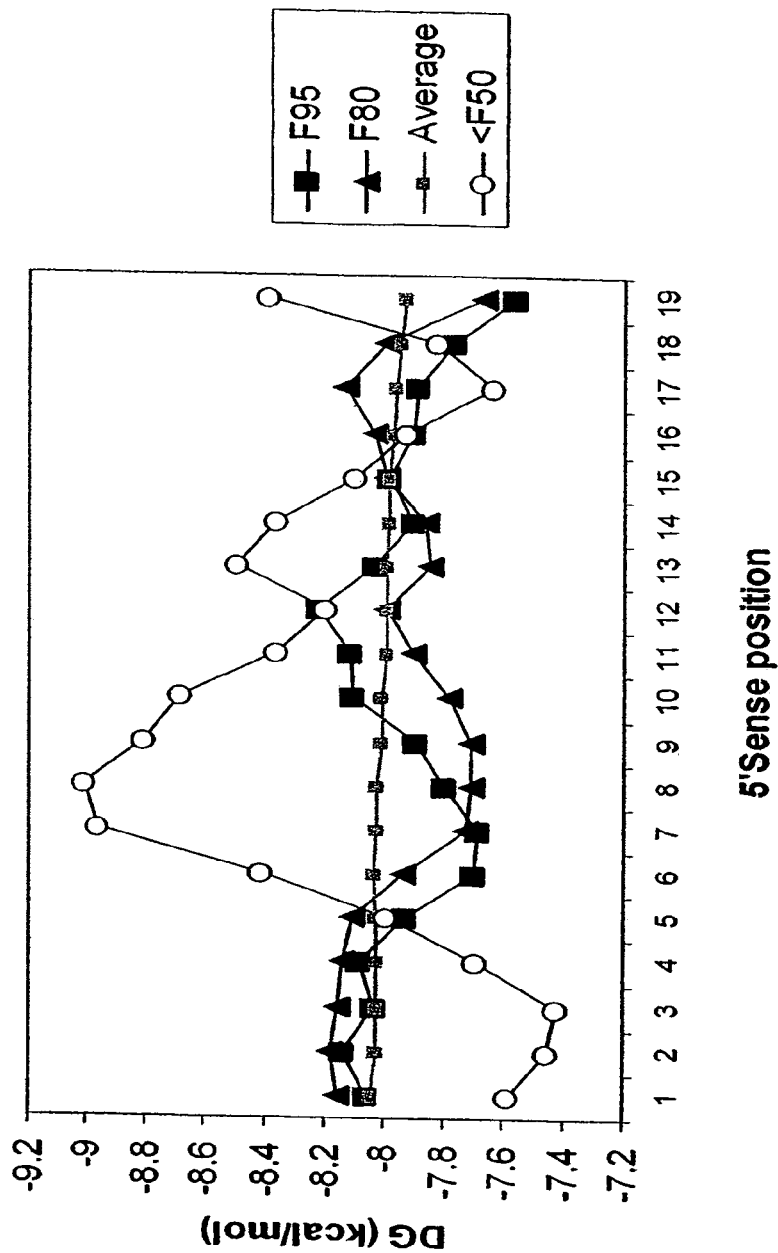
FIG. 6A is a representation of the average internal stability profile (AISP) derived from 270 siRNAs taken from three separate genes (cyclophilin B, DBI and firefly luciferase). Graphs represent AISP values of highly functional, functional, and non-functional siRNA.

The results of the analysis identified multiple key regions in siRNA molecules that were critical for successful gene silencing. At the 3'-most end of the sense strand (5'antisense), highly functional siRNA (>95% gene silencing, see FIG. 6a, >F95) have a low internal stability (AISP of position 19=~−7.6 kcal/mol). In contrast low-efficiency siRNA (i.e. those exhibiting less than 50% silencing, <F50) display a distinctly different profile, having high ΔG values (~−8.4 kcal/mol) for the same position. Moving in a 5' (sense strand)

direction, the internal stability of highly efficient siRNA rises (position 12=~−8.3 kcal/mole) and then drops again (position 7=~−7.7 kcal/mol) before leveling off at a value of approximately −8.1 kcal/mol for the 5' terminus. SiRNA with poor silencing capabilities show a distinctly different profile. While the AISP value at position 12 is nearly identical with that of strong siRNAs, the values at positions 7 and 8 rise considerably, peaking at a high of ~−9.0 kcal/mol. In addition, at the 5' end of the molecule the AISP profile of strong and weak siRNA differ dramatically. Unlike the relatively strong values exhibited by siRNA in the >95% silencing group, siRNAs that exhibit poor silencing activity have weak AISP values (−7.6, −7.5, and −7.5 kcal/mol for positions 1, 2 and 3 respectively).

Overall the profiles of both strong and weak siRNAs form distinct sinusoidal shapes that are roughly 180° out-of-phase with, each other. While these thermodynamic descriptions define the archetypal profile of a strong siRNA, it will likely be the case that neither the ΔG values given for key positions in the profile or the absolute position of the profile along the Y-axis (i.e. the ΔG-axis) are absolutes. Profiles that are shifted upward or downward (i.e. having on an average, higher or lower values at every position) but retain the relative shape and position of the profile along the X-axis can be foreseen as being equally effective as the model profile described here. Moreover, it is likely that siRNA that have strong or even stronger gene-specific silencing effects might have exaggerated ΔG values (either higher or lower) at key positions. Thus, for instance, it is possible that the 5'-most position of the sense strand (position 19) could have ΔG values of 7.4 kcal/mol or lower and still be a strong siRNA if, for instance, a G-C→G-T/U mismatch were substituted at position 19 and altered duplex stability. Similarly, position 12 and position 7 could have values above 8.3 kcal/mol and below 7.7 kcal/mole, respectively, without abating the silencing effectiveness of the molecule. Thus, for instance, at position 12, a stabilizing chemical modification (e.g. a chemical modification of the 2' position of the sugar backbone) could be added that increases the average internal stability at that position. Similarly, at position 7, mismatches similar to those described previously could be introduced that would lower the ΔG values at that position.

Lastly, it is important to note that while functional and non-functional siRNA were originally defined as those molecules having specific silencing properties, both broader or more limiting parameters can be used to define these molecules. As used herein, unless otherwise specified, "non-functional siRNA" are defined as those siRNA that induce less than 50% (<50%) target silencing, "semi-functional siRNA" induce 50-79% target silencing, "functional siRNA" are molecules that induce 80-95% gene silencing, and "highly-functional siRNA" are molecules that induce great than 95% gene silencing. These definitions are not intended to be rigid and can vary depending upon the design and needs of the application. For instance, it is possible that a researcher attempting to map a gene to a chromosome using a functional assay, may identify an siRNA that reduces gene activity by only 30%. While this level of gene silencing may be "non-functional" for e.g. therapeutic needs, it is sufficient for gene mapping purposes and is, under these uses and conditions, "functional." For these reasons, functional siRNA can be defined as those molecules having greater than 10%, 20%, 30%, 40%, 50%, 60%, 70%, 80%, or 90% silencing capabilities at 100 nM transfection conditions. Similarly, depending upon the needs of the study and/or application, non-functional and semi-functional siRNA can be defined as having different parameters. For instance, semi-functional siRNA can be defined as being those molecules that induce 20%, 30%, 40%, 50%, 60%, or 70% silencing at 100 nM transfection conditions. Similarly, non-functional siRNA can be defined as being those molecules that silence gene expression by less than 70%, 60%, 50%, 40%, 30%, or less. Nonetheless, unless otherwise stated, the descriptions stated in the "Definitions" section of this text should be applied.

Functional attributes can be assigned to each of the key positions in the AISP of strong siRNA. The low 5' (sense strand) AISP values of strong siRNAs maybe necessary for determining which end of the molecule enters the RISC complex. In contrast, the high and low AISP values observed in the central regions of the molecule may be critical for siRNA-target mRNA interactions and product release, respectively.

Figure 6B:
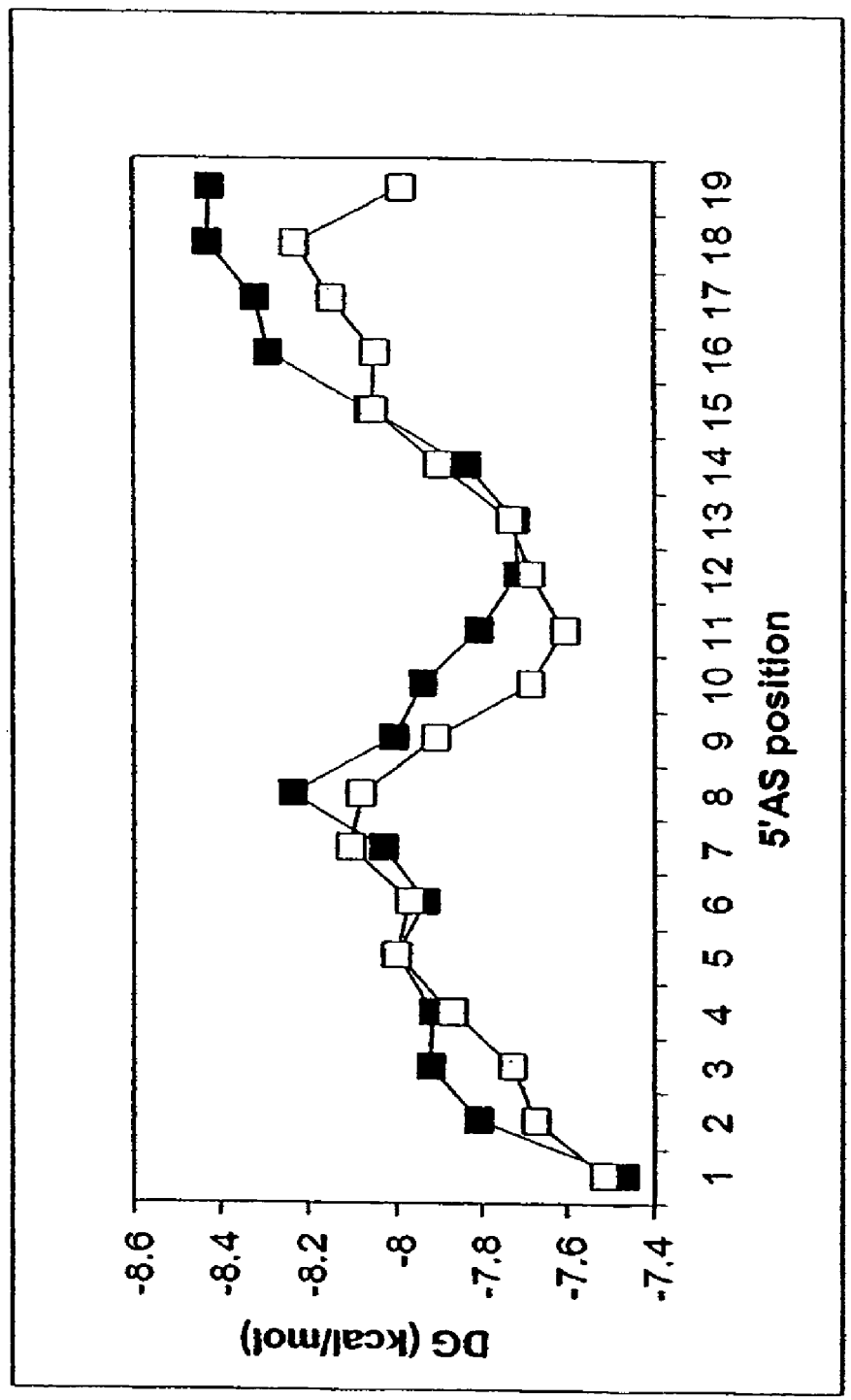
FIG. 6B is a comparison between the. AISP of naturally derived GFP siRNA (filled squares) and the AISP of siRNA from cyclophilin B, DBI, and luciferase having >90% silencing properties (no fill) for the antisense strand. "DG" is the symbol for ΔG, free energy.

If the AISP values described above accurately define the thermodynamic parameters of strong siRNA, it would be expected that similar patterns would be observed in strong siRNA isolated from nature. Natural siRNAs exist in a harsh, RNase-rich environment and it can be hypothesized that only those siRNA that exhibit heightened affinity for RISC (i.e. siRNA that exhibit an average internal stability profile similar to those observed in strong siRNA) would survive in an intracellular environment. This hypothesis was tested using GFP-specific siRNA isolated from *N. benthamiana*. Llave et al. (2002) *Endogenous and Silencing-Associated Small RNAs in Plants*, The Plant Cell 14, 1605-1619, introduced long double-stranded GFP-encoding RNA into plants and subsequently re-isolated GFP-specific siRNA from the tissues. The AISP of fifty-nine of these GFP-siRNA were determined, averaged, and subsequently plotted alongside the AISP profile obtained from the cyclophilin B/DBI/luciferase siRNA having >90% silencing properties (FIG. 6*b*). Comparison of the two groups show that profiles are nearly identical. This finding validates the information provided by the internal stability profiles and demonstrates that: (1) the profile identified by analysis of the cyclophilin B/DBI/luciferase siRNAs are not gene specific; and (2) AISP values can be used to search for strong siRNAs in a variety of species.

Figure 7:
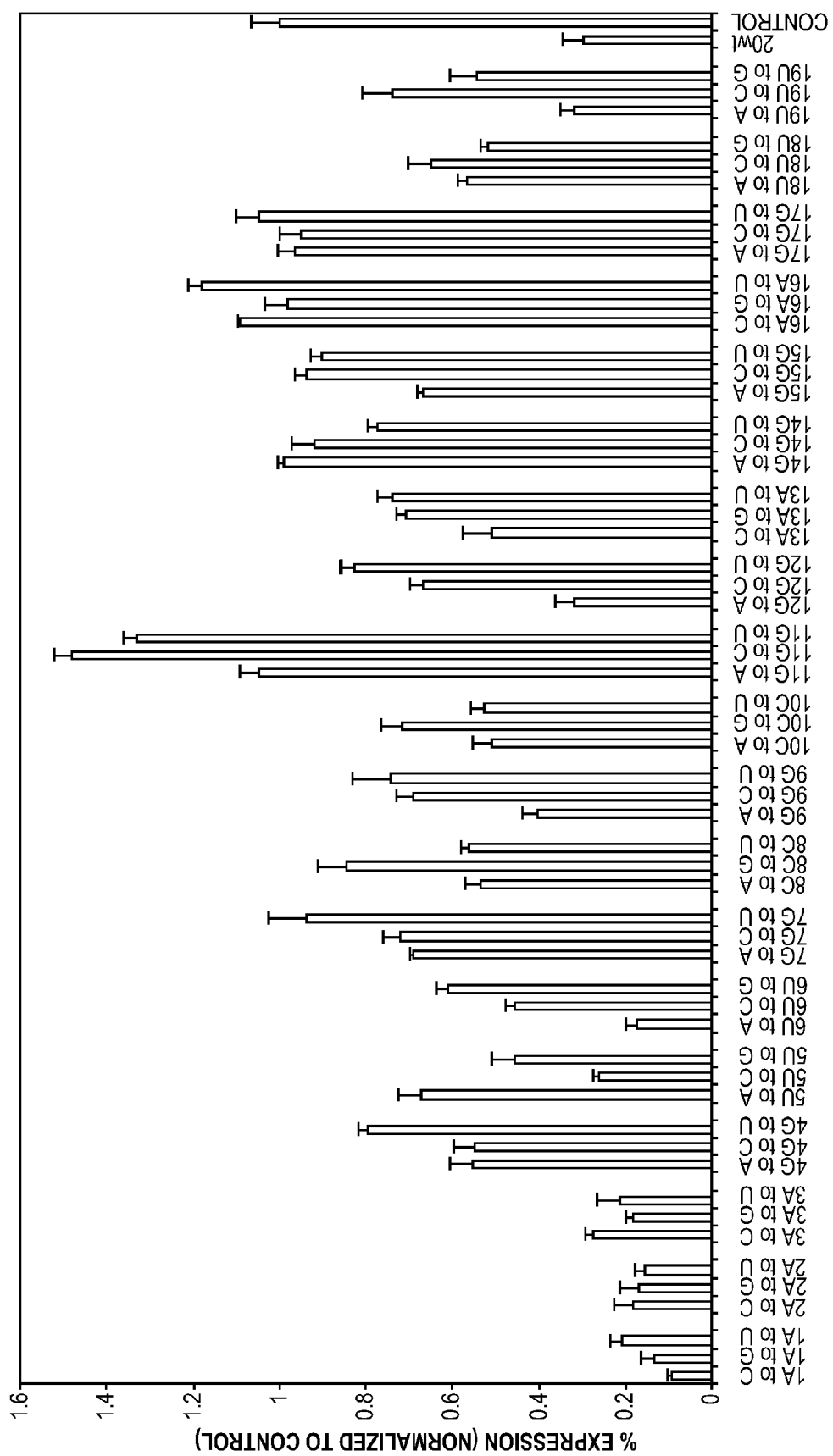
FIG. 7 is a histogram showing the differences in duplex functionality upon introduction of basepair mismatches. The X-axis shows the mismatch introduced inot the siRNA and the position it is introduced (e.g., 8C–>A reveals that position 8 (which normally has a C) has been changed to an A). The Y-axis is "% Silencing (Normalized to Control)."
Figure 8A:
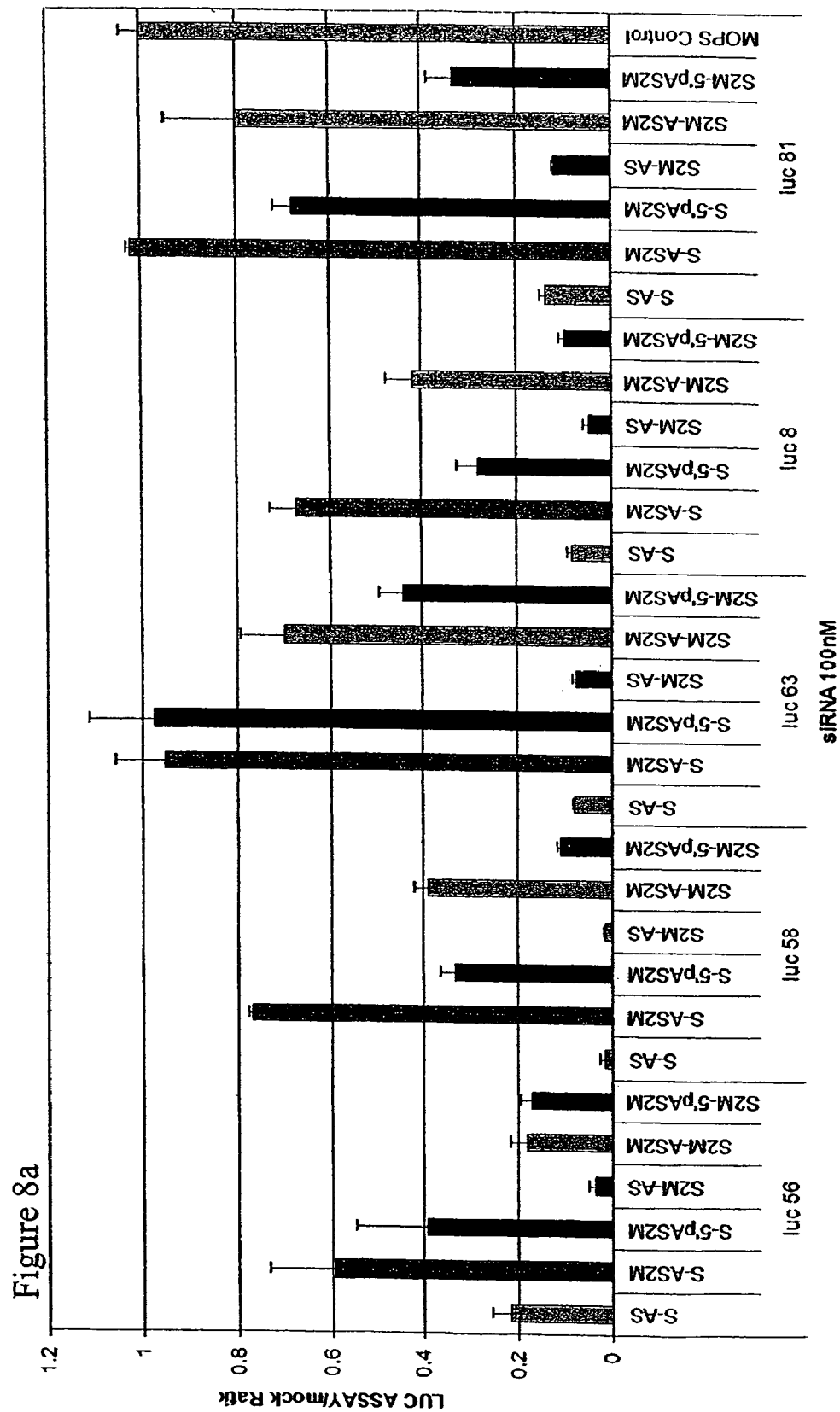
FIG. 8a is histogram that shows the effects of 5' sense and antisense strand modification with 2'-O-methylation on functionality.

Both chemical modifications and base-pair mismatches can be incorporated into siRNA to alter the duplex's AISP and functionality. For instance, introduction of mismatches at positions 1 or 2 of the sense strand destabilized the 5' end of the sense strand and increases the functionality of the molecule (see Luc, FIG. 7). Similarly, addition of 2'-O-methyl groups to positions 1 and 2 of the sense strand can also alter the AISP and (as a result) increase both the functionality of the molecule and eliminate off-target effects that results from sense strand homology with the unrelated targets (FIGS. 8*a*, 8*b*).

Rationale for Criteria in a Biological Context

The fate of siRNA in the RNAi pathway may be described in 5 major steps: (1) duplex recognition and pre-RISC complex formation; (2) ATP-dependent duplex unwinding/strand selection and RISC activation; (3) mRNA target identification; (4) mRNA cleavage, and (5) product release (FIG. 1). Given the level of nucleic acid-protein interactions at each step, siRNA functionality is likely influenced by specific biophysical and molecular properties that promote efficient interactions within the context of the multi-component complexes. Indeed, the systematic analysis of the siRNA test set identified multiple factors that correlate well with functionality. When combined into a single algorithm, they proved to be very effective in selecting active siRNAs.

The factors described here may also be predictive of key functional associations important for each step in RNAi. For example, the potential formation of internal hairpin structures correlated negatively with siRNA functionality. Complementary strands with stable internal repeats are more likely to exist as stable hairpins thus decreasing the effective concentration of the functional duplex form. This suggests that the duplex is the preferred conformation for initial pre-RISC association. Indeed, although single complementary strands can induce gene silencing, the effective concentration required is at least two orders of magnitude higher than that of the duplex form.

siRNA-pre-RISC complex formation is followed by an ATP-dependent duplex unwinding step and "activation" of the RISC. The siRNA functionality was shown to correlate with overall low internal stability of the duplex and low internal stability of the 3' sense end (or differential internal stability of the 3' sense compare to the 5' sense strand), which may reflect strand selection and entry into the RISC. Overall duplex stability and low internal stability at the 3' end of the sense strand were also correlated with siRNA functionality. Interestingly, siRNAs with very high and very low overall stability profiles correlate strongly with non-functional duplexes. One interpretation is that high internal stability prevents efficient unwinding while very low stability reduces siRNA target affinity and subsequent mRNA cleavage by the RISC.

Several criteria describe base preferences at specific positions of the sense strand and are even more intriguing when considering their potential mechanistic roles in target recognition and mRNA cleavage. Base preferences for A at position 19 of the sense strand but not C, are particularly interesting because they reflect the same base preferences observed for naturally occurring miRNA precursors. That is, among the reported miRNA precursor sequences 75% contain a U at position 1 which corresponds to an A in position 19 of the sense strand of siRNAs, while G was under-represented in this same position for miRNA precursors. These observations support the hypothesis that both miRNA precursors and siRNA duplexes are processed by very similar if not identical protein machinery. The functional interpretation of the predominance of a U/A basepair is that it promotes flexibility at the 5' antisense ends of both siRNA duplexes and miRNA precursors and facilitates efficient unwinding and selective strand entrance into an activated RISC.

Among the criteria associated with base preferences that are likely to influence mRNA cleavage or possibly product release, the preference for U at position 10 of the sense strand exhibited the greatest impact, enhancing the probability of selecting an F80 sequence by 13.3%. Activated RISC preferentially cleaves target mRNA between nucleotides 10 and 11 relative to the 5' end of the complementary targeting strand. Therefore, it may be that U, the preferred base for most endoribonucleases, at this position supports more efficient cleavage. Alternatively, a U/A bp between the targeting siRNA strand and its cognate target mRNA may create an optimal conformation for the RISC-associated "slicing" activity.

Pooling

According to another embodiment, the present invention provides a pool of at least two siRNAs, preferably in the form of a kit or therapeutic reagent, wherein one strand of each of the siRNAs, the sense strand comprises a sequence that is substantially similar to a sequence within a target mRNA. The opposite strand, the antisense strand, will preferably comprise a sequence that is substantially complementary to that of the target mRNA. More preferably, one strand of each siRNA will comprise a sequence that is identical to a sequence that is contained in the target mRNA. Most preferably, each siRNA will be 19 base pairs in length, and one strand of each of the siRNAs will be 100% complementary to a portion of the target mRNA.

By increasing the number of siRNAs directed to a particular target using a pool or kit, one is able both to increase the likelihood that at least one siRNA with satisfactory functionality will be included, as well as to benefit from additive or synergistic effects. Further, when two or more siRNAs directed against a single gene do not have satisfactory levels of functionality alone, if combined, they may satisfactorily promote degradation of the target messenger RNA and successfully inhibit translation. By including multiple siRNAs in the system, not only is the probability of silencing increased, but the economics of operation are also improved when compared to adding different siRNAs sequentially. This effect is contrary to the conventional wisdom that the concurrent use of multiple siRNA will negatively impact gene silencing (e.g. Holen, T. et al. (2003) "Similar behavior of single strand and double strand siRNAs suggests they act through a common RNAi pathway." NAR 31: 2401-21407).

In fact, when two siRNAs were pooled together, 54% of the pools of two siRNAs induced more than 95% gene silencing. Thus, a 2.5-fold increase in the percentage of functionality was achieved by randomly combining two siRNAs. Further, over 84% of pools containing two siRNAs induced more than 80% gene silencing.

More preferably, the kit is comprised of at least three siRNAs, wherein one strand of each siRNA comprises a sequence that is substantially similar to a sequence of the target mRNA and the other strand comprises a sequence that is substantially complementary to the region of the target mRNA. As with the kit that comprises at least two siRNAs, more preferably one strand will comprise a sequence that is identical to a sequence that is contained in the mRNA and another strand that is 100% complementary to a sequence that is contained in the mRNA. During experiments, when three siRNAs were combined together, 60% of the pools induced more than 95% gene silencing and 92% of the pools induced more than 80% gene silencing.

Further, even more preferably, the kit is comprised of at least four siRNAs, wherein one strand of each siRNA comprises a sequence that is substantially similar to a region of the sequence of the target mRNA, and the other strand comprises a sequence that is substantially complementary to the region of the target mRNA. As with the kit or pool that comprises at least two siRNAs, more preferably one strand of each of the siRNA duplexes will comprise a sequence that is identical to a sequence that is contained in the mRNA, and another strand that is 100% complementary to a sequence that is contained in the mRNA.

Additionally, kits and pools with at least five, at least six, and at least seven siRNAs may also be useful with the present invention. For example, pools of five siRNA induced 95% gene silencing with 77% probability and 80% silencing with 98.8% probability. Thus, pooling of siRNAs together can result in the creation of a target-specific silencing reagent with almost a 99% probability of being functional. The fact that such high levels of success are achievable using such pools of siRNA, enables one to dispense with costly and time-consuming target-specific validation procedures.

For this embodiment, as well as the other aforementioned embodiments, each of the siRNAs within a pool will preferably comprise between 18 and 30 base pairs, more preferably between 18 and 25 base pairs, and most preferably 19 base pairs. Within each siRNA, preferably at least 18 contiguous bases of the antisense strand will be 100% complementary to the target mRNA. More preferably, at least 19 contiguous bases of the antisense strand will be 100% complementary to the target mRNA. Additionally, there may be overhangs on either the sense strand or the antisense strand, and these overhangs may be at either the 5' end or the 3' end of either of the strands, for example there may be one or more overhangs of 1-6 bases. When overhangs are present, they are not included in the calculation of the number of base pairs. The two nucleotide 3' overhangs mimic natural siRNAs and are commonly used but are not essential. Preferably, the overhangs should consist of two nucleotides, most often dTdT or UU at the 3' end of the sense and antisense strand that are not complementary to the target sequence. The siRNAs may be produced by any method that is now known or that comes to be known for synthesizing double stranded RNA that one skilled in the art would appreciate would be useful in the present invention. Preferably, the siRNAs will be produced by Dharmacon's proprietary ACE® technology. However, other methods for synthesizing siRNAs are well known to persons skilled in the art and include, but are not limited to, any chemical synthesis of RNA oligonucleotides, ligation of shorter oligonucleotides, in vitro transcription of RNA oligonucleotides, the use of vectors for expression within cells, recombinant Dicer products and PCR products.

The siRNA duplexes within the aforementioned pools of siRNAs may correspond to overlapping sequences within a particular mRNA, or non-overlapping sequences of the mRNA. However, preferably they correspond to non-overlapping sequences. Further, each siRNA may be selected randomly, or one or more of the siRNA may be selected according to the criteria discussed above for maximizing the effectiveness of siRNA.

Included in the definition of siRNAs are siRNAs that contain substituted and/or labeled nucleotides that may, for example, be labeled by radioactivity, fluorescence or mass. The most common substitutions are at the 2' position of the ribose sugar, where moieties such as H (hydrogen) F, $NH_3$, $OCH_3$ and other O- alkyl, alkenyl, alkynyl, and orthoesters, may be substituted, or in the phosphorous backbone, where sulfur, amines or hydrocarbons may be substituted for the bridging of non-bridging atoms_in the phosphodiester bond. Examples of modified siRNAs are explained more fully in commonly assigned U.S. patent application Ser. No. 10/613, 077, filed Jul. 1, 2003, which is incorporated by reference herein.

Additionally, as noted above, the cell type into which the siRNA is introduced may affect the ability of the siRNA to enter the cell; however, it does not appear to affect the ability of the siRNA to function once it enters the cell. Methods for introducing double-stranded RNA into various cell types are well known to persons skilled in the art.

As persons skilled in the art are aware, in certain species, the presence of proteins such as RdRP, the RNA-dependent RNA polymerase, may catalytically enhance the activity of the siRNA. For example, RdRP propagates the RNAi effect in *C. elegans* and other non-mammalian organisms. In fact, in organisms that contain these proteins, the siRNA may be inherited. Two other proteins that are well studied and known to be a part of the machinery are members of the Argonaute family and Dicer, as well as their homologues. There is also initial evidence that the RISC complex might be associated with the ribosome so the more efficiently translated mRNAs will be more susceptible to silencing than others.

Another very important factor in the efficacy of siRNA is mRNA localization. In general, only cytoplasmic mRNAs are considered to be accessible to RNAi to any appreciable degree. However, appropriately designed siRNAs, for example, siRNAs modified with internucleotide linkages, may be able to cause silencing by acting in the nucleus. Examples of these types of modifications are described in commonly assigned U.S. patent application Ser. Nos. 10/431, 027 and 10/613,077, each of which is incorporated by reference herein.

As described above, even when-one selects at least two siRNAs at random, the effectiveness of the two may be greater than one would predict based on the effectiveness of two individual siRNAs. This additive or synergistic effect is particularly noticeable as one increases to at least three siRNAs, and even more noticeable as one moves to at least four siRNAs. Surprisingly, the pooling of the non-functional and semi-functional siRNAs, particularly more than five siRNAs, can lead to a silencing mixture that is as effective if not more effective than any one particular functional siRNA.

Within the kit of the present invention, preferably each siRNA will be present in a concentration of between 0.001 and 200 µM, more preferably between 0.01 and 200 nM, and most preferably between 0.1 and 10 nM.

In addition to preferably comprising at least four or five siRNAs, the kit of the present invention will also preferably comprise a buffer to keep the siRNA duplex stable. Persons skilled in the art are aware of buffers suitable for keeping siRNA stable. For example, the buffer may be comprised of 100 mM KCl, 30 mM HEPES-pH 7.5, and 1 mM $MgCl_2$. Alternatively, kits might contain complementary strands that contain any one of a number of chemical modifications (e.g. a 2'-O-ACE) that protect the agents from degradation by nucleases. In this instance, the user may (or may not) remove the modifying protective group (e.g. deprotect, before annealing the two complementary strands together.

By way of example, the kit may be organized such that pools of siRNA duplexes are provided on an array or microarray of wells or drops for a particular gene set or for unrelated genes. The array may, for example, be in 96 wells, 384 wells or 1284 wells arrayed in a plastic plate or on a glass slide using techniques now known or that come to be known to persons skilled in the art. Within an array, preferably there will be controls such as functional anti-lamin A/C, cyclophilin and two siRNA duplexes that are not specific to the gene of interest.

In order to ensure stability of the siRNA pools prior to usage, they may be retained in lyophilized form at minus twenty degrees (−20° C.) until they are ready for use. Prior to usage, they should be resuspended; however, even once resuspended, for example, in the aforementioned buffer, they should be kept at minus twenty degrees, (−20° C.) until used. The aforementioned buffer, prior to use, may be stored at approximately 4° C. or room temperature. Effective temperatures at which to conduct transfections are well known to persons skilled in the art and include for example, room temperature.

The kit may be applied either in vivo or in vitro. Preferably, the siRNA of the pools or kits is applied to a cell through transfection, employing standard transfection protocols. These methods are well known to persons skilled in the art and include the use of lipid-based carriers, electroporation, cationic carriers, and microinjection. Further, one could apply the present invention by synthesizing equivalent DNA sequences (either as two separate, complementary strands, or as hairpin molecules) instead of siRNA sequences and introducing them into cells through vectors. Once in the cells, the cloned DNA could be transcribed, thereby forcing the cells to generate the siRNA. Examples of vectors suitable for use with the present application include but are not limited to the standard transient expression vectors, adenoviruses, retroviruses, lentivirus-based vectors, as well as other traditional expression vectors. Any vector that has an adequate siRNA expression and procession module may be used. Furthermore, certain chemical modifications to siRNAs, including but not limited to conjugations to other molecules, may be used to facilitate delivery. For certain applications it may be preferable to deliver molecules without transfection by simply formulating in a physiological acceptable solution.

This embodiment may be used in connection with any of the aforementioned embodiments. Accordingly, the sequences within any pool may be selected by rational design.

Multigene Silencing

In addition to developing kits that contain multiple siRNA directed against a single gene, another embodiment includes the use of multiple siRNA targeting multiple genes. Multiple genes may be targeted through the use of high- or hyper-functional siRNA. High- or hyper-functional siRNA that exhibit increased potency, require lower concentrations to induce desired phenotypic (and thus therapeutic) effects. This circumvents RISC saturation. It therefore reasons that if lower concentrations of a single siRNA are needed for knockout or knockdown expression of one gene, then the remaining (uncomplexed) RISC will be free and available to interact with siRNA directed against two, three, four, or more, genes. Thus in this embodiment, the authors describe the use of highly functional or hyper-functional siRNA to knock out three separate genes. More preferably, such reagents could be combined to knockout four distinct genes. Even more preferably, highly functional or hyperfunctional siRNA could be used to knock out five distinct genes. Most preferably, siRNA of this type could be used to knockout or knockdown the expression of six or more genes.

Hyperfunctional siRNA

The term hyperfunctional siRNA (hf-siRNA) describes a subset of the siRNA population that induces RNAi in cells at low- or sub-nanomolar concentrations for extended periods of time. These traits, heightened potency and extended longevity of the RNAi phenotype, are highly attractive from a therapeutic standpoint. Agents having higher potency require lesser amounts of the molecule to achieve the desired physiological response, thus reducing the probability of side effects due to "off-target" interference. In addition to the potential therapeutic benefits associated with hyperfunctional siRNA, hf-siRNA are also desirable from an economic position. Hyperfunctional siRNA may cost less on a per-treatment basis, thus reducing the overall expenditures to both the manufacturer and the consumer.

Figure 9:
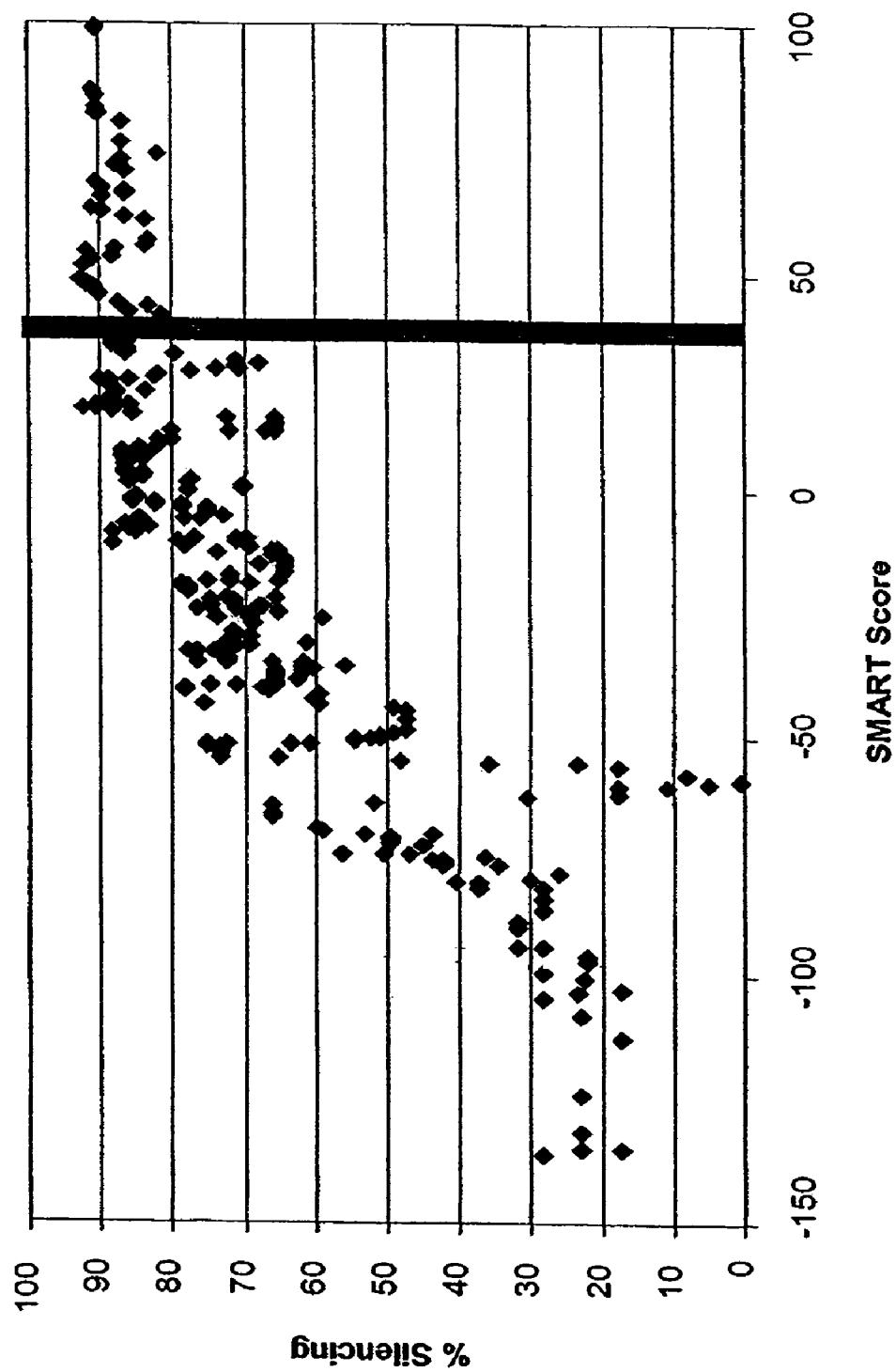
FIG. 9 shows a graph of SMARTscores™ versus RNAi silencing values for more than 360 siRNA directed against 30 different genes. SiRNA to the right of the vertical bar represent those siRNA that have desirable SMARTscores™.

Identification of hyperfunctional siRNA involves multiple steps that are designed to examine an individual siRNA agent's concentration- and/or longevity-profiles. In one non-limiting example, a population of siRNA directed against a single gene are first analyzed using the previously described algorithm (Formula VIII). Individual siRNA are then introduced into a test cell line and assessed for the ability to degrade the target mRNA. It is important to note that when performing this step it is not necessary to test all of the siRNA. Instead, it is sufficient to test only those siRNA having the highest SMARTscores™ (i.e. SMARTscore™>−10). Subsequently, the gene silencing data is plotted against the SMARTscores™ (see FIG. 9). siRNA that (1) induce a high degree of gene silencing (i.e. they induce greater than 80% gene knockdown) and (2) have superior SMARTscores™ (i.e. a SMARTscore™ of >−10, suggesting a desirable average internal stability profile) are selected for further investigations designed to better understand the molecule's potency and longevity. In one, non-limiting study dedicated to understanding a molecule's potency, an siRNA is introduced into one (or more) cell types in increasingly diminishing concentrations (e.g. 3.0→0.3 nM). Subsequently, the level of gene silencing induced by each concentration is examined and siRNA that exhibit hyperfunctional potency (i.e. those that induce 80% silencing or greater at e.g. picomolar concentrations) are identified. In a second study, the longevity profiles of siRNA having high (>−10) SMARTscores™ and greater than 80% silencing are examined. In one non-limiting example of how this is achieved, siRNA are introduced into a test cell line and the levels of RNAi are measured over an extended period of time (e.g. 24-168 hrs). SiRNAs that exhibit strong RNA interference patterns (i.e. >80% interference) for periods of time greater than, e.g., 120 hours are thus identified. Studies similar to those described above can be performed on any and all of the >$10^6$ siRNA included in this document to further define the most functional molecule for any given gene. Molecules possessing one or both properties (extended longevity and heightened potency) are labeled "hyperfunctional siRNA," and earmarked as candidates for future therapeutic studies.

While the example(s) given above describe on means by which hyperfunctional siRNA can be isolated, neither the assays themselves nor the selection parameters used are rigid and can vary with each family of siRNA. Families of siRNA include siRNAs directed against a single gene, or directed against a related family of genes.

The highest quality siRNA achievable for any given gene may vary considerably. Thus, for example, in the case of one gene (gene X), rigorous studies such as those described above may enable the identification of an siRNA that, at picomolar concentrations, induces $99^+$% silencing for a period of 10 days. Yet identical studies of a second gene (gene Y) may yield an siRNA that at high nanomolar concentrations (e.g. 100 nM) induces only 75% silencing for a period of 2 days. Both molecules represent the very optimum siRNA for their respective gene targets and therefore are designated "hyperfunctional." Yet due to a variety of factors including but not limited to target concentration, siRNA stability, cell type, off-target interference, and others, equivalent levels of potency and longevity are not achievable. Thus, for these reasons, the parameters described in the before mentioned assays, can vary. While the initial screen selected siRNA that had SMARTscores™ above −10 and a gene silencing capability of greater than 80%, selections that have stronger (or weaker) parameters can be implemented. Similarly, in the subsequent studies designed to identify molecules with high potency and longevity, the desired cutoff criteria (i.e. the lowest concentration that induces a desirable level of interference, or the longest period of time that interference can be observed) can vary. The experimentation subsequent to application of the rational criteria of this application is significantly reduced where one is trying to obtain a suitable hyperfunctional siRNA for, for example, therapeutic use. When, for example, the additional experimentation of the type described herein is applied by one skilled in the art with this disclosure in hand, a hyperfunctional siRNA is readily identified.

The siRNA may be introduced into a cell by any method that is now known or that comes to be known and that from reading this disclosure, persons skilled in the art would determine would be useful in connection with the present invention in enabling siRNA to cross the cellular membrane. These methods include, but are not limited to, any manner of transfection, such as for example transfection employing DEAE-Dextran, calcium phosphate, cationic lipids/liposomes, micelles, manipulation of pressure, microinjection, electroporation, immunoporation, use of vectors such as viruses, plasmids, cosmids, bacteriophages, cell fusions, and coupling of the polynucleotides to specific conjugates or ligands such as antibodies, antigens, or receptors, passive introduction, adding moieties to the siRNA that facilitate its uptake, and the like.

Having described the invention with a degree of particularity, examples will now be provided. These examples are not intended to and should-not be construed to limit the scope of the claims in any way.

EXAMPLES

General Techniques and Nomenclatures siRNA nomenclature. All siRNA duplexes are referred to by sense strand. The first nucleotide of the 5'-end of the sense strand is position 1, which corresponds to position 19 of the antisense strand for a 19-mer. In most cases, to compare results from different experiments, silencing was determined by measuring specific transcript mRNA levels or enzymatic activity associated with specific transcript levels, 24 hours post-transfection, with siRNA concentrations held constant at 100 nM. For all experiments, unless otherwise specified transfection efficiency was ensured to be over 95%, and no detectable cellular toxicity was observed. The following system of nomenclature was used to compare and report siRNA-silencing functionality: "F" followed by the degree of minimal knockdown. For example, F50 signifies at least 50% knockdown, F80 means at least 80%, and so forth. For this study, all sub-F50 siRNAs were considered non-functional.

Cell culture and transfection. 96-well plates are coated with 50 µl of 50 mg/ml poly-L-lysine (Sigma) for 1 hr, and then washed 3× with distilled water before being dried for 20 min. HEK293 cells or HEK293Lucs or any other cell type of interest are released from their solid support by trypsinization, diluted to $3.5 \times 10^5$ cells/ml, followed by the addition of 100 µL of cells/well. Plates are then incubated overnight at 37° C., 5% $CO_2$ Transfection procedures can vary widely depending on the cell type and transfection reagents. In one non-limiting example, a transfection mixture consisting of 2 mL Opti-MEM I (Gibco-BRL), 80 µl Lipofectamine 2000 (Invitrogen), 15 µL SUPERNasin at 20 U/µl (Ambion), and 1.5 µl of reporter gene plasmid at 1 µg/µl is prepared in 5-ml polystyrene round bottom tubes. 100 µl of transfection reagent is then combined with 100 µl of siRNAs in polystyrene deep-well titer plates (Beckman) and incubated for 20 to 30 min at room temp. 550 µl of Opti-MEM is then added to each well to bring the final siRNA concentration to 100 nM. Plates are then sealed with parafilm and mixed. Media is removed from HEK293 cells and replaced with 95 µl of transfection mixture. Cells are incubated overnight at 37° C., 5% $CO_2$.

Quantification of gene knockdown. A variety of quantification procedures can be used to measure the level of silencing induced by siRNA or siRNA pools. In one non-limiting example: to measure mRNA levels 24 hrs post-transfection, QuantiGene branched-DNA (bDNA) kits (Bayer) (Wang, et al, *Regulation of insulin preRNA splicing by glucose*. Proc Natl Acad Sci 1997, 94:4360.) are used according to manufacturer instructions. To measure luciferase activity, media is removed from HEK293 cells 24 hrs post-transfection, and 50 µl of Steady-GLO reagent (Promega) is added. After 5 min. plates are analyzed on a plate reader.

Example I

Sequences Used to Develop the Algorithm

Anti-Firefly and anti-Cyclophilin siRNAs panels (FIG. 5*a*, *b*) sorted according to using Formula VIII predicted values. All siRNAs scoring more than 0 (formula VIII) and more then 20 (formula DC) are fully functional. All ninety sequences for each gene (and DBI) appear below in Table III.

TABLE III

| | | | | |
|---|---|---|---|---|
| Cyclo | 1 | SEQ. ID 0032 | GUUCCAAAAACAGUGGAUA |
| Cyclo | 2 | SEQ. ID 0033 | UCCAAAAACAGUGGAUAAU |
| Cyclo | 3 | SEQ. ID 0034 | CAAAAACAGUGGAUAAUUU |
| Cyclo | 4 | SEQ. ID 0035 | AAAACAGUGGAUAAUUUUG |
| Cyclo | 5 | SEQ. ID 0036 | AACAGUGGAUAAUUUUGUG |
| Cyclo | 6 | SEQ. ID 0037 | CAGUGGAUAAUUUUGUGGC |
| Cyclo | 7 | SEQ. ID 0038 | GUGGAUAAUUUUGUGGCCU |
| Cyclo | 8 | SEQ. ID 0039 | GGAUAAUUUUGUGGCCUUA |
| Cyclo | 9 | SEQ. ID 0040 | AUAAUUUUGUGGCCUUAGC |
| Cyclo | 10 | SEQ. ID 0041 | AAUUUUGUGGCCUUAGCUA |
| Cyclo | 11 | SEQ. ID 0042 | UUUUGUGGCCUUAGCUACA |
| Cyclo | 12 | SEQ. ID 0043 | UUGUGGCCUUAGCUACAGG |
| Cyclo | 13 | SEQ. ID 0044 | GUGGCCUUAGCUACAGGAG |
| Cyclo | 14 | SEQ. ID 0045 | GGCCUUAGCUACAGGAGAG |
| Cyclo | 15 | SEQ. ID 0046 | CCUUAGCUACAGGAGAGAA |
| Cyclo | 16 | SEQ. ID 0047 | UUAGCUACAGGAGAGAAAG |
| Cyclo | 17 | SEQ. ID 0048 | AGCUACAGGAGAGAAAGGA |
| Cyclo | 18 | SEQ. ID 0049 | CUACAGGAGAGAAAGGAUU |
| Cyclo | 19 | SEQ. ID 0050 | ACAGGAGAGAAAGGAUUUG |
| Cyclo | 20 | SEQ. ID 0051 | AGGAGAGAAAGGAUUUGGC |
| Cyclo | 21 | SEQ. ID 0052 | GAGAGAAAGGAUUUGGCUA |
| Cyclo | 22 | SEQ. ID 0053 | GAGAAAGGAUUUGGCUACA |
| Cyclo | 23 | SEQ. ID 0054 | GAAAGGAUUUGGCUACAAA |
| Cyclo | 24 | SEQ. ID 0055 | AAGGAUUUGGCUACAAAAA |
| Cyclo | 25 | SEQ. ID 0056 | GGAUUUGGCUACAAAAACA |
| Cyclo | 26 | SEQ. ID 0057 | AUUUGGCUACAAAAACAGC |
| Cyclo | 27 | SEQ. ID 0058 | UUGGCUACAAAAACAGCAA |
| Cyclo | 28 | SEQ. ID 0059 | GGCUACAAAAACAGCAAAU |
| Cyclo | 29 | SEQ. ID 0060 | CUACAAAAACAGCAAAUUC |
| Cyclo | 30 | SEQ. ID 0061 | ACAAAAACAGCAAAUUCCA |
| Cyclo | 31 | SEQ. ID 0062 | AAAAACAGCAAAUUCCAUC |
| Cyclo | 32 | SEQ. ID 0063 | AAACAGCAAAUUCCAUCGU |

TABLE III-continued

| | | | |
|---|---|---|---|
| Cyclo | 33 | SEQ. ID 0064 | ACAGCAAAUUCCAUCGUGU |
| Cyclo | 34 | SEQ. ID 0065 | AGCAAAUUCCAUCGUGUAA |
| Cyclo | 35 | SEQ. ID 0066 | CAAAUUCCAUCGUGUAAUC |
| Cyclo | 36 | SEQ. ID 0067 | AAUUCCAUCGUGUAAUCAA |
| Cyclo | 37 | SEQ. ID 0068 | UUCCAUCGUGUAAUCAAGG |
| Cyclo | 38 | SEQ. ID 0069 | CCAUCGUGUAAUCAAGGAC |
| Cyclo | 39 | SEQ. ID 0070 | AUCGUGUAAUCAAGGACUU |
| Cyclo | 40 | SEQ. ID 0071 | CGUGUAAUCAAGGACUUCA |
| Cyclo | 41 | SEQ. ID 0072 | UGUAAUCAAGGACUUCAUG |
| Cyclo | 42 | SEQ. ID 0073 | UAAUCAAGGACUUCAUGAU |
| Cyclo | 43 | SEQ. ID 0074 | AUCAAGGACUUCAUGAUCC |
| Cyclo | 44 | SEQ. ID 0075 | CAAGGACUUCAUGAUCCAG |
| Cyclo | 45 | SEQ. ID 0076 | AGGACUUCAUGAUCCAGGG |
| Cyclo | 46 | SEQ. ID 0077 | GACUUCAUGAUCCAGGGCG |
| Cyclo | 47 | SEQ. ID 0078 | CUUCAUGAUCCAGGGCGGA |
| Cyclo | 48 | SEQ. ID 0079 | UCAUGAUCCAGGGCGGAGA |
| Cyclo | 49 | SEQ. ID 0080 | AUGAUCCAGGGCGGAGACU |
| Cyclo | 50 | SEQ. ID 0081 | GAUCCAGGGCGGAGACUUC |
| Cyclo | 51 | SEQ. ID 0082 | HCCAGGGCGGAGACUUCAC |
| Cyclo | 52 | SEQ. ID 0083 | CAGGGCGGAGACUUCACCA |
| Cyclo | 53 | SEQ. ID 0084 | GGGCGGAGACUUCACCAGG |
| Cyclo | 54 | SEQ. ID 0085 | GCGGAGACUUCACCAGGGG |
| Cyclo | 55 | SEQ. ID 0086 | GGAGACUUCACCAGGGGAG |
| Cyclo | 56 | SEQ. ID 0087 | AGACUUCACCAGGGGAGAU |
| Cyclo | 57 | SEQ. ID 0088 | ACUUCACCAGGGGAGAUGG |
| Cyclo | 58 | SEQ. ID 0089 | UUCACCAGGGGAGAUGGCA |
| Cyclo | 59 | SEQ. ID 0090 | CACCAGGGGAGAUGGCACA |
| Cyclo | 60 | SEQ. ID 0091 | CCAGGGGAGAUGGCACAGG |
| Cyclo | 61 | SEQ. ID 0092 | AGGGGAGAUGGCACAGGAG |
| Cyclo | 62 | SEQ. ID 0093 | GGGAGAUGGCACAGGAGGA |
| Cyclo | 63 | SEQ. ID 0094 | GAGAUGGCACAGGAGGAAA |
| Cyclo | 64 | SEQ. ID 0095 | GAUGGCACAGGAGGAAAGA |
| Cyclo | 65 | SEQ. ID 0094 | UGGCACAGGAGGAAAGAGC |
| Cyclo | 66 | SEQ. ID 0096 | GCACAGGAGGAAAGAGCAU |
| Cyclo | 67 | SEQ. ID 0097 | ACAGGAGGAAAGAGCAUCU |
| Cyclo | 68 | SEQ. ID 0098 | AGGAGGAAAGAGCAUCUAC |
| Cyclo | 69 | SEQ. ID 0099 | GAGGAAAGAGCAUCUACGG |
| Cyclo | 70 | SEQ. ID 0100 | GGAAAGAGCAUCUACGGUG |
| Cyclo | 71 | SEQ. ID 0101 | AAAGAGCAUCUACGGUGAG |
| Cyclo | 72 | SEQ. ID 0102 | AGAGCAUCUACGGUGAGCG |
| Cyclo | 73 | SEQ. ID 0103 | AGCAUCUACGGUGAGCGCU |
| Cyclo | 74 | SEQ. ID 0104 | CAUCUACGGUGAGCGCUUC |
| Cyclo | 75 | SEQ. ID 0105 | UCUACGGUGAGCGCUUCCC |
| Cyclo | 76 | SEQ. ID 0106 | UACGGUGAGCGCUUCCCCG |
| Cyclo | 77 | SEQ. ID 0107 | CGGUGAGCGCUUCCCCGAU |
| Cyclo | 78 | SEQ. ID 0108 | GUGAGCGCUUCCCCGAUGA |
| Cyclo | 79 | SEQ. ID 0109 | GAGCGCUUCCCCGAUGAGA |
| Cyclo | 80 | SEQ. ID 0110 | GCGCUUCCCCGAUGAGAAC |
| Cyclo | 81 | SEQ. ID 0111 | GCUUCCCCGAUGAGAACUU |
| Cyclo | 82 | SEQ. ID 0112 | UUCCCCGAUGAGAACUUCA |
| Cyclo | 83 | SEQ. ID 0113 | CCCCGAUGAGAACUUCAAA |
| Cyclo | 84 | SEQ. ID 0114 | CCGAUGAGAACUUCAAACU |
| Cyclo | 85 | SEQ. ID 0115 | GAUGAGAACUUCAAACUGA |
| Cyclo | 86 | SEQ. ID 0116 | UGAGAACUUCAAACUGAAG |
| Cyclo | 87 | SEQ. ID 0117 | AGAACUUCAAACUGAAGCA |
| Cyclo | 88 | SEQ. ID 0118 | AACUUCAAACUGAAGCACU |
| Cyclo | 89 | SEQ. ID 0119 | CUUCAAACUGAAGCACUAC |
| Cyclo | 90 | SEQ. ID 0120 | UCAAACUGAAGCACUACGG |
| DB | 1 | SEQ. ID 0121 | ACGGGCAAGGCCAAGUGGG |
| DB | 2 | SEQ. ID 0122 | CGGGCAAGGCCAAGUGGGA |
| DB | 3 | SEQ. ID 0123 | GGGCAAGGCCAAGUGGGAU |
| DB | 4 | SEQ. ID 0124 | GGCAAGGCCAAGUGGGAUG |
| DB | 5 | SEQ. ID 0125 | GCAAGGCCAAGUGGGAUGC |
| DB | 6 | SEQ. ID 0126 | CAAGGCCAAGUGGGAUGCC |
| DB | 7 | SEQ. ID 0127 | AAGGCCAAGUGGGAUGCCU |
| DB | 8 | SEQ. ID 0128 | AGGCCAAGUGGGAUGCCUG |
| DB | 9 | SEQ. ID 0129 | GGCCAAGUGGGAUGCCUGG |
| DB | 10 | SEQ. ID 0130 | GCCAAGUGGGAUGCCUGGA |
| DB | 11 | SEQ. ID 0131 | CCAAGUGGGAUGCCUGGAA |
| DB | 12 | SEQ. ID 0132 | CAAGUGGGAUGCCUGGAAU |
| DB | 13 | SEQ. ID 0133 | AAGUGGGAUGCCUGGAAUG |
| DB | 14 | SEQ. ID 0134 | AGUGGGAUGCCUGGAAUGA |
| DB | 15 | SEQ. ID 0135 | GUGGGAUGCCUGGAAUGAG |
| DB | 16 | SEQ. ID 0136 | UGGGAUGCCUGGAAUGAGC |
| DB | 17 | SEQ. ID 0137 | GGGAUGCCUGGAAUGAGCU |
| DB | 18 | SEQ. ID 0138 | GGAUGCCUGGAAUGAGCUG |
| DB | 19 | SEQ. ID 0139 | GAUGCCUGGAAUGAGCUGA |
| DB | 20 | SEQ. ID 0140 | AUGCCUGGAAUGAGCUGAA |
| DB | 21 | SEQ. ID 0141 | UGCCUGGAAUGAGCUGAAA |

TABLE III-continued

| | | | |
|---|---|---|---|
| DB | 22 | SEQ. ID 0142 | GCCUGGAAUGAGCUGAAAG |
| DB | 23 | SEQ. ID 0143 | CCUGGAAUGAGCUGAAAGG |
| DB | 24 | SEQ. ID 0144 | CUGGAAUGAGCUGAAAGGG |
| DB | 25 | SEQ. ID 0145 | UGGAAUGAGCUGAAAGGGA |
| DB | 26 | SEQ. ID 0146 | GGAAUGAGCUGAAAGGGAC |
| DB | 27 | SEQ. ID 0147 | GAAUGAGCUGAAAGGGACU |
| DB | 28 | SEQ. ID 0148 | AAUGAGCUGAAAGGGACUU |
| DB | 29 | SEQ. ID 0149 | AUGAGCUGAAAGGGACUUC |
| DB | 30 | SEQ. ID 0150 | UGAGCUGAAAGGGACUUCC |
| DB | 31 | SEQ. ID 0151 | GAGCUGAAAGGCACUUCCA |
| DB | 32 | SEQ. ID 0152 | AGCUGAAAGGGACUUCCAA |
| DB | 33 | SEQ. ID 0153 | GCUGAAAGGGACUUCCAAG |
| DB | 34 | SEQ. ID 0154 | CUGAAAGGGACUUCCAAGG |
| DB | 35 | SEQ. ID 0155 | UGAAAGGGACUUCCAAGGA |
| DB | 36 | SEQ. ID 0156 | GAAAGGGACUUCCAAGGAA |
| DB | 37 | SEQ. ID 0157 | AAAGGGACUUCCAAGGAAG |
| DB | 38 | SEQ. ID 0158 | AAGGGACUUCCAAGGAAGA |
| DB | 39 | SEQ. ID 0159 | AGGGACUUCCAAGGAAGAU |
| DB | 40 | SEQ. ID 0160 | GGGACUUCCAAGGAAGAUG |
| DB | 41 | SEQ. ID 0161 | GGACUUCCAAGGAAGAUGC |
| DB | 42 | SEQ. ID 0162 | GACUUCCAAGGAAGAUGCC |
| DB | 43 | SEQ. ID 0163 | ACUUCCAAGGAAGAUGCCA |
| DB | 44 | SEQ. ID 0164 | CUUCCAAGGAAGAUGCCAU |
| DB | 45 | SEQ. ID 0165 | UUCCAAGGAAGAUGCCAUG |
| DB | 46 | SEQ. ID 0166 | UCCAAGGAAGAUGCCAUGA |
| DB | 47 | SEQ. ID 0167 | CCAAGGAAGAUGCCAUGAA |
| DB | 48 | SEQ. ID 0168 | GAAGGAAGAUGCCAUGAAA |
| DB | 49 | SEQ. ID 0169 | AAGGAAGAUGCCAUGAAAG |
| DB | 50 | SEQ. ID 0120 | AGGAAGAUGCCAUGAAAGC |
| DB | 51 | SEQ. ID 0171 | GGAAGAUGCCAUGAAAGCU |
| DB | 52 | SEQ. ID 0172 | GAAGAUGCCAUGAAAGCUU |
| DB | 53 | SEQ. ID 0173 | AAGAUGCCAUGAAAGCUUA |
| DB | 54 | SEQ. ID 0174 | AGAUGCCAUGAAAGCUUAC |
| DB | 55 | SEQ. ID 0175 | GAUGCCAUGAAAGCUUACA |
| DB | 56 | SEQ. ID 0176 | AUGCCAUGAAAGCUUACAU |
| DB | 57 | SEQ. ID 0177 | UGCCAUGAAAGCUUACAUC |
| DB | 58 | SEQ. ID 0178 | GCCAUGAAAGCUUACAUCA |
| DB | 59 | SEQ. ID 0179 | CCAUGAAAGCUUACAUCAA |
| DB | 60 | SEQ. ID 0180 | CAUGAAAGCUUACAUCAAC |
| DB | 61 | SEQ. ID 0181 | AUGAAAGCUUACAUCAACA |
| DB | 62 | SEQ. ID 0182 | UGAAAGCUUACAUCAACAA |
| DB | 63 | SEQ. ID 0183 | GAAAGCUUACAUCAACAAA |
| DB | 64 | SEQ. ID 0184 | AAAGCUUACAUCAACAAAG |
| DB | 65 | SEQ. ID 0185 | AAGCUUACAUCAACAAAGU |
| DB | 66 | SEQ. ID 0186 | AGCUUACAUCAACAAAGUA |
| DB | 67 | SEQ. ID 0187 | GCUUACAUCAACAAAGUAG |
| DB | 68 | SEQ. ID 0188 | CUUACAUCAACAAAGUAGA |
| DB | 69 | SEQ. ID 0189 | UUACAUCAACAAAGUAGAA |
| DB | 70 | SEQ. ID 0190 | UACAUCAACAAAGUAGAAG |
| DB | 71 | SEQ. ID 0191 | ACAUCAACAAAGUAGAAGA |
| DB | 72 | SEQ. ID 0192 | CAUCAACAAAGUAGAAGAG |
| DB | 73 | SEQ. ID 0193 | AUCAACAAAGUAGAAGAGC |
| DB | 74 | SEQ. ID 0194 | UCAACAAAGUAGAAGAGCU |
| DB | 75 | SEQ. ID 0195 | CAACAAAGUAGAAGAGCUA |
| DB | 76 | SEQ. ID 0196 | AACAAAGUAGAAGAGCUAA |
| DB | 77 | SEQ. ID 0197 | AGAAAGUAGAAGAGCUAAA |
| DB | 78 | SEQ. ID 0198 | CAAAGUAGAAGAGCUAAAG |
| DB | 79 | SEQ. ID 0199 | AAAGUAGAAGAGCUAAAGA |
| DB | 80 | SEQ. ID 0200 | AAGUAGAAGAGCUAAAGAA |
| DB | 81 | SEQ. ID 0201 | AGUAGAAGAGCUAAAGAAA |
| DB | 82 | SEQ. ID 0202 | GUAGAAGAGCUAAAGAAAA |
| DB | 83 | SEQ. ID 0203 | UAGAAGAGCUAAAdAAAAA |
| DB | 84 | SEQ. ID 0204 | AGAAGAGCUAAAGAAAAAA |
| DB | 85 | SEQ. ID 0205 | GAAGAGCUAAAGAAAAAAU |
| DB | 86 | SEQ. ID 0206 | AAGAGGUAAAGAAAAAAUA |
| DB | 87 | SEQ. ID 0207 | AGAGCUAAAGAAAAAAUAC |
| DB | 88 | SEQ. ID 0208 | GAGCUAAAGAAAAAAUACG |
| DB | 89 | SEQ. ID 0209 | AGCUAAAGAAAAAAUACGG |
| DB | 90 | SEQ. ID 0210 | GCUAAAGAAAAAAUACGGG |
| Luc | 1 | SEQ. ID 0211 | AUCCUCAUAAAGGGCAAGA |
| Luc | 2 | SEQ. ID 0212 | AGAUCCUCAUAAAGGCCAA |
| Luc | 3 | SEQ. ID 0213 | AGAGAUCCUCAUAAAGGCC |
| Luc | 4 | SEQ. ID 0214 | AGAGAGAUCCUCAUAAAGG |
| Luc | 5 | SEQ. ID 0215 | UCAGAGAGAUCCUCAUAAA |
| Luc | 6 | SEQ. ID 0216 | AAUCAGAGAGAUCCUCAUA |
| Luc | 7 | SEQ. ID 0217 | AAAAUCAGAGAGAUCCUCA |
| Luc | 8 | SEQ. ID 0218 | GAAAAUCAGAGAGAUCGU |
| Luc | 9 | SEQ. ID 0219 | AAGAAAAUCAGAGAGAUC |
| Luc | 10 | SEQ. ID 0220 | GCAAGAAAAUCAGAGAGA |

TABLE III-continued

| | | | |
|---|---|---|---|
| Luc | 11 | SEQ. ID 0221 | ACGCAAGAAAAAUCAGAGA |
| Luc | 12 | SEQ. ID 0222 | CGACGCAAGAAAAAUCAGA |
| Luc | 13 | SEQ. ID 0223 | CUCGACGCAAGAAAAAUCA |
| Luc | 14 | SEQ. ID 0224 | AACUCGACGCAAGAAAAAU |
| Luc | 15 | SEQ. ID 0225 | AAAACUCGACGCAAGAAAA |
| Luc | 16 | SEQ. ID 0226 | GGAAAACUCGACGCAAGAA |
| Luc | 17 | SEQ. ID 0227 | CCGGAAAACUCGACGCAAG |
| Luc | 18 | SEQ. ID 0228 | UACCGGAAAACUCGACGCA |
| Luc | 19 | SEQ. ID 0229 | CUUACCGGAAAACUCGACG |
| Luc | 20 | SEQ. ID 0230 | GUCUUACCGGAAAACUCGA |
| Luc | 21 | SEQ. ID 0231 | AGGUCUUACCGGAAAACUC |
| Luc | 22 | SEQ. ID 0232 | AAAGGUCUUACCGGAAAAC |
| Luc | 23 | SEQ. ID 0233 | CGAAAGGUCUUACCGGAAA |
| Luc | 24 | SEQ. ID 0234 | ACCGAAAGGUCUUACCGGA |
| Luc | 25 | SEQ. ID 0235 | GUACCGAAAGGUCUUACCG |
| Luc | 26 | SEQ. ID 0236 | AAGUACCGAAAGGUCUUAC |
| Luc | 27 | SEQ. ID 0237 | CGAAGUACCGAAAGGUCUU |
| Luc | 28 | SEQ. ID 0238 | GACGAAGUACCGAAAGGUC |
| Luc | 29 | SEQ. ID 0239 | UGGACGAAGUACCGAAAGG |
| Luc | 30 | SEQ. ID 0240 | UGUGGACGAAGUACCGAAA |
| Luc | 31 | SEQ. ID 0241 | UUUGUGGACGAAGUACCGA |
| Luc | 32 | SEQ. ID 0242 | UGUUUGUGGACGAAGUACC |
| Luc | 33 | SEQ. ID 0243 | UGUGUUUGUGGACGAAGUA |
| Luc | 34 | SEQ. ID 0244 | GUUGUGUUUGUGGACGAAG |
| Luc | 35 | SEQ. ID 0245 | GAGUUGUGUUUGUGGACGA |
| Luc | 36 | SEQ. ID 0246 | AGGAGUUGUGUUUGUGGAC |
| Luc | 37 | SEQ. ID 0247 | GGAGGAGUUGUGUUUGUGG |
| Luc | 38 | SEQ. ID 0248 | GCGGAGGAGUUGUGUUUGU |
| Luc | 39 | SEQ. ID 0249 | GCGCGGAGGAGUUGUGUUU |
| Luc | 40 | SEQ. ID 0250 | UUGCGCGGAGGAGUUGUGU |
| Luc | 41 | SEQ. ID 0251 | AGUUGCGCGGAGGAGUUGU |
| Luc | 42 | SEQ. ID 0252 | AAAGUUGCGCGGAGGAGUU |
| Luc | 43 | SEQ. ID 0253 | AAAAGUUGCGCGGAGGAG |
| Luc | 44 | SEQ. ID 0254 | CGAAAAGUUGCGCGGAGG |
| Luc | 45 | SEQ. ID 0255 | CGCGAAAAGUUGCGCGGA |
| Luc | 46 | SEQ. ID 0256 | ACCGCGAAAAGUUGCGCG |
| Luc | 47 | SEQ. ID 0257 | CAACCGCGAAAAGUUGCG |
| Luc | 48 | SEQ. ID 0258 | AACAACCGCGAAAAGUUG |
| Luc | 49 | SEQ. ID 0259 | GUAACAACCGCGAAAAGU |
| Luc | 50 | SEQ. ID 0260 | AAGUAACAACCGCGAAAAA |
| Luc | 51 | SEQ. ID 0261 | UCAAGUAACAACCGCGAAA |
| Luc | 52 | SEQ. ID 0262 | AGUCAAGUAACAACCGCGA |
| Luc | 53 | SEQ. ID 0263 | CCAGUCAAGUAACAACCGC |
| Luc | 54 | SEQ. ID 0264 | CGCCAGUCAAGUAACAACG |
| Luc | 55 | SEQ. ID 0265 | GUCGCCAGUCAAGUAACAA |
| Luc | 56 | SEQ. ID 0266 | ACGUCGCCAGUCAAGUAAC |
| Luc | 57 | SEQ. ID 0267 | UUACGUCGCCAGUCAAGUA |
| Luc | 58 | SEQ. ID 0268 | GAUUACGUCGCCAGUCAAG |
| Luc | 59 | SEQ. ID 0269 | UGGAUUACGUCGCCAGUCA |
| Luc | 60 | SEQ. ID 0270 | CGUGGAUUACGUCGCCAGU |
| Luc | 61 | SEQ. ID 0271 | AUCGUGGAUUACGUCGCCA |
| Luc | 62 | SEQ. ID 0272 | AGAUCGUGGAUUACGUCGC |
| Luc | 63 | SEQ. ID 0273 | AGAGAUCGUGGAUUACGUC |
| Luc | 64 | SEQ. ID 0274 | AAAGAGAUCGUGGAUUACG |
| Luc | 65 | SEQ. ID 0275 | AAAAGAGAUCGUGGAUUA |
| Luc | 66 | SEQ. ID 0276 | GGAAAAGAGAUCGUGGAU |
| Luc | 67 | SEQ. ID 0277 | ACGGAAAAGAGAUCGUGG |
| Luc | 68 | SEQ. ID 0278 | UGACGGAAAAGAGAUCGU |
| Luc | 69 | SEQ. ID 0279 | GAUGACGAAAAAGAGAUC |
| Luc | 70 | SEQ. ID 0280 | ACGAUGACGGAAAAGAGA |
| Luc | 71 | SEQ. ID 0281 | AGACGAUGACGGAAAAGA |
| Luc | 72 | SEQ. ID 0282 | AAAGACGAUGACGGAAAA |
| Luc | 73 | SEQ. ID 0283 | GGAAAGACGAUGACGGAAA |
| Luc | 74 | SEQ. ID 0284 | ACGGAAAGACGAUGACGGA |
| Luc | 75 | SEQ. ID 0285 | GCACGGAAAGACGAUGACG |
| Luc | 76 | SEQ. ID 0286 | GAGCACGGAAAGACGAUGA |
| Luc | 77 | SEQ. ID 0287 | UGGAGCACGGAAAGACGAU |
| Luc | 78 | SEQ. ID 0288 | UUUGGAGCACGGAAAGACG |
| Luc | 79 | SEQ. ID 0289 | GUUUUGGAGCACGGAAAGA |
| Luc | 80 | SEQ. ID 0290 | UUGUUUUGGAGCACGGAAA |
| Luc | 81 | SEQ. ID 0291 | UGUUGUUUUGGAGCACGGA |
| Luc | 82 | SEQ. ID 0292 | GUUGUUGUUUUGGAGCACG |
| Luc | 83 | SEQ. ID 0293 | CCGUUGUUGUUUUGGAGCA |
| Luc | 84 | SEQ. ID 0294 | CGCCGUUGUUGUUUUGGAG |
| Luc | 85 | SEQ. ID 0295 | GCCGCCGUUGUUGUUUUGG |
| Luc | 86 | SEQ. ID 0296 | CCGCCGCCGUUGUUGUUUU |
| Luc | 87 | SEQ. ID 0297 | UCCCGCCGCCGUUGUUGUU |
| Luc | 88 | SEQ. ID 0298 | CUUCCCGCCGCCGUUGUUG |

TABLE III-continued

| | | | |
|---|---|---|---|
| Luc | 89 | SEQ. ID 0299 | AACUUCCCGCCGCCGUUGU |
| Luc | 90 | SEQ. ID 0300 | UGAACUUCCCGCCGCCGUU |

Example II

Validation of the Algorithm Using DBI, Luciferase, PLK, EGFR, and SEAP

Figure 10:
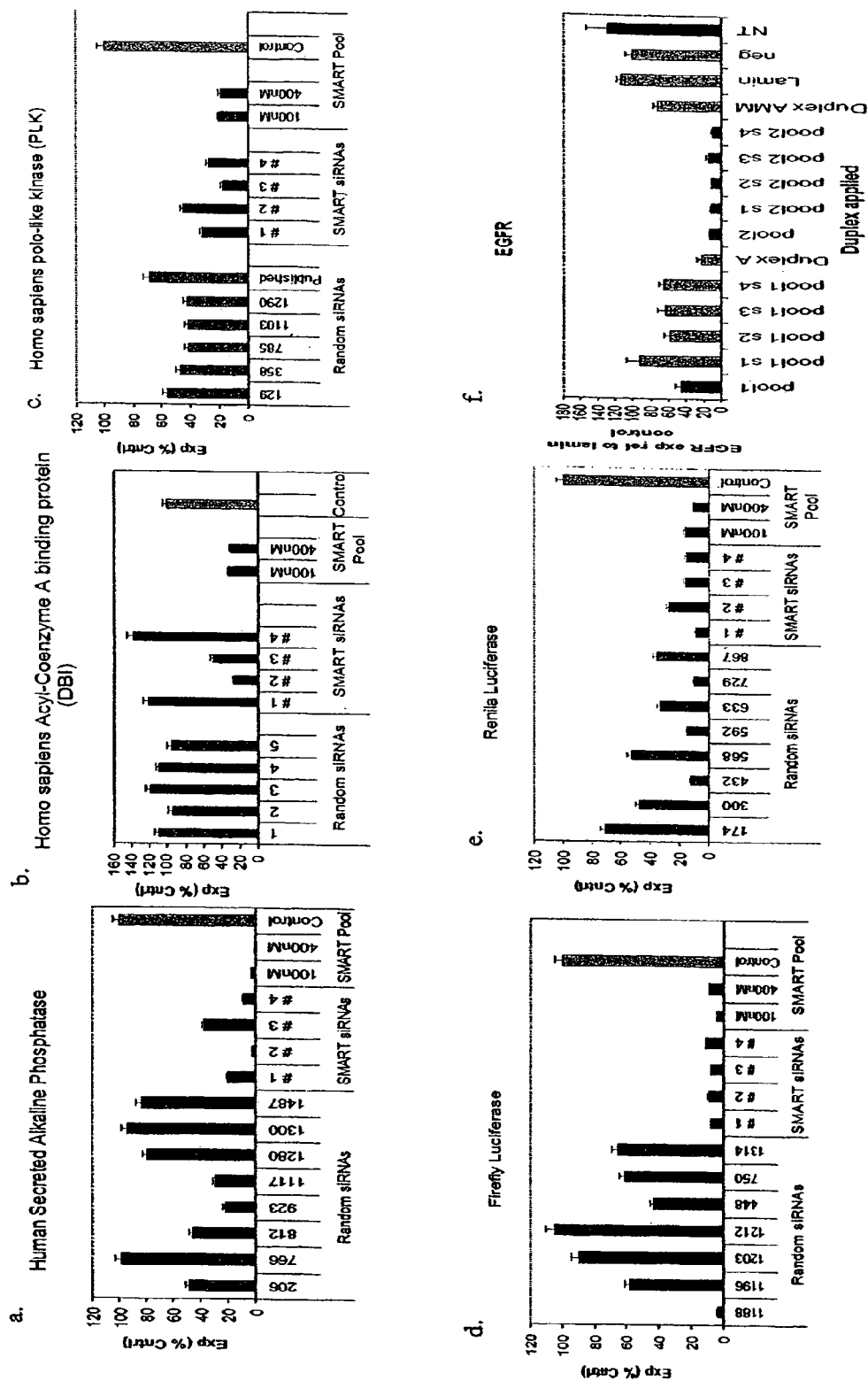
FIGS. 10A-E compare the RNAi of five different genes (SEAP, DBI, PLK, Firefly Luciferase, and Renila Luciferase) by varying numbers of randomly selected siRNA and four rationally designed (SMART-selected) siRNA chosen using the algorithm described in Formula VIII. In addition, RNAi induced by a pool of the four SMART-selected siRNA is reported at two different concentrations (100 and 400 nM). 10F is a comparison between a pool of randomly selected EGFR siRNA (Pool 1) and a pool of SMART selected EGFR siRNA (Pool 2). Pool 1, S1-S4 and Pool 2 S1-S4 represent the individual members that made up each respective pool. Note that numbers for random siRNAs represent the position of the 5' end of the sense strand of the duplex. The Y-axis represents the % expression of the control(s). The X-axis is the percent expression of the control.

The algorithm (Formula VIII) identified siRNAs for five genes, human DBI, firefly luciferase (fLuc), renilla luciferase (rLuc), human PLK, and human secreted alkaline phosphatase (SEAP). Four individual siRNAs were selected on the basis of their SMARTscores™ derived by analysis of their sequence using Formula VIII (all of the siRNAs would be selected with Formula IX as well) and analyzed for their ability to silence their targets' expression. In addition to the scoring, a BLAST search was conducted for each siRNA. To minimize the potential for off-target silencing effects, only those target sequences with more than three mismatches against un-related sequences were selected. Semizarov, et al, *Specificity of short interfering RNA determined through gene expression signatures*. Proc. Natl. Acad. Sci. U.S.A. 2003, 100:6347. These duplexes were analyzed individually and in pools of 4 and compared with several siRNAs that were randomly selected. The functionality was measured a percentage of targeted gene knockdown as compared to controls. All siRNAs were transfected as described by the methods above at 100 nM concentration into HEK293 using Lipofectamine 2000. The level of the targeted gene expression was evaluated by B-DNA as described above and normalized to the non-specific control. FIG. 10 shows that the siRNAs selected by the algorithm disclosed herein were significantly more potent than randomly selected siRNAs. The algorithm increased the chances of identifying an F50 siRNA from 48% to 91%, and an F80 siRNA from 13% to 57%. In addition, pools of SMART siRNA silence the selected target better than randomly selected pools (see FIG. 10F).

Example III

Validation of the Algorithm Using Genes Involved in Clathrin-Dependent Endocytosis Components of clathrin-mediated endocytosis pathway are key to modulating intracellular signaling and play important roles in disease. Chromosomal rearrangements that result in fusion transcripts between the Mixed-Lineage Leukemia gene (MLL) and CALM (Clathrin assembly lymphoid myeloid leukemia gene) are believed to play a role in leukemogenesis. Similarly, disruptions in Rab7 and Rab9, as well as HIP1 (Huntingtin-interacting protein), genes that are believed to be involved in endocytosis, are potentially responsible for ailments resulting in lipid storage, and neuronal diseases, respectively. For these reasons, siRNA directed against clathrin and other genes involved in the clathrin-mediated endocytotic pathway are potentially important research and therapeutic tools.

siRNAs directed against genes involved in the clathrin-mediated endocytosis pathways were selected using Formula VIII. The targeted genes were clathrin heavy chain (CHC, accession # NM_004859), clathrin light chain A (CLCa, NM_001833), clathrin light chain B (CLCb, NM_001834), CALM (U45976), β2 subunit of AP-2 (β2, NM_001282), Eps15 (NM_001981), Eps15R (NM_021235), dynamin II (DYNII, NM_004945), Rab5a (BC001267), Rab5b (NM_002868), Rab5c (AF141304), and EEA.1 (XM_018197).

For each gene, four siRNAs duplexes with the highest scores were selected and a BLAST search was conducted for each of them using the Human EST database. In order to minimize the potential for off-target silencing effects, only those sequences with more than three mismatches against un-related sequences were used. All duplexes were synthesized at Dharmacon, Inc. as 21-mers with 3'-UU overhangs using a modified method of 2'-ACE chemistry Scaringe, *Advanced 5'-silyl-2'-orthoester approach to RNA oligonucleotide synthesis*, Methods Enzymol 2000, 317:3 and the antisense strand was chemically phosphorylated to insure maximized activity.

HeLa cells were grown in Dulbecco's modified Eagle's medium (DMEM) containing 10% fetal bovine serum, antibiotics and glutamine. siRNA duplexes were resuspended in 1× siRNA Universal buffer (Dharmacon, Inc.) to 20 µM prior to transfection. HeLa cells in 12-well plates were transfected twice with 4 µl of 20 µM siRNA duplex in 3 µl Lipofectamine 2000 reagent (Invitrogen, Carlsbad, Calif., USA) at 24-hour intervals. For the transfections in which 2 or 3 siRNA duplexes were included, the amount of each duplex was decreased, so that the total amount was the same as in transfections with single siRNAs. Cells were plated into normal culture medium 12 hours prior to experiments, and protein levels were measured 2 or 4 days after the first transfection.

Equal amounts of lysates were resolved by electrophoresis, blotted, and stained with the antibody specific to targeted protein, as well as antibodies specific to unrelated proteins, PP1 phosphatase and Tsg101 (not shown). The cells were lysed in Triton X-100/glycerol solubilization buffer as described previously. Tebar, Bohlander, & Sorkin, *Clathrin Assembly Lymphoid Myeloid Leukemia (CALM) Protein: Localization in Endocytic-coated Pits, Interactions with Clathrin, and the Impact of Overexpression on Clathrin-mediated Traffic*, Mol. Biol. Cell August 1999, 10:2687. Cell lysates were electrophoresed, transferred to nitrocellulose membranes, and Western blotting was performed with several antibodies followed by detection using enhanced chemiluminescence system (Pierce, Inc). Several x-ray films were analyzed to determine the linear range of the chemiluminescence signals, and the quantifications were performed using densitometry and AlphaImager v5.5 software (Alpha Innotech Corporation). In experiments with Eps15R-targeted siRNAs, cell lysates were subjected to immunoprecipitation with Ab860, and Eps15R was detected in immunoprecipitates by Western blotting as described above.

The antibodies to assess the levels of each protein by Western blot were obtained from the following sources: monoclonal antibody to clathrin heavy chain (TD.1) was obtained from American Type Culture Collection (Rockville, Md., USA); polyclonal antibody to dynamin II was obtained from Affinity Bioreagents, Inc. (Golden, Colo., USA); monoclonal antibodies to EEA.1 and Rab5a were purchased from BD Transduction Laboratories (Los Angeles, Calif, USA); the monoclonal antibody to Tsg101 was purchased from Santa Cruz Biotechnology, Inc. (Santa Cruz, Calif, USA); the monoclonal antibody to GFP was from ZYMED Laboratories Inc. (South San Francisco, Calif, USA); the rabbit polyclonal antibodies Ab32 specific to α-adaptins and Ab20 to CALM were described previously Sorkin, et al, *Stoichiometric Interaction of the Epidermal Growth Factor Receptor with the Clathrin-associated Protein Complex AP-2*, J. Biol. Chem.

January 1995, 270:619, the polyclonal antibodies to clathrin light chains A and B were kindly provided by Dr. F. Brodsky (UCSF); monoclonal antibodies to PP1 (BD Transduction Laboratories) and α-Actinin (Chemicon) were kindly provided by Dr. M. Dell'Acqua (University of Colorado); Eps15 Ab577 and Eps15R Ab860 were kindly provided by Dr. P. P. Di Fiore (European Cancer Institute).

Figure 11:
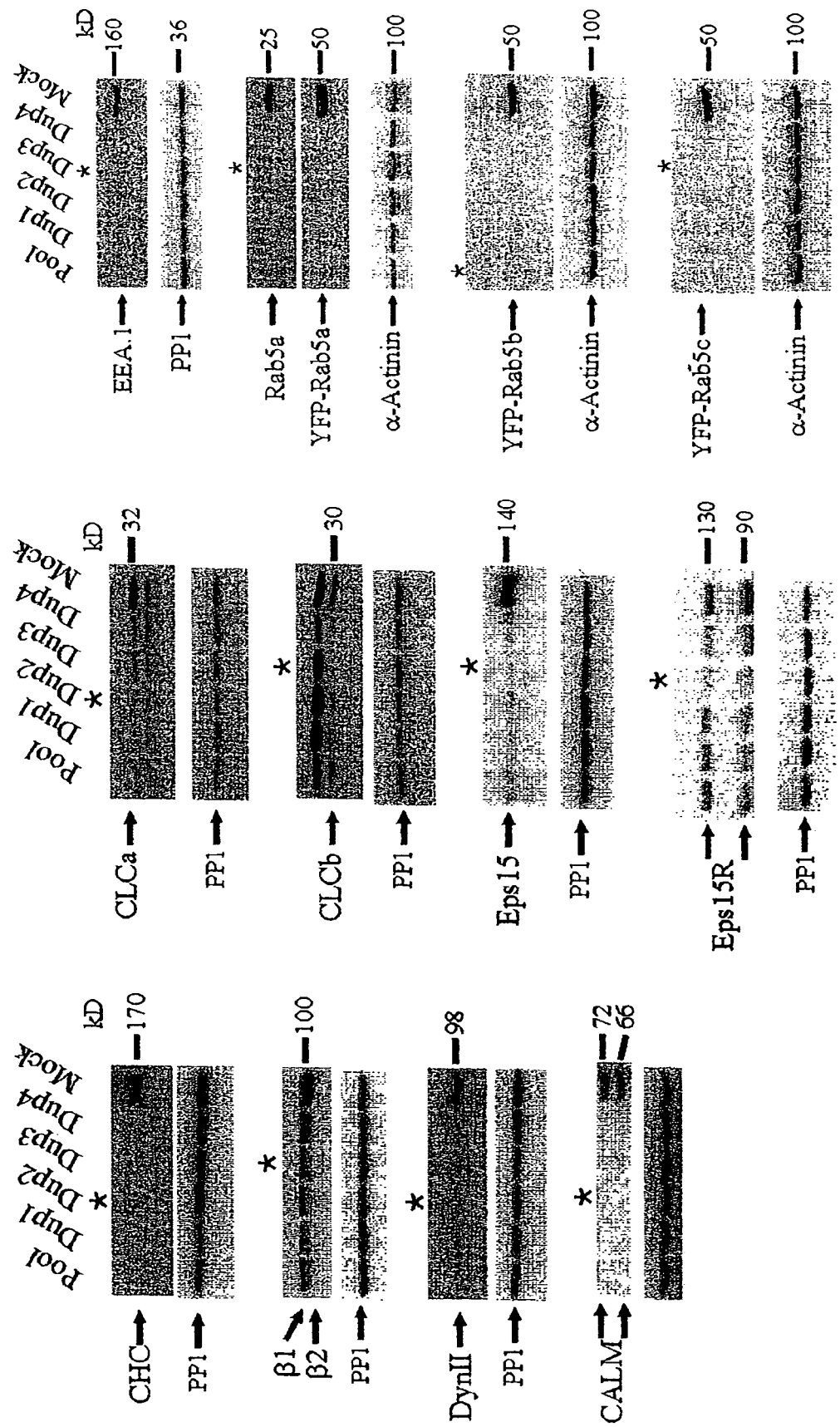
FIG. 11 shows the Western blot results from cells treated with siRNA directed against twelve different genes involved in the clathrin-dependent endocytosis pathway (CHC, DynII, CALM, CLCa, CLCb, Eps15, Eps15R, Rab5a, Rab5b, Rab5c, β2 subunit of AP-2 and EEA.1). SiRNA were selected using Formula VIII. "Pool" represents a mixture of duplexes 1-4. Total concentration of each siRNA in the pool is 25 nM. Total concentration=4×25=100 nM.

FIG. 11 demonstrates the in vivo functionality of 48 individual siRNAs, selected using Formula VIII (most of them will meet the criteria incorporated by Formula IX as well) targeting 12 genes. Various cell lines were transfected with siRNA duplexes (Dup1-4) or pools of siRNA duplexes (Pool), and the cells were lysed 3 days after transfection with the exception of CALM (2 days) and β2 (4 days).

Note a β1-adaptin band (part of AP-1 Golgi adaptor complex) that runs slightly slower than β2 adaptin. CALM has two splice variants, 66 and 72 kD. The full-length Eps15R (a doublet of ~130 kD) and several truncated spliced forms of ~100 kD and ~70 kD were detected in Eps15R immnunoprecipitates (shown by arrows). The cells were lysed 3 days after transfection. Equal amounts of lysates were resolved by electrophoresis and blotted with the antibody specific to a targeted protein (GFP antibody for YFP fusion proteins) and the antibody specific to unrelated proteins PP1 phosphatase or α-actinin, and TSG101. The amount of protein in each specific band was normalized to the amount of non-specific proteins in each lane of the gel. Nearly all of them appear to be functional, which establishes that Formula VIII and IX can be used to predict siRNAs' functionality in general in a genome wide manner.

To generate the fusion of yellow fluorescent protein (YFP) with Rab5b or Rab5c (YFP-Rab5b or YFP-Rab5c), a DNA fragment encoding the full-length human Rab5b or Rab5c was obtained by PCR using Pfu polymerase (Stratagene) with a SacI restriction site introduced into the 5' end and a KpnI site into the 3' end and cloned into pEYFP-C1 vector (CLON-TECH, Palo Alto, Calif., USA). GFP-CALM and YFP-Rab5a were described previously Tebar, Bohlander, & Sorkin, *Clathrin Assembly Lymphoid Myeloid Leukemia (CALM) Protein: Localization in Endocytic-coated Pits, Interactions with Clathrin, and the Impact of Overexpression on Clathrin-mediated Traffic*, Mol. Biol. Cell August 1999, 10:2687.

Example III

Validation of the Algorithm Using Eg5, GADPH, ATE1, MEK2, MEK1, QB, LaminA/C, c-myc, Human Cyclophilin, and Mouse Cyclophilin A number of genes have been identified as playing potentially important roles in disease etiology. Expression profiles of normal and diseased kidneys has implicated Edg5 in immunoglobulin A neuropathy, a common renal glomerular disease. Myc1, MEK1/2 and other related kinases have been associated with one or more cancers, while lamins have been implicated in muscular dystrophy and other diseases. For these reasons, siRNA directed against the genes encoding these classes of molecules would be important research and therapeutic tools.

Figure 12:
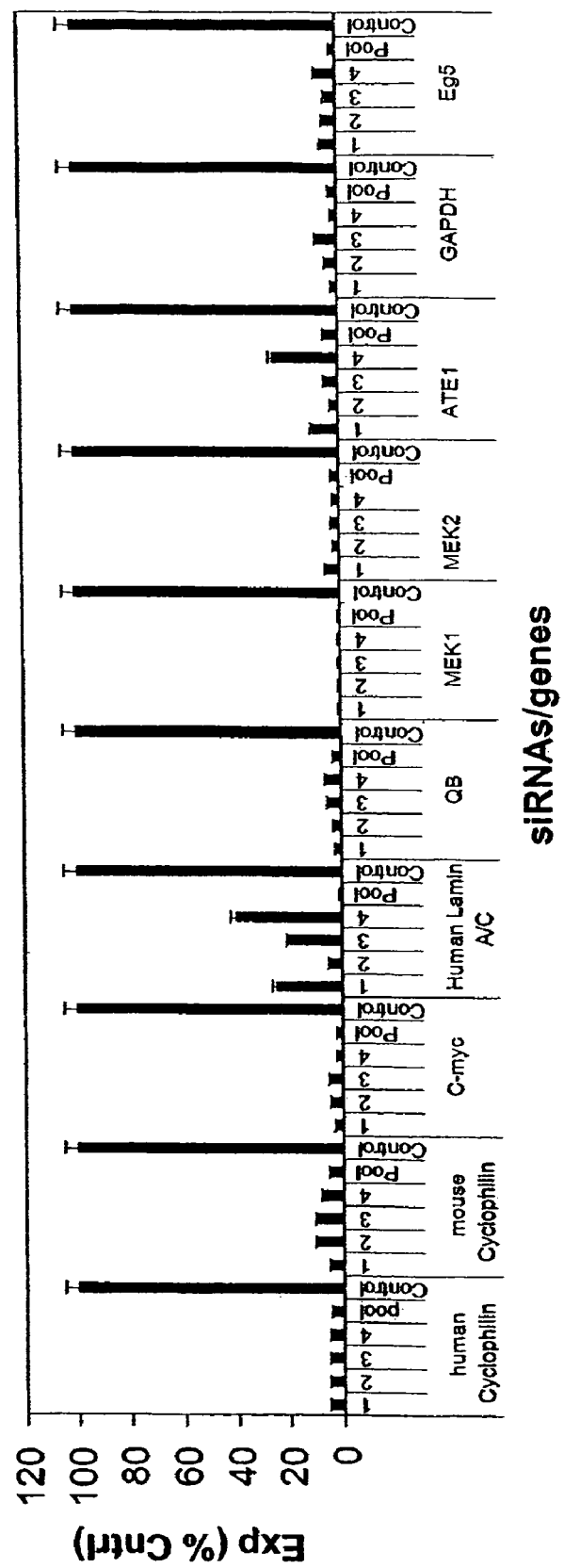
FIG. 12 is a representation of the gene silencing capabilities of rationally-selected siRNA directed against ten different genes (human and mouse cyclophilin, C-myc, human lamin A/C, QB (ubiquinol-cytochrome c reductase core protein I), MEK1 and MEK2, ATE1 (arginyl-tRNA protein transferase), GAPDH, and Eg5). The Y-axis is the percent expression of the control. Numbers 1, 2, 3 and 4 represent individual rationally selected siRNA. "Pool" represents a mixture of the four individual siRNA.

FIG. 12 illustrates four siRNAs targeting 10 different genes (Table V for sequence and accession number information) that were selected according to the Formula VIII and assayed as individuals and pools in HEK293 cells. The level of siRNA induced silencing was measured using the B-DNA assay. These studies demonstrated that thirty-six out of the forty individual SMART-selected siRNA tested are functional (90%) and all 10 pools are fully functional.

Example V

Validation of the Algorithm Using Bcl2

Bcl-2 is a ~25 kD, 205-239 amino acid, anti-apoptotic protein that contains considerable homology with other members of the BCL family including BCLX, MCL1, BAX, BAD, and BIK. The protein exists in at least two forms (Bcl2a, which has a hydrophobic tail for membrane anchorage, and Bcl2b, which lacks the hydrophobic tail) and is predominantly localized to the mitochondrial membrane. While Bcl2 expression is widely distributed, particular interest has focused on the expression of this molecule in B and T cells. Bcl2 expression is down-regulated in normal germinal center B cells yet in a high percentage of follicular lymphomas, Bcl2 expression has been observed to be elevated. Cytological studies have identified a common translocation ((14;18)(q32; q32)) amongst a high percentage (>70%) of these lymphomas. This genetic lesion places the Bcl2 gene in juxtaposition to immunoglobulin heavy chain gene (IgH) encoding sequences and is believed to enforce inappropriate levels of gene expression, and resistance to programmed cell death in the follicle center B cells. In other cases, hypomethylation of the Bcl2 promoter leads to enhanced expression and again, inhibition of apoptosis. In addition to cancer, dysregulated expression of Bcl-2 has been correlated with multiple sclerosis and various neurological diseases.

The correlation between Bcl-2 translocation and cancer makes this gene an attractive target for RNAi. Identification of siRNA directed against the bcl2 transcript (or Bcl2-IgH fusions) would further our understanding Bcl2 gene function and possibly provide a future therapeutic agent to battle diseases that result from altered expression or function of this gene.

In Silico Identification of Functional siRNA

To identify functional and hyperfunctional siRNA against the Bcl2 gene, the sequence for Bcl-2 was downloaded from the NCBI Unigene database and analyzed using the Formula VIII algorithm. As a result of these procedures, both the sequence and SMARTscores™ of the Bcl2 siRNA were obtained and ranked according to their functionality. Subsequently, these sequences were BLAST'ed (database) to insure that the selected sequences were specific and contained minimal overlap with unrealated genes. The SMARTscores™ for the top 10 Bcl-2 siRNA are identified in FIG. 13.

In Vivo Testing of Bcl-2 SiRNA

Bcl-2 siRNAs having the top ten SMARTscores™ were selected and tested in a functional assay to determine silencing efficiency. To accomplish this, each of the ten duplexes were synthesized using 2'-O-ACE chemistry and transfected at 100 nM concentrations into cells. Twenty-four hours later assays were performed on cell extracts to assess the degree of target silencing. Controls used in these experiments included mock transfected cells, and cells that were transfected with a non-specific siRNA duplex.

Figure 14:
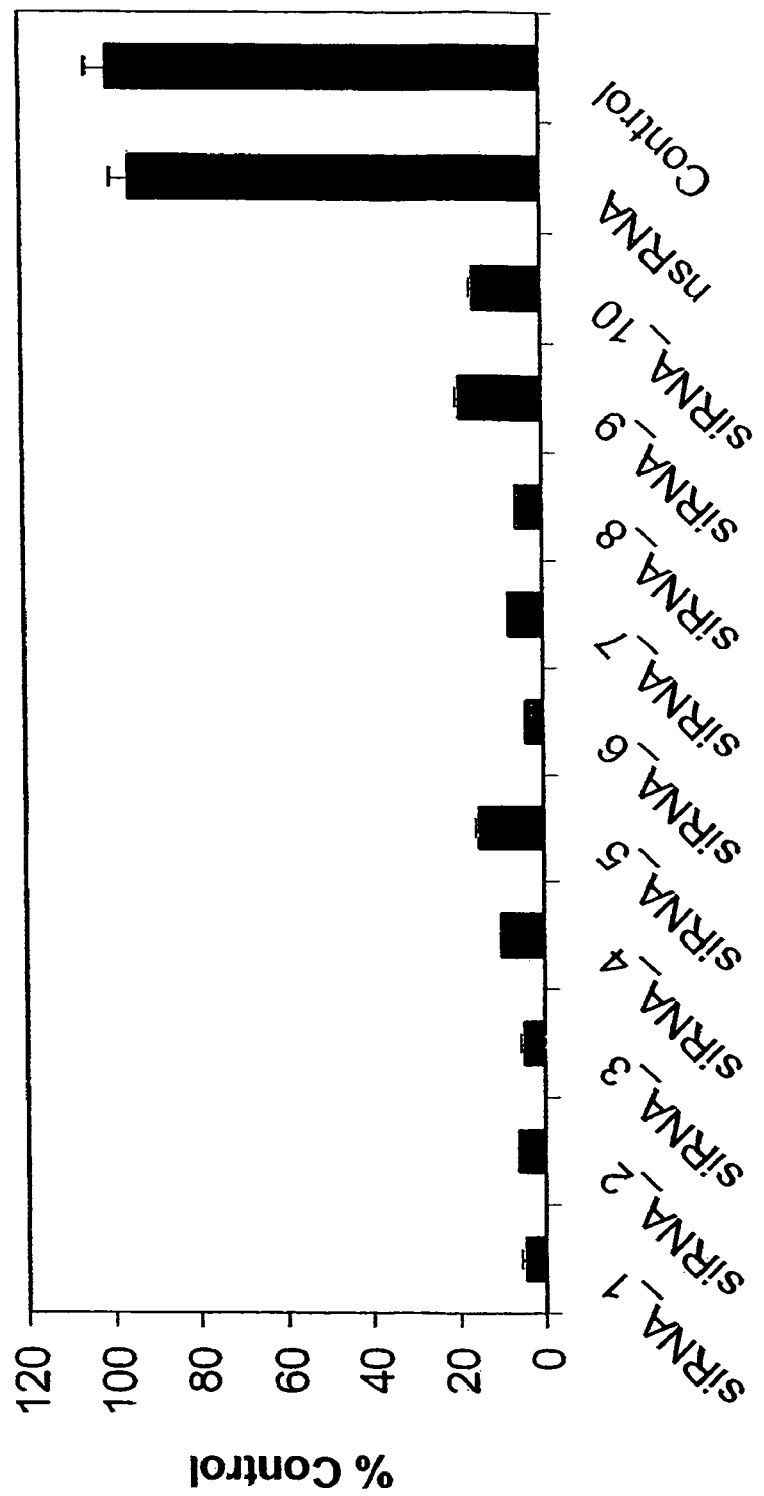
FIG. 14 is the knockdown by the top ten Bcl2 siRNAs at 100 nM concentrations. The Y-axis represents the amount of expression relative to the non-specific (ns) and transfection mixture control.

The results of these experiments are presented below (and in FIG. 14) and show that all ten of the selected siRNA induce 80% or better silencing of the Bcl2 message at 100 nM concentrations. These data verify that the algorithm successfully identified functional Bcl2 siRNA and provide a set of functional agents that can be used in experimental and therapeutic environments.

siRNA 1  GGGAGAUAGUGAUGAAGUA    SEQ. ID NO. 301
siRNA 2  GAAGUACAUCCAUUAUAAG    SEQ. ID NO. 302
siRNA 3  GUACGACAACGGGGAGAUA    SEQ. ID NO. 303
siRNA 4  AGAUAGUGAUGAAGUACAU    SEQ. ID NO. 304
siRNA 5  UGAAGACUCUGCUCAGUUU    SEQ. ID NO. 305
siRNA 6  GCAUGCGGCCUCUGUUUGA    SEQ. ID NO. 306
siRNA 7  UGCGGCCUCUGUUUGAUUU    SEQ. ID NO. 307
siRNA 8  GAGAUAGUGAUGAAGUACA    SEQ. ID NO. 308
siRNA 9  GGAGAUAGUGAUGAAGUAC    SEQ. ID NO. 309
siRNA 10 GAAGACUCUGCUCAGUUUG    SEQ. ID NO. 310

Bcl2 siRNA: Sense Strand, 5'→3'

Example VI

Sequences Selected by the Algorithm

Sequences of the siRNAs selected using Formulas (Algorithms) VIII and IX with their corresponding ranking, which have been evaluated for the silencing activity in vivo in the present study (Formula VIII and IX, respectively).

TABLE V

| Gene Name | Accession Formula Number | SEQ. ID NO. | Formula FT11SeqTence | VIII | IX |
|---|---|---|---|---|---|
| CLTC | NM_004859 | SEQ. ID NO. 0301 | GAAAGAATCTGTAGAGAAA | 76 | 94.2 |
| CLTC | NM_004859 | SEQ. ID NO. 0302 | GCAATGAGCTGTTTGAAGA | 65 | 39.9 |
| CLTC | NM_004859 | SEQ. ID NO. 0303 | TGACAAAGGTGGATAAATT | 57 | 38.2 |
| CLTC | NM_004859 | SEQ. ID NO. 0304 | GGAAATGGATCTCTTTGAA | 54 | 49.4 |
| CLTA | NM_001833 | SEQ. ID NO. 0305 | GGAAAGTAATGGTCCAACA | 22 | 55.5 |
| CLTA | NM_001833 | SEQ. ID NO. 0306 | AGACAGTTATGCAGCTATT | 4 | 22.9 |
| CLTA | NM_001833 | SEQ. ID NO. 0307 | CCAATTCTCGGAAGCAAGA | 1 | 17 |
| CLTA | NM_001833 | SEQ. ID NO. 0308 | GAAAGTAATGGTCCAACAG | -1 | -13 |
| CLTB | NM_001834 | SEQ. ID NO. 0309 | GCGCCAGAGTGAACAAGTA | 17 | 57.5 |
| CLTB | NM_001834 | SEQ. ID NO. 0310 | GAAGGTGGCCCAGCTATGT | 15 | -8.6 |
| CLTB | NM_001834 | SEQ. ID NO. 0311 | GGAACCAGCGCCAGAGTGA | 13 | 40.5 |
| CLTB | NM_001834 | SEQ. ID NO. 0312 | GAGCGAGATTGCAGGCATA | 20 | 61.7 |
| CALM | U45976 | SEQ. ID NO. 0313 | GTTAGTATCTGATGACTTG | 36 | -34.6 |
| CALM | U45976 | SEQ. ID NO. 0314 | GAAATGGAACCACTAAGAA | 33 | 46.1 |
| CALM | U45976 | SEQ. ID NO. 0315 | GGAAATGGAACCACTAAGA | 30 | 61.2 |
| CALM | U45976 | SEQ. ID NO. 0316 | CAACTACACTTTCCAATGC | 28 | 6.8 |
| EPS15 | NM_001981 | SEQ. ID NO. 0317 | CCACCAAGATTTCATGATA | 48 | 25.2 |
| EPS15 | NM_001981 | SEQ. ID NO. 0318 | GATCGGAACTCCAACAAGA | 43 | 49.3 |
| EPS15 | NM_001981 | SEQ. ID NO. 0319 | AAACGGAGCTACAGATTAT | 39 | 11.5 |
| EPS15 | NM_001981 | SEQ. ID NO. 0320 | CCACACAGCATTCTTGTAA | 33 | -23.6 |
| EPS15R | NM_021235 | SEQ. ID NO. 0321 | GAAGTTACCTTGAGCAATC | 48 | 33 |
| EPS15R | NM_021235 | SEQ. ID NO. 0322 | GGACTTGGCCGATCCAGAA | 27 | 33 |
| EPS15R | NM_021235 | SEQ. ID NO. 0323 | GCACTTGGATCGAGATGAG | 20 | 1.3 |
| EPS15R | NM_021235 | SEQ. ID NO. 0324 | CAAAGACCAATTCGCGTTA | 17 | 27.7 |
| DNM2 | NM_004945 | SEQ. ID NO. 0325 | CCGAATCAATCGCATCTTC | 6 | -29.6 |
| DNM2 | NM_004945 | SEQ. ID NO. 0326 | GACATGATCCTGCAGTTCA | 5 | -14 |
| DNM2 | NM_004945 | SEQ. ID NO. 0327 | GAGCGAATCGTCACCACTT | 5 | 24 |

TABLE V-continued

| Gene Name | Accession Formula Number | SEQ. ID NO. | Formula FT11SeqTence | VIII | IX |
|---|---|---|---|---|---|
| DNM2 | NM_004945 | SEQ. ID NO. 0328 | CCTCCGAGCTGGCGTCTAC | −4 | −63.6 |
| ARF6 | AF93885 | SEQ. ID NO. 0329 | TCACATGGTTAACCTCTAA | 27 | −21.1 |
| ARF6 | AF93885 | SEQ. ID NO. 0330 | GATGAGGGACGCCATAATC | 7 | −38.4 |
| ARF6 | AF93885 | SEQ. ID NO. 0331 | CCTGTAACTACAAATCTTA | 4 | 16.9 |
| ARF6 | AF93885 | SEQ. ID NO. 0332 | GGAAGGTGCTATCCAAAAT | 4 | 11.5 |
| RAB5A | BC001267 | SEQ. ID NO. 0333 | GCAAGCAAGTCCTAACATT | 40 | 25.1 |
| RAB5A | BC001267 | SEQ. ID NO. 0334 | GGAAGAGGAGTAGACCTTA | 17 | 50.1 |
| RAB5A | BC001267 | SEQ. ID NO. 0335 | AGGAATCAGTGTTGTAGTA | 16 | 11.5 |
| RAB5A | BC001267 | SEQ. ID NO. 0336 | GAAGAGGAGTAGACCTTAC | 12 | 7 |
| RAB5B | NM_002868 | SEQ. ID NO. 0337 | GAAAGTCAAGCCTGGTATT | 14 | 18.1 |
| RAB5B | NM_002868 | SEQ. ID NO. 0338 | AAAGTCAAGCCTGGTATTA | 6 | −17.8 |
| RAB5B | NM_002868 | SEQ. ID NO. 0339 | GCTATGAACGTGAATGATC | 3 | −21.1 |
| RAB5B | NM_002868 | SEQ. ID NO. 0340 | CAAGCCTGGTATTACGTTT | −7 | −37.5 |
| RAB5C | AF141304 | SEQ. ID NO. 0341 | GGAACAAGATCTGTCAATT | 38 | 51.9 |
| RAB5C | AF141304 | SEQ. ID NO. 0342 | GCAATGAACGTGAACGAAA | 29 | 43.7 |
| RAB5C | AF141304 | SEQ. ID NO. 0343 | CAATGAACGTGAACGAAAT | 18 | 43.3 |
| RAB5C | AF141304 | SEQ. ID NO. 0344 | GGACAGGAGCGGTATCACA | 6 | 18.2 |
| EEA1 | XM_018197 | SEQ. ID NO. 0345 | AGACAGAGCTTGAGAATAA | 67 | 64.1 |
| EEA1 | XM_018197 | SEQ. ID NO. 0346 | GAGAAGATCTTTATGCAAA | 60 | 48.7 |
| EEA1 | XM_018197 | SEQ. ID NO. 0347 | OAAGAGAAATCAGCAGATA | 58 | 45.7 |
| EEA1 | XM_018197 | SEQ. ID NO. 0348 | GCAAGTAACTCAACTAACA | 56 | 72.3 |
| AP2B1 | NM_001282 | SEQ. ID NO. 0349 | GAGGTAATCTGCCACATTG | 49 | −12.4 |
| AP2B1 | NM_001282 | SEQ. ID NO. 0350 | GCAGATGAGTUACTAGAAA | 44 | 48.9 |
| AP2B1 | NM_001282 | SEQ. ID NO. 0351 | CAACTTAATUGTCCAGAAA | 41 | 28.2 |
| AP2B1 | NM_001282 | SEQ. ID NO. 0352 | CAACACAGGATTCTGATAA | 33 | −5.8 |
| PLK | NM_005030 | SEQ. ID NO. 0353 | AGATTGTGCCTAAGTCTCT | −35 | −3.4 |
| PLK | NM_005030 | SEQ. ID NO. 0354 | ATGAAGATCTGGAGGTGAA | 0 | −4.3 |
| PLK | NM_005030 | SEQ. ID NO. 0355 | TTTGAGACTTCTGGCCTAA | −5 | −27.7 |
| PLK | NM_005030 | SEQ. ID NO. 0356 | AGATCACCCTCCTTAAATA | 15 | 72.3 |
| GAPDH | NM_002046 | SEQ. ID NO. 0357 | CAACGGATTTGGTCGTATT | 27 | −2.8 |
| GAPDH | NM_002046 | SEQ. ID NO. 0358 | GAAATCCCATCACCATCTT | 24 | 3.9 |
| GAPDH | NM_002046 | SEQ. ID NO. 0359 | GACCTCAACTACATGGTTT | 22 | −22.9 |
| GAPDH | NM_002046 | SEQ. ID NO. 0360 | TGGTTTACATGTTCCAATA | 9 | 9.8 |
| c-Myc | | SEQ. ID NO. 0361 | GAAGAAATCGATGTTGTTT | 31 | −113 |
| c-Myc | | SEQ. ID NO. 0362 | ACACAAACTTGAACAGCTA | 22 | 51.3 |
| c-Myc | | SEQ. ID NO. 0363 | GGAAGAAATCGATGTTGTT | 18 | 26 |
| c-Myc | | SEQ. ID NO. 0364 | GAAACGACGAGAACAGTTG | 18 | −8.9 |
| MAP2K1 | NM_002755 | SEQ. ID NO. 0365 | GCACATGGATGGAGGTTCT | 26 | 16 |

TABLE V-continued

| Gene Name | Accession Formula Number | SEQ. ID NO. | Formula FT11SeqTence | VIII | IX |
|---|---|---|---|---|---|
| MAP2K1 | NM_002755 | SEQ. ID NO. 0366 | GCAGAGAGAGCAGATTTGA | 16 | 0.4 |
| MAP2K1 | NM_002755 | SEQ. ID NO. 0367 | GAGGTTCTCTGGATCAAGT | 14 | 15.5 |
| MAP2K1 | NM_002755 | SEQ. ID NO. 0368 | GAGCAGATTFGAAGCAACT | 14 | 18.5 |
| MAP2K2 | NM_030662 | SEQ. ID NO. 0369 | CAAAGACGATGACTTCGAA | 37 | 26.4 |
| MAP2K2 | NM_030662 | SEQ. ID NO. 0370 | GATCAGCATTTGCATGGAA | 24 | -0.7 |
| MAP2K2 | NM_030662 | SEQ. ID NO. 0371 | TCCAGGAGTTTGTCAATAA | 17 | -4.5 |
| MAP2K2 | NM_030662 | SEQ. ID NO. 0372 | GGAAGCTGATCCACCTTGA | 16 | 59.2 |
| KNSL1(EG5) | NM_004523 | SEQ. ID NO. 0373 | GCAGAAATCTAAGGATATA | 53 | 35.8 |
| KNSL1(EG5) | NM_004523 | SEQ. ID NO. 0374 | CAACAAGGATGAAGTCTAT | 50 | 18.3 |
| KNSL1(EG5) | NM_004523 | SEQ. ID NO. 0375 | CAGCAGAAATCTAAGGATA | 41 | 32.7 |
| KNSL1(EG5) | NM_004523 | SEQ. ID NO. 0376 | CTAGATGGCTTTCTCAGTA | 39 | 3.9 |
| CyclophilinA_ | NM_021130 | SEQ. ID NO. 0377 | AGACAAGGTCCCAAAGACA | -16 | 58.1 |
| CyclophilinA_ | NM_021130 | SEQ. ID NO. 0378 | GGAATGGCAAGACCAGCAA | -6 | 36 |
| CyclophilinA_ | NM_021130 | SEQ. ID NO. 0379 | AGAATTATTCCAGGGTTTA | -3 | 16.1 |
| CyclophilinA_ | NM_021130 | SEQ. ID NO. 0380 | GCAGACAAGGTCCCAAAGA | 8 | 8.9 |
| LAMIN A/C | NM_170707 | SEQ. ID NO. 0381 | AGAAGCAGCTTCAGGATGA | 31 | 38.8 |
| LAMIN A/C | NM_170707 | SEQ. ID NO. 0382 | GAGCTTGACTTCCAGAAGA | 33 | 22.4 |
| LAMIN A/C | NM_170707 | SEQ. ID NO. 0383 | CCACCGAAGTTCACCCTAA | 21 | 27.5 |
| LAMIN A/C | NM_170707 | SEQ. ID NO. 0384 | GAGAAGAGCTCCTCCATCA | 55 | 30.1 |
| CyclophilinB | M60857 | SEQ. ID NO. 0385 | GAAAGAGCATCTACGGTGA | 41 | 83.9 |
| CyclophilinB | M60857 | SEQ. ID NO. 0386 | GAAAGGATTTGGCTACAAA | 53 | 59.1 |
| CyclopbilinB | M60857 | SEQ. ID NO. 0387 | ACAGCAAATTCCATCGTGT | -20 | 28.8 |
| CyclophilinB | M60857 | SEQ. ID NO. 0388 | GGAAAGACTGTTCCAAAAA | 2 | 27 |
| DBI1 | NM_020548 | SEQ. ID NO. 0389 | CAACACGCCTCATCGTCTA | 27 | -7.6 |
| DBI2 | NM_020548 | SEQ. ID NO. 0390 | CATGAAAGCTTACATCAAC | 25 | -30.8 |
| DBI3 | NM_020548 | SEQ. ID NO. 0391 | AAGATGCCATGAAAGCTTA | 17 | 22 |
| DBI4 | NM_020548 | SEQ. ID NO. 0392 | GCACATACCGCCTGAGTCT | 15 | 3.9 |
| rLUC1 | | SEQ. ID NO. 0393 | GATCAAATCTGAAGAAGGA | 57 | 49.2 |
| rLUC2 | | SEQ. ID NO. 0394 | GCCAAGAAGTTTCCTAATA | 50 | 13.7 |
| rLUC3 | | SEQ. ID NO. 0395 | CAGCATATCTTGAACCATT | 41 | -2.2 |
| rLUC4 | | SEQ. ID NO. 0396 | GAACAAAGGAAACGGATGA | 39 | 29.2 |
| SeAP1 | NM_031313 | SEQ. ID NO. 0397 | CGGAAACGGTCCAGGCTAT | 6 | 26.9 |
| SeAP2 | NM_031313 | SEQ. ID NO. 0398 | GCTTCGAGCAGACATGATA | 4 | -11.2 |
| SeAP3 | NM_031313 | SEQ. ID NO. 0399 | CCTACACGGTCCTCCTATA | 4 | 4.9 |
| SeAP4 | NM_031313 | SEQ. ID NO. 0400 | GCCAAGAACCTCATCATCT | 1 | -9.9 |
| fLUC1 | | SEQ. ID NO. 0401 | GATATGGGCTGAATACAAA | 54 | 40.4 |
| fLUC2 | | SEQ. ID NO. 0402 | GCACTCTGATTGACAAATA | 47 | 54.7 |

TABLE V-continued

| Gene Name | Accession Formula Number | SEQ. ID NO. | Formula FT11SeqTence | VIII | IX |
|---|---|---|---|---|---|
| fLUC3 | | SEQ. ID NO. 0403 | TGAAGTCTCTGATTAAGTA | 46 | 34.5 |
| fLUC4 | | SEQ. ID NO. 0404 | TCAGAGAGATCCTCATAAA | 40 | 11.4 |
| mCyclo_1 | NM_008907 | SEQ. ID NO. 0405 | GCAAGAAGATCACCATTTC | 52 | 46.4 |
| mCyclo_2 | NM_008907 | SEQ. ID NO. 0406 | GAGAGAAATTTGAGGATGA | 36 | 70.7 |
| mCyclo_3 | NM_008907 | SEQ. ID NO. 0407 | GAAAGGATTTGGCTATAAG | 35 | -1.5 |
| mCyclo_4 | NM_008907 | SEQ. ID NO. 0408 | GAAAGAAGGCATGAACATT | 27 | 10.3 |
| BCL2_1 | NM_000633 | SEQ. ID NO. 0409 | GGGAGATAGTGATGAAGTA | 21 | 72 |
| BCL2_2 | NM_000633 | SEQ. ID NO. 0410 | GAAGTACATCCATTATAAG | 1 | 3.3 |
| BCL2_3 | NM 090633 | SEQ. ID NO. 0411 | GTACGACAACCGGGAGATA | 1 | 35.9 |
| BCL2_4 | NM_000633 | SEQ. ID NO. 0412 | AGATAGTGATGAAGTACAT | -12 | 22.1 |
| BCL2_5 | NM_000633 | SEQ. ID NO. 0413 | TGAAGACTCTGCTCAGTTT | 36 | 19.1 |
| BCL2_6 | NM_000633 | SEQ. ID NO. 0414 | GCATGCGGCCTCTGTTTGA | 5 | -9.7 |
| QB1 | NM_003365.1 | SEQ. ID NO. 0415 | GCACACAGCUUACUACAUC | 52 | -4.8 |
| QB2 | NM_003365.1 | SEQ. ID NO. 0416 | GAAAUGCCCUGGUAUCUCA | 49 | 22.1 |
| QB3 | NM_003365.1 | SEQ. ID NO. 0417 | GAAGGAACGUGAUGUGAUC | 34 | 22.9 |
| QB4 | NM_003365.1 | SEQ. ID NO. 0418 | GCACUACUCCUGUGUGUGA | 28 | 20.4 |
| ATE1-1 | NM_007041 | SEQ. ID NO. 0419 | GAACCCAGCUGGAGAACUU | 45 | 15.5 |
| ATE1-2 | NM_007041 | SEQ. ID NO. 0420 | GAUAUACAGUGUGAUCUUA | 40 | 12.2 |
| ATE1-3 | NM_007041 | SEQ. ID NO. 0421 | GUACUACGAUCCUGAUUAU | 37 | 32.9 |
| ATE1-4 | NM_007041 | SEQ. ID NO. 0422 | GUGCCGACCUUUACAAUUU | 35 | 18.2 |
| EGFR-1 | NM_005228 | SEQ. ID NO. 0423 | GAAGGAAACTGAATTCAAA | 68 | 79.4 |
| EGFR-1 | NM_005228 | SEQ. ID NO. 0424 | GGAAATATGTACTACGAAA | 49 | 49.5 |
| EGFR-1 | NM_005228 | SEQ. ID NO. 0425 | CCACAAAGCAGTGAATTTA | 41 | 7.6 |
| EGFR-1 | NM_005228 | SEQ. ID NO. 0426 | GTAACAAGCTCACGCAGTT | 40 | 25.9 |

Example VII

Genome-Wide Application of the Algorithm

The examples described above demonstrate that the algorithm(s) can successfully identify functional siRNA and that these duplexes can be used to induce the desirable phenotype of transcriptional knockdown or knockout. Each gene or family of genes in each organism plays an important role in maintaining physiological homeostasis and the algorithm can be used to develop functional, highly functional, or hyperfunctional siRNA to each gene. To accomplish this for the human genome, the entire online ncbi refseq database was accessed through Entrez (efetch). The database was processed through Formula VIII. For each gene the top 80-100 scores for siRNAs were obtained and BLAST'ed to insure that the selected sequences are specific in targeting the gene of choice. These sequences are provided on the enclosed CDs in electronic form.

With respect to the disks, there are four tables on each disk copy in text format: Tables XII-XV. Table XII, which is located in a file entitled Table_2.txt, provides a list of the 80-100 sequences for each target, identified by Formula VIII as having the highest relative SMARTscores™ for the target analyzed. Table XIII, which is located in a file entitled Table_13.txt, provides the SMARTscores™, and for each gene, a pool pick of up to four sequences is denoted. (The denotation of "1" in Table XIII means that it is a pool pick.) These pool pick sequences represent the most functional siRNAs for the corresponding target. Any 1, 2, 3, or 4 of the pool pick sequences could be used for gene silencing. Further, sequences that are not denoted as pool pick sequences, but that are included on the compact disks may also be used for gene silencing either alone or in combination with other sequences. However, their individual relative functionality would be less than that of a pool pick sequence. Table XIV, which is located in a file entitled Table_14.txt, provides an identification of genes by accession number, and Table XV, which is located in a file entitled Table_15.txt, provides a short name for the genes identified on the disk. The information contained on the disks is part of this patent application and are incorporated into the specification by reference. One may use these tables in order to identify functional siRNAs for the gene provided therein, by simply looking for the gene of interest and an siRNA that is listed as functional. Preferably, one would select one or more of the siRNA that most optimized for the target of interest and is denoted as a pool pick.

Table XII: siRNA Selected by Formula VIII
See data submitted herewith on a CD-ROM in accordance with PCT Administrative Instructions Section 801(a)
Table XIII: SMARTscores™
See data submitted herewith on a CD-ROM in accordance with PCT Administrative Instructions Section 801(a)
Table XIV: Identification of Targets
See data submitted herewith on a CD-ROM in accordance with PCT Administrative Instructions Section 801(a)
Table XV: Description of Targts
See data submitted herewith on a CD-ROM in accordance with PCT Administrative Instructions Section 801(a)

Many of the genes to which the described siRNA are directed play critical roles in disease etiology. For this reason, the siRNA listed in the accompanying compact disk may potentially act as therapeutic agents. A number of prophetic examples follow and should be understood in view of the siRNA that are identified on the accompanying CD. To isolate these siRNA, the appropriate message sequence for each gene is analyzed using one of the before mentioned formulas (preferably formula VIII) to identify potential siRNA targets. Subsequently these targets are BLAST'ed to eliminate homology with potentially off-targets.

The list of potential disease targets is extensive. For instance, over-expression of Bcl10 has been implicated in the development of MALT lymphoma (mucosa associated lymphoid tissue lymphoma) and thus, functional, highly functional, or hyperfunctional siRNA directed against that gene (e.g. SEQ. ID NO. 0427: GGAAACCUCUCAUUGCUAA; SEQ. ID NO. 0428: GAAAGAACCUUGCCGAUCA; SEQ. ID NO. 0429: GGAAAUACAUCAGAGCUUA, or SEQ. ID NO. 0430: GAAAGUAUGUGUCUUAAGU) may contribute to treatment of this disorder.

In another example, studies have shown that molecules that inhibit glutamine:fructose-6-phosphate aminotransferase (GFA) may act to limit the symptoms suffered by Type II diabetics. Thus, functional, highly functional, or hyperfunctional siRNA directed against GFA (also known as GFPT1: siRNA=SEQ. ID NO. 0433 UGAAACGGCUGCCUGA-UUU; SEQ. ID NO. 0434 GAAGUUACCUCUUACAUUU; SEQ. ID NO. 0435 GUACGAAACUGUAUGAUUA; SEQ. ID NO. 0436 GGACGAGGCUAUCAUUAUG) may contribute to treatment of this disorder.

In another example, the von Hippel-Lindau (VHL) tumor suppressor has been observed to be inactivated at a high frequency in sporadic clear cell renal cell carcinoma (RCC) and RCCs associated with VHL disease. The VHL tumor suppressor targets hypoxia-inducible factor-1 alpha (HIF-1 alpha), a transcription factor that can induce vascular endothelial growth factor (VEGF) expression, for ubiquitination and degradation. Inactivation of VHL can lead to increased levels of HIF-1 alpha, and subsequent VEGF over expression. Such over expression of VEGF has been used to explain the increased (and possibly necessary) vascularity observed in RCC. Thus, functional, highly functional, or hyperfunctional siRNAs directed against either HIF-1 alpha (SEQ. ID NO. 0437 GAAGGAACCUGAUGCUUUA; SEQ. ID NO. 0438 GCAUAUAUCUAGAAGGUAU; SEQ. ID NO. 0439 GAA-CAAAUACAUGGGAUUA; SEQ. ID NO. 0440 GGACA-CAGAUUUAGACUUG) or VEGF (SEQ. ID NO. 0441 GAACGUACUUGCAGAUGUG; SEQ. ID NO. 0442 GAGAAAGCAUUUGUUUGUA; SEQ. ID NO. 0443 GGAGAAAGCAUUUGUUUGU; SEQ. ID NO. 0444 CGAGGCAGCUUGAGUUAAA) may be useful in the treatment of renal cell carcinoma.

In another example, gene expression of platelet derived growth factor A and B (PDGF-A and PDGF-B) has been observed to be increased 22- and 6-fold, respectively, in renal tissues taken from patients with diabetic nephropathy as compared with controls. These findings suggest that over expression of PDGF A and B may play a role in the development of the progressive fibrosis that characterizes human diabetic kidney disease. Thus, functional, highly functional, or hyperfunctional siRNAs directed against either PDGF A (SEQ. ID NO. 0445: GGUAAGAUAUUGUGCUUUA; SEQ. ID NO. 0446: CCGCAAAUAUGCAGAAUUA; SEQ. ID NO. 0447: GGAUGUACAUGGCGUGUUA; SEQ. ID NO. 0448: GGUGAAGUUUGUAUGUUUA) or PDGF B
(SEQ. ID NO. 0449: CCGAGGAGCUUUAUGAGAU; SEQ. ID NO. 0450: GCUCCGCGCUUUCCGAUUU; SEQ. ID NO. 0451 GAGCAGGAAUGGUGAGAUG; SEQ. ID NO. 0452: GAACUUGGGAUAAGAGUGU; SEQ. ID NO. 0453 CCGAGGAGCUUUAUGAGAU; SEQ. ID NO. 0454 UUUAUGAGAUGCUGAGUGA) may be useful in the treatment of this form of kidney disorder.

In another example, a strong correlation exists between the over-expression of glucose transporters (e.g. GLUT12) and cancer cells. It is predicted that cells undergoing uncontrolled cell growth up-regulate GLUT molecules so that they can cope with the heightened energy needs associated with increased rates of proliferation and metastasis. Thus, siRNA-based therapies that target the molecules such as

```
GLUT1 (also known as SLC2A1: siRNA=
SEQ. ID NO.: 0455        GCAAUGAUGUCCAGAAGAA;

SEQ. ID NO.: 0456        GAAGAAUAUUCAGGACUUA;

SEQ. ID NO.: 0457        GAAGAGAGUCGGCAGAUGA;

SEQ. ID NO.: 0458        CCAAGAGUGUGCUAAAGAA)

GLUT12 (also known as SLCA12: siRNA=
SEQ. ID NO. 0459:        GAGACACUCUGAAAUGAUA;

SEQ. ID NO. 0460:        GAAAUGAUGUGGAUAAGAG;

SEQ. ID NO. 0461:        GAUCAAAUCCUCCCUGAAA;

SEQ. ID NO. 0462:        UGAAUGAGCUGAUGAUUGU)
``` and other related transporters, may be of value in treating a multitude of malignancies.

The siRNA sequences listed above are presented in a 5'→3' sense strand direction. In addition, siRNA directed against the targets listed above as well as those directed against other targets and listed in the accompanying compact disk may be useful as therapeutic agents.

Example VIII

Evidence for the Benefits of Pooling

Evidence for the benefits of pooling have been demonstrated using the reporter gene, luciferase. Ninety siRNA duplexes were synthesized using Dharmacon proprietary ACE® chemistry against one of the standard reporter genes: firefly luciferase. The duplexes were designed to start two base pairs apart and to cover approximately 180 base pairs of the luciferase gene (see sequences in Table III). Subsequently, the siRNA duplexes were co-transfected with a luciferase expression reporter plasmid into HEK293 cells using standard transfection protocols and luciferase activity was assayed at 24 and 48 hours.

Figure 15:
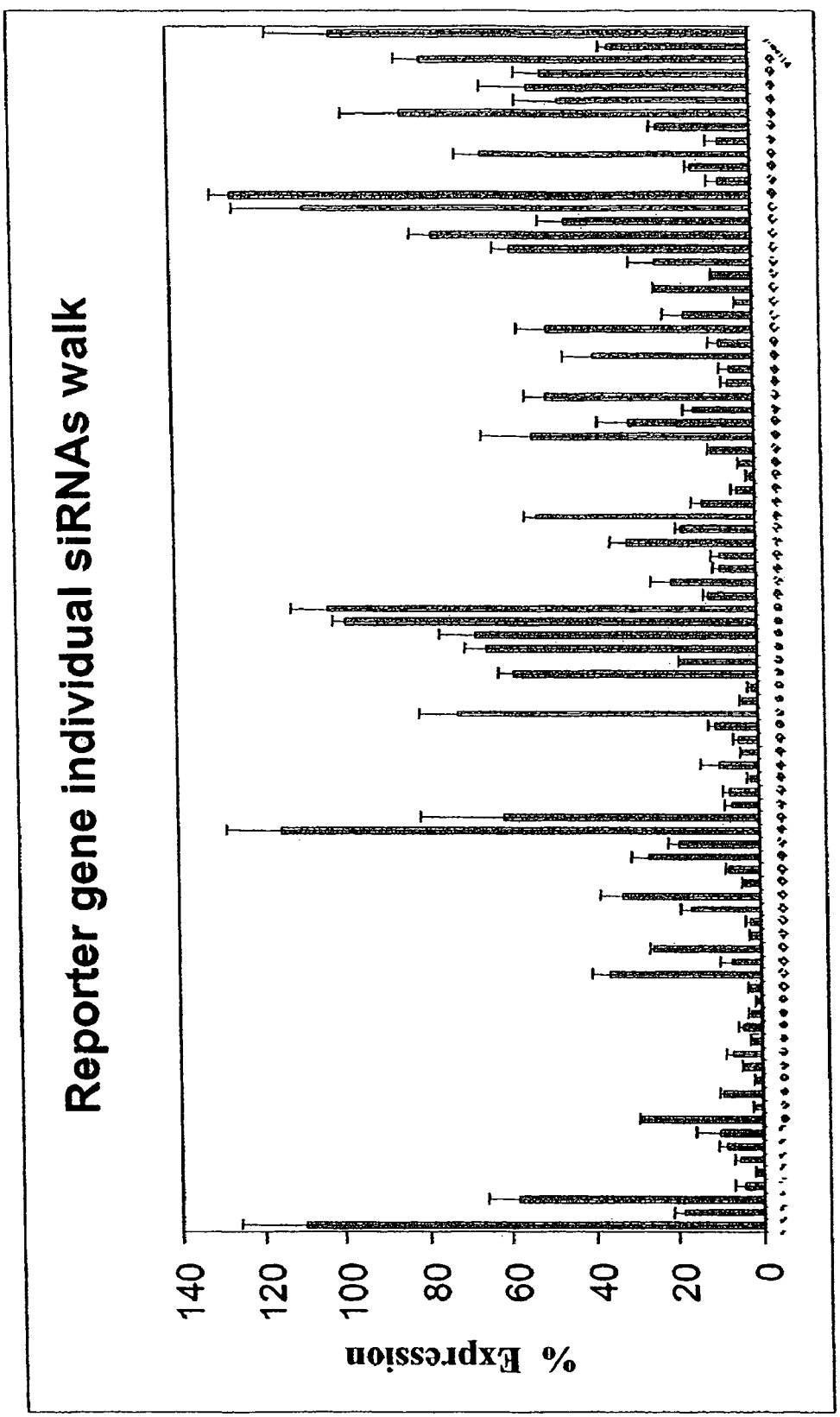
FIG. 15 represents a functional walk where siRNA beginning on every other base pair of a region of the luciferase gene are tested for the ability to silence the luciferase gene. The Y-axis represents the percent expression relative to a control. The X-axis represents the position of each individual siRNA.

Transfection of individual siRNAs showed standard distribution of inhibitory effect. Some duplexes were active, while others were not. FIG. 15 represents a typical screen of ninety siRNA duplexes (SEQ. ID NO. 0032-0120) positioned two base pairs apart. As the figure suggests, the functionality of the siRNA duplex is determined more by a particular sequence of the oligonucleotide than by the relative oligonucleotide position within a gene or excessively sensitive part of the mRNA, which is important for traditional anti-sense technology.

Figure 16:
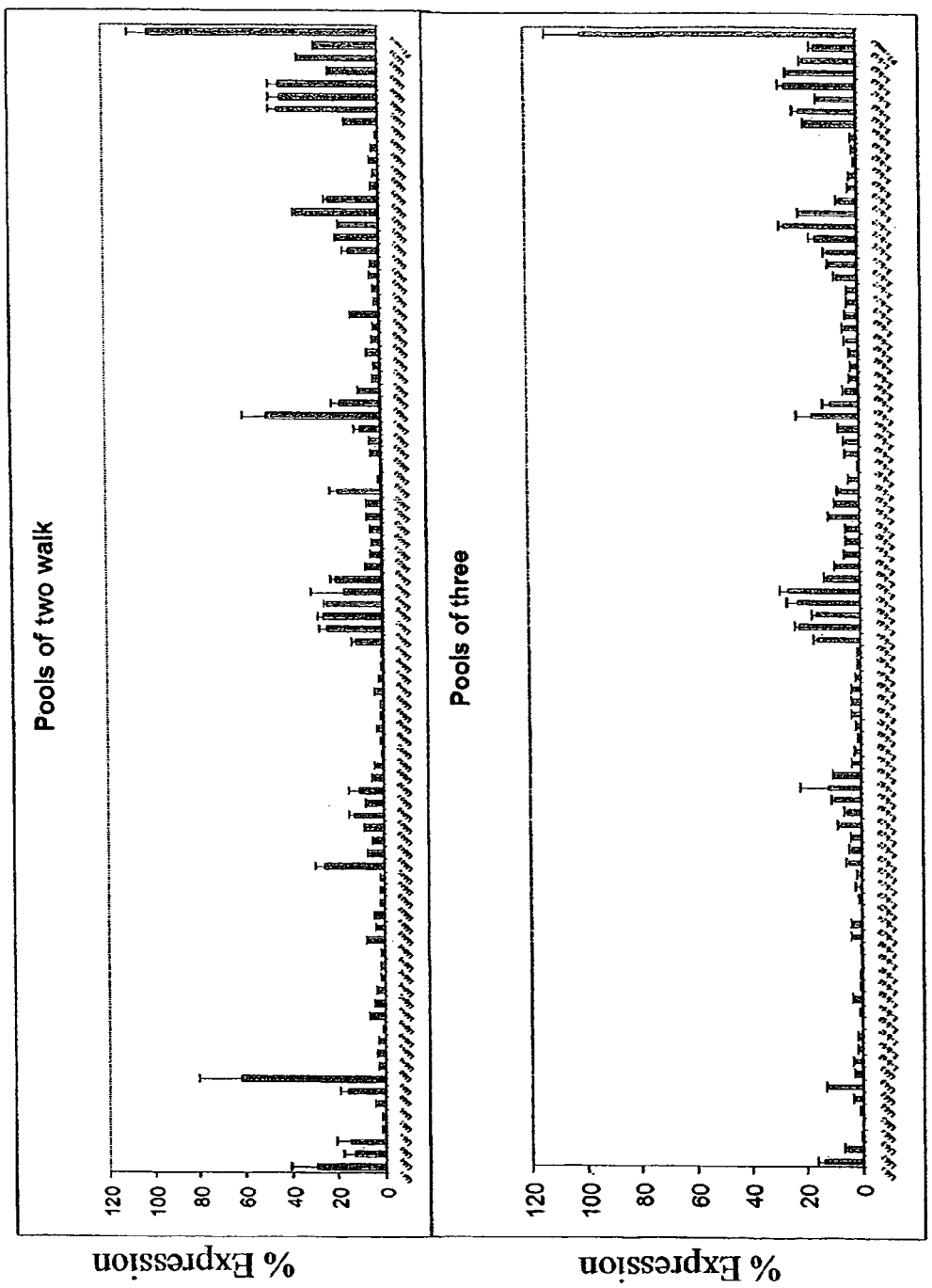
Figure 17:
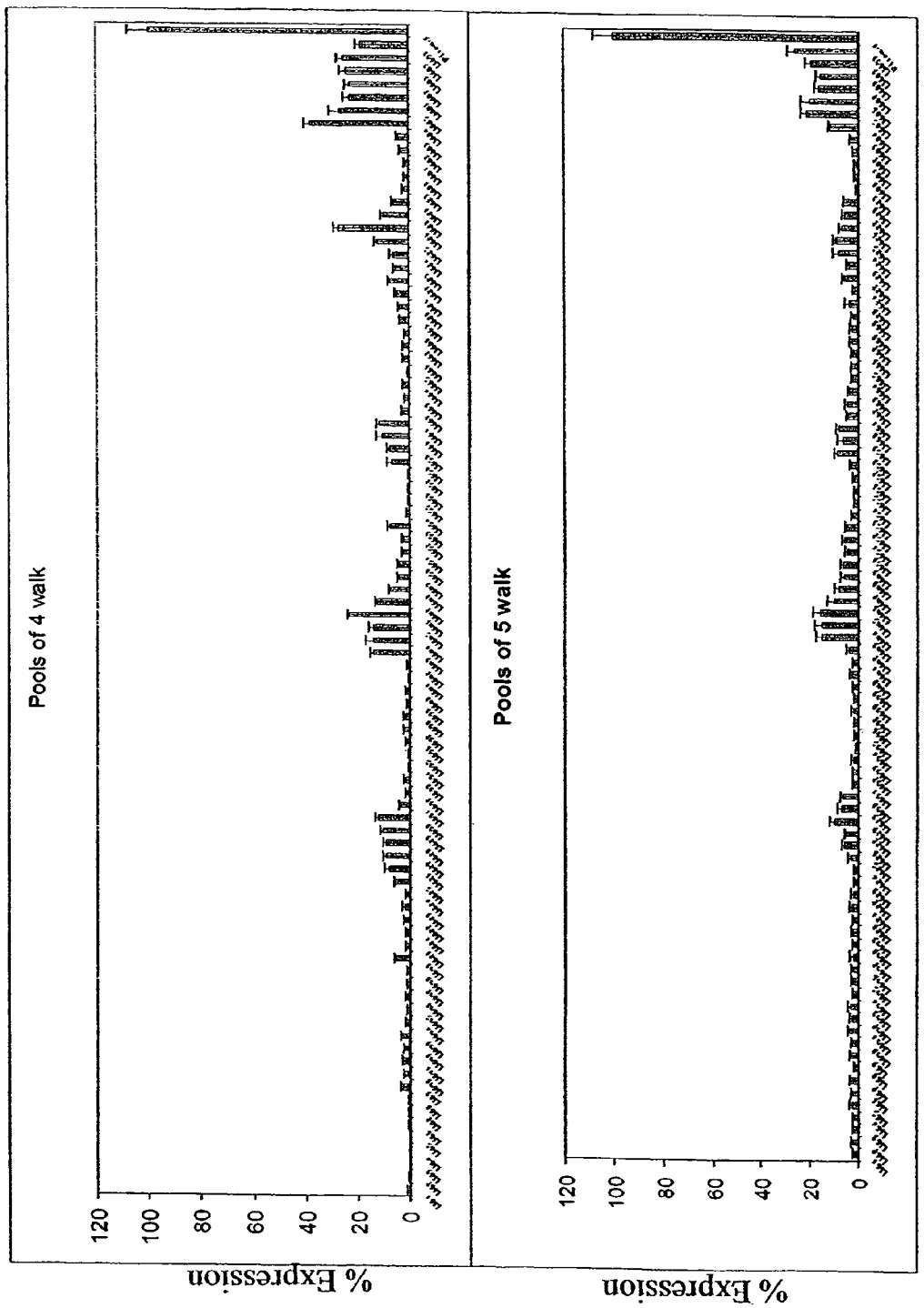
FIG. 17 is a histogram demonstrating the inhibition of target gene expression by pools of 4 and 5 siRNA duplexes. The Y-axis represents the percent expression relative to a control. The X-axis represents the positoin of the first siRNA in each pool.
Figure 18:
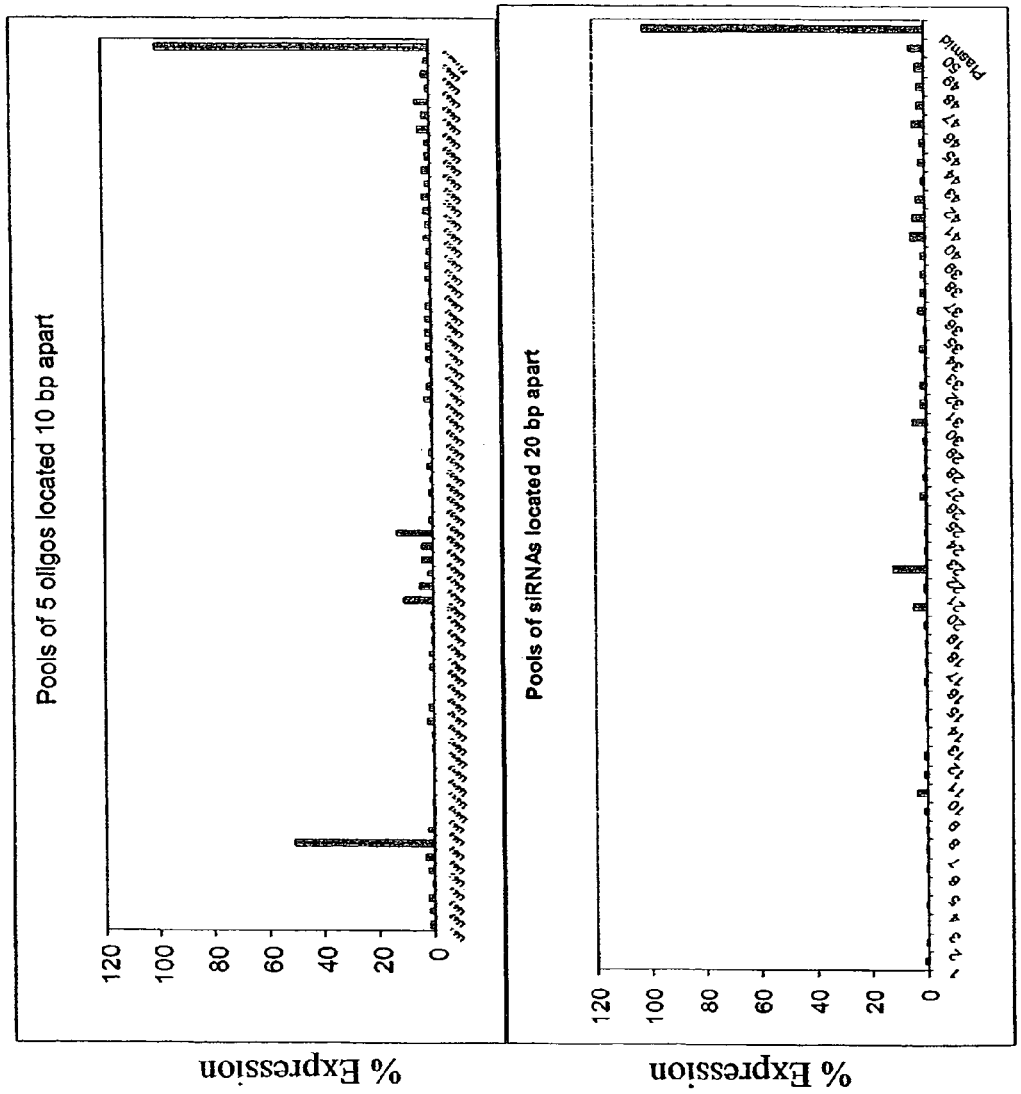
FIG. 18 is a histogram demonstrating the inhibition of target gene expression by siRNAs that are ten and twenty basepairs apart. The Y-axis represents the percent expression relative to a control. The X-axis represents the position of the first siRNA in each pool.

When two continuous oligonucleotides were pooled together, a significant increase in gene silencing activity was observed. (See FIG. 16) A gradual increase in efficacy and the frequency of pools functionality was observed when the number of siRNAs increased to 3 and 4. (FIGS. 16, 17). Further, the relative positioning of the oligonucleotides within a pool did not determine whether a particular pool was functional (see FIG. 18, in which 100% of pools of oligonucleotides distanced by 2, 10 and 20 base pairs were functional).

However, relative positioning may nonetheless have an impact. An increased functionality may exist when the siRNA are positioned continuously head to toe (5' end of one directly adjacent to the 3' end of the others).

Figure 19:
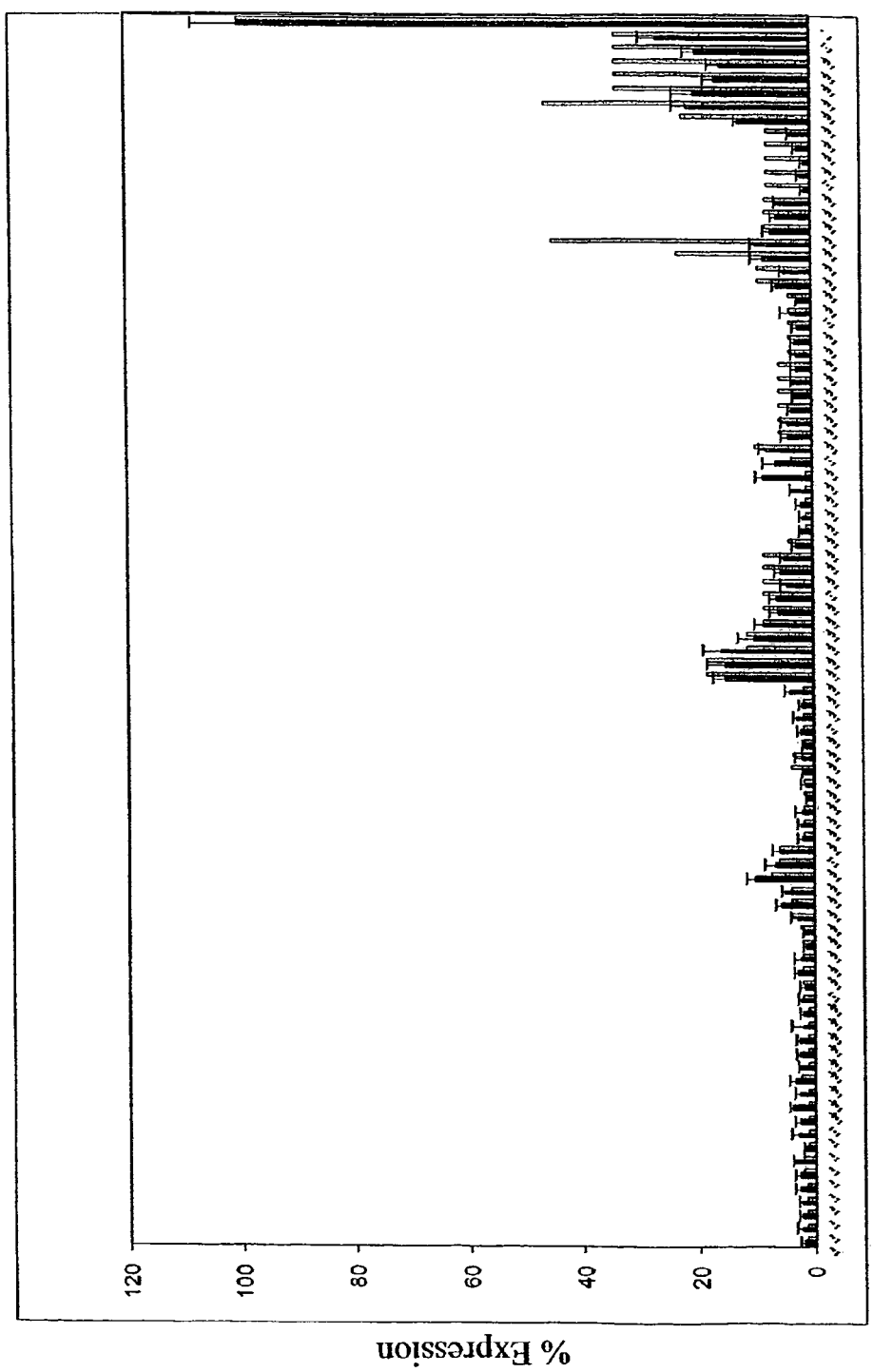
FIG. 19 shows that-pools of siRNAs (dark gray bar) work as well (or better) than the best siRNA in the pool (light gray bar). The Y-axis represents the percent expression relative to a control. The-X axis represents the position of the first siRNA in each pool.
Figure 20:
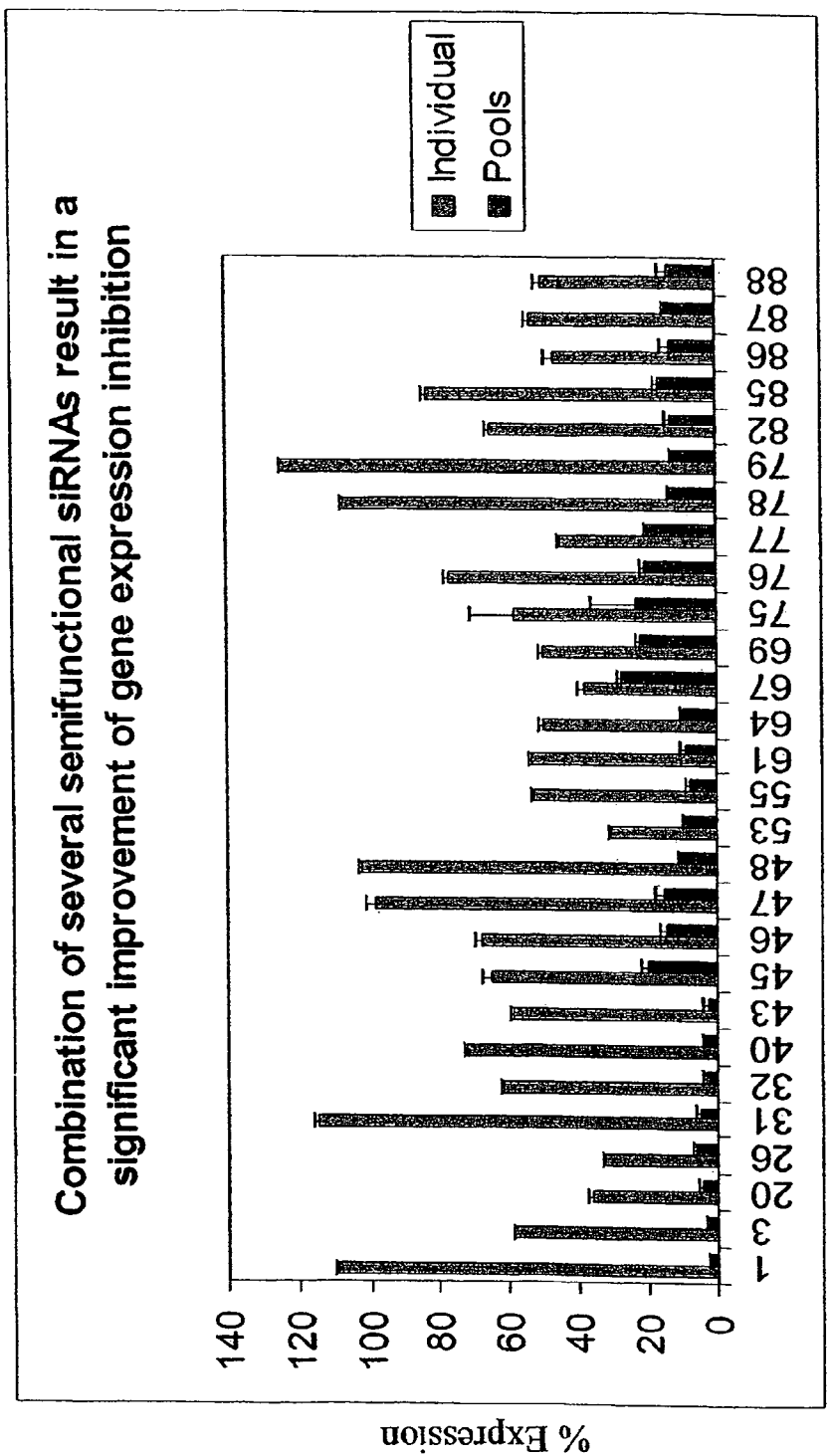
FIG. 20 shows that the combination of several semifunctional siRNAs (dark gray) result in a significant improvement of gene expression inhibition over individual (semi-functional; light gray) siRNA. The Y-axis represents the percent expression relative to a control.
Figure 21:
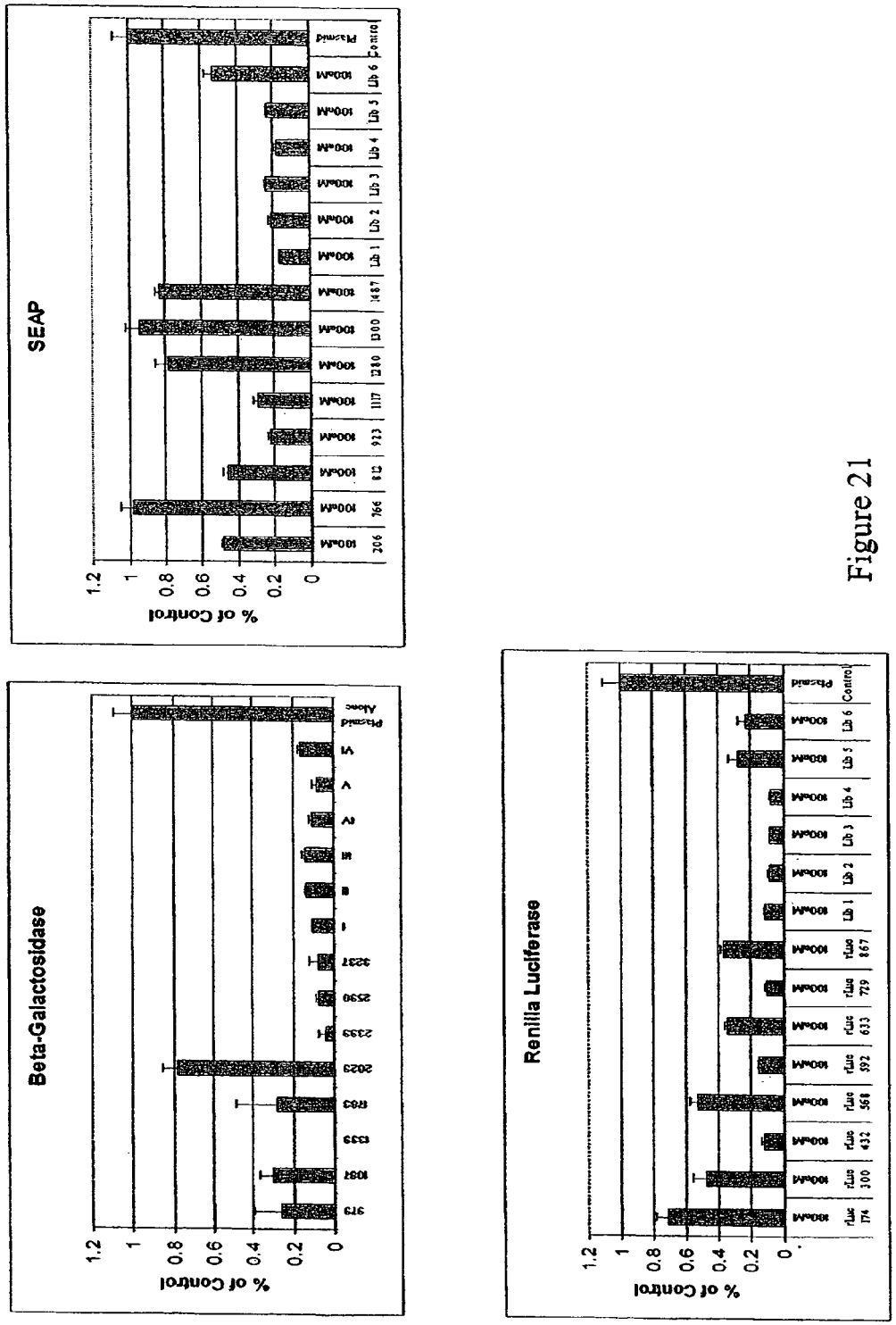
FIG. 21 shows both pools (Library, Lib) and individual siRNAs in inhibition of gene expression of Beta-Galactosidase, Renilla Luciferase and SEAP (alkaline phosphatase). Numbers on the X-axis indicate the position of the 5'-most nucleotide of the sense strand of the duplex. The Y-axis represents the percent expression of each gene relative to a control. Libraries contain siRNAs that begin at the following nucleotides: Seap: Lib 1: 206, 766, 812, 923, Lib 2: 1117, 1280, 1300, 1487, Lib 3: 206, 766, 812, 923, 1117, 1280, 1300, 1487; Lib 4: 206, 812, 1117, 1300, Lib 5: 766, 923, 1280, 1487, Lib 6: 206, 1487; Bgal: Lib 1: 979, 1339, 2029, 2590, Lib 2: 1087, 1783, 2399, 3257, Lib 3: 979, 1783, 2590, 3257, Lib 4: 979, 1087, 1339, 1783, 2029, 2399, 2590, 3257, Lib 5: 979, 1087, 1339, 1783, Lib 6: 2029, 2399, 2590, 3257; Renila: Lib 1: 174, 300, 432, 568, Lib 2: 592, 633, 729, 867, Lib 3: 174, 300, 432, 568, 592, 633, 729, 867, Lib 4: 174, 432, 592, 729, Lib 5: 300, 568, 633, 867, Lib 6: 592, 568.

Additionally, siRNA pools that were tested performed at least as well as the best oligonucleotide in the pool, under the experimental conditions whose results are depicted in FIG. 19. Moreover, when previously identified non-functional and marginally (semi) functional siRNA duplexes were pooled together in groups of five at a time, a significant functional cooperative action was observed. (See FIG. 20) In fact, pools of semi-active oligonucleotides were 5 to 25 times more functional than the most potent oligonucleotide in the pool. Therefore, pooling several siRNA duplexes together does not interfere with the functionality of the most potent siRNAs within a pool, and pooling provides an unexpected significant increase in overall functionality Example IX Pooling Across Species Experiments were performed on the following genes: β-galactosidase, Renilla luciferase, and Secreted alkaline phosphatase, which demonstrates the benefits of pooling. (see FIG. 21) Approximately 50% of individual siRNAs designed to silence the above-specified genes were functional, while 100% of the pools that contain the same siRNA duplexes were functional.

Example X

Highly Functional siRNA

Pools of five siRNAs in which each two siRNAs overlap to 10-90% resulted in 98% functional entities (>80% silencing). Pools of siRNAs distributed throughout the mRNA that were evenly spaced, covering an approximate 20-2000 base pair range, were also functional. When the pools of siRNA were positioned continuously head to tail relative to mRNA sequences and mimicked the natural products of Dicer cleaved long double stranded RNA, 98% of the pools evidenced highly functional activity (>95% silencing).

Example XI

Human Cyclophyline

Table III above lists the siRNA sequences for the human cyclophyline protein. A particularly functional siRNA may be selected by applying these sequences to any of Formula I to VII above.

Alternatively, one could pool 2, 3, 4, 5 or more of these sequences to create a kit for silencing a gene. Preferably, within the kit there would be at least one sequence that has a relatively high predicted functionality when any of Formulas I-VII is applied.

Example XII

Sample Pools of siRNAs and Their Application to Human Disease

The genetic basis behind human disease is well documented and siRNA may be used as both research or diagnostic tools and therapeutic agents, either individually or in pools. Genes involved in signal transduction, the immune response, apoptosis, DNA repair, cell cycle control, and a variety of other physiological functions have clinical relevance and therapeutic agents that can modulate expression of these genes may alleviate some or all of the associated symptoms. In some instances, these genes can be described as a member of a family or class of genes and siRNA (randomly, conventionally, or rationally designed) can be directed against one or multiple members of the family to induce a desired result.

To identify rationally designed siRNA to each gene, the sequence was analyzed using Formula VIII to identify a SMARTpool containing the functional sequences. To confirm the activity of these sequences, the siRNA are introduced into a cell type of choice (e.g. HeLa cells, HEK293 cells) and the levels of the appropriate message are analyzed using one of several art proven techniques. siRNA having heightened levels of potency can be identified by testing each of the before mentioned duplexes at increasingly limiting concentrations. Similarly, siRNA having increased levels of longevity can be identified by introducing each duplex into cells and testing functionality at 24, 48, 72, 96, 120, 144, 168, and 192 hours after transfection. Agents that induce >95% silencing at sub-nanomolar concentrations and/or induce functional levels of silencing for >96 hours are considered hyperfunctional.

The following are non-limiting examples of families of proteins to which siRNA described in this document are targeted against:

Transporters, Pumps, and Channels

Transporters, pumps, and channels represent one class of genes that are attractive targets for siRNAs. One major class of transporter molecules are the ATP-binding cassette (ABC) transporters. To date, nearly 50 human ABC-transporter genes have been characterized and have been shown to be involved in a variety of physiological functions including transport of bile salts, nucleosides, chloride ions, cholesterol, toxins, and more. Predominant among this group are MDR1 (which encodes the P-glycoprotein, NP_000918), the MDR-related proteins (MRP1-7), and the breast cancer resistance protein (BCRP). In general, these transporters share a common structure, with each protein containing a pair of ATP-binding domains (also known as nucleotide binding folds, NBF) and two sets of transmembrane (TM) domains, each of which typically contains six membrane-spanning α-helices.

The genes encoding this class of transporter are organized as either full transporters (i.e. containing two TM and two NBF domains) or as half transporters that assemble as either homodimers or heterodimers to create functional transporters. As a whole, members of the family are widely dispersed throughout the genome and show a high degree of amino acid sequence identify among eukaryotes.

ABC-transporters have been implicated in several human diseases. For instance, molecular efflux pumps of this type play a major role in the development of drug resistance exhibited by a variety of cancers and pathogenic microorganisms. In the case of human cancers, increased expression of the MDR1 gene and related pumps have been observed to generate drug resistance to a broad collection of commonly used chemotherapeutics including doxorubicin, daunorubicin, vinblastine, vincristine, colchicines. In addition to the contribution these transporters make to the development of multidrug resistance, there are currently 13 human genetic diseases associated with defects in 14 different transporters. The most common of these conditions include cystic fibrosis, Stargardt disease, age-related macular degeneration, adrenoleukodystrophy, Tangier disease, Dubin-Johnson syndrome and progressive familial intrahepatic cholestasis. For this reason, siRNAs directed against members of this, and related, families are potentially valuable research and therapeutic tools.

With respect to channels, analysis of *Drosophila* mutants has enabled the initial molecular isolation and characterization of several distinct channels including (but not limited to) potassium (K+) channels. This list includes shaker (Sh), which encodes a voltage activated $K^+$ channel, slowpoke (Slo), a $Ca^{2+}$ activated $K^+$ channel, and ether-a-go-go (Eag). The Eag family is further divided into three subfamilies: Eag, Elk (eag-like K channels), and Erg (Eag related genes).

The Erg subfamily contains three separate family members (Erg1-3) that are distantly related to the sh family of voltage activated $K^+$ channels. Like sh, erg polypetides contain the classic six membrane spanning architecture of $K^+$ channels (S1-S6) but differ in that each includes a segment associated with the C-terminal cytoplasmic region that is homologous to cyclic nucleotide binding domains (cNBD). Like many isolated ion channel mutants, erg mutants are temperature-sensitive paralytics, a phenotype caused by spontaneous repetitive firing (hyperactivity) in neurons and enhanced transmitter release at the neuromuscular junction.

Initial studies on the tissue distribution of all three members of the erg subfamily show two general patterns of expression. Erg1 and erg3 are broadly expressed throughout the nervous system and are observed in the heart, the superior mesenteric ganglia, the celiac ganglia, the retina, and the brain. In contrast, erg2 shows a much more restricted pattern of expression and is only observed in celiac ganglia and superior mesenteric ganglia. Similarly, the kinetic properties of the three erg potassium channels are not homogenous. Erg1 and erg2 channels are relatively slow activating delayed rectifiers whereas the erg3 current activates rapidly and then exhibits a predominantly transient component that decays to a sustained plateau. The current properties of all three channels are sensitive to methanesulfonanilides, suggesting a high degree of conservation in the pore structure of all three proteins.

Recently, the erg family of $K^+$ channels has been implicated in human disease. Consistent with the observation that erg1 is expressed in the heart, single strand conformation polymorphism and DNA sequence analyses have identified HERG (human erg1) mutations in six long-QT-syndrome (LQT) families, an inherited disorder that results in sudden death from a ventricular tachyarrythmia. Thus siRNA directed against this group of molecules (e.g. KCNH1-8) will be of extreme therapeutic value.

Another group of channels that are potential targets of siRNAs are the CLCA family that mediate a $Ca^{2+}$-activated $Cl^-$ conductance in a variety of tissues. To date, two bovine (bCLC1; bCLCA2 (Lu-ECAM-1)), three mouse (mCLCA1; mCLCA2; mCLCA3) and four human (HCLCA1; hCLCA2; hCLCA3; hCLCA4) CLCA family members have been isolated and patch-clamp studies with transfected human embryonic kidney (HEK-293) cells have shown that bCLCA1, mCLCA1, and hCLCA1 mediate a $Ca^{2+}$-activated $Cl^-$ conductance that can be inhibited by the anion channel blocker DIDS and the reducing agent dithiothreitol (DTT).

The protein size, structure, and processing seem to be similar among different CLCA family members and has been studied in greatest detail for Lu-ECAM-1. The Lu-ECAM-1 open reading frame encodes a precursor glycoprotein of 130 kDa that is processed to a 90-kDa amino-terminal cleavage product and a group of 30- to 40-kDa glycoproteins that are glycosylation variants of a single polypeptide derived from its carboxy terminus. Both subunits are associated with the outer cell surface, but only the 90-kDa subunit is thought to be anchored to the cell membrane via four transmembrane domains.

Although the protein processing and function appear to be conserved among CLCA homologs, significant differences exist in their tissue expression patterns. For example, bovine Lu-ECAM-1 is expressed primarily in vascular endothelia, bCLCA1 is exclusively detected in the trachea, and hCLCA1 is selectively expressed in a subset of human intestinal epithelial cells. Thus the emerging picture is that of a multigene family with members that are highly tissue specific, similar to the ClC family of voltage-gated $Cl^-$ channels. The human channel, hCLCA2, is particular interesting from a medical and pharmacological standpoint. CLCA2 is expressed on the luminal surface of lung vascular endothelia and serves as an adhesion molecule for lung metastatic cancer cells, thus mediating vascular arrest and lung colonization. Expression of this molecule in normal mammary epithelium is consistently lost in human breast cancer and in nearly all tumorigenic breast cancer cell lines. Moreover, re-expression of hCLCA2 in human breast cancer cells abrogates tumorigenicity in nude mice, implying that hCLCA2 acts as a tumour suppressor in breast cancer. For these reasons, siRNA directed against CLCA family members and related channels may prove to be valuable in research and therapeutic venues.

Transporters Involved in Synaptic Transmission.

Synaptic transmission involves the release of a neurotransmitter into the synaptic cleft, interaction of that transmitter with a postsynaptic receptor, and subsequent removal of the transmitter from the cleft. In most synapses the signal is terminated by a rapid reaccumulation of the neurotransmitter into presynaptic terminals. This process is catalyzed by specific neurotransmitter transporters that are often energized by the electrochemical gradient of sodium across the plasma membrane of the presynaptic cells.

Aminobutyric acid (GABA) is the major inhibitory neurotransmitter in the central nervous system. The inhibitory action of GABA, mediated through $GABA_A/GABA_B$ receptors, and is regulated by GABA transporters (GATs), integral membrane proteins located perisynaptically on neurons and glia. So far four different carriers (GAT1-GAT4) have been cloned and their cellular distribution has been partly worked out. Comparative sequence analysis has revealed that GABA transporters are related to several other proteins involved in neurotransmitter uptake including gamma-aminobutyric acid transporters, monoamine transporters, amino acid transporters, certain "orphan" transporters, and the recently discovered bacterial transporters. Each of these proteins has a similar 12 transmembrane helices topology and relies upon the Na+/Cl-gradient for transport function. Transport rates are dependent on substrate concentrations, with half-maximal effective concentrations for transport frequently occurring in the submicromolar to low micromolar range. In addition, transporter function is bidirectional, and non-vesicular efflux of transmitter may contribute to ambient extracellular transmitter levels.

Recent evidence suggests that GABA transporters, and neurotransmitter transporters in general, are not passive players in regulating neuronal signaling, rather, transporter function can be altered by a variety of initiating factors and signal transduction cascades. In general, this functional regulation occurs in two ways, either by changing the rate of transmitter flux through the transporter or by changing the number of functional transporters on the plasma membrane. A recurring theme in transporter regulation is the rapid redistribution of the transporter protein between intracellular locations and the cell surface. In general, this functional modulation occurs in part through activation of second messengers such as kinases, phosphatases, arachidonic acid, and pH. However, the mechanisms underlying transporter phosphorylation and transporter redistribution have yet to be fully elucidated.

GABA transporters play a pathophysiological role in a number of human diseases including temporal lobe epilepsy and are the targets of pharmacological interventions. Studies in seizure sensitive animals show some (but not all) of the GAT transporters have altered levels of expression at times prior to and post seizure, suggesting this class of transporter may affect epileptogenesis, and that alterations following seizure may be compensatory responses to modulate seizure activity. For these reasons, siRNAs directed against members of this family of genes (including but not limited to SLCG6A1-12) may prove to be valuable research and therapeutic tools.

Organic Ion Transporters.

The human body is continuously exposed to a great variety of xenobiotics, via food, drugs, occupation, and environment Excretory organs such as kidney, liver, and intestine defend the body against the potentially harmful effects of these compounds by transforming them into less active metabolites that are subsequently secreted from the system.

Carrier-mediated transport of xenobiotics and their metabolites exist for the active secretion of organic anions and cations. Both systems are characterized by a high clearance capacity and tremendous diversity of substances accepted, properties that result from the existance of multiple transporters with overlapping substrate specificities. The class of organic anion transporters plays a critical role in the elimination of a large number of drugs (e.g., antibiotics, chemotherapeutics, diuretics, nonsteroidal anti-inflammatory drugs, radiocontrast agents, cytostatics); drug metabolites (especially conjugation products with glutathione, glucuronide, glycine, sulfate, acetate); and toxicants and their metabolites (e.g., mycotoxins, herbicides, plasticizers, glutathione S-conjugates of polyhaloalkanes, polyhaloalkenes, hydroquinones, aminophenols), many of which are specifically harmful to the kidney.

Over the past couple of years the number of identified anion transporting molecules has grown tremendously Uptake of organic anions (OA⁻) across the basolateral membrane is mediated by the classic sodium-dependent organic anion transport system, which includes α-ketoglutarate ($\alpha$-$KG^{2-}$)/$OA^-$ exchange via the organic anion transporter (OAT1) and sodium-ketoglutarate cotransport via the Na$^+$/dicarboxylate cotransporter (SDCT2). The organic anion transporting polypeptide, Oatp1, and the kidney-specific OAT-K1 and OAT-K2 are seen as potential molecules that mediate facilitated OA⁻ efflux but could also be involved in reabsorption via an exchange mechanism. Lastly the PEPT1 and PEPT2 mediate luminal uptake of peptide drugs, whereas CNT1 and CNT2 are involved in reabsorption of nucleosides The organic anion-transporting polypeptide 1 (Oatp1) is a Na$^+$- and ATP-independent transporter originally cloned from rat liver. The tissue distribution and transport properties of the Oatp1 gene product are complex. Oatp1 is localized to the basolateral membrane of hepatocytes, and is found on the apical membrane of S3 proximal tubules. Studies with transiently transfected cells (e.g. HeLa cells) have indicated that Oatp1 mediates transport of a variety of molecules including taurocholate, estrone-3-sulfate, aldosterone, cortisol, and others. The observed uptake of taurocholate by Oatp1 expressed in *X. laevis* oocytes is accompanied by efflux of GSH, suggesting that transport by this molecule may be glutathione dependent.

Computer modeling suggests that members of the Oatp family are highly conserved, hydrophobic, and have 12 transmembrane domains. Decreases in expression of Oatp family members have been associated with cholestatic liver diseases and human hepatoblastomas, making this family of proteins of key interest to researchers and the medical community. For these reasons, siRNAs directed against OAT family members (including but not limited to SLC21A2, 3, 6, 8, 9, 11, 12, 14, 15, and related transporters) are potentially useful as research and therapeutic tools.

Nucleoside Transporters.

Nucleoside transporters play key roles in physiology and pharmacology. Uptake of exogenous nucleosides is a critical first step of nucleotide synthesis in tissues such as bone marrow and intestinal epithelium and certain parasitic organisms that lack de novo pathways for purine biosynthesis. Nucleoside transporters also control the extracellular concentration of adenosine in the vicinity of its cell surface receptors and regulate processes such as neurotransmission and cardiovascular activity. Adenosine itself is used clinically to treat cardiac arrhythmias, and nucleoside transport inhibitors such as dipyridamole, dilazep, and draflazine function as coronary vasodilators.

In mammals, plasma membrane transport of nucleosides is brought about by members of the concentrative, Na$^+$-dependent (CNT) and equilibrative, Na$^+$-independent (ENT) nucleoside transporter families. CNTs are expressed in a tissue-specific fashion; ENTs are present inmost, possibly all, cell types and are responsible for the movement of hydrophilic nucleosides and nucleoside analogs down their concentration gradients. In addition, structure/function studies of ENT family members have predicted these molecules to contain eleven transmembrane helical segments with an amino terminus that is intracellular and a carboxyl terminus that is extracellular. The proteins have a large glycosylated loop between TMs 1 and 2 and a large cytoplasmic loop between TMs 6 and 7. Recent investigations have implicated the TM 3-6 region as playing a central role in solute recognition. The medical importance of the ENT family of proteins is broad. In humans adenosine exerts a range of cardioprotective effects and inhibitors of ENTs are seen as being valuable in alleviating a variety of cardio/cardiovascular ailments. In addition, responses to nucleoside analog drugs has been observed to vary considerably amongst e.g. cancer patients. While some forms of drug resistance have been shown to be tied to the up-regulation of ABC-tansporters (e.g. MDR1), resistance may also be the result of reduced drug uptake (i.e. reduced ENT expression). Thus, a clearer understanding of ENT transporters may aid in optimizing drug treatments for patients suffering a wide range of malignancies. For these reasons, siRNAs directed against this class of molecules (including SLC28A1-3, SLC29A1-4, and related molecules) may be useful as therapeutic and research tools.

Sulfate Transporters.

All cells require inorganic sulfate for normal function. Sulfate is the fourth most abundant anion in human plasma and is the major source of sulfur in many organisms. Sulfation of extracellular matrix proteins is critical for maintaining normal cartilage metabolism and sulfate is an important constituent of myelin membranes found in the brain Because sulfate is a hydrophilic anion that cannot passively cross the lipid bilayer of cell membranes, all cells require a mechanism for sulfate influx and efflux to ensure an optimal supply. To date, a variety of sulfate transporters have been identified in tissues from many origins. These include the renal sulfate transporters (NaSi-1 and Sat-1), the ubiquitously expressed diastrophic dysplasia sulfate transporter (DTDST), the intestinal sulfate transporter (DRA), and the erythrocyte anion exchanger (AE1). Most, if not all, of these molecules contain the classic 12 transmembrane spanning domain architecture commonly found amongst members of the anion transporter superfamily.

Recently three different sulfate transporters have been associated with specific human genetic diseases. Family members SLC26A2, SLC26A3, and SLC26A4 have been recognized as the disease genes mutated in diastrophic dysplasia, congenital chloride diarrhea (CLD), and Pendred syndrome (PDS), respectively. DTDST is a particularly complex disorder. The gene encoding this molecule maps to chromosome 5q, and encodes two distinct transcripts due to alternative exon usage. In contrast to other sulfate transporters (e.g. Sat-1) anion movement by the DTDST protein is markedly inhibited by either extracellular chloride or bicarbonate. Impaired function of the DTDST gene product leads to undersulfation of proteoglycans and a complex family of recessively inherited osteochondrodysplasias (achondrogenesis type 1B, atelosteogenesis type II, and diastrophic dysplasia) with clinical features including but not limited to, dwarfism, spinal deformation, and specific joint abnormalities. Interestingly, while epidemiological studies have shown that the disease occurs in most populations, it is particularly prevalent in Finland owing to an apparent founder effect. For these reasons, siRNAs directed against this class of genes (including but not limited to SLC26A1-9, and related molecules) may be potentially helpful in both therapeutic and research venues.

Ion Exchangers

Intracellular pH regulatory mechanisms are critical for the maintenance of countless cellular processes. For instance, in muscle cells, contractile processes and metabolic reactions are influenced by pH. During periods of increased energy demands and ischemia, muscle cells produce large amounts of lactic acid that, without quick and efficient disposal, would lead to acidification of the sarcoplasm.

Several different transport mechanisms have evolved to maintain a relatively constant intracellular pH. The relative contribution of each of these processes varies with cell type, the metabolic requirements of the cell, and the local environmental conditions. Intracellular pH regulatory processes that have been characterized functionally include but are not limited to the $Na^+/H^+$ exchange, the $Na(HCO_3)_n$ cotransport, and the $Na^+$-dependent and -independent $Cl^-$/base exchangers. As bicarbonate and $CO_2$ comprise the major pH buffer of biological fluids, sodium biocarbonate cotransporters (NBCs) are critical. Studies have shown that these molecules exist in numerous tissues including the kidney, brain, liver, cornea, heart, and lung, suggesting that NBCs play an important role in mediating $HCO_3^-$ transport in both epithelial as well as nonepithelial cells.

Recent molecular cloning experiments have identified the existence of four NBC isoforms (NBC1, 2, 3 and 4) and two NBC-related proteins, AE4 and NCBE (Anion Exchanger 4 and Na-dependent Chloride-Bicarbonate Exchanger). The secondary structure analyses and hydropathy profile of this family predict them to be intrinsic membrane proteins with 12 putative transmembrane domains and several family members exhibit N-linked glycosylation sites, protein kinases A and C, casein kinase II, and ATP/GTP-binding consensus phosphorylation sites, as well as potential sites for myristylation and amidation. AE4 is a relatively recent addition to this family of proteins and shows between 30-48% homology with the other family members. When expressed in COS-7 cells and Xenopus oocytes AE4 exhibits sodium-independent and DIDS-insensitive anion exchanger activity. Exchangers have been shown to be responsible for a variety of human diseases. For instance, mutations in three genes of the anion transporter family (SLC) are believed to cause known hereditary diseases, including chondrodysplasia (SLC26A2, DTD), diarrhea (A3, down-regulated in adenoma/chloride-losing diarrhea protein: DRA/CLD), and goiter/deafness syndrome (A4, pendrin). Moreover mutations in Na+/HCO3 co-transporters have also been associated with various human maladies. For these reasons, siRNAs directed against these sorts of genes (e g. SLC4A4-10, and related genes) may be useful for therapeutic and research purposes.

Receptors Involved in Synaptic Transmission

In all vertebrates, fast inhibitory synaptic transmission is the result of the interaction between the neurotransmitters glycine (Gly) and γ-aminobutyric acid (GABA) and their respective receptors. The strychnine-sensitive glycine receptor is especially important in that it acts in the mammalian spinal cord and brain stem and has a well-established role in the regulation of locomotor behavior.

Glycine receptors display significant sequence homology to several other receptors including the nicotinic acetylcholine receptor, the aminobutyric acid receptor type A ($GABA_AR$), and the serotonin receptor type 3 ($5-HT_3R$) subunits. As members of the superfamily of ligand-gated ion channels, these polypeptides share common topological features. The glycine receptor is composed of two types of glycosylated integral membrane proteins ($\alpha1-\alpha4$ and $\beta$) arranged in a pentameric suprastructure. The alpha subunit encodes a large extracellular, N-terminal domain that carries the structural determinants essential for agonist and antagonist binding, followed by four transmembrane spanning regions (TM1-TM4), with TM2 playing the critical role of forming the inner wall of the chloride channel.

The density, location, and subunit composition of glycine neurotransmitter receptors changes over the course of development. It has been observed that the amount of GlyR gene translation (assessed by the injection of developing rat cerebral cortex mRNA into Xenopus oocytes) decreases with age, whereas that of GABARs increases. In addition, the type and location of mRNAs coding for GlyR changes over the course of development. For instance in a study of the expression of alpha 1 and alpha 2 subunits in the rat, it was observed that min embryonic periods E11-18) the mantle zone was scarce in the alpha 1 mRNA, but the germinal zone (matrix layer) at E11-14 expressed higher levels of the message. At postnatal day 0 (P0), the alpha 1 signals became manifested throughout the gray matter of the spinal cord. By contrast, the spinal tissues at P0 exhibited the highest levels of alpha-2 mRNA, which decreased with the postnatal development.

In both, man and mouse mutant lines, mutations of GlyR subunit genes result in hereditary motor disorders characterized by exaggerated startle responses and increased muscle tone. Pathological alleles of the Glra1 gene are associated with the murine phenotypes oscillator ($spd^{ot}$) and spasmodic (spd). Similarly, a mutant allele of Glrb has been found to underly the molecular pathology of the spastic mouse (spa). Resembling the situation in the mouse, a variety of GLRA1 mutant alleles have been shown to be associated with the human neurological disorder hyperekplexia or startle disease. For these reasons, siRNA directed against glycine receptors (GLRA1-3, GLRB, and related molecules), glutamate receptors, GABA receptors, ATP receptors, and related neurotransmitter receptor molecules may be valuable therapeutic and research reagents.

Proteases

Kallikreins

One important class of proteases are the kallikreins, serine endopeptidases that split peptide substrates preferentially on the C-terminal side of internal arginyl and lysyl residues. Kallikreins are generally divided into two distinct groups, plasma kallikreins and tissue kallikreins. Tissue kallikreins represent a large group of enzymes that have substantial similarities at both the gene and protein level. The genes encoding this group are frequently found on a single chromosome, are organized in clusters, and are expressed in a broad range of tissues (e.g. pancreas, ovaries, breast). In contrast, the plasma form of the enzyme is encoded by a single gene (e.g. KLK3) that has been localized to chromosome 4q34-35 in humans. The gene encoding plasma kallikrein is expressed solely in the liver, contains 15 exons, and encodes a glycoprotein that is translated as a preprotein called prekallikrein.

Kallikreins are believed to play an important role in a host of physiological events For instance, the immediate consequence of plasma prekallikrein activation is the cleavage of high molecular weight kininogen (HK) and the subsequent liberation of bradykinin, a nine amino acid vasoactive peptide that is an important mediator of inflammatory responses. Similarly, plasma kallikrein promotes single-chain urokinase activation and subsequent plasminogen activation, events that are critical to blood coaggulation and wound healing.

Disruptions in the function of kallikreins have been implicated in a variety of pathological processes including imbalances in renal function and inflammatory processes. For these reasons, siRNAs directed against this class of genes (e.g. KLK1-15) may prove valuable in both research and therapeutic settings.

ADAM Proteins

The process of fertilization takes place in a series of discrete steps whereby the sperm interacts with, i) the cumulus cells and the hyaluronic acid extracellular matrix (ECM) in which they are embedded, ii) the egg's own ECM, called the *zona pellucida* (ZP), and iii) the egg plasma membrane. During the course of these interactions, the "acrosome reaction," the exocytosis of the acrosome vesicle on the head of the sperm, is induced, allowing the sperm to penetrate the ZP and gain access to the perivitelline space. This process exposes new portions of the sperm membrane, including the inner acrosomal membrane and the equatorial segment, regions of the sperm head that can participate in initial gamete membrane binding.

The interactions of the gamete plasma membranes appear to involve multiple ligands and receptors and are frequently compared to leukocyte-endothelial interactions. These interactions lead to a series of signal transduction events in the egg, known as collectively as egg activation and include the initiation of oscillations in intracellular calcium concentration, the exit from meiosis, the entry into the first embryonic mitosis, and the formation of a block to polyspermy via the release of ZP-modifying enzymes from the egg's cortical granules. Ultimately, sperm and egg not only adhere to each other but also go on to undergo membrane fusion, making one cell (the zygote) from two.

Studies on the process of sperm-egg interactions have identified a number of proteins that are crucial for fertilization. One class of proteins, called the ADAM family (A Disintegrin And Metalloprotease), has been found to be important in spermatogenesis and fertilization, as well as various developmental systems including myogenesis and neurogenesis. Members of the family contain a disintegrin and metalloprotease domain (and therefore have (potentially) both cell adhesion and protease activities), as well as cysteine-rich regions, epidermal growth factor (EGF)-like domains, a transmembrane region, and a cytoplasmic tail. Currently, the ADAM gene family has 29 members and constituents are widely distributed in many tissues including the brain, testis, epididymis, ovary, breast, placenta, liver, heart, lung, bone, and muscle.

One of the best-studied members of the ADAM family is fertilin, a heterodimeric protein comprised of at least two subunits, fertilin alpha and fertilin beta. The fertilin beta gene (ADAM2) has been disrupted with a targeting gene construct corresponding to the exon encoding the fertilin beta disintegrin domain. Sperm from males homozygous for disruptions in this region exhibit defects in multiple facets of sperm function including reduced levels of sperm transit from the uterus to the oviduct, reduced sperm-ZP binding, and reduced sperm-egg binding, all of which contribute to male infertility.

Recently, four new ADAM family members (ADAM 24-27) have been isolated. The deduced amino acid sequences show that all four contain the complete domain organization common to ADAM family members and Northern Blot analysis has shown all four to be specific to the testes. SiRNAs directed against this class of genes (e.g. ADAM2 and related proteins) may be useful as research tools and therapeutics directed toward fertility and birth control.

Aminopeptidases

Aminopeptidases are proteases that play critical roles in processes such as protein maturation, protein digestion in its terminal stage, regulation of hormone levels, selective or homeostatic protein turnover, and plasmid stabilization. These enzymes generally have broad substrate specificity, occur in several forms and play a major role in physiological homeostasis. For instance, the effects of bradykinin, angiotensin converting enzyme (ACE), and other vasoactive molecules muted by one of several peptidases that cleave the molecule at an internal position and eliminate its ability to bind its cognate receptor (e.g. for bradykinin, the B2-receptor).

Among the enzymes that can cleave bradykinin is the membrane bound aminopeptidase P, also referred to as aminoacylproline aminopeptidase, proline aminopeptidase; X-Pro aminopeptidase (eukaryote) and XPNPEP2. Aminopeptidase P is an aminoacylproline aminopeptidase specific for NH$_2$-terminal Xaa-proline bonds. The enzyme i) is a mono-zinc-containing molecule that lacks any of the typical metal binding motifs found in other zinc metalloproteases, ii) has an active-site configuration similar to that of other members of the MG peptidase family, and iii) is present in a variety of tissues including but not limited to the lung, kidney, brain, and intestine.

Aminopeptidases play an important role in a diverse set of human diseases. Low plasma concentrations of aminopeptidase P are a potential predisposing factor for development of angio-oedema in patients treated with ACE inhibitors, and inhibitors of aminopeptidase P may act as cardioprotectors against other forms of illness including, but not limited to myocardial infarction. For these reasons, siRNAs directed against this family of proteins (including but not limited to XPNPEP1 and related proteins) may be useful as research and therapeutic tools.

Serine Proteases

One important class of proteases are the serine proteases. Serine proteases share a common catalytic triad of three amino acids in their active site (serine (nucleophile), aspartate (electrophile), and histidine (base)) and can hydrolyze either esters or peptide bonds utilizing mechanisms of covalent catalysis and preferential binding of the transition state. Based on the position of their introns serine proteases have been classified into a minimum of four groups including those in which 1) the gene has no introns interrupting the exon coding for the catalytic triad (e.g. the haptoglobin gene,); 2) each gene contains an intron just downstream from the codon for the histidine residue at the active site, a second intron downstream from the exon containing the aspartic acid residue of the active site and a third intron just upstream from the exon containing the serine of the active site (e.g. trypsinogen, chymotrypsinogen, kallikrein and proelastase); 3) the genes contain seven introns interrupting the exons coding the catalytic region (e.g. complement factor B gene); and 4) the genes contain two introns resulting in a large exon that contains both the active site aspartatic acid and serine residues (e.g. factor X, factor IX and protein C genes).

Cytotoxic lymphocytes (e.g. CD8(+) cytotoxic T cells and natural killer cells) form the major defense of higher organisms against virus-infected and transformed cells. A key function of these cells is to detect and eliminate potentially harmful cells by inducing them to undergo apoptosis. This is achieved through two principal pathways, both of which require direct but transient contact between the killer cell and its target. The first pathway involves ligation of TNF receptor-like molecules such as Fas/CD95 to their cognate ligands, and results in mobilization of conventional, programmed cell-death pathways centered on activation of pro-apoptotic caspases. The second mechanism consists of a pathway whereby the toxic contents of a specialized class of secretory vesicles are introduced into the target cell. Studies over the last two decades have identified the toxic components as Granzymes, a family of serine proteases that are expressed exclusively by cytotoxic T lymphocytes and natural killer (NK) cells. These agents are stored in specialized lytic granules and enter the target cell via endocytosis. Like caspases, cysteine proteases that play an important role in apoptosis, granzymes can cleave proteins after acidic residues, especially aspartic acid, and induce apoptosis in the recipient cell.

Granzymes have been grouped into three subfamilies according to substrate specificity. Members of the granzyme family that have enzymatic activity similar to the serine protease chymotrypsin are encoded by a gene cluster termed the 'chymase locus'. Similarly, granzymes with trypsin-like specificities are encoded by the 'tryptase locus', and a third subfamily cleaves after unbranched hydrophobic residues, especially methionine, and are encoded by the 'Met-ase locus'. All granzymes are synthesized as zymogens and, after clipping of the leader peptide, obtain maximal enzymatic activity subsequent to the removal of an amino-terminal dipeptide.

Granzymes have been found to be important in a number of important biological functions including defense against intracellular pathogens, graft versus host reactions, the susceptibility to transplantable and spontaneous malignancies, lymphoid homeostasis, and the tendency toward auto-immune diseases. For these reasons, siRNAs directed against granszymes (e.g. GZMA, GZMB, GZMH, GZHK, GZMM) and related serine proteases may be useful research and therapeutic reagents.

Kinases

Protein Kinases (PKs) have been implicated in a number of biological processes. Kinase molecules play a central role in modulating cellular physiology and developmental decisions, and have been implicated in a large list of human maladies including cancer, diabetes, and others.

During the course of the last three decades, over a hundred distinct protein kinases have been identified, all with presumed specific cellular functions. A few of these enzymes have been isolated to sufficient purity to perform in vitro studies, but most remain intractable due to the low abundance of these molecules in the cell. To counter this technical difficulty, a number of protein kinases have been isolated by molecular cloning strategies that utilize the conserved sequences of the catalytic domain to isolate closely related homologs. Alternatively, some kinases have been purified (and subsequently studied) based on their interactions with other molecules.

p58 is a member of the p34cdc2-related supergene family and contains a large domain that is highly homologous to the cell division control kinase, cdc2. This new cell division control-related protein kinase was originally identified as a component of semipurified galactosyltransferase; thus, it has been denoted galactosyltransferase-associated protein kinase (GTA-kinase). GTA-kinase has been found to be expressed in both adult and embryonic tissues and is known to phosphorylate a number of substrates, including histone H1, and casein. Interestingly enough, over expression of this molecule in CHO cells has shown that elevated levels of p58 result in a prolonged late telophase and an early G1 phase, thus hinting of an important role for GTA-kinase in cell cycle regulation.

Cyclin Dependent Kinases

The cyclin-dependent kinases (Cdks) are a family of highly conserved serine/threonine kinases that mediate many of the cell cycle transitions that occur during duplication. Each of these Cdk catalytic subunits associates with a specific subset of regulatory subunits, termed cyclins, to produce a distinct Cdk-cyclin kinase complex that, in general, functions to execute a unique cell cycle event.

Activation of the Cdk-cyclin kinases during cellular transitions is controlled by a variety of regulatory mechanisms. For the Cdc2-cyclin B complex, inhibition of kinase activity during S phase and $G_2$ is accomplished by phosphorylation of two Cdc2 residues, $Thr^{14}$ and $Tyr^{15}$, which are positioned within the ATP-binding cleft. Phosphorylation of $Thr^{14}$ and/or $Tyr^{15}$ suppresses the catalytic activity of the molecule by disrupting the orientation of the ATP present within this cleft. In contrast, the abrupt dephosphorylation of these residues by the Cdc25 phosphatase results in the rapid activation of Cdc2-cyclin B kinase activity and subsequent downstream mitotic events. While the exact details of this pathway have yet to be elucidated, it has been proposed that $Thr^{14}/Tyr^{15}$ phosphorylation functions to permit a cell to attain a critical concentration of inactive Cdk-cyclin complexes, which, upon activation, induces a rapid and complete cell cycle transition. Furthermore, there is evidence in mammalian cells that $Thr^{14}/Tyr^{15}$ phosphorylation also functions to delay Cdk activation after DNA damage.

The *Schizosaccharomyces pombe* wee1 gene product was the first kinase identified that is capable of phosphorylating $Tyr^{15}$ in Cdc2. Homologs of the Wee1 kinase have been subsequently identified and biochemically characterized from a wide range of species including human, mouse, frog, *Saccharomyces cerevisiae*, and *Drosophila*. In vertebrate systems, where $Thr^{14}$ in Cdc2 is also phosphorylated, the Wee1 kinase was capable of phosphorylating Cdc2 on $Tyr^{15}$, but not $Thr^{14}$, indicating that another kinase was responsible for $Thr^{14}$ phosphorylation. This gene, Myt1 kinase, was recently isolated from the membrane fractions of *Xenopus* egg extracts and has been shown to be capable of phosphorylating $Thr^{14}$ and, to a lessor extent, $Tyr^{15}$ in Cdc2. A human Myt1 homolog displaying similar properties has been isolated, as well as a non-membrane-associated molecule with $Thr^{14}$ kinase activity.

In the past decade it has been shown that cancer can originate from overexpression of positive regulators, such as cyclins, or from underexpression of negative regulators (e.g. p16 (INK4a), p15 (INK4b), p21 (Cip1)). Inhibitors such as Myt15 are the focus of much cancer research because they are capable of controlling cell cycle proliferation, now considered the Holy Grail for cancer treatment. For these reasons, siRNA directed against kinases and kinase inhibitors including but not limited to ABL1, ABL2, ACK1, ALK, AXL, BLK, BMX, BTK, C20orf64, CSF1R, SCK, DDR1, DDR2, DKFZp761P1010, EGFR, EPHA1, EPHA2, EPHA3, EPHA4, EPHA7, EPHA8, EPHB1, EPHB2, EPHB3, EPHB4. EPHB6, ERBB2, ERBB3, ERBB4, FER, FES, FGFR1, FGFR2, FGFR3, FGFR4, FGR, FLT1, FLT3, FLT4, FRK, FYN, HCK, IGF1R, INSR, ITK, JAK1, JAK2, JAK3, KDR, KIAA1079, KIT, LCK, LTK, LYN, MATK, MERTK, MET, MST1R, MUSK, NTRK1, NTRK2, NTRK3, PDG-FRA, PDGFRB, PTK2, PTK2B, PTK6, PTK7, PTK9, PTK9L, RET, ROR1, ROR2, ROS1, RYK, SRC, SYK, TEC, TEK, TIE, TNK1, TXK, TYK2, TYRO3, YES1, and related proteins, may be useful for research and therapeutic purposes.

G Protein Coupled Receptors

One important class of genes to which siRNAs can be directed are G-protein coupled receptors (GPCRs). GPCRs constitute a superfamily of seven transmembrane spanning proteins that respond to a diverse array of sensory and chemical stimuli, such as light, odor, taste, pheromones, hormones and neurotransmitters. GPCRs play a central role in cell proliferation, differentiation, and have been implicated in the etiology of disease.

The mechanism by which G protein-coupled receptors translate extracellular signals into cellular changes was initially envisioned as a simple linear model: activation of the receptor by agonist binding leads to dissociation of the heterotrimeric GTP-binding G protein (Gs, Gi, or Gq) into its alpha and beta/gamma subunits, both of which can activate or inhibit various downstream effector molecules. More specifically, activation of the GPCR induces a conformational change in the Gα subunit, causing GDP to be released and GTP to be bound in its place. The Gα and Gβγ subunits then dissociate from the receptor and interact with a variety of effector molecules. For instance in the case of the Gs family, the primary function is to stimulate the intracellular messenger adenylate cyclase (AC), which catalyzes the conversion of cytoplasmic ATP into the secondary messenger cyclic AMP (cAMP). In contrast, the Gi family inhibits this pathway and the Gq family activates phospholipases C (PLC), which cleaves phosphatidylinositol 4,5, bisphosphate (PIP2) to generate inositol-1,4,5-phosphate (IP3) and diacylglycerol (DAG).

More recently, studies have shown that the functions of GPCRs are not limited to their actions on G-proteins and that considerable cross-talk exists between this diverse group of receptor molecules and a second class of membrane bound proteins, the receptor tyrosine kinases (RTKs). A number of GPCRs such as endothelin-1, thrombin, bombesin, and dopamine receptors can activate MAPKs, a downstream effector of the RTK/Ras pathway. Interestingly, the interaction between these two families is not unidirectional and RTKs can also modulate the activity of signaling pathways traditionally thought to be controlled exclusively by ligands that couple to GPCRs. For instance, EGF, which normally activates the MAPK cascade via the EGF receptor can stimulate adenylate cyclase activity by activating Gαs.

There are dozens of members of the G Protein-Coupled Receptor family that have emerged as prominent drug targets in the last decade. One non-Limiting list of potential GPCR-siRNA targets is as follows:

CMKLR1

CML1/CMKLR1 (Accession No. Q99788) is a member of the chemokine receptor family of GPCRs that may play a role in a number of diseases including those involved in inflammation and immunological responses (e.g. asthma, arthritis). For this reason, siRNA directed against this protein may prove to be important therapeutic reagents.

Studies of juvenile-onset neuronal ceroid lipofuscinosis (JNCL, Batten disease), the most common form of childhood encephalopathy that is characterized by progressive neural degeneration, show that it is brought on by mutations in a novel lysosomal membrane protein (CLN3). In addition to being implicated in JNCL, CLN3 (GPCR-like protein, Accession No. A57219) expression studies have shown that the CLN3 mRNA and protein are highly over-expressed in a number of cancers (e.g. glioblastomas, neuroblastomas, as well as cancers of the prostate, ovaries, breast, and colon) suggesting a possible contribution of this gene to tumor growth. For this reason, siRNA directed against this protein may prove to be important therapeutic reagents.

CLACR

The calcitonin receptor (CTR/CALCR, Accession No. NM_001742) belongs to "family B" of GPCRs which typically recognized regulatory peptides such as parathyroid hormone, secretin, glucagons and vasoactive intestinal polypeptide. Although the CT receptor typically binds to calcitonin (CT), a 32 amino acid peptide hormone produced primarily by the thyroid, association of the receptor with RAMP (Receptor Activity Modulating Protein) enables it to readily bind other members of the calcitonin peptide family including amylin (AMY) and other CT gene-related peptides (e.g. αCGRP and βCGRP). While the primary function of the calcitonin receptor pertains to regulating osteoclast mediated bone resorption and enhanced $Ca^{+2}$ excretion by the kidney, recent studies have shown that CT and CTRs may play an important role in a variety of processes as wide ranging as embryonic/foetal development and sperm function/physiology. In addition, studies have shown that patients with particular CTR genotypes may be at higher risk to lose bone mass and that this GPCR may contribute to the formation of calcium oxalate urinary stones. For this reason, siRNA directed against CTR may be useful as therapeutic reagents.

OXTR

The human oxytocin receptor (OTR, OXTR) is a 389 amino acid polypeptide that exhibits the seven transmembrane domain structure and belongs to the Class-I (rhodopsin-type) family of G-protein coupled receptors. OTR is expressed in a wide variety of tissues throughout development and mediates physiological changes through G(q) proteins and phospholipase C-beta. Studies on the functions of oxytocin and the oxytocin receptor have revealed a broad list of duties. OT and OTR play a role in a host of sexual, maternal and social behaviors that include egg-laying, birth, milk-letdown, feeding, grooming, memory and learning. In addition, it has been hypothesized that abnormalities in the functionality of oxytocin-OTR receptor-ligand system can lead to a host of irregularities including compulsive behavior, eating disorders (such as anorexia), depression, and various forms of neurodegenerative diseases. For these reasons, siRNA directed against this gene (NM_000916) may play an important role in combating OTR-associated illnesses.

EDG GPCRs

Lysophosphatidic acid and other lipid-based hormones/growth factors induce their effects by activating signaling pathways through the G-protein coupled receptors (GPCRs) and have been observed to play important roles in a number of human diseases including cancer, asthma, and vascular pathologies. For instance, during studies of immunoglobulin A nephropathy (IgAN), researchers have observed an enhanced expression of EDG5 (NP_004221) suggesting a contribution of this gene product in the development of IgAN. For that reasons, siRNA directed against Edg5 (NM_004230), Edg4 (NM_004720), Edg7 (Nm$_{012152}$) and related genes may play an important role in combating human disease.

Genes Involved in Cholesterol Signaling and Biosynthesis

Studies on model genetic organisms such as *Drosophila* and *C. elegans* have led to the identification of a plethora of genes that are essential for early development. Mutational analysis and ectopic expression studies have allowed many of these genes to be grouped into discreet signal transduction pathways and have shown that these elements play critical roles in pattern formation and cell differentiation. Disruption of one or more of these genes during early stages of development frequently leads to birth defects whereas as alteration of gene function at later stages in life can result in tumorigenesis.

One critical set of interactions known to exist in both invertebrates and vertebrates is the Sonic Hedgehog-Patched-Gli pathway. Originally documented as a *Drosophila* segmentation mutant, several labs have recently identified human and mouse orthologs of many of the pathways members and have successfully related disruptions in these genes to known diseases. Pathway activation is initiated with the secretion of Sonic hedgehog. There are three closely related members of the Shh family (Sonic hedgehog, Desert, and Indian) with Shh being the most widely expressed form of the group. The Shh gene product is secreted as a small pro-signal molecule. To successfully initiate its developmental role, Shh is first cleaved, whereupon the N-terminal truncated fragment is covalently modified with cholesterol. The addition of the sterol moiety promotes the interaction between Shh and its cognate membrane bound receptor, Patched (Ptch). There are at least two isoforms of the Patched gene, Ptch1 and Ptch2. Both isoforms contain a sterol-sensing domain (SSD); a roughly 180 amino acid cluster that is found in at least seven different classes of molecules including those involved in cholesterol biosynthesis, vesicular traffic, signal transduction, cholesterol transport, and sterol homeostasis. In the absence of Shh, the Patched protein is a negative regulator of the pathway. In contrast, binding of Shh-cholesterol to the Patched receptor releases the negative inhibition which that molecule enforces on a G-protein coupled receptor known as Smoothened. Subsequent activation of Smoothened (directly or indirectly) leads to the triggering of a trio of transcription factors that belong to the Gli family. All three factors are relatively large, contain a characteristic C2-H2 zinc-finger pentamer, and recognize one of two consensus sequences (SEQ. ID NO. 0463 GACCACCCA or SEQ. ID NO. 0464 GAACCACCCA). In the absence of Shh, Gli proteins are cleaved by the proteosome and the C-terminally truncated fragment translocates to the nucleus and acts as a dominant transcription repressor. In the presence of Shh-cholesterol, Gli repressor formation is inhibited and full-length Gli functions as a transcriptional activator.

Shh and other members of the Shh-PTCH-Gli pathway are expressed in a broad range of tissues (e.g. the notochord, the floorplate of the neural tube, the brain, and the gut) at early stages in development. Not surprisingly, mutations that lead to altered protein expression or function have been shown to induce developmental abnormalities. Defects in the human Shh gene have been shown to cause holoprosencephaly, a midline defect that manifests itself as cleft lip or palate, CNS septation, and a wide range of other phenotypes. Interestingly, defects in cholesterol biosynthesis generate similar Shh-like disorders (e.g. Smith-Lemli-Opitz syndrome) suggesting that cholesterol modification of the Shh gene product is crucial for pathway function. Both the Patched and Smoothened genes have also been shown to be clinically relevant with Smoothened now being recognized as an oncogene that, like PTCH-1 and PTCH-2, is believed to be the causative agent of several forms of adult tumors. For these reasons, siRNA directed against Smoothened (SMO, NM$_{005631}$), Patched (PTCH, nm_000264), and additional genes that participate in cholesterol signaling, biosynthesis, and degradation, have potentially useful research and therapeutic applications.

Targeted Pathways.

In addition to targeting siRNA against one or more members of a family of proteins, siRNA can be directed against members of a pathway. Thus, for instance, siRNA can be directed against members of a signal transduction pathway (e.g. the insulin pathway, including AKT1-3, CBL, CBLB, EIF4EBP1, FOXO1A, FOXO3A, FRAP1, GSK3A, GSK3B, IGF1, IGF1R, INPP5D, INSR, IRS1, MLLT7, PDPK1, PIK3CA, PIK3CB, PIK3R1, PIK3R2, PPP2R2B, PTEN, RPS6, RPS6KA1, RPX6KA3, SGK, TSC1, TSC2, AND XPO1), an apoptotic pathway (CASP3,6,7,8,9, DSH1/2, P110, P85, PDK1/2, CATENIN, HSP90, CDC37, P23, BAD, BCLXL, BCL2, SMAC, and others), pathways, involved in DNA damage, cell cycle, and other physiological (p53, MDM2, CHK1/2, BRCA1/2, ATM, ATR, P15INK4, P27, P21, SKP2, CDC25C/A, 14-3-3, PLK, RB, CDK4, GLUT4, Inos, Mtor, FKBP, PPAR, RXR, ER). Similarly, genes involved in immune system function including TNFR1, IL-IR, IRAK1/2, TRAF2, TRAF6, TRADD, FADD, IKKε, IKKγ, IKKβ, IKKα, IkBα, IkBβ, p50, p65, Rac, RhoA, Cdc42, ROCK, Pak1/2/3/4/5/6, cIAP, HDAC1/2, CBP, β-TrCP, Rip2/4, and others are also important targets for the siRNAs described in this document and may be useful in treating immune system disorders. Genes involved in apoptosis, such as Dsh1/2,PTEN, P110 (pan), P85, PDK1/2, Akt1, Akt2, Akt (pan), p70$^{S6K}$; GSK3β, PP2A (cat), β-catenin, HSP90, Cdc37/p50, P23, Bad, BclxL, Bcl2, Smac/Diablo, and Ask1 are potentially useful in the treatment of diseases that involve defects in programmed cell death (e.g. cancer), while siRNA agents directed against p53, MDM2, Chk1/2, BRCA1/2, ATM, ATR, p15$^{INK4}$, P27, P21, Skp2, Cdc25C/A, 14-3-3σ/ε, PLK, Rb, Cdk4, Glut4, iNOS, mTOR, FKBP, PPARγ, RXRα, ERα and related genes may play a critical role in combating diseases associated with disruptions in DNA repair, and cell cycle abnormalities.

Tables VI-Table X below provide examples of useful pools for inhibiting different genes in the human insulin pathway and tyrosine kinase pathways, proteins involved in the cell cycle, the production of nuclear receptors, and other genes. These particular pools are particularly useful in humans, but would be useful in any species that generates an appropriately homologous mRNA. Further, within each of the listed pools any one sequence may be used independently but preferably at least two, of the listed sequences, more preferably at least three, and most preferably all of the listed sequences for a given gene is present.

TABLE VI

| Gene Name | Acc # | GI | L.L. | Duplex # | Sequence | SEQ. ID NO. |
|---|---|---|---|---|---|---|
| AKT1 | NM_005163 | 4885060 | 207 | D-003000-05 | GACAAGGACGGGCACATTA | 465 |
| AKT1 | NM_005163 | 4885060 | 207 | D-003000-06 | GGACAAGGACGGGCACATT | 466 |
| AKT1 | NM_005163 | 4885060 | 207 | D-003000-07 | GCTACTTCCTCCTCAAGAA | 467 |
| AKT1 | NM_005163 | 4885060 | 207 | D-003000-08 | GACCGCCTCTGCTTTGTCA | 408 |
| AKT2 | | | | | | |
| AKT2 | NM_001626 | 6715585 | 208 | D-003001-05 | GTACTTCGATGATGAATTT | 469 |
| AKT2 | NM_001626 | 6715585 | 208 | D-003001-06 | GCAAAGAGGGCATCAGTGA | 470 |
| AKT2 | NM_001626 | 6715585 | 208 | D-003001-07 | GGGCTAAAGTGACCATGAA | 471 |
| AKT2 | NM_001626 | 6715585 | 208 | D-003001-08 | GCAGAATGCCAGCTGATGA | 472 |
| AKT3 | | | | | | |
| AKT3 | NM_005465 | 32307164 | 10000 | D-003002-05 | GGAGTAAACTGGCAAGATG | 473 |
| AKT3 | NM_005465 | 32307164 | 10000 | D-003002-06 | GACATTAAATTTCCTCGAA | 474 |
| AKT3 | NM_005465 | 32307164 | 10000 | D-003002-07 | GACCAAAGCCAAACACATT | 475 |
| AKT3 | NM_005465 | 32307164 | 10000 | D-003002-08 | GAGGAGAGAATGAATTGTA | 476 |
| CBL | | | | | | |
| CBL | NM_005188 | 4885116 | 867 | D-003003-05 | GGAGACACATTTCGGATTA | 477 |
| CBL | NM_005188 | 4885116 | 867 | D-003003-06 | GATCTGACCTGCAATGATT | 478 |
| CBL | NM_005188 | 4885116 | 867 | D-003003-07 | GACAATCCCTCACAATAAA | 479 |
| CBL | NM_005188 | 4885116 | 867 | D-003003-08 | CCAGAAAGCTTTGGTCATT | 480 |
| CBLB | | | | | | |
| CBLB | NM_170662 | 29366807 | 868 | D-003004-05 | GACCATACCTCATAACAAG | 481 |
| CBLB | NM_170662 | 29366807 | 868 | D-003004-06 | TGAAAGACCTCCACCAATC | 482 |
| CBLB | NM_170662 | 29366807 | 868 | D-003004-07 | GATGAAGGCTCCAGGTGTT | 483 |
| CBLB | NM_170662 | 29366807 | 868 | D-003004-08 | TATCAGCATTTACGACTTA | 484 |
| EIF4EBP1 | | | | | | |
| EIF4EBP1 | NM_004095 | 20070179 | 1978 | D-003005-05 | GCAATAGCCCAGAAGATAA | 485 |
| EIF4EBP1 | NM_004095 | 20070179 | 1978 | D-003005-06 | CGCAATAGCCCAGAAGATA | 486 |
| EIF4EBP1 | NM_004095 | 20070179 | 1978 | D-003005-07 | GAGATGGACATTTAAAGCA | 487 |
| EIF4EBP1 | NM_004095 | 20070179 | 1978 | D-003005-08 | GAATAGCCCAGAAGATAAG | 488 |
| FOXO1A | | | | | | |
| FOXO1A | NM_002015 | 9257221 | 2308 | D-003006-05 | CCAGGCATCTCATAACAAA | 489 |
| FOXO1A | NM_002015 | 9257221 | 2308 | D-003006-06 | CCAGATGCCTATACAAACA | 490 |
| FOXO1A | NM_002015 | 9257221 | 2308 | D-003006-07 | GGAGGTATGAGTCAGTATA | 491 |
| FOXO1A | NM_002015 | 9257221 | 2308 | D-003006-08 | GAGGTATGAGTCAGTATAA | 492 |
| FOXO3A | | | | | | |
| FOXO3A | NM_001455 | 4503738 | 2309 | D-003007-01 | CAATAGCAACAAGTATACC | 493 |
| FOXO3A | NM_001455 | 4503738 | 2309 | D-003007-02 | TGAAGTGCAGGACGATGAT | 494 |
| FOXO3A | NM_001455 | 4503738 | 2309 | D-003007-03 | TGTCACACTATGGTAACCA | 495 |
| FOXO3A | NM_001455 | 4503738 | 2309 | D-003007-04 | TGTTCAATGGGAGCTTGGA | 496 |
| FRAP1 | | | | | | |
| FRAP1 | NM_004958 | 19924298 | 2475 | D-003008-05 | GAGAAGAAATGGAAGAAAT | 497 |
| FRAP1 | NM_004958 | 19924298 | 2475 | D-003008-06 | CCAAAGTGCTGCAGTACTA | 498 |
| FRAP1 | NM_004958 | 19924298 | 2475 | D-003008-07 | GAGCATGCCGTGAATAATA | 499 |
| FRAP1 | NM_004958 | 19924298 | 2475 | D-003008-08 | GGTCTGAACTGAATGAAGA | 500 |
| GSK3A | | | | | | |
| GSK3A | NM_019884 | 11995473 | 2931 | D-003009-05 | GGACAAAGGTGTTCAAATC | 501 |
| GSK3A | NM_019884 | 11995473 | 2931 | D-003009-06 | GAACCCAGCTGCCTAACAA | 502 |
| GSK3A | NM_019884 | 11995473 | 2931 | D-003009-07 | GCGCACAGCTTCTTTGATG | 503 |
| GSK3A | NM_019884 | 11995473 | 2931 | D-003009-08 | GCTGTAGCCTGCTGGAGTA | 504 |
| GSK3B | | | | | | |
| GSK3B | NM_002093 | 21361339 | 2932 | D-003010-05 | GAAGAAAGATGAGGTCTAT | 505 |

TABLE VI-continued

| Gene Name | Acc # | GI | L.L. | Duplex # | Sequence | SEQ. ID NO. |
|---|---|---|---|---|---|---|
| GSK3B | NM_002093 | 21361339 | 2932 | D-003010-06 | GGACCCAAATGTGAAACTA | 506 |
| GSK3B | NM_002093 | 21361339 | 2932 | D-003010-07 | GAAATGAACCCAAACTACA | 507 |
| GSK3B | NM_002093 | 21361339 | 2932 | D-003010-08 | GATGAGGTCTATCTTAATG | 508 |
| IGF1 | | | | | | |
| IGF1 | NM_000618 | | | D-003011-05 | GGAAGTACATTTGAAGAAC | 509 |
| IGF1 | NM_000618 | | | D-003011-06 | AGAAGGAAGTACATTTGAA | 510 |
| IGF1 | NM_000618 | | | D-003011-07 | CCTCAAGCCTGCCAAGTCA | 511 |
| IGF1 | NM_000618 | | | D-003011-08 | GGTGGATGCTGTTCAGTTC | 512 |
| IGF1R | | | | | | |
| IGF1R | NM_000875 | 11068002 | 3480 | D-003012-05 | CAACGAAGCTTCTGTGATG | 513 |
| IGF1R | NM_000875 | 11068002 | 3480 | D-003012-06 | GGCCAGAAATGGAGAATAA | 514 |
| IGF1R | NM_000875 | 11068002 | 3480 | D-003012-07 | GAAGCACCCTTTAAGAATG | 515 |
| IGF1R | NM_000875 | 11068002 | 3480 | D-003012-08 | GCAGACACCTACAACATCA | 516 |
| INPP5D | NM_005541 | 5031798 | 3635 | D-003013-05 | GGAATTGCGTTTACACTTA | 517 |
| INPP5D | NM_005541 | 5031798 | 3635 | D-003013-06 | GGAAACTGATCATTAAGAA | 518 |
| INPP5D | NM_005541 | 5031798 | 3635 | D-003013-07 | CGACAGGGATGAAGTACAA | 519 |
| INPP5D | NM_005541 | 5031798 | 3635 | D-003013-08 | AAACGCAGCTGCCCATCTA | 520 |
| INSR | | | | | | |
| INSR | NM_000208 | 4557883 | 3643 | D-003014-05 | GGAAGACGTTTGAGGATTA | 521 |
| INSR | NM_000208 | 4557883 | 3643 | D-003014-06 | GAAGAAGGCTCCCGAGAGT | 522 |
| INSR | NM_000208 | 4557883 | 3643 | D-003014-07 | GGAGAGACCTTGGAAATTG | 523 |
| INSR | NM_000208 | 4557883 | 3643 | D-003014-08 | GGACGGAACCCACCTATTT | 524 |
| IRS1 | | | | | | |
| IRS1 | NM_005544 | 5031804 | 3667 | D-003015-05 | AAAGAGGTCTGGCAAGTGA | 525 |
| IRS1 | NM_005544 | 5031804 | 3667 | D-003015-06 | GAACCTGATTGGTATCTAC | 526 |
| IRS1 | NM_005544 | 5031804 | 3667 | D-003015-07 | CCACGGCGATCTAGTGCTT | 527 |
| IRS1 | NM_005544 | 5031804 | 3667 | D-003015-08 | GTCAGTCTGTCGTCCAGTA | 528 |
| MLLT7 | | | | | | |
| MLLT7 | NM_005938 | 5174578 | 4303 | D-003016-05 | GGACTGGACTTCAACTTTG | 529 |
| MLLT7 | NM_005938 | 5174578 | 4303 | D-003016-06 | CCACGAAGCAGTTCAAATG | 530 |
| MLLT7 | NM_005938 | 5174578 | 4303 | D-003016-07 | GAGAAGCGACTGACAGTTG | 531 |
| MLLT7 | NM_005938 | 5174578 | 4303 | D-003016-08 | GACCAGAGATCGCTAACCA | 532 |
| PDPK1 | | | | | | |
| PDPK1 | NM_002613 | 4505694 | 5170 | D-003017-05 | CAAGAGACCTCGTGGAGAA | 533 |
| PDPK1 | NM_002613 | 4505694 | 5170 | D-003017-06 | GACCAGAGGCCAAGAATTT | 534 |
| PDPK1 | NM_002613 | 4505694 | 5170 | D-003017-07 | GGAAACGAGTATCTTATAT | 535 |
| PDPK1 | NM_002613 | 4505694 | 5170 | D-003017-08 | GAGAAGCGACATATCATAA | 536 |
| PIK3GA | | | | | | |
| PIK3GA | NM_006218 | 5453891 | 5290 | D-003018-05 | GCTATCATCTGAACAATTA | 537 |
| PIK3CA | NM_006218 | 5453891 | 5290 | D-003018-06 | GGATAGAGGCCAAATAATA | 538 |
| PIK3CA | NM_006218 | 5453891 | 5290 | D-003018-07 | GGACAACTGTTTCATATAG | 539 |
| PIK3CA | NM_006218 | 5453891 | 5290 | D-003018-08 | GCCAGTACCTCATGGATTA | 540 |
| PIK3CB | | | | | | |
| PIK3CB | NM_006219 | 5453893 | 5291 | D-003019-05 | CGACAAGACTGCCGAGAGA | 541 |
| PIK3CB | NM_006219 | 5453893 | 5291 | D-003019-06 | TCAAGTGTCTCCTAATATG | 542 |
| PIK3CB | NM_006219 | 5453893 | 5291 | D-003019-07 | GGATTCAGTTGGAGTGATT | 543 |
| PIK3CB | NM_006219 | 5453893 | 5291 | D-003019-08 | TTTCAAGTGTCTCCTAATA | 544 |
| PIK3R1 | | | | | | |
| PIK3R1 | NM_181504 | 32455251 | 5295 | D-003020-05 | GGAAATATGGCTTCTCTGA | 545 |
| PIK3RI | NM_1815R4 | 32455251 | 5295 | D-003020-06 | GAAAGACGAGAGACCAATA | 540 |
| PIK3R1 | NM_181504 | 32455251 | 5295 | D-003020-07 | GTAAAGCATTGTGTCATAA | 547 |
| PIK3RI | NM_181504 | 32455251 | 5295 | D-003020-08 | GGATCAAGTTGTCAAAGAA | 548 |
| PIK3R2 | | | | | | |
| PIK3R2 | NM_005027 | 4826907 | 5296 | D-003021-05 | GGAAAGGCGGGAACAATAA | 549 |
| PIK3R2 | NM_005027 | 4826907 | 5296 | D-003021-06 | GATGAAGGGTAGTGCAATT | 550 |
| PIK3R2 | NM_005027 | 4826907 | 5296 | D-003021-07 | GGACAGCGAATCTCACTAC | 551 |
| PIK3R2 | NM_005027 | 4826907 | 5296 | D-003021-08 | GCAAGATCCGAGACCAGTA | 552 |
| PPP2R2B | | | | | | |
| PPP2R2B | NM_004576 | 4758953 | 5521 | D-003022-05 | GAATGCAGCTTACTTTCTT | 553 |
| PPP2R2B | NM_004576 | 4758953 | 5521 | D-003022-06 | GACCGAAGCTGACATTATC | 554 |
| PPP2R2B | NM_004576 | 4758953 | 5521 | D-003022-07 | TCGATTACCTGAAGAGTTT | 555 |
| PPP2R2B | NM_004576 | 4758953 | 5521 | D-003022-08 | CCTGAAGAGTTTAGAAATA | 556 |

TABLE VI-continued

| Gene Name | Acc # | GI | L.L. | Duplex # | Sequence | SEQ. ID NO. |
|---|---|---|---|---|---|---|
| PTEN | | | | | | |
| PTEN | NM_000314 | 4506248 | 5728 | D-003023-05 | GTGAAGATCTTGACCAATG | 557 |
| PTEN | NM_000314 | 4506248 | 5728 | D-003023-06 | GATCAGCATACACAAATTA | 558 |
| PTEN | NM_000314 | 4506248 | 5728 | D-003023-07 | GGCGCTATGTGTATTATTA | 559 |
| PTEN | NM_000314 | 4506248 | 5728 | D-003023-08 | GTATAGAGCGTGCAGATAA | 560 |
| RPS6 | | | | | | |
| RPS6 | NM_001010 | 17158043 | 6194 | D-003024-05 | GCCAGAAACTCATTGAAGT | 561 |
| RPS6 | NM_001010 | 17158043 | 6194 | D-003024-06 | GGATATTCCTGGACTGACT | 562 |
| RPS6 | NM_001010 | 17158043 | 6194 | D-003024-07 | CCAAGGAGAACTGGAGAAA | 563 |
| RPS6 | NM_001010 | 17158043 | 6194 | D-003024-08 | GCGTATGGCCACAGAAGTT | 564 |
| RPS6KA1 | | | | | | |
| RPS6KA1 | NM_002953 | 20149546 | 6195 | D-003025-05 | GATGACACCTTCTACTTUG | 565 |
| RPS6KA1 | NM_002953 | 20149546 | 6195 | D-003025-06 | GAGAATGGGCTCCTCATGA | 566 |
| RPS6KA1 | NM_002953 | 20149546 | 6195 | D-003025-07 | CAAGCGGGATCCTTCGAAA | 567 |
| RPS6KA1 | NM_002953 | 20149546 | 6195 | D-003025-08 | CCACCGGCCTGATGGAAGA | 568 |
| RPS6KA3 | | | | | | |
| RPS6KA3 | NM_004586 | 4759049 | 6197 | D-003026-05 | GAAGGGAAGTTGTATCTTA | 569 |
| RPS6KA3 | NM_004586 | 4759049 | 6197 | D-003026-06 | GAAAGTATGTGTATGTAGT | 570 |
| RPS6KA3 | NM_004586 | 4759049 | 6197 | D-003026-07 | GGACAGCATCCAAACATTA | 571 |
| RPS6KA3 | NM_004586 | 4759049 | 6197 | D-003026-08 | GGAGGTGAATTGCTGGATA | 572 |
| SGK | | | | | | |
| SGK | NM_005627 | 5032090 | 6446 | D-003027-01 | TTAATGGTGGAGAGTTGTT | 573 |
| SGK | NM_005627 | 5032090 | 6446 | D-003027-04 | ATTAACTGGGATGATCTCA | 574 |
| SGK | NM_005627 | 25168262 | 6446 | D-003027-05 | GAAGAAAGCAATCCTGAAA | 575 |
| SGK | NM_005627 | 25168262 | 6446 | D-003027-06 | AAACACAGGTGAAATGTAC | 576 |
| TSC1 | | | | | | |
| TSC1 | NM_000368 | 24475626 | 7248 | D-003028-05 | GAAGATGGCTATTCTGTGT | 577 |
| TSC1 | NM_000368 | 24475626 | 7248 | D-003028-06 | TATGAAGGGTCGAGAGTTA | 578 |
| TSC1 | NM_000368 | 24475626 | 7248 | D-003028-07 | CGACACGGCTGATAACTGA | 579 |
| TSC1 | NM_000368 | 24475626 | 7248 | D-003028-08 | CGGCTGATGTTGTTAAATA | 580 |
| TSC2 | | | | | | |
| TSC2 | NM_000548 | 10938006 | 7249 | D-003029-05 | GCATTAATCTCTTACCATA | 581 |
| TSC2 | NM_000548 | 10938006 | 7249 | D-003029-06 | CCAATGTCCTCTTGTCTTT | 582 |
| TSC2 | NM_000548 | 10938006 | 7249 | D-003029-07 | GGAGACACATCACGTACTT | 583 |
| TSC2 | NM_000548 | 10938006 | 7249 | D-003029-08 | TCACCAGGCTCATCAAGAA | 584 |
| XPO1 | | | | | | |
| XPO1 | NM_003400 | 8051634 | 7514 | D-003030-05 | GAAAGTCTCTGTCAAAATA | 585 |
| XPO1 | NM_003400 | 8051634 | 7514 | D-003030-06 | GCAATAGGCTCCATTAGTG | 586 |
| XPO1 | NM_003400 | 8051634 | 7514 | D-003030-07 | GGAACATGATCAACTTATA | 587 |
| XPO1 | NM_003400 | 8051634 | 7514 | D-003030-08 | GGATACAGATTCCATAAAT | 588 |

TABLE VII

| Gene Name | Acc # | GI | L.L. | Duplex # | Sequence | SEQ. ID NO. |
|---|---|---|---|---|---|---|
| ABL1 | | | | | | |
| ABL1 | NM_007313 | 6382057 | 25 | D-003100-05 | GGAAATCAGTGACATAGTG | 589 |
| ABL1 | NM_007313 | 6382057 | 25 | D-003100-06 | GGTCCAGACTGCAATGTTT | 590 |
| ABL1 | NM_007313 | 6382057 | 25 | D-003100-07 | GAAGGAAATCAGTGACATA | 591 |
| ABL1 | NM_007313 | 6382057 | 25 | D-003100-08 | TCACTGAGTTCATGACCTA | 592 |
| ABL2 | | | | | | |
| ABL2 | NM_007314 | 6382061 | 27 | D-003101-05 | GAAATGGAGCGAACAGATA | 593 |
| ABL2 | NM_007314 | 6382061 | 27 | D-003101-06 | GAGCCAAATTTCCTATTAA | 594 |
| ABL2 | NM_007314 | 6382061 | 27 | D-003101-07 | GTAATAAGCCTACAGTCTA | 595 |
| ABL2 | NM_007314 | 6382061 | 27 | D-003101-08 | GGAGTGAAGTTCGCTCTAA | 596 |
| ACK1 | | | | | | |
| ACK1 | NM_005781 | 8922074 | 10188 | D-003102-05 | AAACGCAAGTCGTGGATGA | 597 |
| ACK1 | NM_005781 | 8922074 | 10188 | D-003102-06 | GCAAGTCGTGGATGAGTAA | 598 |
| ACK1 | NM_005781 | 8922074 | 10188 | D-003102-07 | GAGCACTACCTCAGAATGA | 599 |
| ACK1 | NM_005781 | 8922074 | 10188 | D-003102-08 | TCAGCAGCACCCACTATTA | 600 |

TABLE VII-continued

| Gene Name | Acc # | GI | L.L. | Duplex # | Sequence | SEQ. ID NO. |
|---|---|---|---|---|---|---|
| ALK | | | | | | |
| ALK | NM_004304 | 29029631 | 238 | D-003103-05 | GACAAGATCCTGCAGAATA | 601 |
| ALK | NM_004304 | 29029631 | 238 | D-003103-06 | GGAAGAGTCTGGCAGTTGA | 602 |
| ALK | NM_004304 | 29029631 | 238 | D-003103-07 | GCACGTGGCTCGGGACATT | 603 |
| ALK | NM_004304 | 29029631 | 238 | D-003103-08 | GAACTGCAGTGAAGGAACA | 604 |
| AXL | | | | | | |
| AXL | NM_021913 | 21536465 | 558 | D-003104-05 | GGTCAGAGCTGGAGGATTT | 605 |
| AXL | NM_021913 | 21536465 | 558 | D-003104-06 | GAAAGAAGGAGACCCGTTA | 606 |
| AXL | NM_021913 | 21536465 | 558 | D-003104-07 | CCAAGAAGATCTACAATGG | 607 |
| AXL | NM_021913 | 21536465 | 558 | D-003104-08 | GGAACTGCATGCTGAATGA | 608 |
| BLK | | | | | | |
| BLK | NM_001715 | 4502412 | 640 | O-003105-05 | GAGGATGCCTGCTGGATTT | 609 |
| BLK | NM_001715 | 4502412 | 640 | O-003105-06 | ACATGAAGGTGGCCATTAA | 610 |
| BLK | NM_001715 | 4502412 | 640 | O-003105-07 | GGTCAGCGCCCAAGACAAG | 611 |
| BLK | NM_001715 | 4502412 | 640 | O-003105-08 | GAAACTCGGGTGTGGACAA | 612 |
| BMX | | | | | | |
| BMX | NM_001721 | 21359831 | 660 | D-003106-05 | AAACAAACCTTTCCTACTA | 613 |
| BMX | NM_001721 | 21359831 | 660 | D-003106-06 | GAAGGAGCATTTATGGTTA | 614 |
| BMX | NM_001721 | 21359831 | 660 | D-003106-07 | GAGAAGAGATTACCTTGTT | 615 |
| BMX | NM_001721 | 21359831 | 660 | D-003106-08 | GTAAGGGTGTGAATGATAA | 616 |
| BTK | | | | | | |
| BTK | NM_000061 | 4557376 | 695 | D-003107-05 | GAAGAGGAATGGAAGCTTA | 617 |
| BTK | NM_000061 | 4557376 | 695 | D-003107-06 | GCTATGGGCTGCCAAATTT | 618 |
| BTK | NM_000061 | 4557376 | 695 | D-003107-07 | GAAAGCAACTTACCATGGT | 619 |
| BTK | NM_000061 | 4557376 | 695 | D-003107-08 | GGTAAACGATCAAGGAGTT | 620 |
| G20orf64 | | | | | | |
| C20orf64 | NM_033550 | 19923655 | 11285 | D-003108-05 | CAACTTAGCCAAGACAATT | 621 |
| C20orf64 | NM_033550 | 19923655 | 11285 | D-003108-06 | GAAATTGAAGGCTCAGTGA | 622 |
| C20orf64 | NM_033550 | 19923655 | 11285 | D-003108-07 | TGGAACAGCTGAACATTGT | 623 |
| C20orf64 | NM_033550 | 19923655 | 11285 | D-003108-08 | GGTTCCAACTGCTTATATA | 624 |
| CSF1R | | | | | | |
| CSF1R | NM_005211 | 27262658 | 1436 | D-003109-05 | GGAGAGCTCTGACCTTTGA | 625 |
| GSF1R | NM_005211 | 27262658 | 1436 | D-003109-06 | CAACAACGCTAGCTTCCAA | 626 |
| CSF1R | NM_005211 | 27262658 | 1436 | D-003109-07 | CCAGGCAGCTGCCTTACAA | 627 |
| CSF1R | NM_005211 | 27262658 | 1436 | D-003109-08 | GGAACAACCTGCAGTTTGG | 628 |
| GSK | NM_004383 | A758077 | 1445 | D-003110-05 | GAGAATGTATTGCCAAGTA | 629 |
| CSK | NM_004383 | A758077 | 1445 | D-003110-06 | GAACAAAGTCGCCGTCAAG | 630 |
| CSK | NM_004383 | 4758077 | 1445 | D-003110-07 | GGGAGTGGCTTATCCAAGA | 631 |
| CSK | NM_004383 | 4758077 | 1445 | D-003110-08 | GGAGAAGGGCTACAAGATG | 632 |
| DDR1 | | | | | | |
| DDR1 | NM_013994 | 7669484 | 780 | D-003111-05 | GGAGATGGAGTTTGAGTTT | 633 |
| DDR1 | NM_013994 | 7669484 | 780 | D-003111-06 | CAGAGGCCCTGTCATCTTT | 634 |
| DDR1 | NM_013994 | 7669484 | 780 | D-003111-07 | GCTGGTAGCTGTCAAGATC | 635 |
| DDR1 | NM_013994 | 7669484 | 780 | D-003111-08 | TGAAAGAGGTGAAGATCAT | 636 |
| DDR2 | | | | | | |
| DDR2 | NM_006182 | 5453813 | 4921 | D-003112-05 | GGTAAGAACTACACAATCA | 637 |
| DDR2 | NM_006182 | 5453813 | 4921 | D-003112-06 | GAACGAGAGTGCCACCAAT | 638 |
| DDR2 | NM_006182 | 5453813 | 4921 | D-003112-07 | ACACCAATCTGAAGTTTAT | 639 |
| DDR2 | NM_006182 | 5453813 | 4921 | D-003112-08 | CAACAAGAATGCGAGGAAT | 640 |
| DKFZp761P1010 | | | | | | |
| DKFZp761P1010 | NM_018423 | 8922178 | 55359 | D-003113-05 | CCTAGAAGCTGCGATTAAA | 641 |
| DKFZp761P1010 | NM_018423 | 8922178 | 55359 | D-003113-06 | GATTAGGCCTGGCTTATGA | 642 |
| DKFZp761P1010 | NM_018423 | 8922178 | 55359 | D-003113-07 | CCCAGTAGCTGCACACATA | 643 |
| DKFZp761P1010 | NM_018423 | 8922178 | 55359 | D-003113-08 | GGTGGTAGCTGAACTGTAT | 644 |
| EGFR | | | | | | |
| EGFR | NM_005228 | 4885198 | 1956 | D-003114-05 | GAAGGAAACTGAATTCAAA | 645 |
| EGFR | NM_005228 | 4885198 | 1956 | D-003114-06 | GGAAATATGTACTACGAAA | 646 |
| EGFR | NM_005228 | 4885198 | 1956 | D-003114-07 | CCACAAAGCAGTGAATTTA | 647 |
| EGFR | NM_005228 | 4885198 | 1956 | D-003114-08 | GTAACAAGCTCACGGAGTT | 648 |

TABLE VII-continued

| Gene Name | Acc # | GI | L.L. | Duplex # | Sequence | SEQ. ID NO. |
|---|---|---|---|---|---|---|
| EPHA1 | | | | | | |
| EPHA1 | NM_005232 | 4885208 | 2041 | D-003115-05 | GACCAGAGCTTCACCATTC | 649 |
| EPHA1 | NM_005232 | 4885208 | 2041 | D-003115-06 | GCAAGACTGTGGCCATTAA | 650 |
| EPHA1 | NM_005232 | 4885208 | 2041 | D-003115-07 | GGGCGAACGTGACCTATGA | 65T |
| EPHA1 | NM_005232 | 4885208 | 2041 | D-003115-08 | GATTGTAGCCGTCATCTTT | 652 |
| EPHA2 | | | | | | |
| EPHA2 | NM_004431 | 4758277 | 1969 | D-003116-05 | GGAGGGATCTGGCAACTTG | 653 |
| EPHA2 | NM_004481 | 4758277 | 1969 | D-003116-06 | GCAGCAAGGTGCACGAATT | 654 |
| EPHA2 | NM_004431 | 4758277 | 1969 | D-003116-07 | GGAGAAGGATGGCGAGTTC | 655 |
| EPHA2 | NM_004431 | 4758277 | 1969 | D-003116-08 | GAAGTTCAGTACCGAGATC | 656 |
| EPHA3 | | | | | | |
| EPHA3 | NM_005233 | 21361240 | 2042 | D-003117-05 | GATCGGACCTCCAGAAATA | 657 |
| EPHA3 | NM_005233 | 21361240 | 2042 | D-003117-06 | GAACTCAGCTCAGAAGATT | 658 |
| EPHA3 | NM_005233 | 21361240 | 2042 | D-003117-07 | GCAAGAGGCACAAATGTTA | 659 |
| EPHA3 | NM_005233 | 21361240 | 2042 | D-003117-08 | GAGCATCAGTTTACAAAGA | 660 |
| EPHA4 | | | | | | |
| EPHA4 | NM_004438 | 4758279 | 2043 | D-003118-05 | GGTCTGGGATGAAGTATTT | 661 |
| EPHA4 | NM_004438 | 4758279 | 2043 | D-003118-06 | GAATGAAGTTACCTTATTG | 662 |
| EPHA4 | NM_004438 | 4758279 | 2043 | D-003118-07 | GAACTTGGGTGGATAGCAA | 663 |
| EPHA4 | NM_004438 | 4758279 | 2043 | D-003118-08 | GAGATTAAATTCACCTTGA | 664 |
| EPHA7 | | | | | | |
| EPHA7 | NM_004440 | 4758281 | 2045 | D-003119-05 | GAAAAGAGATGTTGCAGTA | 665 |
| EPHA7 | NM_004440 | 4758281 | 2045 | D-003119-06 | CTAGATGGCTCCTGTATTA | 666 |
| EPHA7 | NM_004440 | 4758281 | 2045 | D-003119-07 | AGAAGAAGGTTATCGTTTA | 667 |
| EPHA7 | NM_004440 | 4758281 | 2045 | D-003119-08 | TAGGAAAGCTGACCAAGAA | 668 |
| EPHA8 | | | | | | |
| EPHA8 | NM_020526 | 18201903 | 2046 | D-003120-05 | GAAGATGCACTATCAGAAT | 669 |
| EPHA8 | NM_020526 | 18201903 | 2046 | D-003120-06 | GAGAAGATGCACTATCAGA | 670 |
| EPHA8 | NM_020526 | 18201903 | 2046 | D-003120-07 | AACCTGATCTCCAGTGTGA | 671 |
| EPHA8 | NM_020526 | 18201903 | 2046 | D-003120-08 | TCTCAGACCTGGGCTATGT | 672 |
| EPHB1 | | | | | | |
| EPHB1 | NM_004441 | 21396502 | 2047 | D-003121-05 | GCGATAAGCTCCAGCATTA | 673 |
| EPHB1 | NM_004441 | 21396502 | 2047 | D-003121-06 | GAAACGGGTTTATAGCAAA | 674 |
| EPHB1 | NM_004441 | 21396502 | 2047 | D-003121-07 | GGATGAAGATCTACATTGA | 675 |
| EPHB1 | NM_004441 | 21396502 | 2047 | D-003121-08 | GCACGTCTCTGTCAACATC | 676 |
| EPHB2 | | | | | | |
| EPHB2 | NM_017449 | 17975764 | 2048 | D-003122-05 | ACTATGAGCTGCAGTACTA | 677 |
| EPHB2 | NM_017449 | 17975764 | 2048 | D-003122-06 | GTACAACGCCACAGCCATA | 678 |
| EPHB2 | NM_017449 | 17975764 | 2048 | D-003122-07 | GGAAAGCAATGAGTGTTCT | 679 |
| EPHB2 | NM_017449 | 17975764 | 2040 | D-003122-08 | CGGACAAGCTGCAACACTA | 680 |
| EPHB3 | | | | | | |
| EPHB3 | NM_004443 | 17975767 | 2049 | D-003123-05 | GGTGTGATCTCCAATGTGA | 681 |
| EPHB3 | NM_004443 | 17975767 | 2049 | D-003123-06 | GGGATGACCTCCTGTACAA | 682 |
| EPHB3 | NM_004443 | 17975767 | 2049 | D-003123-07 | CAGAAGACCTGCTCCGTAT | 683 |
| EPHB3 | NM_004443 | 17975767 | 2049 | D-003123-08 | GAGATGAAGTACTTTGAGA | 684 |
| EPHB4 | | | | | | |
| EPHB4 | NM_004444 | 17975769 | 2050 | D-003124-05 | GGACAAACACGGACAGTAT | 685 |
| EPHB4 | NM_004444 | 17975769 | 2050 | D-003124-06 | GTACTAAGGTCTACATCGA | 686 |
| EPHB4 | NM_004444 | 17975769 | 2050 | D-003124-07 | GGAGAGAAGCAGAATATTC | 687 |
| EPHB4 | NM_004444 | 17975769 | 2050 | D-003124-08 | GCCAATAGCCACTCTAACA | 688 |
| EPHB6 | | | | | | |
| EPHB6 | NM_004445 | 4758291 | 2051 | D-003125-05 | GGAAGTCGATCCTGCTTAT | 689 |
| EPHB6 | NM_004445 | 4758291 | 2051 | D-003125-06 | GGACCAAGGTGGACACAAT | 690 |
| EPHB6 | NM_004445 | 4758291 | 2051 | D-003125-07 | TGTGGGAAGTGATGAGTTA | 691 |
| EPHB6 | NM_004445 | 4758291 | 2051 | D-003125-08 | CGGGAGACCTTCACCCTTT | 692 |
| ERBB2 | | | | | | |
| ERBB2 | NM_004448 | 4758297 | 2064 | D-003126-05 | GGACGAATTCTGCACAATG | 693 |
| ERBB2 | NM_004448 | 4758297 | 2064 | D-003126-06 | GACGAATTCTGCACAATGG | 694 |
| ERBB2 | NM_004448 | 4758297 | 2064 | D-003126-07 | CTACAACACAGACACGTTT | 695 |
| ERBB2 | NM_004448 | 4758297 | 2064 | D-003126-08 | AGACGAAGCATACGTGATG | 696 |
| ERBB3 | | | | | | |
| ERBB3 | NM_001982 | 4503596 | 2065 | D-003127-05 | AAGAGGATGTCAACGGTTA | 697 |
| ERBB3 | NM_001982 | 4503596 | 2065 | D-003127-06 | GAAGACTGCCAGACATTGA | 698 |

TABLE VII-continued

| Gene Name | Acc # | GI | L.L. | Duplex # | Sequence | SEQ. ID NO. |
|---|---|---|---|---|---|---|
| ERBB3 | NM_001982 | 4503596 | 2065 | D-003127-07 | GACAAACACTGGTGCTGAT | 699 |
| ERBB3 | NM_001982 | 4503596 | 2065 | D-003127-08 | GCAGTGGATTCGAGAAGTG | 700 |
| ERBB4 | | | | | | |
| ERBB4 | NM_005235 | 4885214 | 2066 | D-003128-05 | GAGGAAAGATGCCAATTAA | 701 |
| ERBB4 | NM_005235 | 4885214 | 2066 | D-003128-06 | GCAGGAAACATCTATATTA | 702 |
| ERBB4 | NM_005235 | 4885214 | 2066 | D-003128-07 | GATCACAACTGCTGCTTAA | 703 |
| ERBB4 | NM_005235 | 4885214 | 2066 | D-003128-08 | CCTCAAAGATACCTAGTTA | 704 |
| FER | | | | | | |
| FER | NM_005246 | 4885230 | 2241 | D-003129-05 | GGAGTGACCTGAAGAATTC | 705 |
| FER | NM_005248 | 4885230 | 2241 | D-003129-06 | TAAAGCAGATTCCCATTAA | 706 |
| FER | NM_005246 | 4885230 | 2241 | D-003129-07 | GGAAAGTACTGTCCAAATG | 707 |
| FER | NM_005246 | 4885230 | 2241 | D-003129-08 | GAACAACGGCTGCTAAAGA | 708 |
| FES | | | | | | |
| FES | NM_002005 | 13376997 | 2242 | D-003130-05 | CGAGGATCCTGAAGCAGTA | 709 |
| FES | NM_002005 | 13376997 | 2242 | D-003130-06 | AGGAATACCTGGAGATTAG | 710 |
| FES | NM_002005 | 13376997 | 2242 | D-003130-07 | CAACAGGAGCTCCGGAATG | 711 |
| FES | NM_002005 | 13376997 | 2242 | D-003130-08 | GGTGTTGGGTGAGCAGATT | 712 |
| FGFR1 | | | | | | |
| FGFR1 | NM_000604 | 13186232 | 2260 | D-003131-05 | TAAGAAATGTCTCCTTTGA | 713 |
| FGFR1 | NM_000604 | 13186232 | 2260 | D-003131-06 | GAAGACTGCTGGAGTTAAT | 714 |
| FGFR1 | NM_000604 | 13186232 | 2260 | D-003131-07 | GATGGTCCCTTGTATGTCA | 715 |
| FGFR1 | NM_000604 | 13186232 | 2260 | D-003131-08 | CTTAAGAAATGTCTCCTTT | 716 |
| FGFR2 | | | | | | |
| FGFR2 | NM_000141 | 13186239 | 2263 | D-003132-05 | CCAAATCTCTGAACCAGAA | 717 |
| FGFR2 | NM_000141 | 13186239 | 2263 | D-003132-06 | GAACAGTATTCACCTAGTT | 718 |
| FGFR2 | NM_000141 | 13186239 | 2263 | D-003132-07 | GGCCAACACTGTCAAGTTT | 719 |
| FGFR2 | NM_000141 | 13186239 | 2263 | D-003132-08 | GTGAAGATGTTGAAAGATG | 720 |
| FGFR3 | | | | | | |
| FGFR3 | NM_000142 | 13112046 | 2261 | D-003133-05 | TGTCGGACCTGGTGTCTGA | 721 |
| FGFR3 | NM_000142 | 13112046 | 2261 | D-003133-06 | GCATCAAGCTGCGGCATCA | 722 |
| FGFR3 | NM_000142 | 13112046 | 2261 | D-003133-07 | GGACGGCACAGCCTACGTT | 723 |
| FGFR3 | NM_000142 | 13112046 | 2261 | D-003133-08 | TGCACAACCTCGACTACTA | 724 |
| FGFR4 | | | | | | |
| FGFR4 | NM_002011 | 13112051 | 2264 | D-003134-05 | GCACTGGAGTGTCGTGATG | 725 |
| FGFR4 | NM_002011 | 13112051 | 2264 | D-003134-06 | CATAGGGACCTCTCGAATA | 726 |
| FGFR4 | NM_002011 | 13112051 | 2264 | D-003134-07 | ATACGGACATCATCCTGTA | 727 |
| FGFR4 | NM_002011 | 13112051 | 2264 | D-003134-08 | ATAGGGACCTCTCGAATAG | 728 |
| FGR | | | | | | |
| FGR | NM_005246 | 4885234 | 2268 | D-003135-05 | GCGATCATGTGAAGCATTA | 729 |
| FGR | NM_005248 | 4885234 | 2268 | D-003135-06 | TCACTGAGCTCATCACCAA | 730 |
| FGR | NM_005248 | 4885234 | 2268 | D-003135-07 | GAAGAGTGGTACTTTGGAA | 731 |
| FGR | NM_005248 | 4885234 | 2268 | D-003135-08 | CCCAGAAGCTGCCCTCTTT | 732 |
| FLT1 | | | | | | |
| FLT1 | NM_002019 | 4503748 | 2321 | D-003136-05 | GAGCAAACGTGACTTATTT | 733 |
| FLT1 | NM_002019 | 4503748 | 2321 | D-003136-06 | CCAAATGGGTTTCATGTTA | 734 |
| FLT1 | NM_002019 | 4503748 | 2321 | D-003136-07 | CAACAAGGATGCAGCACTA | 735 |
| FLT1 | NM_002019 | 4503748 | 2321 | D-003136-08 | GGACGTAACTGAAGAGGAT | 736 |
| FLT3 | | | | | | |
| FLT3 | NM_004119 | 4758395 | 2322 | D-003137-05 | GAAGGCATCTACACCATTA | 737 |
| FLT3 | NM_004119 | 4758395 | 2322 | D-003137-06 | GAAGGAGTCTGGAATAGAA | 738 |
| FLT3 | NM_004119 | 4758395 | 2322 | D-003137-07 | GAATTTAAGTCGTGTGTTC | 739 |
| FLT3 | NM_004119 | 4758395 | 2322 | D-003137-08 | GGAATTCATTTCACTCTGA | 740 |
| FLT4 | | | | | | |
| FLT4 | NM_002020 | 4503752 | 2324 | D-003138-05 | GCAAGAACGTGCATCTGTT | 741 |
| FLT4 | NM_002020 | 4503752 | 2324 | D-003138-06 | GCGAATACCTGTCCTACGA | 742 |
| FLT4 | NM_002020 | 4503752 | 2324 | D-003138-07 | GAAGACATTTGAGGAATTC | 743 |
| FLT4 | NM_002020 | 4503752 | 2324 | D-003138-08 | GAGCAGCCATTCATCAACA | 744 |
| FRK | | | | | | |
| FRK | NM_002031 | 4503786 | 2444 | D-003139-05 | GAAACAGACTCTTCATATT | 745 |
| FRK | NM_002031 | 4503786 | 2444 | D-003139-06 | GAACAATACCACTCCAGTA | 746 |
| FRK | NM_002031 | 4503786 | 2444 | D-003139-07 | CAAGACCGGTTCCTTTCTA | 747 |
| FRK | NM_002031 | 4503786 | 2444 | D-003139-08 | GCAAGAATATCTCCAAAAT | 748 |

TABLE VII-continued

| Gene Name | Acc # | GI | L.L. | Duplex # | Sequence | SEQ. ID NO. |
|---|---|---|---|---|---|---|
| FYN | | | | | | |
| FYN | NM_002037 | 23510344 | 2534 | D-003140-05 | GGAATGGACTCATATGCAA | 749 |
| FYN | NM_002037 | 23510344 | 2534 | D-003140-06 | GCAGAAGAGTGGTACTTTG | 750 |
| FYN | NM_002037 | 23510344 | 2534 | D-003140-07 | CAAAGGAAGTTTACTGGAT | 751 |
| FYN | NM_002037 | 23510344 | 2534 | D-003140-08 | GAAGAGTGGTACTTTGGAA | 752 |
| HCK | | | | | | |
| HCK | NM_002110 | 4504356 | 3055 | D-003141-05 | GAGATACCGTGAAACATTA | 753 |
| HCK | NM_002110 | 4504356 | 3055 | D-003141-06 | GCAGGGAGATACCGTGAAA | 754 |
| HCK | NM_002110 | 4504356 | 3055 | D-003141-07 | CATCGTGGTTGCCCTGTAT | 755 |
| HCK | NM_002110 | 4504356 | 3055 | D-003141-08 | TGTGTAAGATTGCTGACTT | 756 |
| ITK | | | | | | |
| ITK | NM_005546 | 21614549 | 3702 | D-003144-05 | CAAATAATCTGGAAACCTA | 757 |
| ITK | NM_005546 | 21614549 | 3702 | D-003144-06 | GAAGAAACGAGGAATAATA | 758 |
| ITK | NM_005546 | 21614549 | 3702 | D-003144-07 | GAAACTCTCTCATCCCAAA | 759 |
| ITK | NM_005546 | 21614549 | 3702 | D-003144-08 | GGAATGGGCATGAAGGATA | 760 |
| JAK1 | | | | | | |
| JAK1 | NM_002227 | 4504802 | 3716 | D-003145-05 | CCACATAGGTGATGTGAAA | 761 |
| JAK1 | NM_002227 | 4504802 | 3716 | D-003145-06 | TGAAATCACTCACATTGTA | 762 |
| JAK1 | NM_002227 | 4504802 | 3716 | D-003145-07 | TAAGGAACCTCTATCATGA | 763 |
| JAK1 | NM_002227 | 4504802 | 3716 | D-003145-08 | GCAGGTGGCTGTTAAATCT | 764 |
| JAK2 | | | | | | |
| JAK2 | NM_004972 | 13325062 | 3717 | D-003146-05 | GCAAATAGATCCAGTTCTT | 765 |
| JAK2 | NM_004972 | 13325062 | 3717 | D-003146-06 | GAGCAAAGATCCAAGACTA | 766 |
| JAK2 | NM_004972 | 13325062 | 3717 | D-003146-07 | GCCAGAAACTTGAAACTTA | 767 |
| JAK2 | NM_004972 | 13325062 | 3717 | D-003146-08 | GTACAGATTTCGCAGATTT | 768 |
| JAK3 | | | | | | |
| JAK3 | NM_000215 | 4557680 | 3718 | D-003147-05 | GCGCCTATCTTTCTCCTTT | 769 |
| JAK3 | NM_000215 | 4557680 | 3718 | D-003147-06 | CCAGAAATGGTAGACATTA | 770 |
| JAK3 | NM_000215 | 4557680 | 3718 | D-003147-07 | CCTCATCTCTTCAGACTAT | 771 |
| JAK3 | NM_000215 | 4557680 | 3718 | D-003147-08 | TGTACGAGCTCTTCAGCTA | 772 |
| KDR | | | | | | |
| KDR | NM_002253 | 11321596 | 3791 | D-003145-05 | GGAAATCTCTTGCAAGCTA | 773 |
| KDR | NM_002253 | 11321596 | 3791 | D-003148-06 | GATTACAGATCTCCATTTA | 774 |
| KDR | NM_002253 | 11321596 | 3791 | D-003148-07 | GCAGACAGATCTACGTTTG | 775 |
| KDR | NM_002253 | 11321596 | 3791 | D-003148-08 | GCGATGGCCTCTTCTGTAA | 776 |
| KIAA1079 | | | | | | |
| KIAA1079 | NM_014916 | 7662475 | 22853 | D-003149-05 | GAAATTCTCTCAACTGATG | 777 |
| KIAA1079 | NM_014916 | 7662475 | 22853 | D-003149-06 | GCAGAGGTCTTCACACTTT | 778 |
| KIAA1079 | NM_014916 | 7662475 | 22853 | D-003149-07 | TAAATGATCTTCAGACAGA | 779 |
| KIAA1079 | NM_014916 | 7662475 | 22853 | D-003149-08 | GAGCAGCCCTACTCTGATA | 780 |
| KIT | | | | | | |
| KIT | NM_000222 | 4557694 | 3815 | D-003150-05 | AAACACGGCTTAAGCAATT | 781 |
| KIT | NM_000222 | 4557694 | 3815 | D-003150-06 | GAACAGAACCTTCAGTGAT | 782 |
| KIT | NM_000222 | 4557694 | 3815 | D-003150-07 | GGGAAGCCCTCATGTCTGA | 783 |
| KIT | NM_000222 | 4557694 | 3815 | D-003150-08 | GCAATTCCATTTATGTGTT | 784 |
| LCK | | | | | | |
| LCK | NM_005356 | 20428651 | 3932 | D-003151-05 | GAACTGCCATTATCCCATA | 785 |
| LCK | NM_005356 | 20428651 | 3932 | D-003151-06 | GAGAGGTGGTGAAACATTA | 786 |
| LCK | NM_005356 | 20428651 | 3932 | D-003151-07 | GGGCCAAGTTTCCCATTAA | 787 |
| LCK | NM_005356 | 20428651 | 3932 | D-003151-08 | GCACGCTGCTCATCCGAAA | 788 |
| LTK | | | | | | |
| LTK | NM_002344 | 4505044 | 4058 | D-003152-05 | TGAATTGACTCCTGCCAAT | 789 |
| LTK | NM_002344 | 4505044 | 4058 | D-003152-06 | GTGGGAACCTCAACACTGA | 790 |
| LTK | NM_002344 | 4505044 | 4058 | D-003152-07 | GGAGGTAGCTGTGGATAAC | 791 |
| LTK | NM_002344 | 4505044 | 4058 | D-003152-08 | GCAAGTTTCGCCATCAGAA | 792 |
| LYN | | | | | | |
| LYN | NM_002350 | 4505054 | 4067 | D-003153-05 | GCAGATGGCTTGTGCAGAA | 793 |
| LYN | NM_002350 | 4505054 | 4067 | D-003153-06 | GGAGAAGGCTTGTATTAGT | 794 |
| LYN | NM_002350 | 4505054 | 4067 | D-003153-07 | GATGAGCTCTATGACATTA | 795 |
| LYN | NM_002350 | 4505054 | 4067 | D-003153-08 | GGTGCTAAGTTCCCTATTA | 796 |
| MATK | | | | | | |
| MATK | NM_002378 | 21450841 | 4145 | D-003154-05 | TGAAGAATATCAAGTGTGA | 797 |
| MATK | NM_002378 | 21450841 | 4145 | D-003154-06 | CCGCTCAGCTCCTGCAGTT | 798 |

TABLE VII-continued

| Gene Name | Acc # | GI | L.L. | Duplex # | Sequence | SEQ. ID NO. |
|---|---|---|---|---|---|---|
| MATK | NM_002378 | 21450841 | 4145 | D-003154-07 | TACTGAACCTGCAGCATTT | 799 |
| MATK | NM_002378 | 21450841 | 4145 | D-003154-08 | TGGGAGGTCTTCTCATATG | 800 |
| MERTK | | | | | | |
| MERTK | NM_006343 | 5453737 | 10461 | D-003155-05 | GAACTTACCTTACATAGCT | 801 |
| MERTK | NM_006343 | 5453737 | 10461 | D-003155-06 | GGACCTGCATACTTACTTA | 802 |
| MERTK | NM_006343 | 5453737 | 10461 | D-003155-07 | TGACAGGAATCTTCTAATT | 803 |
| MERTK | NM_006343 | 5453737 | 10461 | D-003155-08 | GGTAATGGCTCAGTCATGA | 804 |
| MET | | | | | | |
| MET | NM_000245 | 4557746 | 4233 | D-003156-05 | GAAAGAACCTCTCAACATT | 805 |
| MET | NM_000245 | 4557746 | 4233 | D-003156-06 | GGACAAGGCTGACCATATG | 806 |
| MET | NM_000245 | 4557746 | 4233 | D-003156-07 | CCAATGACCTGGTGAAATT | 807 |
| MET | NM_000245 | 4557746 | 4233 | D-003156-08 | GAGCATACATTAAACCAAA | 808 |
| MST1R | | | | | | |
| MST1R | NM_002447 | 4505264 | 4486 | D-003157-05 | GGATGGAGCTGCTGGCTTT | 809 |
| MST1R | NM_002447 | 4505264 | 4486 | D-003157-06 | CTGCAGACCTATAGATTTA | 810 |
| MST1R | NM_002447 | 4505264 | 4486 | D-003157-07 | GCACCTGTCTCACTCTTGA | 811 |
| MST1R | NM_002447 | 4505264 | 4486 | D-003157-08 | GAAAGAGTCCATCCAGCTA | 812 |
| MUSK | | | | | | |
| MUSK | NM_005592 | 5031926 | 4593 | D-003158-05 | GAAGAAGCCTCGGCAGATA | 813 |
| MUSK | NM_005592 | 5031926 | 4593 | D-003158-06 | GTAATAATCTCGATCATGT | 814 |
| MUSK | NM_005592 | 5031926 | 4593 | D-003158-07 | GGAATGAACTGAAAGTAGT | 815 |
| MUSK | NM_005592 | 5031926 | 4593 | D-003158-08 | GAGATTTCCTGGACTAGAA | 816 |
| NTRK1 | | | | | | |
| NTRK1 | NM_002529 | 4585711 | 4914 | D-003159-05 | GGACAACCCTTTCGAGTTC | 817 |
| NTRK1 | NM_002529 | 4585711 | 4914 | D-003159-06 | CCAGTGACCTCAACAGGAA | 818 |
| NTRK1 | NM_002529 | 4585711 | 4914 | D-003159-07 | CCACAATACTTCAGTGATG | 819 |
| NTRK1 | NM_002529 | 4585711 | 4914 | D-003159-08 | GAAGAGTGGTCTGCGTTTC | 820 |
| NTRK2 | | | | | | |
| NTRK2 | NM_006180 | 21361305 | 4915 | D-003160-05 | GAACAGAAGTAATGAAATC | 821 |
| NTRK2 | NM_006180 | 21361305 | 4915 | D-003160-06 | GTAATGCTGTTTCTGCTTA | 822 |
| NTRK2 | NM_006180 | 21361305 | 4915 | D-003160-07 | GCAAGACACTCCAAGTTTG | 823 |
| NTRK2 | NM_006180 | 21361305 | 4915 | D-003160-08 | GAAAGTCTATCACACATTATC | 824 |
| NTRK3 | | | | | | |
| NTRK3 | NM_002530 | 4505474 | 4916 | D-003161-05 | GAGCGAATCTGCTAGTGAA | 825 |
| NTRK3 | NM_002530 | 4505474 | 4916 | D-003161-06 | GAAGTTCACTACAGAGAGT | 826 |
| NTRK3 | NM_002530 | 4505474 | 4916 | D-003161-07 | GGTCGACGGTCCAAATTTG | 827 |
| NTRK3 | NM_002530 | 4505474 | 4916 | D-003161-08 | GAATATCACTTCCATACAC | 826 |
| PDGFRA | | | | | | |
| PDGFRA | NM_006206 | 15451787 | 5156 | D-003162-05 | GAAACTTCCTGGACTATTT | 829 |
| PDGFRA | NM_006206 | 15451787 | 5156 | D-003162-06 | GAGATTTGGTCAACTATTT | 830 |
| PDGFRA | NM_006206 | 15451787 | 5156 | D-003162-07 | GCACGCCGCTTCCTGATAT | 831 |
| PDGFRA | NM_006206 | 15451787 | 5156 | D-003162-08 | CATCAGAGCTGGATCTAGA | 832 |
| PDGFRB | | | | | | |
| PDGFRB | NM_002609 | 15451788 | 5159 | D-003163-05 | GAAAGGAGACGTCAAATAT | 833 |
| PDGFRB | NM_002609 | 15451788 | 5159 | D-003163-06 | GGAATGAGGTGGTCAACTT | 834 |
| PDGFRB | NM_002609 | 15451788 | 5159 | D-003163-07 | CAACGAGTCTCCAGTGCTA | 835 |
| PDGFRB | NM_002609 | 15451788 | 5159 | D-003163-08 | GAGAGGACCTGCCGAGCAA | 836 |
| PTK2 | | | | | | |
| PTK2 | NM_005607 | 27886592 | 5747 | D-003164-05 | GAAGTTGGGTTGTCTAGAA | 837 |
| PTK2 | NM_005607 | 27886592 | 5747 | D-003164-06 | GAAGAAGAATGATGTAATC | 838 |
| PTK2 | NM_005607 | 27886592 | 5747 | D-003164-07 | GGAAATTGCTTTGAAGTTG | 839 |
| PTK2 | NM_005607 | 27886592 | 5747 | D-003164-08 | GGTTCAAGCTGGATTATTT | 840 |
| PTK2B | | | | | | |
| PTK2B | NM_004103 | 27886583 | 2185 | D-003165-05 | GAACATGGCTGACCTCATA | 841 |
| PTK2B | NM_004103 | 27886583 | 2185 | D-003165-06 | GGACCACGGTGCTCTATTT | 842 |
| PTK2B | NM_004103 | 27886583 | 2185 | D-003165-07 | GGACGAGGACTATTACAAA | 843 |
| PTK2B | NM_004103 | 27886583 | 2185 | D-003165-08 | TGGCAGAGCTCATCAAGAA | 844 |
| PTK6 | | | | | | |
| PTK6 | NM_005975 | 27886594 | 5753 | D-003166-05 | GAGAAAGTGCTGCGCGTTT | 845 |
| PTK6 | NM_005975 | 27886594 | 5753 | D-003166-06 | TGAAGAAGGTGCGGCACAA | 846 |
| PTK6 | NM_005975 | 27886594 | 5753 | D-003166-07 | CCGCGACTCTGATGAGAAA | 847 |
| PTK6 | NM_005975 | 27886594 | 5753 | D-003166-08 | TGCCCGAGCTTGTGAACTA | 848 |
| PTK7 | | | | | | |
| PTK7 | NM_002821 | 27886610 | 5754 | D-003167-05 | GAGAGAAGCCGACTATTAA | 849 |
| PTK7 | NM_002821 | 27886610 | 5754 | D-003167-06 | CGAGAGAAGCCCACTATTA | 850 |

TABLE VII-continued

| Gene Name | Acc # | GI | L.L. | Duplex # | Sequence | SEQ. ID NO. |
|---|---|---|---|---|---|---|
| PTK7 | NM_002821 | 27886610 | 5754 | D-003167-07 | GGAGGGAGTTGGAGATGTT | 851 |
| PTK7 | NM_002821 | 27886610 | 5754 | D-003167-08 | GAAGACATGCCGCTATTTG | 852 |
| PTK9 | NM_002822 | 4506274 | 5756 | D-003168-05 | GAAGAACTACGACAGATTA | 853 |
| PTK9 | NM_002822 | 4506274 | 5756 | D-003168-09 | GAAGGAGACTATTTAGAGT | 854 |
| PTK9 | NM_002822 | 4506274 | 5756 | D-003168-10 | GAGCGGATGCTGTATTCTA | 855 |
| PTK9 | NM_002822 | 4506274 | 5756 | D-003168-11 | CTGCAGACTTCCTTTATGA | 856 |
| PTK9L | NM_007284 | 31543446 | 11344 | D-003169-05 | AGAGAGAGGTCGAGCAGAT | 857 |
| PTK9L | NM_007284 | 31543446 | 11344 | D-003169-06 | TTAACGAGGTGAAGACAGA | 858 |
| PTK9L | NM_007284 | 31543446 | 11344 | D-003169-07 | ACACAGAGCCCACGGATGT | 859 |
| PTK9L | NM_007284 | 31543446 | 11344 | D-003169-08 | GCTGGGATCAGGACTATGA | 860 |
| RET | NM_000323 | 21536316 | 5979 | D-003170-05 | GCAAAGACCTGGAGAAGAT | 861 |
| RET | NM_000323 | 21536316 | 5979 | D-003170-06 | GCACACGGCTGCATGAGAA | 862 |
| RET | NM_000323 | 21536316 | 5979 | D-003170-07 | GAACTGGCCTGGAGAGAGT | 863 |
| RET | NM_000323 | 21536316 | 5979 | D-003170-08 | TTAAATGGATGGCAATTGA | 864 |
| ROR1 | | | | | | |
| ROR1 | NM_005012 | 4826867 | 4919 | D-003171-05 | GCAAGCATCTTTACTAGGA | 865 |
| ROR1 | NM_005012 | 4826867 | 4919 | D-003171-06 | GAGCAAGGCTAAAGAGGTA | 866 |
| ROR1 | NM_005012 | 4826867 | 4919 | D-003171-07 | GAGAGCAACTUCATGTAAA | 867 |
| ROR1 | NM_005012 | 4826867 | 4919 | D-003171-08 | GAGAATGTCCTGTGTCAAA | 868 |
| ROR2 | | | | | | |
| ROR2 | NM_004560 | 19743897 | 4920 | D-003172-05 | GGAACTCGCTGCTGGCTAT | 869 |
| ROR2 | NM_004560 | 19743897 | 4920 | D-003172-06 | GCAGGTGCCTCCTCAGATG | 870 |
| ROR2 | NM_004560 | 19743897 | 4920 | D-003172-07 | GCAATGTGCTAGTGTACGA | 871 |
| ROR2 | NM_004560 | 19743897 | 4920 | D-003172-08 | GAAGACAGAATATGGTTCA | 872 |
| ROS1 | | | | | | |
| ROS1 | NM_002944 | 19924164 | 6098 | D-003173-05 | GAGGAGAGGTTCTTACTTA | 873 |
| ROS1 | NM_002944 | 19924164 | 6098 | D-003173-06 | TTACAGAGGTTCAGGATTA | 874 |
| ROS1 | NM_002944 | 19924164 | 6098 | D-003173-07 | GAACAAACCTAAGCATGAA | 875 |
| ROS1 | NM_002944 | 19924164 | 6098 | D-003173-08 | GAAAGAGCACTTCAAATAA | 876 |
| RYK | | | | | | |
| RYK | NM_002958 | 11863158 | 6259 | D-003174-05 | GAAAGATGGTTACCGAATA | 877 |
| RYK | NM_002958 | 11863158 | 6259 | D-003174-06 | CAAAGTAGATTCTGAAGTT | 878 |
| RYK | NM_002958 | 11863158 | 6259 | D-003174-07 | TCACTACGCTCTATCCTTT | 879 |
| RYK | NM_002958 | 11863158 | 6259 | D-003174-08 | GGTGAAGGATATAGCAATA | 880 |
| SRC | | | | | | |
| SRC | NM_005417 | 21361210 | 6714 | D-003175-05 | GAGAACCTGGTGTGCAAAG | 881 |
| SRC | NM_005417 | 21361210 | 6714 | D-003175-09 | GAGAGAACCTGGTGTGCAA | 882 |
| SRC | NM_005417 | 21361210 | 6714 | D-003175-10 | GGAGTTTGCTGGACTTTCT | 883 |
| SRC | NM_005417 | 21361210 | 6714 | D-003175-11 | GAAAGTGAGACCACGAAAG | 884 |
| SYK | | | | | | |
| SYK | NM_003177 | 21361552 | 6850 | D-003176-05 | GGAATAATCTCAAGAATCA | 885 |
| SYK | NM_003177 | 21381552 | 6850 | D-003176-06 | GAACTGGGCTCTGGTAATT | 886 |
| SYK | NM_003177 | 21361552 | 6850 | D-003176-07 | GGAAGAATCTGAGCAAATT | 887 |
| SYK | NM_003177 | 21361552 | 6850 | D-003176-08 | GAACAGACATGTCAAGGAT | 888 |
| TEC | | | | | | |
| TEC | NM_003215 | 4507428 | 7006 | D-003177-05 | GAAATTGTCTAGTAAGTGA | 889 |
| TEC | NM_003215 | 4507428 | 7006 | D-003177-06 | CACCTGAAGTGTTTAATTA | 890 |
| TEC | NM_003215 | 4507428 | 7006 | D-003177-07 | GTACAAAGTCGCAATCAAA | 891 |
| TEC | NM_003215 | 4507428 | 7006 | D-003177-08 | TGGAGGAGATTCTTATTAA | 892 |
| TEK | | | | | | |
| TEK | NM_000459 | 4557868 | 7010 | D-003178-05 | GAAAGAATATGCCTCCAAA | 893 |
| TEK | NM_000459 | 4557868 | 7010 | D-003178-06 | GGAATGACATCAAATTTCA | 894 |
| TEK | NM_000459 | 4557868 | 7010 | D-003178-07 | TGAAGTACCTGATATTCTA | 895 |
| TEK | NM_000459 | 4557868 | 7010 | D-003178-08 | CGAAAGACCTACGTGAATA | 896 |
| TIE | | | | | | |
| TIE | NM_005424 | 4885630 | 7075 | D-003179-05 | GAGAGGAGGTTTATGTGAA | 897 |
| TIE | NM_005424 | 4885630 | 7075 | D-003179-06 | GGGACAGACCTCTAGCCTTA | 898 |
| TIE | NM_005424 | 4885630 | 7075 | D-003179-07 | GAAGTTCTGTGGAAATTGG | 899 |
| TIE | NM_005424 | 4885630 | 7075 | D-003179-08 | CAACATGGCCTCAGAACTG | 900 |
| TNK1 | | | | | | |
| TNK1 | NM_003985 | 4507610 | 8711 | D-003180-05 | GTTCTGGGCCTAAGTCTAA | 901 |
| TNK1 | NM_003985 | 4507610 | 8711 | D-003180-06 | GAACTGGGTCTACAAGATC | 902 |

TABLE VII-continued

| Gene Name | Acc # | GI | L.L. | Duplex # | Sequence | SEQ. ID NO. |
|---|---|---|---|---|---|---|
| TNK1 | NM_003985 | 4507610 | 8711 | D-003180-07 | CGAGAGGTATCGGTCATGA | 903 |
| TNK1 | NM_003985 | 4507610 | 8711 | D-003180-08 | GGCGCATCCTGGAGCATTA | 904 |
| TXK | | | | | | |
| TXK | NM_003328 | 4507742 | 7294 | D-003181-05 | GAACATCTATTGAGACAAG | 905 |
| TXK | NM_003328 | 4507742 | 7294 | D-003181-06 | TCAAGGCACTTTATGATTT | 906 |
| TXK | NM_003328 | 4507742 | 7294 | D-003181-07 | GGAGAGGAATGGCTATATT | 907 |
| TXK | NM_003328 | 4507742 | 7294 | D-003181-08 | GGATATATGTGAAGGAATG | 908 |
| TYK2 | | | | | | |
| TYK2 | NM_003331 | 4507748 | 7297 | D-003182-05 | GAGGAGATCCACCACTTTA | 909 |
| TYK2 | NM_003331 | 4507748 | 7297 | D-003182-06 | GCATCCACATTGCACATAA | 910 |
| TYK2 | NM_003331 | 4507748 | 7297 | D-003182-07 | TCAAATACCTAGCCACACT | 911 |
| TYK2 | NM_003331 | 4507748 | 7297 | D-003182-08 | CAATCTTGCTGACGTCTTG | 912 |
| TYRO3 | | | | | | |
| TYRO3 | NM_006293 | 27597077 | 7301 | D-003183-05 | GGTAGAAGGTGTGCCATTT | 913 |
| TYRO3 | NM_006293 | 27597077 | 7301 | D-003183-06 | ACGCTGAGATTTACAACTA | 914 |
| TYRO3 | NM_006293 | 27597077 | 7301 | D-003183-07 | GGATGGCTCCTTTGTGAAA | 915 |
| TYRO3 | NM_006293 | 27597077 | 7301 | D-003183-08 | GAGAGGAACTACGAAGATC | 916 |
| YES1 | | | | | | |
| YES1 | NM_005433 | 21071041 | 7525 | D-003184-05 | GAAGGACCCTGATGAAAGA | 917 |
| YES1 | NM_005433 | 21071041 | 7525 | D-003184-06 | TAAGAAGGGTGAAAGATTT | 918 |
| YES1 | NM_005433 | 21071041 | 7525 | D-003184-07 | TCAAGAAGCTCAGATAATG | 919 |
| YES1 | NM_005433 | 21071041 | 7525 | D-003184-08 | CAGAATCCCTCCATGAATT | 920 |

TABLE V111

| Gene Name | Acc # Acc # | GI | Locus Link | Duplex # | Full Sequence | SEQ. ID NO. |
|---|---|---|---|---|---|---|
| APC2 | | | | | | |
| APC2 | NM_013366 | 7549800 | 29882 | D-003200-05 | GCAAGGACCTCTTCATCAA | 921 |
| APC2 | NM_013366 | 7549800 | 29882 | D-003200-06 | GAGAAGAAGTCCACACTAT | 922 |
| APC2 | NM_013366 | 7549800 | 29882 | D-003200-07 | GGAATGCCATCTCCCAATG | 923 |
| APC2 | NM_013366 | 7549800 | 29882 | D-003200-09 | CAACACGTGTGACATCATC | 924 |
| ATM | | | | | | |
| ATM | NM_000051 | 20336202 | 472 | D-003201-05 | GCAAGCAGCTGAAACAAAT | 925 |
| ATM | NM_000051 | 20336202 | 472 | D-003201-06 | GAATGTTGCTTTCTGAATT | 926 |
| ATM | NM_000051 | 20336202 | 472 | D-003201-07 | GACCTGAAGTCTTATTTAA | 927 |
| ATM | NM_000051 | 20336202 | 472 | D-003201-08 | AGACAGAATTCCCAAATAA | 928 |
| ATR | | | | | | |
| ATR | NM_001184 | 20143978 | 545 | D-003202-05 | GAACAACACTGCTGGTTTG | 929 |
| ATR | NM_001184 | 20143978 | 545 | D-003202-06 | GAAGTCATCTGTTCATTAT | 930 |
| ATR | NM_001184 | 20143978 | 545 | D-003202-07 | GAAATAAGGTAGACTCAAT | 931 |
| ATR | NM_001184 | 20143978 | 545 | D-003202-08 | CAACATAAATCCAAGAAGA | 932 |
| BTAK | | | | | | |
| BTAK | NM_003600 | 3213196 | 6790 | D-003545-04 | CAAAGAATCAGCTAGCAAA | 933 |
| BTAK | NM_003600 | 3213196 | 6790 | D-003203-05 | GAAGAGAGTTATTCATAGA | 934 |
| BTAK | NM_003600 | 3213196 | 6790 | D-003203-07 | CAAATGCCCTGTCTTACTG | 935 |
| STK6 | NM_003600 | 3213196 | 6790 | D-003203-09 | TCTCGTGAGTCAGCAAATT | 936 |
| CCNA1 | | | | | | |
| CCNA1 | NM_003914 | 16306528 | 8900 | D-003204-05 | GAACCTGGCTAAGTACGTA | 937 |
| CCNA1 | NM_003914 | 16306528 | 8900 | D-003204-06 | GCAGATCCATTCTTGAAAT | 938 |
| CCNA1 | NM_003914 | 16306528 | 8900 | D-003204-07 | TCACAAGAATCAGGTGTTA | 939 |
| CCNA1 | NM_003914 | 16306528 | 8900 | D-003204-08 | CATAAAGCGTACCTTGATA | 940 |
| CCNA2 | | | | | | |
| CCNA2 | NM_001237 | 16950653 | 890 | D-003205-05 | GCTGTGAACTACATTGATA | 941 |
| CCNA2 | NM_001237 | 16950653 | 890 | D-003205-06 | GATGATACCTACACCAAGA | 942 |
| CCNA2 | NM_001237 | 16950653 | 890 | D-003205-07 | GCTGTTAGCCTCAAAGTTT | 943 |
| CCNA2 | NM_001237 | 16950653 | 890 | D-003205-08 | AAGCTGGCCTGAATCATTA | 944 |
| CCNB1 | | | | | | |
| CCNB1 | NM_031966 | 14327895 | 891 | D-003206-05 | CAACATTACCTGTCATATA | 945 |
| CCNB1 | NM_031966 | 14327895 | 891 | D-003206-06 | CCAAATACCTGATGGAACT | 946 |
| CCNB1 | NM_031966 | 14327895 | 891 | D-003206-07 | GAAATGTACCCTCCAGAAA | 947 |
| CCNB1 | NM_031966 | 14327895 | 891 | D-003206-08 | GCACCTGGCTAAGAATGTA | 948 |

TABLE VIII-continued

| Gene Name | Acc # | GI | Locus Link | Duplex # | Full Sequence | SEQ. ID NO. |
|---|---|---|---|---|---|---|
| CCNB2 | | | | | | |
| CCNB2 | NM_004701 | 10938017 | 9133 | D-003207-05 | CAACAAATGTCAACAAACA | 949 |
| CCNB2 | NM_004701 | 10938017 | 9133 | D-003207-06 | GCAGCAAACTCCTGAAGAT | 950 |
| CCNB2 | NM_004701 | 10938017 | 9133 | D-003207-07 | CCAGTGATTTGGAGAATAT | 951 |
| CCNB2 | NM_004701 | 10938017 | 9133 | D-003207-08 | GRGACTACGTTAAGGATAT | 952 |
| CCNB3 | | | | | | |
| CCNB3 | NM_033031 | 14719419 | 85417 | D-003208-05 | TGAACAAACTGCTGACTTT | 953 |
| CCNB3 | NM_033031 | 14719419 | 85417 | D-003208-06 | GCTAGCTGCTGCCTCCTTA | 954 |
| CCNB3 | NM_033031 | 14719419 | 85417 | D-003208-07 | CAACTCACCTCGTGTGGAT | 955 |
| CCNB3 | NM_033031 | 14719419 | 85417 | D-003208-08 | GTGGATCTCTACCTAATGA | 956 |
| CCNC | | | | | | |
| CCNC | NM_005190 | 7382485 | 892 | D-003209-05 | GCAGAGCTCCCACTATTTG | 957 |
| CCNC | NM_005190 | 7382485 | 892 | D-003209-06 | GGAGTAGTTTCAAATACAA | 958 |
| CCNC | NM_005190 | 7382485 | 892 | D-003209-07 | GACCTTTGCTCCAGTATGT | 959 |
| CCNC | NM_005190 | 7382485 | 892 | D-003209-08 | GAGATTCTATGCCAGGTAT | 960 |
| CCND1 | | | | | | |
| CCND1 | NM_053056 | 16950654 | 595 | D-003210-05 | TGAACAAGCTCAAGTGGAA | 961 |
| CCND1 | NM_053056 | 16950654 | 595 | D-003210-06 | CCAGAGTGATCAAGTGTGA | 962 |
| CCND1 | NM_053056 | 16950654 | 595 | D-003210-07 | GTTCGTGGCCTCTAAGATG | 963 |
| CCND1 | NM_053056 | 16950654 | 595 | D-003210-08 | CCGAGAAGCTGTGCATCTA | 964 |
| CCND2 | | | | | | |
| CCND2 | NM_001759 | 16950656 | 894 | D-003211-06 | TGAATTACCTGGACCGTTT | 965 |
| CCND2 | NM_001759 | 16950656 | 894 | D-003211-07 | CGGAGAAGCTGTGCATTTA | 966 |
| CCND2 | NM_001759 | 16950656 | 894 | D-003211-08 | CTACAGACGTGCGGGATAT | 967 |
| CCND2 | NM_001759 | 16950656 | 894 | D-003211-09 | CAACACAGACGTGGATTGT | 968 |
| CCND3 | | | | | | |
| CCND3 | NM_001760 | 16950657 | 896 | D-003212-05 | GGACCTGGCTGCTGTGATT | 969 |
| CCND3 | NM_001760 | 16950657 | 896 | D-003212-06 | GATTATACCTTTGCCATGT | 970 |
| CCND3 | NM_001760 | 16950657 | 896 | D-003212-07 | GACCAGCACTCCTACAGAT | 971 |
| CCND3 | NM_001760 | 16950657 | 896 | D-003212-08 | TGCGGAAGATGCTGGCTTA | 972 |
| CCNE1 | | | | | | |
| CCNE1 | NM_001238 | 17318558 | 898 | D-003213-05 | GTACTGAGCTGGGCAAATA | 973 |
| CCNE1 | NM_001238 | 17318558 | 898 | D-003213-06 | GGAAATCTATCCTCCAAAG | 974 |
| CCNE1 | NM_001238 | 17318558 | 898 | D-003213-07 | GGAGGTGTGTGAAGTCTAT | 975 |
| CCNE1 | NM_001238 | 17318558 | 898 | D-003213-08 | CTAAATGACTTACATGAAG | 976 |
| CCNE2 | | | | | | |
| CCNE2 | NM_057749 | 17318564 | 9134 | D-003214-05 | GGATGGAACTCATTATATT | 977 |
| CCNE2 | NM_057749 | 17318564 | 9134 | D-003214-06 | GCAGATATGTTCATGACAA | 978 |
| CCNE2 | NM_057749 | 17318564 | 9134 | D-003214-07 | CATAATATCCAGACACATA | 979 |
| CCNE2 | NM_057749 | 17318564 | 9134 | D-003214-08 | TAAGAAAGCCTCAGGTTTG | 980 |
| CCNF | | | | | | |
| CCNF | NM_001761 | 4502620 | 899 | D-003215-05 | TCACAAAGCATCCATATTG | 981 |
| CCNF | NM_001761 | 4502620 | 899 | D-003215-06 | GAAGTCATGTTTACAGTGT | 982 |
| CCNF | NM_001761 | 4502620 | 899 | D-003215-07 | TAGCCTACCTCTACAATGA | 983 |
| CCNF | NM_001761 | 4502620 | 899 | D-003215-08 | GCACCCGGTTTATCAGTAA | 984 |
| CCNG1 | | | | | | |
| CCNG1 | NM_004060 | 8670528 | 900 | D-003216-05 | GATAATGGCCTCAGAATGA | 985 |
| CCNG1 | NM_004060 | 8670528 | 900 | D-003216-06 | GCACGGCAATTGAAGCATA | 986 |
| CCNG1 | NM_004060 | 8670528 | 900 | D-003216-07 | GGAATAGAATGTCTTCAGA | 987 |
| CCNG1 | NM_004060 | 8670528 | 900 | D-003216-08 | TAACTCACCTTCCAACAAT | 988 |
| CCNG2 | | | | | | |
| CCNG2 | NM_004354 | 4757935 | 901 | D-003217-05 | GGAGAGAGTTGGTTTCTAA | 989 |
| CCNG2 | NM_004354 | 4757935 | 901 | D-003217-06 | GGTGAAACCTAAACATTTG | 990 |
| CCNG2 | NM_004354 | 4757935 | 901 | D-003217-07 | GAAATACTGAGCCTTGATA | 991 |
| CCNG2 | NM_004354 | 4757935 | 901 | D-003217-08 | TGCCAAAGTTGAAGATTTA | 992 |
| CCNH | | | | | | |
| CCNH | NM_001239 | 17738313 | 902 | D-003218-05 | GCTGATGACTTTCTTAATA | 993 |
| CCNH | NM_001239 | 17738313 | 902 | D-003218-06 | CAACTTAATTTCCACCTTA | 994 |
| CCNH | NM_001239 | 17738313 | 902 | D-003218-07 | ATACACACCTTCCCAAATT | 995 |
| CCNH | NM_001239 | 17738313 | 902 | D-003218-08 | GCTATGAAGATGATGATTA | 996 |
| CCNI | | | | | | |
| CCNI | NM_006835 | 17738314 | 10983 | D-003219-05 | GCAAGCAGACCTCTACTAA | 997 |
| CCNI | NM_006835 | 17738314 | 10983 | D-003219-07 | TGAGAGAATTCCAGTACTA | 998 |

TABLE VIII-continued

| Gene Name | Acc # Acc # | GI | Locus Link | Duplex # | Full Sequence | SEQ. ID NO. |
|---|---|---|---|---|---|---|
| CCNI | NM_006835 | 17738314 | 10983 | D-003219-08 | GGAATCAAACGGCTCTATA | 999 |
| CCNI | NM_006835 | 17738314 | 10983 | D-003219-09 | GAATTGGGATCTTCACACA | 1000 |
| CCNT1 | | | | | | |
| CCNT1 | NM_001240 | 17978465 | 904 | D-003220-05 | TATCAACACTGCTATAGTA | 1001 |
| CCNT1 | NM_001240 | 17978465 | 904 | D-003220-06 | GAACAAACGTCCTGGTGAT | 1002 |
| CCNT1 | NM_001240 | 17978465 | 904 | D-003220-07 | GCACAAGACTCACCCATCT | 1003 |
| CCNT1 | NM_001240 | 17978465 | 904 | D-003220-08 | GCACAGACTTCTTACTTCA | 1004 |
| CCNT2A | | | | | | |
| CCNT2A | NM_001241 | 17978467 | 905 | D-003221-05 | GCACAGACATCCTATTTCA | 1005 |
| CCNT2A | NM_001241 | 17978467 | 905 | D-003221-06 | GCAGGGACCTTCTATATCA | 1006 |
| CCNT2A | NM_001241 | 17978467 | 905 | D-003221-07 | GAACAGCTATATTCACAGA | 1007 |
| CCNT2A | NM_001241 | 17978467 | 905 | D-003221-09 | TTATATAGCTGCCCAGGTA | 1008 |
| CCNT2B | | | | | | |
| CCNT2B | NM_058241 | 17978468 | 905 | D-003222-05 | GCACAGACATCCTATTTCA | 1009 |
| CCNT2B | NM_058241 | 17978468 | 905 | D-003222-06 | GCAGGGACCTTCTATATCA | 1010 |
| CCNT2B | NM_058241 | 17978468 | 905 | D-003222-07 | GAACAGCTATATTCACAGA | 1011 |
| CCNT2B | NM_058241 | 17978468 | 905 | D-003222-08 | GGTGAAATGTACCCAGTTA | 1012 |
| CDC16 | | | | | | |
| CDC16 | NM_003903 | 14110370 | 8881 | D-003223-05 | GTAGATGGCTTGCAAGAGA | 1013 |
| CDC16 | NM_003903 | 14110370 | 8881 | D-003223-06 | TAAAGTAGCTTCACTCTCT | 1014 |
| CDC16 | NM_003903 | 14110370 | 8881 | D-003223-07 | GCTACAAGCTTACTTCTGT | 1015 |
| CDC16 | NM_003903 | 14110370 | 8881 | D-003223-08 | TGGAAGAGCCCATCAATAA | 1016 |
| CDC2 | | | | | | |
| CDC2 | NM_033379 | 27886643 | 983 | D-003552-01 | GTACAGATCTCCAGAAGTA | 1017 |
| CDC2 | NM_033379 | 27886643 | 983 | D-003552-02 | GATCAACTCTTCAGGATTT | 1018 |
| CDC2 | NM_033379 | 27886643 | 983 | D-003552-03 | GGTTATATCTCATCTTTGA | 1019 |
| CDC2 | NM_033379 | 27886643 | 983 | D-003552-04 | GAACTTCGTCATCCAAATA | 1020 |
| CDC20 | | | | | | |
| CDC20 | NM_001255 | 4557436 | 991 | D-003225-05 | GGGAATATATATCCTCTGT | 1021 |
| CDC20 | NM_001255 | 4557436 | 991 | D-003225-06 | GAAACGGCTTCGAAATATG | 1022 |
| CDC20 | NM_001255 | 4557436 | 991 | D-003225-07 | GAAGACCTGCCGTTACATT | 1023 |
| CDC20 | NM_001255 | 4557436 | 991 | D-003225-08 | CACCAGTGATCGACACATT | 1024 |
| CDC25A | | | | | | |
| CDC25A | NM_001789 | 4502704 | 993 | D-003226-05 | GAAATTATGGCATCTGTTT | 1025 |
| CDC25A | NM_001789 | 4502704 | 993 | D-003226-06 | TACAAGGAGTTCTTTATGA | 1026 |
| CDC25A | NM_001789 | 4502704 | 993 | D-003226-07 | CCACGAGGACTTTAAAGAA | 1027 |
| CDC25A | NM_001789 | 4502704 | 993 | D-003226-08 | TGGGAAACATCAGGATTTA | 1028 |
| CDC25B | | | | | | |
| CDC25B | NM_004358 | 11641416 | 994 | D-003227-05 | GCAGATACCCCTATGAATA | 1029 |
| CDC25B | NM_004358 | 11641416 | 994 | D-003227-06 | CTAGGTCGCTTCTCTCTGA | 1030 |
| CDC25B | NM_004358 | 11641416 | 994 | D-003227-07 | GAGAGCTGATTGGAGATTA | 1031 |
| CDC25B | NM_004358 | 11641416 | 994 | D-003227-08 | AAAAGGACCTCGTCATGTA | 1032 |
| CDC25C | | | | | | |
| CDC25C | NM_001790 | 12408659 | 995 | D-003228-05 | GAGCAGAAGTGGCCTATAT | 1033 |
| CDC25C | NM_001790 | 12408659 | 995 | D-003228-06 | CAGAAGAGATTTCAGATGA | 1034 |
| CDC25C | NM_001790 | 12408659 | 995 | D-003228-07 | CCAGGGAGCCTTAAACTTA | 1035 |
| CDC25C | NM_001790 | 12408659 | 995 | D-003228-08 | GAAACTTGGTGGACAGTGA | 1036 |
| CDC27 | | | | | | |
| CDC27 | NM_001256 | 16554576 | 996 | D-003229-06 | CATGCAAGCTGAAAGAATA | 1037 |
| CDC27 | NM_001256 | 16554576 | 996 | D-003229-07 | CAACACAAGTACCTAATCA | 1038 |
| CDC27 | NM_001256 | 16554576 | 996 | D-003229-08 | GGAGATGGATCCTATTTAC | 1039 |
| CDC27 | NM_001256 | 16554576 | 996 | D-003229-09 | GAAAAGCCATGATGATATT | 1040 |
| CDC34 | | | | | | |
| CDC34 | NM_004359 | 16357476 | 997 | D-003230-05 | GCTCAGACCTCTTCTACGA | 1041 |
| CDC34 | NM_004359 | 16357476 | 997 | D-003230-06 | GGACGAGGGCGATCTATAC | 1042 |
| CDC34 | NM_004359 | 16357476 | 997 | D-003230-07 | GATCGGGAGTACAGAGACA | 1043 |
| CDC34 | NM_004359 | 16357476 | 997 | D-003230-08 | TGAACGAGCCCAACACCTT | 1044 |
| CDC37 | | | | | | |
| CDC37 | NM_007065 | 16357478 | 11140 | D-003231-05 | GGGAGGAGACAGCCAATTA | 1045 |
| CDC37 | NM_007065 | 16357478 | 11140 | D-003231-06 | CACAAGACCTTCGTGGAAA | 1046 |
| CDC37 | NM_007065 | 16357478 | 11140 | D-003231-07 | ACAATCGTCATGCAATTTA | 1047 |
| CDC37 | NM_007065 | 16357478 | 11140 | D-003231-08 | GAGGAGAAATGTGCACTCA | 1048 |

TABLE VIII-continued

| Gene Name | Acc # | GI | Locus Link | Duplex # | Full Sequence | SEQ. ID NO. |
|---|---|---|---|---|---|---|
| CDC45L | | | | | | |
| CDC45L | NM_003504 | 34335230 | 8318 | D-003232-05 | GCACACGGATCTCCTTTGA | 1049 |
| CDC45L | NM_003504 | 34335230 | 8318 | D-003232-06 | GCAAACACCTGCTCAAGTC | 1050 |
| CDC45L | NM_003504 | 34335230 | 8318 | D-003232-07 | TGAAGAGTCTGCAAATAAA | 1051 |
| CDC45L | NM_003504 | 34335230 | 8318 | D-003232-08 | GGACGTGGATGCTCTGTGT | 1052 |
| CDC6 | | | | | | |
| CDC6 | NM_001254 | 16357469 | 990 | D-003233-05 | GAACACAGCTGTCCCAGAT | 1053 |
| CDC6 | NM_001254 | 16357469 | 990 | D-003233-06 | GAGCAGAGATGTCCACTGA | 1054 |
| CDC6 | NM_001254 | 16357469 | 990 | D-003233-07 | GGAAATATCTTAGCTACTG | 1055 |
| CDC6 | NM_001254 | 16357469 | 990 | D-003233-08 | GGACGAAGATTGGTATTTG | 1056 |
| CDC7 | | | | | | |
| CDC7 | NM_003503 | 11038647 | 8317 | D-003234-05 | GGAATGAGGTACCTGATGA | 1057 |
| CDC7 | NM_003503 | 11038647 | 8317 | D-003234-06 | CAGGAAAGGTGTTCACAAA | 1058 |
| CDC7 | NM_003503 | 11038647 | 8317 | D-003234-07 | CTACACAAATGCACAAATT | 1059 |
| CDC7 | NM_003503 | 11038647 | 8317 | D-003234-08 | GTACGGGAATATATGCTTA | 1060 |
| CDK10 | | | | | | |
| CDK10 | NM_003674 | 32528262 | 8558 | D-003235-05 | GAACTGCTGTTGGGAACCA | 1061 |
| CDK10 | NM_003674 | 32528262 | 8558 | D-003235-06 | GGAAGCAGCCCTACAACAA | 1062 |
| CDK10 | NM_003674 | 32628262 | 8558 | D-003235-07 | GCACGCCCAGTGAGAACAT | 1063 |
| CDK10 | NM_003674 | 32528262 | 8558 | D-003235-08 | GGAAGCAGCCCTACAACAA | 1064 |
| CDK2 | | | | | | |
| CDK2 | NM_001798 | 16936527 | 1017 | D-003236-05 | GAGCTTAACCATCCTAATA | 1065 |
| C0K2 | NM_001798 | 16936527 | 1017 | D-003236-06 | GAGCTTAACCATCCTAATA | 1066 |
| CDK2 | NM_001798 | 16936527 | 1017 | D-003236-07 | GTACCGAGCTCCTGAAATC | 1067 |
| CDK2 | NM_001798 | 16936527 | 1017 | D-003236-08 | GAGAGGTGGTGGCGCTTAA | 1068 |
| CDK3 | | | | | | |
| CDK3 | NM_001258 | 4557438 | 1018 | D-003237-05 | GAGCATTGGTTGCATCTTT | 1069 |
| CDK3 | NM_001258 | 4557438 | 1018 | D-003237-06 | GATCGGAGAGGGCACCTAT | 1070 |
| CDK3 | NM_001258 | 4557438 | 1018 | D-003237-07 | GAAGCTCTATCTGGTGTTT | 1071 |
| CDK3 | NM_001258 | 4557438 | 1018 | D-003237-08 | GCAGAGATGGTGACTCGAA | 1072 |
| CDK4 | | | | | | |
| CDK4 | NM_000075 | 456426 | 1019 | D-003238-05 | GCAGGACTCTTATCTACAT | 1073 |
| CDK4 | NM_000075 | 456426 | 1019 | D-003238-06 | GGAGGAGGCCTTCCCATCA | 1074 |
| CDK4 | NM_000075 | 456426 | 1019 | D-003238-07 | TCGAAAGCCTCTCTTCTGT | 1075 |
| CDK4 | NM_000075 | 456426 | 1019 | D-003238-08 | GTACCGAGCTCCCGAAGTT | 1076 |
| CDK5 | | | | | | |
| CDK5 | NM_004935 | 4826674 | 1020 | D-003239-05 | TGACCAAGCTGCCAGACTA | 1077 |
| CDK5 | NM_004935 | 4826674 | 1020 | D-003239-06 | GAGCTGAAATTGGCTGATT | 1078 |
| CDK5 | NM_004935 | 4826674 | 1020 | D-003239-07 | CAACATCCCTGGTGAACGT | 1079 |
| CDK5 | NM_004935 | 4826674 | 1020 | D-003239-08 | GGATTCCCGTCCGCTGTTA | 1080 |
| CDK6 | | | | | | |
| CDK6 | NM_001259 | 16950658 | 1021 | D-003240-05 | GCAAAGACCTACTTCTGAA | 1081 |
| CDK6 | NM_001259 | 16950658 | 1021 | D-003240-06 | GAAGAAGACTGGCCTAGAG | 1082 |
| CDK6 | NM_001259 | 16950658 | 1021 | D-003240-07 | GGTCTGGACTTTCTTCATT | 1083 |
| CDK6 | NM_001259 | 16950658 | 1021 | D-003240-08 | TAACAGATATCGATGAACT | 1084 |
| CDK7 | | | | | | |
| CDK7 | NM_001799 | 16950659 | 1022 | D-003241-05 | GGACATAGATCAGAAGCTA | 1085 |
| CDK7 | NM_001799 | 16950659 | 1022 | D-003241-06 | CAATAGAGCTTATACACAT | 1086 |
| CDK7 | NM_001799 | 16950659 | 1022 | D-003241-07 | CATACAAGGCTTATTCTTA | 1087 |
| CDK7 | NM_001799 | 16950659 | 1022 | D-003241-08 | GGAGACGACTTACTAGATC | 1088 |
| CDK8 | | | | | | |
| CDK8 | NM_001260 | 4502744 | 1024 | D-003242-05 | CCACAGTACTCACATCAGA | 1089 |
| CDK8 | NM_001260 | 4502744 | 1024 | D-003242-06 | GCAATAACCACACTAATGG | 1090 |
| CDK8 | NM_001260 | 4502744 | 1024 | D-003242-07 | GAAGAAAGTGAGAGTTGTT | 1091 |
| CDK8 | NM_001260 | 4502744 | 1024 | D-003242-08 | GAACATGACCTCTGGGATA | 1092 |
| CDK9 | | | | | | |
| CDK9 | NM_001261 | 17017983 | 1025 | D-003243-05 | GGCCAAACGTGGAGAACTA | 1093 |
| CDK9 | NM_001261 | 17017983 | 1025 | D-003243-06 | TGACGTCCATGTTCGAGTA | 1094 |
| CDK9 | NM_001261 | 17017983 | 1025 | D-003243-07 | CCAACCAGACGGAGTTTGA | 1095 |
| CDK9 | NM_001261 | 17017983 | 1025 | D-003243-08 | GAAGGTGGCTCTGAAGAAG | 1096 |
| CDKN1C | | | | | | |
| CDKN1C | NM_000076 | 4557440 | 1028 | D-003244-05 | GACCAGAACCGCTGGGATT | 1097 |
| CDKN1C | NM_000076 | 4557440 | 1028 | D-003244-06 | GGACCGAAGTGGACAGCGA | 1098 |

TABLE VIII-continued

| Gene Name | Acc # Acc # | GI | Locus Link | Duplex # | Full Sequence | SEQ. ID NO. |
|---|---|---|---|---|---|---|
| CDKN1C | NM_000076 | 4557440 | 1028 | D-003244-08 | GCAAGAGATCAGCGCCTGA | 1099 |
| CDKN1C | NM_000076 | 4557440 | 1028 | D-003244-09 | CCGCTGGGATTACGACTTC | 1100 |
| CDKN2B | | | | | | |
| CDKN2B | NM_004936 | 17981693 | 1030 | D-003245-05 | GCGAGGAGAACAAGGGCAT | 1101 |
| CDKN2B | NM_004936 | 17981693 | 1030 | D-003245-06 | CCAACGGAGTCAACCGTTT | 1102 |
| CDKN2B | NM_004936 | 17981693 | 1030 | D-003245-07 | CGATCCAGGTCATGATGAT | 1103 |
| CDKN2B | NM_004936 | 17981693 | 1030 | D-003245-08 | CCTGGAAGCCGGCGGGGAT | 1104 |
| CDKN2C | | | | | | |
| CDKN2C | NM_001262 | 17981697 | 1031 | D-003246-05 | GGACACCGCCTGTGATTTG | 1105 |
| CDKN2C | NM_001262 | 17981697 | 1031 | D-003246-06 | GCCAGGAGACTGCTACTTA | 1106 |
| CDKN2C | NM_001262 | 17981697 | 1031 | D-003246-07 | TGAAAGACCGAACTGGTTT | i107 |
| CDKN2C | NM_001262 | 17981697 | 1031 | D-003246-08 | GAACCTGCCCTTGCACTTG | 1108 |
| CDKN2D | | | | | | |
| CDKN2D | NM_001800 | 17981700 | 1032 | D-003247-05 | TGGCAGTTGAAGAGGGTCA | 1109 |
| CDKN2D | NM_001800 | 17981700 | 1032 | D-003247-06 | GTCAGGACCTCGTGGACAT | 1110 |
| CDKN2D | NM_001800 | 17981700 | 1032 | D-003247-07 | TGAAGGTCCTAGTGGAGCA | 1111 |
| CDKN2D | NM_001800 | 17981700 | 1032 | D-003247-08 | AGACGGCGCTGCAGGTCAT | 1112 |
| CDT1 | | | | | | |
| CDT1 | NM_030928 | 19923847 | 81620 | D-003240-05 | CCAAGGAGGCACAGAAGCA | 1113 |
| CDT1 | NM_030928 | 19923847 | 81620 | D-003240-06 | GCTTCAACGTGGATGAAGT | 1114 |
| CDT1 | NM_030928 | 19923847 | 81620 | D-003240-07 | TCTCCGGGCCAGAAGATAA | 1115 |
| CDT1 | NM_030928 | 19923847 | 81620 | D-003240-08 | GCGCAATGTTGGCCAGATC | 1116 |
| CENPA | | | | | | |
| CENPA | NM_001809 | 4585861 | 1058 | D-003249-05 | GCACACACCTCTTGATAAG | 1117 |
| CENPA | NM_001809 | 4585861 | 1058 | D-003249-06 | GCAAGAGAAATATGTGTTA | 1118 |
| CENPA | NM_001809 | 4585861 | 1058 | D-003249-07 | TTACATGCAGGCCGAGTTA | 1119 |
| CENPA | NM_001809 | 4585861 | 1058 | D-003249-08 | GAGACAAGGTTGGCTAAAG | 1120 |
| CENPB | | | | | | |
| CENPB | NM_001810 | 26105977 | 1059 | D-003250-05 | GGACATAGCCGCCTGCTTT | 1121 |
| CENPB | NM_001810 | 26105977 | 1059 | D-003250-06 | GCACGATCCTGAAGAACAA | 1122 |
| CENPB | NM_001810 | 26105977 | 1059 | D-003250-07 | GGAGGAGGGTGATGTTGAT | 1123 |
| CENPB | NM_001810 | 26105977 | 1059 | D-003250-08 | CCGAATGGCTGCAGAGTCT | 1124 |
| CENPC1 | | | | | | |
| CENPC1 | NM_001812 | 4502778 | 1060 | D-003251-05 | GCGAATAGATTATCAAGGA | 1125 |
| CENPC1 | NM_001812 | 4502778 | 1060 | D-003251-06 | GAACAGAATCCATCACAAA | 1126 |
| CENPC1 | NM_001812 | 4502778 | 1060 | D-003251-07 | CCATAAACCTCACCCAGTA | 1127 |
| CENPC1 | NM_001812 | 4502778 | 1060 | D-003251-08 | CAAGAGAACACGTTTGAAA | 1128 |
| CENPE | | | | | | |
| CENPE | NM_001813 | 4502780 | 1062 | D-003252-05 | GAAGACAGCTCAAATAATA | 1129 |
| CENPE | NM_001813 | 4502780 | 1062 | D-003252-06 | CAACAAAGCTACTAAATCA | 1130 |
| CENPE | NM_001813 | 4502780 | 1062 | D-003252-07 | GGAAAGAAGTGCTACCATA | 1131 |
| CENPE | NM_001813 | 4502780 | 1062 | D-003252-08 | GGAAAGAAATGACACAGTT | 1132 |
| CENPF | | | | | | |
| CENPF | NM_016343 | 14670380 | 1063 | D-003253-05 | GCGAATATCTGAATTAGAA | 1133 |
| CENPF | NM_016343 | 14670380 | 1063 | D-003253-06 | GGAAATTAATGCATCCTTA | 1134 |
| CENPF | NM_016343 | 14670380 | 1063 | D-003253-07 | GAGCGAGGCTGGTGGTTTA | 1135 |
| CENPF | NM_016343 | 14670380 | 1063 | D-003253-08 | CAAGTCATCTTTCATCTAA | 1136 |
| CENPH | | | | | | |
| CENPH | NM_022909 | 21264590 | 64946 | D-003254-05 | GAAAGAAGAGATTGCAATT | 1137 |
| CENPH | NM_022909 | 21264590 | 64946 | D-003254-06 | CAGAACAAATTATGCAAGA | 1138 |
| CENPH | NM_022909 | 21264590 | 64946 | D-003254-07 | CTAGTGTGCTCATGGATAA | 1139 |
| CENPH | NM_022909 | 21264590 | 64946 | D-003254-08 | GAAACACCTATTAGAGCTA | 1140 |
| CHEK1 | | | | | | |
| CHEK1 | NM_001274 | 20127419 | 1111 | D-003255-05 | CAAATTGGATGCAGACAAA | 1141 |
| CHEK1 | NM_001274 | 20127419 | 1111 | D-003255-06 | GCAACAGTATTTCGGTATA | 1142 |
| CHEK1 | NM_001274 | 20127419 | 1111 | D-003255-07 | GGACTTCTCTCCAGTAAAC | 1143 |
| CHEK1 | NM_001274 | 20127419 | 1111 | D-003255-08 | AAAGATAGATGGTACAACA | 1144 |
| CHEK2 | | | | | | |
| CHEK2 | NM_007194 | 22209010 | 11200 | D-003256-02 | CTCTTACATTGCATACATA | 1145 |
| CHEK2 | NM_007194 | 22209010 | 11200 | D-003256-03 | TAAACGCCTGAAAGAAGCT | 1146 |
| CHEK2 | NM_007194 | 22209010 | 11200 | D-003256-04 | GCATAGGACTGAAGTGTCA | 1147 |
| CHEK2 | NM_007194 | 22209010 | 11200 | D-003256-05 | GAAATTGCACTGTCACTAA | 1148 |

TABLE VIII-continued

| Gene Name | Acc # Acc # | GI | Locus Link | Duplex # | Full Sequence | SEQ. ID NO. |
|---|---|---|---|---|---|---|
| CNK | | | | | | |
| CNK | NM_004073 | 4758015 | 1263 | D-003257-05 | GCGAGAAGATCCTAAATGA | 1149 |
| CNK | NM_004073 | 4758015 | 1263 | D-003257-07 | GCAAGTGGGTTGACTACTC | 1150 |
| CNK | NM_004073 | 4758015 | 1263 | D-003257-08 | GGACATCCGTTGGCCATCA | 1151 |
| CNK | NM_004073 | 4758015 | 1263 | D-003257-09 | GACCTCAAGTTGGGAAATT | 1152 |
| CRI1 | | | | | | |
| CRI1 | NM_014335 | 7656937 | 23741 | D-003258-05 | GTGATGAGATTATTGATAG | 1153 |
| CRI1 | NM_014335 | 7656937 | 23741 | D-003258-06 | GGACGAGGGCGAGGAATTT | 1154 |
| CRI1 | NM_014335 | 7656937 | 23741 | D-003258-07 | GGAAACGGAGCCTTGCTAA | 1155 |
| CRI1 | NM_014335 | 7656937 | 23741 | D-003258-08 | TCAATCGTCTGACCGAAGA | 1156 |
| E2F1 | | | | | | |
| E2F1 | NM_005225 | 12669910 | 1869 | D-003259-05 | GAACAGGGCGACTGACTCT | 1157 |
| E2F1 | NM_005225 | 12669910 | 1869 | D-003259-06 | TGGACCACCTGATGAATAT | 1158 |
| E2F1 | NM_005225 | 12669910 | 1869 | D-003259-07 | CCCAGGAGGTGACTTCTGA | 1159 |
| E2F1 | NM_005225 | 12669910 | 1869 | D-003259-08 | GGCTGGACCTGGAAACTGA | 1160 |
| E2F2 | | | | | | |
| E2F2 | NM_004091 | 34485718 | 1870 | D-003260-05 | GGGAGAAGACTCGGTATGA | 1161 |
| E2F2 | NM_004091 | 34485718 | 1870 | D-003260-06 | GAGGACAACCTGCAGATAT | 1162 |
| E2F2 | NM_004091 | 34485718 | 1870 | D-003260-07 | TGAAGGAGCTGATGAACAC | 1163 |
| E2F2 | NM_004091 | 34485718 | 1870 | D-003260-08 | CCAAG~AGTTCATTTACCT | 1164 |
| E2F3 | | | | | | |
| E2F3 | NM_001949 | 12669913 | 1871 | D-003261-05 | GAAATTAGATGAACTGATC | 1165 |
| E2F3 | NM_001949 | 12669913 | 1871 | D-003261-06 | TGAAGTGCCTGACTCAATA | 1166 |
| E2F3 | NM_001949 | 12669913 | 1871 | D-003261-07 | GAACAAGGCAGCAGAAGTG | 1167 |
| E2F3 | NM_001949 | 12669913 | 1871 | D-003261-08 | GAAACACACAGTCCAATGA | 1168 |
| E2F4 | | | | | | |
| E2F4 | NM_001950 | 12669914 | 1874 | D-003262-05 | GGAGATTGCTGACAAACTG | 1169 |
| E2F4 | NM_001950 | 12669914 | 1874 | D-003262-06 | GAAGGTATCGGGCTAATCG | 1170 |
| E2F4 | NM_001950 | 12669914 | 1874 | D-003262-07 | GTGCAGAAGTCCAGGGAAT | 1171 |
| E2F4 | NM_001950 | 12669914 | 1874 | D-003262-08 | GGACAGTGGTGAGCTCAGT | 1172 |
| E2F5 | | | | | | |
| E2F5 | NM_001951 | 12669916 | 1875 | D-003263-05 | GCAGATGACTACAACTTTA | 1173 |
| E2F5 | NM_001951 | 12669916 | 1875 | D-003263-06 | GACATCAGCTACAGATATA | 1174 |
| E2F5 | NM_001951 | 12669916 | 1875 | D-003263-07 | CAACATGTCTCTGAAAGAA | 1175 |
| E2F5 | NM_001951 | 12669916 | 1875 | D-003263-08 | GAAGACATCTGTAATTGCT | 1176 |
| E2F6 | | | | | | |
| E2F6 | NM_001952 | 12669917 | 1876 | D-003264-05 | TAAAGAAGGTTGCAACGAA | 1177 |
| E2F6 | NM_001952 | 12669917 | 1876 | D-003264-06 | TAGCATATGTGACCTATCA | 1178 |
| E2F6 | NM_001952 | 12669917 | 1876 | D-003264-07 | GAAACCAGATTGGATGTTC | 1179 |
| E2F6 | NM_001952 | 12669917 | 1876 | D-003264-09 | GGAACTTTCTGACTTATCA | 1180 |
| FOS | | | | | | |
| FOS | NM_005252 | 6552332 | 2353 | D-003265-05 | GGGATAGCCTCTCTTACTA | 1181 |
| FOS | NM_005252 | 6552332 | 2353 | D-003265-06 | GAACAGTTATCTCCAGAAG | 1182 |
| FOS | NM_005252 | 6552332 | 2353 | D-003265-07 | GGAGACAGACCAACTAGAA | 1183 |
| FOS | NM_005252 | 6552332 | 2353 | D-003265-08 | AGACCGAGCCCTTTGATGA | 1184 |
| HIPK2 | | | | | | |
| HIPK2 | NM_022740 | 13430859 | 28996 | D-003266-06 | GAGAATCACTCCAATCGAA | 1185 |
| HIPK2 | NM_022740 | 13430859 | 28996 | D-003266-07 | AGACAGGGATTAAGTCAAA | 1186. |
| HIPK2 | NM_022740 | 13430859 | 28996 | D-003266-08 | GGACAAAGACAACTAGGTT | 1187 |
| HIPK2 188 | NM_022740 | 13430859 | 28996 | D-003266-09 | GCACACACGTCAAATCATG | |
| HUS1 | | | | | | |
| HUS1 | NM_004507 | 31077213 | 3364 | D-003267-05 | ACAAAGGCCTTATGCAATA | 1189 |
| HUS1 | NM_004507 | 31077213 | 3364 | D-003267-06 | GAAGTGCACATAGATATTA | 1190 |
| HUS1 | NM_004507 | 31077213 | 3364 | D-003267-07 | AAGCTTAACTTCATCCTTT | 1191 |
| HUS1 | NM_004507 | 31077213 | 3364 | D-003267-08 | GAACTTCTTCAACGAATTT | 1192 |
| JUN | | | | | | |
| JUN | NM_002228 | 7710122 | 3725 | D-003268-05 | TGGAAACGACCTTCTATGA | 1193 |
| JUN | NM_002228 | 7710122 | 3725 | D-003268-06 | GAACTGCACAGCCAGAACA | 1194 |
| JUN | NM_002228 | 7710122 | 3725 | D-003268-07 | GAGCTGGAGCGCCTGATAA | 1195 |
| JUN | NM_002228 | 7710122 | 3725 | D-003268-08 | TAACGCAGCAGTTGCAAAC | 1196 |

TABLE VIII-continued

| Gene Name | Acc # | GI | Locus Link | Duplex # | Full Sequence | SEQ. ID NO. |
|---|---|---|---|---|---|---|
| JUNB | | | | | | |
| JUNB | NM_002229 | 4504808 | 3726 | D-003269-05 | GCATCAAAGTGGAGCGCAA | 1197 |
| JUNB | NM_002229 | 4504808 | 3726 | D-003269-06 | TGGAAGACCAAGAGCGCAT | 1198 |
| JUNB | NM_002229 | 4504808 | 3726 | D-003269-07 | CATAGACAGCTACGGGATA | 1199 |
| JUNB | NM_002229 | 4504808 | 3726 | D-003269-08 | CCATCAACATGGAAGACCA | 1200 |
| LOC51053 | | | | | | |
| LOC51053 | NM_015895 | 20127542 | 51053 | D-003270-05 | GGAGAAAGGCGCTGTATGA | 1201 |
| LOC51053 | NM_015895 | 20127542 | 51053 | D-003270-06 | GAATAGTTCTGTCCCAAGA | 1202 |
| LOC51053 | NM_015895 | 20127542 | 51053 | D-003270-07 | GAACATGTACAGTATATGG | 1203 |
| LOC51053 | NM_015895 | 20127542 | 51053 | D-003270-08 | GCAGAAACAAGAAGAAATC | 1204 |
| MAD2L1 | | | | | | |
| MAD2L1 | NM_002358 | 6466452 | 4085 | D-003271-05 | GAAAGATGGCAGTTTGATA | 1205 |
| MAD2L1 | NM_002358 | 6466452 | 4085 | D-003271-06 | TAAATAATGTGGTGGAACA | 1206 |
| MAD2L1 | NM_002358 | 6466452 | 4085 | D-003271-07 | GAAATCCGTTCAGTGATCA | 1207 |
| MAD2L1 | NM_002358 | 6466452 | 4085 | D-003271-08 | TTACTCGAGTGCAGAAATA | 1208 |
| MAD2L2 | | | | | | |
| MAD2L2 | NM_006341 | 6006019 | 10459 | D-003272-05 | GGAAGAGCGCGCTCATAAA | 1209 |
| MAD2L2 | NM_006341 | 6006019 | 10459 | D-003272-06 | TGGAAGAGCGCGCTCATAA | 1210 |
| MAD2L2 | NM_006341 | 6006019 | 10459 | D-003272-07 | AGCCACTCCTGGAGAAGAA | 1211 |
| MAD2L2 | NM_006341 | 6006019 | 10459 | D-003272-08 | TGGAGAAATTCGTCTTGA | 1212 |
| MCM2 | | | | | | |
| MCM2 | NM_004526 | 33356546 | 4171 | D-003273-05 | GAAGATCTTTGCCAGCATT | 1213 |
| MCM2 | NM_004526 | 33356546 | 4171 | D-003273-06 | GGATAAGGCTCGTCAGATC | 1214 |
| MCM2 | NM_004526 | 33356546 | 4171 | D-003273-07 | CAGAGCAGGTGACATATCA | 1215 |
| MCM2 | NM_004526 | 33356546 | 4171 | D-003273-08 | GCCGTGGGCTCCTGTATGA | 1216 |
| MCM3 | | | | | | |
| MCM3 | NM_002388 | 33356548 | 4172 | D-003274-05 | GGACATCAATATTCTTCTA | 1217 |
| MCM3 | NM_002388 | 33356548 | 4172 | D-003274-06 | GCCAGGAGATCTCCAGTTA | 1218 |
| MCM3 | NM_002388 | 33356548 | 4172 | D-003274-07 | GCAGGTATGACCAGTATAA | 1219 |
| MCM3 | NM_002388 | 33356548 | 4172 | D-003274-08 | GGAAATGCCTGAAGTACAC | 1220 |
| MCM4 | | | | | | |
| MCM4 | NM_030274 | 22047061 | 4173 | D-003275-05 | GGACATATCTATTCTTACT | 1221 |
| MCM4 | NM_030274 | 22047061 | 4173 | D-003275-06 | GATGTTAGTTCAGCACTGA | 1222 |
| MCM4 | NM_030274 | 22047061 | 4173 | D-003275-07 | CCAGCTGCCTCATACTTTA | 1223 |
| MCM4 | NM_030274 | 22047061 | 4173 | D-003275-08 | GAAAGTACAAGATCGGTAT | 1224 |
| MCM5 | | | | | | |
| MCM5 | NM_006739 | 23510447 | 4174 | D-003276-05 | GAAGATCCCTGGCATCATC | 1225 |
| MCM5 | NM_006739 | 23510447 | 4174 | D-003276-06 | GAACAGGGTTACCATCATG | 1226 |
| MCM5 | NM_006739 | 23S10447 | 4174 | D-003276-07 | GGACAACATTGACTTCATG | 1227 |
| MCM5 | NM_006739 | 23510447 | 4174 | D-003276-08 | CCAAGGAGGTAGCTGATGA | 1228 |
| MCM6 | | | | | | |
| MCM6 | NM_005915 | 33469920 | 4175 | D-003277-05 | GGAAAGAGCTCAGAGATGA | 1229 |
| MCM6 | NM_005915 | 33469920 | 4175 | D-003277-06 | GAGCAGCGATGGAGAAATT | 1230 |
| MCM6 | NM_005915 | 33469920 | 417S | D-003277-07 | GGAAACACCTGATGTCAAT | 1231 |
| MCM6 | NM_005915 | 33469920 | 4175 | D-003277-08 | CCAAACATCTGCCGAAATC | 1232 |
| MCM7 | | | | | | |
| MCM7 | NM_005916 | 33469967 | 4176 | D-003278-05 | GGAAATATCCCTCGTAGTA | 1233 |
| MCM7 | NM_005916 | 33469967 | 4176 | D-003278-06 | GGAAGAAGCAGTTCAAGTA | 1234 |
| MCM7 | NM_005916 | 33469967 | 4176 | D-003278-07 | CAACAAGCCTCGTGTGATC | 1235 |
| MCM7 | NM_005916 | 33469967 | 4176 | D-003278-08 | GGAGAGAACACAAGGATTG | 1236 |
| MDM2 | | | | | | |
| MDM2 | NM_002392 | 4505136 | 4193 | D-003279-05 | GGAGATATGTTGTGAAAGA | 1237 |
| MDM2 | NM_002392 | 4505136 | 4193 | D-003279-06 | CCACAAATCTGATAGTATT | 1238 |
| MDM2 | NM_002392 | 4505136 | 4193 | D-003279-07 | GATGAGGTATATCAAGTTA | 1239 |
| MDM2 | NM_002392 | 4505136 | 4193 | D-003279-08 | GGAAGAAACCCAAGACAAA | 1240 |
| MK167 | | | | | | |
| MK167 | NM_002417 | 19923216 | 4288 | D-003280-05 | GCACAAAGGTTGGTTATAA | 1241 |
| MK167 | NM_002417 | 19923216 | 4288 | D-003280-06 | CCTAAGACCTGAACTATTT | 1242 |

TABLE VIII-continued

| Gene Name | Acc # | GI | Locus Link | Duplex # | Full Sequence | SEQ. ID NO. |
|---|---|---|---|---|---|---|
| MK167 | NM_002417 | 19923216 | 4288 | D-003280-07 | CAAAGAGGAACACAAATTA | 1243 |
| MK167 | NM_002417 | 19923216 | 4288 | D-003280-08 | GTAAATGGGTCTGTTATTG | 1244 |
| MNAT1 | | | | | | |
| MNAT1 | NM_002431 | 4505224 | 4331 | D-003281-05 | GGAAGAAGCTTTAGAAGTG | 1245 |
| MNAT1 | NM_002431 | 4505224 | 4331 | D-003281-06 | TAGATGAGCTGGAGAGTTC | 1246 |
| MNAT1 | NM_002431 | 4505224 | 4331 | D-003281-07 | GGACCTTGCTGGAGGCTAT | 1247 |
| MNAT1 | NM_002431 | 4505224 | 4331 | D-003281-08 | GCAGATAGAGACATATGGA | 1248 |
| MYC | | | | | | |
| MYC | NM_002467 | 31543215 | 4609 | D-003282-05 | CAGAGAAGCTGGCCTCCTA | 1249 |
| MYC | NM_002467 | 31543215 | 4609 | D-003282-06 | GAAACGACGAGAACAGTTG | 1250 |
| MYC | NM_002467 | 31543215 | 4609 | D-003282-07 | CGACGAGACCTTCATCAAA | 1251 |
| MYC | NM_002467 | 31543215 | 4609 | D-003282-08 | CCACACATCAGCACAACTA | 1252 |
| ORC1L | | | | | | |
| ORC1L | NM_004153 | 31795543 | 4998 | D-003283-05 | GAACAGGAATTCCAAGACA | 1253 |
| ORC1L | NM_004153 | 31795543 | 4998 | D-003283-06 | TAAGAAACGTGCTCGAGTA | 1254 |
| ORC1L | NM_004153 | 31795543 | 4998 | D-003283-07 | GAGATCACCTCACCTTCTA | 1255 |
| ORC1L | NM_004153 | 31795543 | 4998 | D-003283-08 | GCAGAGAGCCCTTCTTGGA | 1256 |
| ORC2L | | | | | | |
| ORC2L | NM_006190 | 32454751 | 4999 | D-003284-05 | GAAGAAACCTCCTATGAGA | 1257 |
| ORC2L | NM_006190 | 32454751 | 4999 | D-003284-06 | GAAGGGAACTGATGGAGTA | 1258 |
| ORC2L | NM_006190 | 32454751 | 4999 | D-003284-07 | GAAGAATGATCCTGAGATT | 1259 |
| ORC2L | NM_006190 | 32454751 | 4999 | D-003284-08 | GAAGAGATGTTCAAGAATC | 1260 |
| ORC3L | | | | | | |
| ORC3L | NM_012381 | 32483366 | 23595 | D-003285-05 | GGACTGCTGTGTAGATATA | 1261 |
| ORC3L | NM_012381 | 32483366 | 23595 | D-003285-06 | GAACTGATGACCATACTTG | 1262 |
| ORC3L | NM_012381 | 32483366 | 23595 | D-003285-07 | AAAGATCTCTCTGCCAATA | 1263 |
| ORC3L | NM_012381 | 32483366 | 23595 | D-003285-08 | CAGCACAGCTAAGAGAATA | 1264 |
| ORC4L | | | | | | |
| QRC4L | NM_002552 | 32454749 | 5000 | D-003286-06 | GAAAGCACATTCCGTTTAT | 1265 |
| ORC4L | NM_002552 | 32454749 | 5000 | D-003286-07 | TGAAAGAACTCATGGAAAT | 1266 |
| ORC4L | NM_002552 | 32454749 | 5000 | D-003286-08 | GCTGAGAAGTGGAATGAAA | 1267 |
| ORC4L | NM_002552 | 32454749 | 5000 | D-003286-09 | CCAGTGATCTTCATATTAG | 1268 |
| ORC5L | | | | | | |
| ORC5L | NM_002553 | 32454752 | 5001 | D-003287-05 | GAAATAACCTGTGAAACAT | 1269 |
| ORC5L | NM_002553 | 32454752 | 5001 | D-003287-06 | CAGATTACCTCTCTAGTGA | 1270 |
| ORC5L | NM_002553 | 32454752 | 5001 | D-003287-07 | GAACTTCCATATTACTCTA | 1271 |
| ORC5L | NM_002553 | 32454752 | 5001 | D-003287-08 | GTATTCAGCTGATTTCTAT | 1272 |
| ORC6L | | | | | | |
| ORC6L | NM_014321 | 32454755 | 23594 | D-003288-05 | GAACATGGCTTCAAAGATA | 1273 |
| ORC6L | NM_014321 | 32454755 | 23594 | D-003288-06 | GGACAGGGGTTATTTAATT | 1274 |
| ORC6L | NM_014321 | 32454755 | 23594 | D-003288-07 | GAAAGAAGATAGTGGTTGA | 1275 |
| ORC6L | NM_014321 | 32454755 | 23594 | D-003288-08 | TATCAGAGCTGTCTTAAAT | 1276 |
| PCNA | | | | | | |
| PCNA | NM_002592 | 33239449 | 5111 | D-003289-05 | GATCGAGGATGAAGAAGGA | 1277 |
| PCNA | NM_002592 | 33239449 | 5111 | D-003289-07 | GCCGAGATCTCAGCCATAT | 1278 |
| PCNA | NM_002592 | 33239449 | 5111 | D-003289-09 | GAGGCCTGCTGGGATATTA | 1279 |
| PCNA | NM_002592 | 33239449 | 5111 | D-003289-10 | GTGGAGAACTTGGAAATGG | 1280 |
| PLK | | | | | | |
| PLK | NM_005030 | 21359872 | 5347 | D-003290-05 | CAACCAAAGTCGAATATGA | 1281 |
| PLK | NM_005030 | 21359872 | 5347 | D-003290-06 | CAAGAAGAATGAATACAGT | 1282 |
| PLK | NM_005030 | 21359872 | 5347 | D-003290-07 | GAAGATGTCCATGGAAATA | 1283 |
| PLK | NM_005030 | 21359872 | 5347 | D-006290-08 | CAACACGCCTCATCCTCTA | 1284 |
| PIN1 | | | | | | |
| PIN1 | NM_006221 | 5453897 | 5300 | D-003291-05 | GGACCAAGGAGGAGGCCCT | 1285 |
| PIN1 | NM_006221 | 5453897 | 5300 | D-003291-06 | CGTCCTGGCGGCAGGAGAA | 1286 |
| PIN1 | NM_006221 | 5453897 | 5300 | D-003291-07 | CGGGAGAGGAGGACTTTGA | 1287 |
| PIN1 | NM_006221 | 5453897 | 5300 | D-003291-08 | AGTCGGGAGAGGAGGACTT | 1288 |
| PIN1L | | | | | | |
| PIN1L | NM_006222 | 5453899 | 5301 | D-003292-06 | CGACCTGGCGGCAGGAAAT | 1289 |
| PIN1L | NM_006222 | 5453899 | 5301 | D-003292-07 | AGGCAGGAGAGAAGGACTT | 1290 |
| PIN1L | NM_006222 | 5453899 | 5301 | D-003292-08 | GCTACATCCAGAAGATCAA | 1291 |
| PIN1L | NM_006222 | 5453899 | 5301 | D-003292-09 | GGACAGTGTTCAGGGATTC | 1292 |

TABLE VIII-continued

| Gene Name | Acc # Acc # | GI | Locus Link | Duplex # | Full Sequence | SEQ. ID NO. |
|---|---|---|---|---|---|---|
| RAD1 | | | | | | |
| RAD1 | NM_002853 | 19718797 | 5810 | D-003293-05 | GAAGATGGACAAATATGTT | 1293 |
| RAD1 | NM_002853 | 19718797 | 5810 | D-003293-06 | GGAAGAGTCTGTTACTTTT | 1294 |
| RAD1 | NM_002853 | 19718797 | 5810 | D-003293-07 | GATAACAGAGGCTTCCTTT | 1295 |
| RAD1 | NM_002853 | 19718797 | 5810 | D-003293-08 | GCATTAGTCCTATCTTGTA | 1296 |
| RAD17 | | | | | | |
| RAD17 | NM_133338 | 19718783 | 5884 | D-003294-05 | GAATCAAGCTTCCATATGT | 1297 |
| RAD17 | NM_133338 | 19718783 | 5884 | D-003294-06 | CAACAAAGCCCGAGGATAT | 1298 |
| RAD17 | NM_133338 | 19718783 | 5884 | D-003294-07 | ACACATGCGTGGAGACTTA | 1299 |
| RAD17 | NM_133338 | 19718783 | 5884 | D-003294-08 | CTACATAGATTTCTTCATG | 1300 |
| RAD9A | | | | | | |
| RAD9A | NM_004584 | 19924112 | 5883 | D-003295-05 | TCAGCAAACTTGAATCTTA | 1301 |
| RAD9A | NM_004584 | 19924112 | 5883 | D-003295-06 | GACATTGACTCTTACATGA | 1302 |
| RAD9A | NM_004584 | 19924112 | 5883 | D-003295-08 | GGAAACCACTATAGGCAAT | 1303 |
| RAD9A | NM_004584 | 19924112 | 5883 | D-003295-09 | CGGACGACTTTGCCAATGA | 1304 |
| RB1 | | | | | | |
| RB1 | NM_000321 | 19924112 | 5925 | D-003296-05 | GAAAGGACATGTGAACTTA | 1305 |
| RB1 | NM_000321 | 19924112 | 5925 | D-003296-06 | GAAGAAGTATGATGTATTG | 1306 |
| RB1 | NM_000321 | 4506434 | 5925 | D-003296-07 | GAAATGACTTGTACTCGAA | 1307 |
| RB1 | NM_000321 | 4506434 | 5925 | D-003296-08 | GGAGGGAACATCTATATTT | 1308 |
| RBBP2 | | | | | | |
| RBBP2 | NM_005056 | 4026967 | 5927 | D-003297-05 | CAAAGAAGCTGAATAAACT | 1309 |
| RBBP2 | NM_005056 | 4826967 | 5927 | D-003297-06 | CAACACATATGGCGGATTT | 1310 |
| RBBP2 | NM_005056 | 4826967 | 5927 | D-003297-07 | GGACAAACCTAGAAAGAAG | 1311 |
| RBBP2 | NM_005056 | 4826967 | 5927 | D-003297-08 | GAAAGGCACTCTCTCTGTT | 1312 |
| RBL1 | | | | | | |
| RBL1 | NM_002895 | 34577078 | 5933 | D-003298-05 | CAAGAGAAGTTGTGGCATA | 1313 |
| RBL1 | NM_002895 | 34577078 | 5933 | D-003298-06 | CAGCAGCACTCCATTTATA | 1314 |
| RBL1 | NM_002895 | 34577078 | 5933 | D-003298-07 | ACAGAAAGGTCTATCATTT | 1315 |
| RBL1 | NM_002895 | 34577078 | 5933 | D-003298-08 | GGACATAAAGTTACAATTC | 1316 |
| RBL2 | | | | | | |
| RBL2 | NM_005611 | 21361291 | 5934 | D-003299-05 | GAGCAGAGCTTAATCGAAT | 1317 |
| RBL2 | NM_005611 | 21361291 | 5934 | D-003299-06 | GAGAATAGCCCTTGTGTGA | 1318 |
| RBL2 | NM_005611 | 21361291 | 5934 | D-003299-07 | GGACTTAGTTTATGGAAAT | 1319 |
| RBL2 | NM_005611 | 21361291 | 5934 | D-003299-08 | GAATTTAGATGAGCGGATA | 1320 |
| RBP1 | | | | | | |
| RBP1 | NM_002899 | 8400726 | 5947 | D-003300-05 | GAGACAAGCTCCAGTGTGT | 1321 |
| RBP1 | NM_002899 | 8400726 | 5947 | D-003300-06 | GCAAGCPAGTATTCAAGAA | 1322 |
| RBP1 | NM_002899 | 8400726 | 5947 | D-003300-07 | GCAGGACGGTGACCATATG | 1323 |
| RBP1 | NM_002899 | 8400726 | 5947 | D-003300-08 | GCAAGTGCATGACAACAGT | 1324 |
| RPA3 | | | | | | |
| RPA3 | NM_002947 | 19923751 | 6119 | D-003322-05 | GGAAGTGGTTGGAAGAGTA | 1325 |
| RPA3 | NM_002947 | 19923751 | 6119 | D-003322-06 | GAAGATAGCCATCCTTTTG | 1326 |
| RPA3 | NM_002947 | 19923751 | 6119 | D-003322-07 | CATGCTAGCTCAATTCATC | 1327 |
| RPA3 | NM_002947 | 19923751 | 6119 | D-003322-08 | GATCTTGGACTTTACAATG | 1328 |
| SKP1A | | | | | | |
| SKP1A | NM_006930 | 25777710 | 6500 | D-003323-05 | GGAGAGATATTTGAAGTTG | 1329 |
| SKP1A | NM_006930 | 25777710 | 6500 | D-003323-06 | GGGAATGGATGATGAAGGA | 1330 |
| SKP1A | NM_006930 | 25777710 | 6500 | D-003323-07 | GAAACAATCTGTGACTATT | 1331 |
| SKP1A | NM_006930 | 25777710 | 6500 | D-003323-08 | TGAATTAAGTTGCAGAGTT | 1332 |
| SKP2 | | | | | | |
| SKP2 | NM_005983 | 16306594 | 6502 | D-003324-05 | CATCTAGACTTAAGTGATA | 1333 |
| SKP2 | NM_005983 | 16306594 | 6502 | D-003324-06 | GAAATCAGATCTCTCTACT | 1334 |
| SKP2 | NM_005983 | 16306594 | 6502 | D-003324-07 | CTAAAGGTCTCTGGTGTTT | 1335 |
| SKP2 | NM_005983 | 16306594 | 6502 | D-003324-08 | GATGGTAGCCTTCAACTGT | 1336 |
| SNK | | | | | | |
| SNK | NM_006622 | 5730054 | 10769 | D-003325-05 | GAAGACATCTACAAGCTTA | 1337 |
| SNK | NM_006622 | 5730054 | 10769 | D-003325-06 | GAAATACCTTCATGAACAA | 1338 |
| SNK | NM_006622 | 5730054 | 10769 | D-003325-07 | GAAGGTCAATGGCTCATAT | 1339 |
| SNK | NM_006622 | 5730054 | 10769 | D-003325-08 | CCGGAGATCTCGCGGATTA | 1340 |
| STK12 | | | | | | |
| STK12 | NM_004217 | 4759177 | 9212 | D-003326-07 | CAGAAGAGCTGCACATTTG | 1341 |
| STK12 | NM_004217 | 4759177 | 9212 | D-003326-08 | CCAAACTGGTCAGGCATAA | 1342 |

TABLE VIII-continued

| Gene Name | Acc # Acc # | GI | Locus Link | Duplex # | Full Sequence | SEQ. ID NO. |
|---|---|---|---|---|---|---|
| STK12 | NM_004217 | 4759177 | 9212 | D-003326-09 | ACGCGGCACTTCACAATTG | 1343 |
| STK12 | NM_004217 | 4759177 | 9212 | D-003326-10 | TGGGACACCCGACATCTTA | 1344 |
| | | | | | | |
| TFDP1 | | | | | | |
| TFDP1 | NM_007111 | 34147667 | 7027 | D-003327-05 | GGAAGCAGCTCTTGCCAAA | 1345 |
| TFDP1 | NM_007111 | 34147667 | 7027 | D-003327-06 | GAGGAGACTTGAAAGAATA | 1346 |
| TFDP1 | NM_007111 | 34147667 | 7027 | D-003327-07 | GAACTTAGAGGTGGAAAGA | 1347 |
| TFDP1 | NM_007111 | 34147667 | 7027 | D-003327-08 | GCGAGAAGGTGCAGAGGAA | 1348 |
| | | | | | | |
| TFDP2 | | | | | | |
| TFDP2 | NM_006286 | 5454111 | 7029 | D-003328-05 | GAAAGTGTGTGAGAAAGTT | 1349 |
| TFDP2 | NM_006286 | 5454111 | 7029 | D-003328-06 | CACAGGACCTTCTTGGTTA | 1350 |
| TFDP2 | NM_006286 | 5454111 | 7029 | D-003328-07 | CGAAATCCCTGGTGCCAAA | 1351 |
| TFDP2 | NM_006286 | 5454111 | 7029 | D-003328-08 | TGAGATCCATGATGACATA | 1352 |
| | | | | | | |
| TP53 | | | | | | |
| TP53 | NM_000546 | 8400737 | 7157 | D-003329-05 | GAGGTTGGCTCTGACTGTA | 1353 |
| TP53 | NM_000546 | 8400737 | 7157 | D-003329-06 | CAGTCTACCTCCCGCCATA | 1354 |
| TP53 | NM_000540 | 8400737 | 7157 | D-003329-07 | GCACAGAGGAAGAGAATCT | 1355 |
| TP53 | NM_000546 | 8400737 | 7157 | D-003329-08 | GAAGAAACCACTGGATGGA | 1356 |
| | | | | | | |
| TP63 | | | | | | |
| TP63 | NM_003722 | 31543817 | 8626 | D-003330-05 | CATCATGTCTGGACTATTT | 1357 |
| TP63 | NM_003722 | 31543817 | 8626 | D-003330-06 | CAAACAAGATTGAGATTAG | 1358 |
| TP63 | NM_003722 | 31543817 | 8626 | D-003330-07 | GCACACAGACAAATGAATT | 1359 |
| TP63 | NM_003722 | 31543817 | 8626 | D-003330-08 | CGACAGTCTTGTACAATTT | 1360 |
| | | | | | | |
| TP73 | | | | | | |
| TP73 | NM_005427 | 4885644 | 7161 | D-003331-05 | GCAAGCAGCCCATCAAGGA | 1361 |
| TP73 | NM_005427 | 4885644 | 7161 | D-003331-06 | GAGACGAGGACACGTACTA | 1362 |
| TP73 | NM_005427 | 4885644 | 7161 | D-003331-07 | CTGCAGAACCTGACCATTG | 1363 |
| TP73 | NM_005427 | 4885644 | 7161 | D-003331-08 | GGCCATGCCTGTTTACAAG | 1364 |
| | | | | | | |
| YWHAZ | | | | | | |
| YWHAZ | NM_003406 | 21735623 | 7534 | D-003332-05 | GCAAGGAGCTGAATTATCC | 1365 |
| YWHAZ | NM_003406 | 21735623 | 7534 | D-003332-06 | TAAGAGATATCTGCAATGA | 1366 |
| YWHAZ | NM_003406 | 21735623 | 7534 | D-003332-07 | GACGGAAGGTGCTGAGAAA | 1367 |
| YWHAZ | NM_003406 | 21735623 | 7534 | D-003332-08 | AGAGCAAAGTCTTCTATTT | 1368 |

TABLE IX

| Gene Name | Accession # | GI # | Duplex # | Sequence | SEQ. ID NO. |
|---|---|---|---|---|---|
| AR | NM_000044 | 21322251 | D-003400-01 | GGAACTCGATCGTATCATT | 1369 |
| AR | NM_000044 | 21322251 | D-003400-02 | CAAGGGAGGTTACACCAAA | 1370 |
| AR | NM_000044 | 21322251 | D-003400-03 | TCAAGGAACTCGATCGTAT | 1371 |
| AR | NM_000044 | 21322251 | D-003400-04 | GAAATGATTGCACTATTGA | 1372 |
| | | | | | |
| ESR1 | NM_000125 | 4503602 | D-003401-01 | GAATGTGCCTGGCTAGAGA | 1373 |
| ESR1 | NM_000125 | 4503602 | D-003401-02 | CATGAGAGCTGCCAACCTT | 1374 |
| ESR1 | NM_000125 | 4503602 | D-003401-03 | AGAGAAAGATTGGCCAGTA | 1375 |
| ESR1 | NM_000125 | 4503602 | D-003401-04 | CAAGGAGACTCGCTACTGT | 1376 |
| | | | | | |
| ESR2 | NM_001437 | 10835012 | D-003402-01 | GAACATCTGCTCAACATGA | 1377 |
| ESR2 | NM_001437 | 10835012 | D-003402-02 | GCACGGCTCCATATACATA | 1378 |
| ESR2 | NM_001437 | 10835012 | D-003402-03 | CAAGAAGATTCCCGGCTTT | 1379 |
| ESR2 | NM_001437 | 10835012 | D-003402-04 | GGAAATGCGTAGAAGGAAT | 1380 |
| | | | | | |
| ESRRA | NM_004451 | 18860919 | D-003403-01 | GGCCTTCGCTGAGGACTTA | 1381 |
| ESRRA | NM_004451 | 18860919 | D-003403-02 | TGAATGCACTGGTGTCTCA | 1382 |
| ESRRA | NM_004451 | 18860919 | D-003403-03 | GCATTGAGCCTCTCTACAT | 1383 |
| ESRRA | NM_004451 | 18860919 | D-003403-04 | CGAGACAGCGGGCAAAGTG | 1384 |
| | | | | | |
| ESRRB | NM_004452 | 22035686 | D-003404-01 | TACCTGAGCTTACAAATTT | 1385 |
| ESRRB | NM_004452 | 22035686 | D-003404-02 | GCACTTCTATAGCGTCAAA | 1386 |
| ESRRB | NM_004452 | 22035686 | D-003404-03 | CAACTCCGATTCCATGTAC | 1387 |
| ESRRB | NM_004452 | 22035686 | D-003404-04 | GGACTCGCCACCCATGTTT | 1388 |
| | | | | | |
| ESRRG | NM_001438 | 4503604 | D-003405-01 | AAACAAAGATCGACACATT | 1389 |
| ESRRG | NM_001438 | 4503604 | D-003405-02 | TCAGGAAACTGTATGATGA | 1390 |
| ESRRG | NM_001438 | 4503604 | D-003405-03 | GAAGACCAGTCCAAATTAG | 1391 |
| ESRRG | NM_001438 | 4503604 | D-003405-04 | ATGAAGCGCTGCAGGATTA | 1392 |

TABLE IX-continued

| Gene Name | Accession # | GI # | Duplex # | Sequence | SEQ. ID NO. |
|---|---|---|---|---|---|
| HNF4A | NM_000457 | 21361184 | D-003406-01 | CGACATCACTGGAGCATAT | 1393 |
| HNF4A | NM_000457 | 21361184 | D-003406-02 | GAAGGAAGCCGTCCAGAAT | 1394 |
| HNF4A | NM_000457 | 21361184 | D-003406-03 | CCAAGTACATCCCAGCTTT | 1395 |
| HNF4A | NM_000457 | 21361184 | D-003406-04 | GGACATGGCCGACTACAGT | 1396 |
| HNF4G | NM_004133 | 6631087 | D-003407-01 | GCACTGACATAAACGTTAA | 1397 |
| HNF4G | NM_004133 | 6631087 | D-003407-02 | ACAAAGAGATCCATGATGT | 1398 |
| HNF4G | NM_004133 | 6631087 | D-003407-03 | AGAGATCCATGATGTATAA | 1399 |
| HNF4G | NM_004133 | 6631087 | D-003407-04 | AAATGAACGTGACAGAATA | 1400 |
| HSAJ2425 | NM_01753 | 28923776 | D-003408-01 | GAATGAATCTACACCTTTG | 1401 |
| HSAJ2425 | NM_01753 | 28923776 | D-003408-02 | GGAAATACGTGGAGACACT | 1402 |
| HSAJ2425 | NM_01753 | 28923776 | D-003408-03 | CCAGATAACTACGGCGATA | 1403 |
| HSAJ2425 | NM_01753 | 28923776 | D-003408-04 | TGGCGTACCTTCTCATTGA | 1404 |
| NR0B1 | NM_000475 | 5016089 | D-003409-01 | CAGCATGGATGATATGATG | 1405 |
| NR0B1 | NM_000475 | 5016089 | D-003409-02 | CTGCTGAGATTCATCAATG | 1406 |
| NR0B1 | NM_000475 | 5016089 | D-003409-03 | ACAGATTCATCGAACTTAA | 1407 |
| NR0B1 | NM_000475 | 5016089 | D-003409-04 | GAACGTGGCGCTCCTGTAC | 1408 |
| NR0B2 | NM_021969 | 13259502 | D-003410-01 | GAATATGCCTGCCTGAAAG | 1409 |
| NR0B2 | NM_021969 | 13259502 | D-003410-02 | GGAATATGCCTGCCTGAAA | 1410 |
| NR0B2 | NM_021969 | 13259502 | D-003410-03 | CGTAGGCGCTGCCTATGTA | 1411 |
| NR0B2 | NM_021969 | 13259502 | D-003410-04 | GCCATTCTCTACGCACTTC | 1412 |
| NR1D1 | NM_021724 | 13430847 | D-003411-01 | CAACACAGGTGGCGTCATCTT | 1413 |
| NR1D1 | NM_021724 | 13430847 | D-003411-02 | GGCATGGTGTTACTGTGTATT | 1414 |
| NR1D1 | NM_021724 | 13430847 | D-003411-03 | CAACATGCATTCCGAGAAGTT | 1415 |
| NR1D1 | NM_021724 | 13430847 | D-003411-04 | GCGCTTTGCTTCGTTGTTCTT | 1416 |
| NR1H2 | NM_007121 | 11321629 | D-003412-01 | GAACAGATCCGGAAGAAGA | 1417 |
| NR1H2 | NM_007121 | 11321629 | D-003412-02 | GAAGAACAGATCCGGAAGA | 1418 |
| NR1H2 | NM_007121 | 11321629 | D-003412-03 | CTAAGCAAGTGCCTGGTTT | 1419 |
| NR1H2 | NM_007121 | 11321629 | D-003412-04 | GCTAACAGCGGCTCAAGAA | 1420 |
| NR1H3 | NM_005693 | 5031892 | D-003413-01 | GAACAGATCCGCCTGAAGA | 1421 |
| NR1H3 | NM_005693 | 5031892 | D-003413-02 | GGAGATAGTTGACTTTGCT | 1422 |
| NR1H3 | NM_005693 | 5031892 | D-003413-03 | GAGTTTGCCTTGCTCATTG | 1423 |
| NR1H3 | NM_005693 | 5031892 | D-003413-04 | TGACTTTGCTAAACAGCTA | 1424 |
| NR1H4 | NM_005123 | 4826979 | D-003414-01 | CAAGTGACCTCGACAACAA | 1425 |
| NR1H4 | NM_005123 | 4826979 | D-003414-02 | GAAAGAATTCGAAATAGTG | 1426 |
| NR1H4 | NM_005123 | 4826979 | D-003414-03 | CAACAGACTCTTCTACATT | 1427 |
| NR1H4 | NM_005123 | 4826979 | D-003414-04 | GAACCATACTCGCAATACA | 1428 |
| NR1I2 | NM_003889 | 11863133 | D-003415-01 | GAACCATGCTGACTTTGTA | 1429 |
| NR1I2 | NM_003889 | 11863133 | D-003415-02 | GATGGACGCTCAGATGAAA | 1430 |
| NR1I2 | NM_003889 | 11863133 | D-003415-03 | CAACCTACATGTTCAAAGG | 1431 |
| NR1I2 | NM_003889 | 11863133 | D-003415-04 | CAGGAGCAATTCGCCATTA | 1432 |
| NR1I3 | NM_005122 | 4826660 | D-003416-01 | GGAAATCTGTCACATCGTA | 1433 |
| NR1I3 | NM_005122 | 4826660 | D-003416-02 | TCGCAGACATCAACACTTT | 1434 |
| NR1I3 | NM_005122 | 4826660 | D-003416-03 | CCTCTTCGCTACACAATTG | 1435 |
| NR1I3 | NM_005122 | 4826660 | D-003416-04 | GAACAGTTTGTGCAGTTTA | 1436 |
| NR2C1 | NM_003297 | 4507672 | D-003417-01 | TGACAGCACTTGATCATAA | 1437 |
| NR2C1 | NM_003297 | 4507672 | D-003417-02 | GGAAGGAAGTGTACACCTA | 1438 |
| NR2C1 | NM_003297 | 4507672 | D-003417-03 | GAGCACATCTTCAAACTAC | 1439 |
| NR2C1 | NM_003297 | 4507672 | D-003417-04 | GAAGAAATTGCACATCAAA | 1440 |
| NR2C2 | NM_003298 | 4507674 | D-003418-01 | GAACAACGGTGACACTTCA | 1441 |
| NR2C2 | NM_003298 | 4507674 | D-003418-02 | CTGATGAGCTCCAACATAA | 1442 |
| NR2C2 | NM_003298 | 4507674 | D-003418-03 | CAACCTAAGTGAATCTTTG | 1443 |
| NR2C2 | NM_003298 | 4507674 | D-003418-04 | GAAGACACCTACCGATTGG | 1444 |
| NR2E1 | NM_003269 | 21361108 | D-003419-01 | GATCATATCTGAAATACAG | 1445 |
| NR2E1 | NM_003269 | 21361108 | D-003419-02 | CAAGACTGCTTTCAGATAT | 1446 |
| NR2E1 | NM_003269 | 21361108 | D-003419-03 | GTTAGATGCTACTGAATTT | 1447 |
| NR2E1 | NM_003269 | 21361108 | D-003419-04 | CAATGTATCTCTATGAAGT | 1448 |
| NR2E3 | NM_014249 | 7657394 | D-003420-01 | GAGAAGCTCCTTTGTGATA | 1449 |
| NR2E3 | NM_014249 | 7657394 | D-003420-02 | GAAGCACTATGGCATCTAT | 1450 |
| NR2E3 | NM_014249 | 7657394 | D-003420-03 | GAAGGATCCTGAGCACGTA | 1451 |
| NR2E3 | NM_014249 | 7657394 | D-003420-04 | GAAGCTCCTTTGTGATATG | 1452 |

TABLE IX-continued

| Gene Name | Accession # | GI # | Duplex # | Sequence | SEQ. ID NO. |
|---|---|---|---|---|---|
| NR2F1 | NM_005654 | 20127484 | D-003421-01 | GAAACTCTCATCCGCGATA | 1453 |
| NR2F1 | NM_005654 | 20t27484 | D-003421-02 | TCTCATCCGCGATATGTTA | 1454 |
| NR2F1 | NM_005654 | 20127484 | D-003421-03 | CAAGAAGTGCCTCAAAGTG | 1455 |
| NR2F1 | NM_005654 | 20127484 | D-003421-04 | GGAACTTAACTTACACATG | 1456 |
| NR2F2 | NM_021005 | 14149745 | D-003422-01 | GTACCTGTCCGGATATATT | 1457 |
| NR2F2 | NM_021005 | 14149745 | D-003422-02 | CCAACCAGCCGAGGAGATT | 1458 |
| NR2F2 | NM_021005 | 14149745 | D-003422-03 | ACTCGTAGCTGTCCGGATA | 1459 |
| NR2F2 | NM_021005 | 14149745 | D-003422-04 | GGCCGTATATGGCAATTCA | 1480 |
| NR2F6 | NM_005234 | 20070198 | D-003423-01 | CGACGCCTGTGGCCTCTCA | 1461 |
| NR2F6 | NM_005234 | 20070198 | D-003423-02 | CAGCCGGTGTCCGAACTGA | 1462 |
| NR2F6 | NM_005234 | 20070198 | D-003423-03 | CAACCGTGACTGGGAGATC | 1483 |
| NR2F6 | NM_005234 | 20070198 | D-003423-04 | GTACTGCCGTCTCAAGAAG | 1464 |
| NR3C1 | NM_000176 | 4504132 | D-003424-01 | GAGGACAGATGTACCACTA | 1465 |
| NR3C1 | NM_000176 | 4504132 | D-003424-02 | GATAAGACCATGAGTATTG | 1466 |
| NR3C1 | NM_000176 | 4504132 | D-003424-03 | GAAGACGATTCATTCCTTT | 1467 |
| NR3C1 | NM_000176 | 4504132 | D-003424-04 | GGACAGATGTACCACTATG | 1468 |
| NR3C2 | NM_000901 | 4505198 | D-003425-01 | GCAAACAGATGATCCAAGT | 1469 |
| NR3C2 | NM_000901 | 4505198 | D-003425-02 | CAGCTAAGATTTATCAGAA | 1470 |
| NR3C2 | NM_000901 | 4505198 | D-003425-03 | GCACGAAAGTCAAAGAAGT | 1471 |
| NR3C2 | NM_000901 | 4505198 | D-003425-04 | GGTATCCGGTCTTAGAATA | 1472 |
| NR4A1 | NM_002135 | 21361341 | D-003426-01 | GAAGGAAGTTGTCCGAACA | 1473 |
| NR4A1 | NM_002135 | 21361341 | D-003426-02 | CAGGAGAGTTTGACACCTT | 1474 |
| NR4A1 | NM_002135 | 21361341 | D-003426-03 | CAGTGGCTCTGACTACTAT | 1475 |
| NR4A1 | NM_002135 | 21361341 | D-003426-04 | GAAGGCCGCTGTGCTGTGT | 1476 |
| NR4A2 | NM_006186 | 5453821 | D-003427-01 | GCAATGCGTTCGTGGCTTT | 1477 |
| NR4A2 | NM_006186 | 5453821 | D-003427-02 | CGGCTACACAGGAGAGTTT | 1478 |
| NR4A2 | NM_006186 | 5453821 | D-003427-03 | CCACGTGACTTTCAACAAT | 1479 |
| NR4A2 | NM_006186 | 5453821 | D-003427-04 | GAATACAGCTCCGATTTCT | 1480 |
| NR4A3 | NM_006981 | 11276070 | D-003428-01 | CAAAGAAGATCAGACATTA | 1481 |
| NR4A3 | NM_006981 | 11276070 | D-003428-02 | GATCAGACATTACTTATTG | 1482 |
| NR4A3 | NM_006981 | 11276070 | D-003428-03 | CCAGAGATCTTGATTATTC | 1483 |
| NR4A3 | NM_006981 | 11276070 | D-003428-04 | GAAGTTGTCCGTACAGATA | 1484 |
| NR5A1 | NM_004959 | 20070192 | D-003429-01 | GATTTGAAGTTCCTGAATA | 1405 |
| NR5A1 | NM_004959 | 20070192 | D-003429-02 | GGAGCGAGCTGCTGGTGTT | 1486 |
| NR5A1 | NM_004959 | 20070192 | D-003429-03 | GGAGGTGGCCGACCAGATG | 1487 |
| NR5A1 | NM_004959 | 20070192 | D-003429-04 | CAACGTGCCTGAGCTCATC | 1488 |
| NR5A2 | NM_003822 | 20070161 | D-003430-01 | CCAAACATATGGCCACTTT | 1489 |
| NR5A2 | NM_003822 | 20070161 | D-003430-02 | TCAGAGAACTTAAGGTTGA | 1490 |
| NR5A2 | NM_003822 | 20070161 | D-003430-03 | GGATCCATCTTCCTGGTTA | 1491 |
| NR5A2 | NM_003822 | 20070161 | D-003430-04 | AAGAATACCTCTACTACAA | 1492 |
| NR6A1 | NM_033334 | 15451847 | D-003431-01 | CAACGAACCTGTCTCATTT | 1493 |
| NR6A1 | NM_033334 | 15451847 | D-003431-02 | GAAGAACTAGACAGATTTA | 1494 |
| NR6A1 | NM_033334 | 15451847 | D-003431-03 | GAAGATGGATACGCTGTGA | 1495 |
| NR6A1 | NM_033334 | 15451847 | D-003431-04 | AAACGATACTGGTACATTT | 1496 |
| null | D16815 | 2116671 | D-003432-01 | GAAGAATGATCGAATAGAT | 1497 |
| null | D16815 | 2116671 | D-003432-02 | GAACATGGAGCAATATAAT | 1498 |
| null | D16815 | 2116671 | D-003432-03 | GAGGAGCTCTTGGCCTTTA | 1499 |
| null | D16815 | 2116671 | D-003432-04 | TAAACAACATGCACTCTGA | 1500 |
| PGR | NM_000926 | 4505766 | D-003433-01 | GAGATGAGGTCAAGCTACA | 1501 |
| PGR | NM_000926 | 4505766 | D-003433-02 | CAGCGTTTCTATCAACTTA | 1502 |
| PGR | NM_000926 | 4505766 | D-003433-03 | AGATAACTCTCATTCAGTA | 1503 |
| PGR | NM_000926 | 4505766 | D-003433-04 | GTAGTCAAGTGGTCTAAAT | 1504 |
| PPARA | NM_005036 | 7549810 | D-003434-01 | TCACGGAGCTCACGGAATT | 1505 |
| PPARA | NM_005036 | 7549810 | D-003434-02 | GAACATGACATAGAAGATT | 1506 |
| PPARA | NM_005036 | 7549810 | D-003434-03 | GGATAGTTCTGGAAGCTTT | 1507 |
| PPARA | NM_005036 | 7549810 | D-003434-04 | GACTCAAGCTGGTGTATGA | 1508 |
| PPARD | NM_006238 | 5453939 | D-003435-01 | GAGCGCAGCTGCAAGATTC | 1509 |
| PPARD | NM_006238 | 5453939 | D-003435-02 | GCATGAAGCTGGAGTACGA | 1510 |
| PPARD | NM_006238 | 5453939 | D-003435-03 | GGAAGCAGTTGGTGAATGG | 1511 |
| PPARD | NM_006238 | 5453939 | D-003435-04 | GCTGCAAGATTCAGAAGAA | 1512 |

TABLE IX-continued

| Gene Name | Accession # | GI # | Duplex # | Sequence | SEQ. ID NO. |
|---|---|---|---|---|---|
| PPARG | NM_138712 | 20336234 | D-003436-01 | AGACTCAGCTCTACAATAA | 1513 |
| PPARG | NM_138712 | 20336234 | D-003436-02 | GATTGAAGCTTATCTATGA | 1514 |
| PPARG | NM_138712 | 20336234 | D-003436-03 | AAGTAACTCTCCTCAAATA | 1515 |
| PPARG | NM_138712 | 20336234 | D-003436-04 | GCATTTCTACTCCACATTA | 1516 |
| RARA | NM_000964 | 4506418 | D-003437-01 | GACAAGAACTGCATCATCA | 1517 |
| RARA | NM_000964 | 4506418 | D-003437-02 | GCAAATACACTACGAACAA | 1518 |
| RARA | NM_000964 | 4506418 | D-003437-03 | GAACAACAGCTCAGAACAA | 1519 |
| RARA | NM_000964 | 4506418 | D-003437-04 | GAGCAGCAGTTGTGAAGAG | 1520 |
| RARB | NM_000965 | 14916493 | D-003438-01 | GCACACTGCTCAATCAATT | 1521 |
| RARB | NM_000965 | 14916493 | D-003438-02 | GCAGAAGTATTCAGAAGAA | 1522 |
| RARB | NM_000965 | 14916493 | D-003438-03 | GGAATGACAGGAACAAGAA | 1523 |
| RARB | NM_000965 | 14916493 | D-003438-04 | GCACAGTCCTAGCATCTCA | 1524 |
| RARG | NM_000966 | 21359851 | D-003439-01 | GAAATGACCGGAACAAGAA | 1525 |
| RARG | NM_000966 | 21359851 | D-003439-02 | TAGAAGAGCTCATCACCAA | 1526 |
| RARG | NM_000966 | 21359851 | D-003439-03 | CAAGGAAGCTGTGCGAAAT | 1527 |
| RARG | NM_000966 | 21359851 | D-003439-04 | TCAGTGAGCTGGCTACCAA | 1528 |
| RORA | NM_134261 | 19743902 | D-003440-01 | GGAAAGAGTTTATGTTCTA | 1529 |
| RORA | NM_134261 | 19743902 | D-003440-02 | CAAGATCTGTGGAGACAAA | 1530 |
| RORA | NM_134261 | 19743902 | D-003440-03 | GCACCTGACTGAAGATGAA | 1531 |
| RORA | NM_134261 | 19743902 | D-003440-04 | GCGAGAAGATGGAATACTA | 1532 |
| RORB | NM_006914 | 19743906 | D-003441-01 | GCACAGAACATCATTAAGT | 1533 |
| RORB | NM_006914 | 19743906 | D-003441-02 | CCACACCTATGAAGAAATT | 1534 |
| RORB | NM_006914 | 19743906 | D-003441-03 | GATCAAATTCTACITCTGA | 1535 |
| RORB | NM_006914 | 19743906 | D-003441-04 | TCAAACAGATAAAGCAAGA | 1536 |
| RORC | NM_005060 | 19743908 | D-003442-01 | TAGAACAGCTGCAGTACAA | 1537 |
| RORC | NM_005060 | 19743908 | D-003442-02 | TCACCGAGGCCATTCAGTA | 1538 |
| RORC | NM_005060 | 19743908 | D-003442-03 | GAACAGCTGCAGTACAATC | 1539 |
| RORC | NM_005060 | 19743908 | D-003442-04 | CCTCATGCCACCTTGAATA | 1540 |
| RXRA | NM_002957 | 21536318 | D-003443-01 | TGACGGAGCTTGTGTCCAA | 1541 |
| RXRA | NM_002957 | 21536318 | D-003443-02 | CAACAAGGACTGCCTGATT | 1542 |
| RXRA | NM_002957 | 21536318 | D-003443-03 | GCAAGGACCTGACCTACAC | 1543 |
| RXRA | NM_002957 | 21536318 | D-003443-04 | GCAAGGACCGGAACGAGAA | 1544 |
| RXRB | NM_021976 | 21687229 | D-003444-01 | GCAAAGACCTTAGATACTC | 1545 |
| RXRB | NM_021976 | 21687229 | D-003444-02 | GCAATCATTCTGTTTAATC | 1546 |
| RXRB | NM_021976 | 21687229 | D-003444-03 | TCACACCGATCCATTGATG | 1547 |
| RXRB | NM_021976 | 21687229 | D-003444-04 | GCAAACGGCTATGTGCAAT | 1548 |
| RXRG | NM_006917 | 21361386 | D-003445-01 | GGAAGGACCTCATCTACAC | 1549 |
| RXRG | NM_006917 | 21361386 | D-003445-02 | CCGGATCTCTGGTTAAACA | 1550 |
| RXRG | NM_006917 | 21361386 | D-003445-03 | GCGAGCCATTGTACTCTTT | 1551 |
| RXRG | NM_006917 | 21361386 | D-003445-04 | GAGCCATTGTAGTCTTTAA | 1552 |
| THRA | NM_003250 | 20127451 | D-003446-01 | GGACAAAGACGAGCAGTGT | 1553 |
| THRA | NM_003250 | 20127451 | D-003446-02 | GGAAACAGAGGCGGAAATT | 1554 |
| THRA | NM_003250 | 20127451 | D-003446-03 | GTAAGCTGATTGAGCAGAA | 1555 |
| THRA | NM_003250 | 20127451 | D-003446-04 | GAACCTCCATCCCACCTAT | 1556 |
| THRB | NM_000461 | 10835122 | D-003447-01 | GAATGTCGCTTTAAGAAAT | 1557 |
| THRB | NM_000461 | 10835122 | D-003447-02 | GAAGAGTCGTCGCCACATC | 1558 |
| THRB | NM_000461 | 10835122 | D-003447-03 | GGACAAGCACGAATAGTCA | 1559 |
| THRB | NM_000461 | 10835122 | D-003447-04 | GTGGAAAGGTTGACTTGGA | 1560 |
| VDR | NM_000376 | 4507882 | D-003448-01 | TGAAGAAGCTGAAGTTGCA | 1561 |
| VDR | NM_000376 | 4507882 | D-003448-02 | GCAACCAAGACTACAAGTA | 1562 |
| VDR | NM_000376 | 4507882 | D-003448-03 | TCAATGCTATGACCTGTGA | 1563 |
| VDR | NM_000376 | 4507882 | D-003448-04 | CCATTGAGGTCATCATGTT | 1564 |

TABLE X

| Gene Symbol | | |
|---|---|---|
| ABCB1 | GACCAUAAAUGUAAGGUUU | 1565 |
| | UAGAAGAUCUGAUGUCAAA | 1566 |
| | GAAAUGUUCACUUCAGUUA | 1567 |
| | GAAGAUCGCUACUGAAGCA | 1568 |
| ABCC1 | GGAAGCAACUGCAGAGACA | 1569 |
| | GAUGACACCUCUCAAGAAA | 1570 |
| | UAAAGUUGCUCAUCAAGUU | 1571 |
| | CAACGAGUCUGCCGAAGGA | 1572 |
| ABCG2 | GCAGAUGCCUUCUUCGUUA | 1573 |
| | AGGCAAAUCUUCGUUAUUA | 1574 |
| | GGGAAGAAAUCUGGUCUAA | 1575 |
| | UGACUCAUCCCAACAUUUA | 1576 |
| KCNH2 | CCGACGUGCUGCCUGAGUA | 1577 |
| | GAGAAGAGCAGCGACACUU | 1578 |
| | GAUCAUAGCACCUAAGAUA | 1579 |
| | GCUAUUUACUGCUCUUAUU | 1580 |
| | UCACUGGGCUCCUUUAAUU | 1581 |
| | GUGCGAGCCUUCUGAAUAU | 1582 |
| | GCUAAGCUAUACUACUGUA | 1583 |
| | UGACGGCGCUCUACUUCAC | 1584 |
| KCNH1 | GAGAUGAAUUCCUUUGAAA | 1585 |
| | GAAGAACGCAUGAAACGAA | 1586 |
| | GAUAAAGCACGAUUUGAAA | 1587 |
| | GCUGAGAGGUCUAUUUAAA | 1588 |
| CLCA1 | GAACAACAAUGGCUAUGAA | 1589 |
| | GUACAUACCUGGCUGGAUU | 1590 |
| | GAACAGCUCACAAGUAUAU | 1591 |
| | GGAAACGUGUGUCUAUAUU | 1592 |
| SLC6A1 | GGAGGUGGGAGGACAGUUA | 1593 |
| | UCACAGCCCUGGUGGAUGA | 1594 |
| | GGUCAACACUACCAACAUG | 1595 |
| | GGUCAACACUACCAACAUG | 1596 |
| SLC6A2 | GAACACAAGGUCAACAUUG | 1597 |
| | AGAAGGAGCUGGCCUAGUG | 1598 |
| | CGGAAACUCUUCACAUUUG | 1599 |
| | CAACAAAUUUGACAAGAAC | 1600 |
| SLC21A2 | GUACAUCUCCAUCUUAUUU | 1601 |
| | GGAAGUGGCUGAGUUAUUA | 1602 |
| | GAAGGGAGGCUCAAUGUAA | 1603 |
| | GAAGGAAGUGGCUGAGUUA | 1604 |
| SLC21A3 | GUAGAAACAGGAGCUAUUA | 1605 |
| | CAAGAUUACUGUCAAACAA | 1606 |
| | GCACAAGAGUAUUUGGUAA | 1607 |
| | GCAAAUGUCCCUUCUGUAU | 1608 |
| | GCAUGACUCCUAUAUAAUA | 1609 |
| | AAACAGCAAUUUCCCUUAA | 1610 |
| | GAAAAUGCCUCUUCAGGAA | 1611 |
| SLC28A1 | GUUCAUCGCUCUCCUCUUU | 1612 |
| | GGAUCAAGCUGUUUCUGAA | 1613 |
| | GGACUGCAGUUUGUACUUG | 1614 |
| | GAGUGAAACUGACCUAUGG | 1615 |
| SLC29A1 | GAACGCUGCUCCCGUGGAA | 1616 |
| | GAAAGCCACUCUAUCAAAG | 1617 |
| | GAAACCAGGUGCCUUCAGA | 1618 |
| | CCUCACAGCUGUAUUCAUG | 1619 |
| SLC26A1 | CCACGGAGCUGCUGGUCAU | 1620 |
| | GGGUUGACAUCUUAUUUGA | 1621 |
| | GCACGAGGGUCUCUGUGUU | 1622 |
| | GGCCAUCGCCUACUCAUUG | 1623 |
| | CAACACCCAUGGCAAUUAA | 1624 |
| | GAGGAAAGAUCUUGCUGAU | 1625 |
| | GAGCAAGCGUCCUCCAAAU | 1626 |
| SLC26A2 | GCAACACGCAUGGCAAUUA | 1627 |
| | CCAAAGAACUCAAUGAACA | 1628 |
| | ACAAGAACCUUCAGACUAA | 1629 |
| | GAAGGUAGAUA6AAGAAUG | 1630 |
| | GUAUUGAACUGUACUGUAA | 1631 |
| SLC4A4 | GCAAUUCUGUUCAUUUAUC | 1632 |
| | GGAAAGAUGUCCACUGAAA | 1633 |
| | GGACAAAGCCUUCUUCAAU | 1634 |
| | GGAAUGGGAUGCAGCAAUU | 1635 |
| GLRA1 | UGAAAGCCAUUGACAUUUG | 1636 |
| | CAGACACGCUGGAGUUUAA | 1637 |
| | CAAUAGCGCUUUCUGGUUU | 1638 |
| | GCAGGUAGCAGAUGGAGUA | 1639 |
| KLK1 | UCAGAGUGCUGUCUUUAUGU | 1640 |
| | CAACUUGUUUGACGACGAA | 1641 |
| | UGACAGAGCCUGCUGAUAC | 1642 |
| | AGGCGGCUCUGUACCAUUU | 1643 |
| ADAM2 | GAAACAUGCUGUGAUAUUG | 1644 |
| | GCAGAUGUUUCCUUAUAUA | 1645 |
| | CAACAGAGAUGCCAUGAUA | 1646 |
| | GAAAGGCGCUACAUUGAGA | 1647 |
| XPNPEP1 | GACCUGAGCUUCCCAACAA | 1648 |
| | GCGACUGGCUCAACAAUUA | 1649 |
| | GAGAUUGCGUGGCUAUUUA | 1650 |
| | GACAGCAACUGGACACUUA | 1651 |
| GZMA | GGAAGAGACUCGUGCAAUG | 1652 |
| | GGAACCAUGUGCCAAGUUG | 1653 |
| | GAAGUAACUCCCAUUCAA | 1654 |
| | GAACUCCUAUAGAUUUCUG | 1655 |
| CMKLR1 | CAUAGAAGCUUUACCAAGA | 1656 |
| | GAAUGGAGGAUGAAGAUUA | 1657 |
| | GGUCAAUGCUCUAAGUGAA | 1658 |
| | GAGAGGACUUCUAUGAAUG | 1659 |
| CLN3 | CAUCAUGCCUUCUGAAUAA | 1660 |
| | CAACAGCUCAUCACGAUUU | 1661 |
| | GCAACAACUUCUCUUAUGU | 1662 |
| | GGUCUUCGCUAGCAUCUCA | 1663 |
| CALCR | GGACCUAGCUGUUGUAAAG | 1664 |
| | GAAAGACCAUGCAUUUAAA | 1665 |
| | GCAGGAAGAUGUAUGCUUU | 1666 |
| | GAAUAAACCAGUAUCGUUA | 1667 |
| OXTR | GGACCCAGAUAUCCAAAUA | 1668 |
| | GCAAUACUAUCCUAACUGA | 1669 |
| | GAAUAGAUUAGCGUUUG | 1670 |
| | GAUGAGGCAUGACUAGUAA | 1671 |
| EDG4 | GCGAGUCUGUCCACUAUAC | 1672 |
| | GAGAACGGCCACCCACUGA | 1673 |
| | GAACGGCCAGCCACUGAUG | 1674 |
| | GGUCAAUGCUGCUGUGUAC | 1675 |
| EDG5 | UCCAGGAACACUAUAAUUA | 1676 |
| | GUGACCAUCUUCUCCAUCA | 1677 |
| | CAUCCUCUGUUGCGCCAUU | 1678 |
| | CCAACAAGGUCCAGGAACA | 1679 |
| EDG7 | ACACUGAUACUGUCGAUGA | 1680 |
| | AAUAGGAGCAACACUGAUA | 1681 |
| | CAGCAGGAGUUACCUUGUU | 1682 |
| | GGACACCCAUGAAGCUAAU | 1683 |
| PTCH | GCACAGAACUGCACUCAAA | 1684 |
| | GGACAGCAGUUCAUUGUUA | 1685 |

TABLE X-continued

| Gene Symbol | Sequence | # |
|---|---|---|
| | GAGAAGAGGCUAUGUUUAA | 1686 |
| | GGAGAAACUUCGACCCUUU | 1687 |
| SMO | UCGCUACCCUGCUGUUAUU | 1688 |
| | CGUACAAGAACUACCGAUA | 1689 |
| | CAAGAAAGCUUCCUUCAAC | 1690 |
| | GAGAAGAAAUACAGUCAAU | 1691 |
| CASP3 | CAAUAUAUCUGAAGAGCUA | 1692 |
| | GAACUGGACUGUGGCAUUG | 1693 |
| | GUGAGAAGAUGGUAUAUUU | 1694 |
| | GAGGGUACUUUAAGACAUA | 1695 |
| GASP6 | CAUGAGGUGUCAACUGUUA | 1696 |
| | GAAGUGAAAUGCUUUAAUG | 1697 |
| | AAAUAUGGCUCCUCCUUAG | 1698 |
| | GCAAUCACAUUUAUGCAUA | 1699 |
| | CAACUAAACUGAGGUGGAU | 1700 |
| | GAUGGUACAUUCAAGAUUU | 1701 |
| CASP7 | GAACUCUACUUCAGUCAAU | 1702 |
| | GGGCAAAUGCAUCAUAAUA | 1703 |
| | CAACAGAGGGAGUUUAAUA | 1704 |
| | GAAGAAAGCCACUGACUGA | 1705 |
| CASP8 | GAAGUGAACUAUGAAGUAA | 1706 |
| | CAACAAGGAUGACAAGAAA | 1707 |
| | GGACAAAGUUUAGCAAAUG | 1708 |
| | GAGGGUGGAUCAUCUAUUA | 1709 |
| | GAAUAUAGAGGGCUUAUGA | 1710 |
| | CAACGACUAUGAAGAUUC | 1711 |
| | GAAGUGAGCAGAUCAGAAU | 1712 |
| | GAGGAAAUCUGCAAAUGCA | 1713 |
| CASP9 | CCAGGCAGCUGAUCAUAGA | 1714 |
| | UCUCAGGUGUUGCCAAAUA | 1715 |
| | GAACAGCUGUAAUCUAUGA | 1716 |
| | CCACUGGUCUGUAGGGAUU | 1717 |
| DVL1 | UCGUAAAGCUGUUGAUAUC | 1718 |
| | GAGGAGAUCUUUGAUGACA | 1719 |
| | GUAAAGCUGUUUGAUAUCGA | 1720 |
| | GAUCGUAAAGCUGUUGAUA | 1721 |
| DVL2 | AGACGAAGGUGAUUUACCA | 1722 |
| | UGUGAGAGCUACCUAGUCA | 1723 |
| | GAAGAAAUUUCAGAUGACA | 1724 |
| | UAAUAGGCAUUUCCUCUUU | 1725 |
| PTEN | GUGAAGAUCUUGACCAAUG | 1726 |
| | GAUCAGCAUACACAAAUUA | 1727 |
| | GAAUGAACCUUCUGCAACA | 1728 |
| | GGCGCUAUGUGUAUUAUUA | 1729 |
| PDK1 | GUACAAAGCUGGUAUAUCC | 1730 |
| | GAAAGACUCCCAGUGUAUA | 1731 |
| | GGAAGUCCAUCUCAUCGAA | 1732 |
| | CCAAAGACAUGACGACGUU | 1733 |
| PDK2 | GUAAAGAGGAGACUGAAUG | 1734 |
| | GGUCUGUGAUGGUCCCUAA | 1735 |
| | CAAAGAUGCCUACGACAUG | 1736 |
| | GGGCGAUGCCUGAGGGUUA | 1737 |
| PPP2CA | UCACACAAGUUUAUGGUUU | 1738 |
| | CAACAGCCGUGACCACUUU | 1739 |
| | UACCAAGCUGCAAUCAUG | 1740 |
| | GAACUUGACGAUACUCUAA | 1741 |
| CTNNA1 | GAAGAGAGGUCGUUCUAAG | 1742 |
| | AAGAUGUGCAUGAUUA | 1743 |
| | UCUAAUAACAGUGUUU | 1744 |
| | GUAAAGGGCCCUCUAAUAA | 1745 |
| CTNNA2 | GAAAGAAUAUGCCCAAGUU | 1746 |
| | GAAGAAGAAUGCCACAAUG | 1747 |
| | GCAGGAAGAUUAUGAUGUG | 1748 |
| | AAAGAAAGCCCAUGUACUA | 1749 |
| HSPCA | GGGAAAGAGCUGCAUAUUA | 1750 |
| | GCUUAGAACUCUUUACUGA | 1751 |
| | UAUAAGAGCUUGACCAAUG | 1752 |
| | GCAGAUAUCUCUAUGAUUG | 1753 |
| DCTN2 | CAACUCAUGUCCAAUACUG | 1754 |
| | GGAAUGAGCCAGAUGUUUA | 1755 |
| | GGAGACAGCUGUACGUUGU | 1756 |
| | UCCAAGAGCUGACAACUGA | 1757 |
| CD2 | GUAAGGAGAAGCAAUAUAA | 1758 |
| | AAGAUGAGCUUUCCAUGUA | 1759 |
| | GGACAUCUAUCUCAUCAUU | 1760 |
| | GACAAGAGCGCACAGAGUA | 1761 |
| BAD | GUACUUCCCUCAGGCCUAU | 1762 |
| | GCUGUGCCUUGACUACGUA | 1763 |
| | GUACUUCCCUCAGGCUAU | 1764 |
| | GGUCAGGUGCCUCGAGAUC | 1765 |
| SMAC | CAGCGUAACUUCAUUCUUC | 1766 |
| | UAACUUCAUUCUUCAGGUA | 1767 |
| | CAGCUGCUCUUACCCAUUU | 1768 |
| | GAUUGAAGCUAUUACUGAA | 1769 |
| | UAGAAGAGCUCCGUCAGAA | 1770 |
| | CCACAUAUGCGUUGAUUGA | 1771 |
| | GCGCAGGGCUCUCUACCUA | 1772 |
| MAP3K5 | GAACAGCCUUCAAAUCAAA | 1773 |
| | GAUGUUCUCUACUAUGUUA | 1774 |
| | GCAAAUACUGGAAGGAUUA | 1775 |
| | CAGGAAAGCUCGUAAUUUA | 1776 |
| PVR | CCACACGGCUGACCUCAUA | 1777 |
| | CAGCAGAAUUCCUCUUAUA | 1778 |
| | GCAGAAUUCCUCUUAUAAA | 1779 |
| | GAUCGGGAUUUAUUUCUAU | 1780 |
| ERBB2 | UGUGGGAGCUGAUGACUUU | 1781 |
| | UCACAGAGAUCUUGAAAGG | 1782 |
| | UGGAAGAGAUCACAGGUUA | 1783 |
| | GCUCAUCGGUCACAACCAA | 1784 |
| SOS1 | CAGCACCACUUCUAUGAUU | 1785 |
| | CAAAGAAGCUGUUCAAUAU | 1786 |
| | UGAAAGCCCUCGGUUAUUA | 1787 |
| | GAAAUAGCAUGGAGAAGGA | 1788 |
| BRCA1 | CCAUACAGCUUCAUAAAUA | 1789 |
| | GAAGAGAACUUAUCUAGUG | 1790 |
| | GAAGUGGGCUCCAGUAUUA | 1791 |
| | GCAAGAUGCUGAUUCAUUA | 1792 |
| | GAAGUGGGCUCCAGUAUUA | 1793 |
| | GAAGGGACACUGAAAUAUU | 1794 |
| | GCAGAUAGUUCUACCAGUA | 1795 |
| CDKN1A | GAACAAGGAGUCAGACAUU | 1796 |
| | AAACUAGGCGGUUGAAUGA | 1797 |
| | GAUGGAACUUGGACUUUGU | 1798 |
| | GUAAACAGAUGGGACUUUG | 1799 |
| CDKN1B | GGAAUGGACAUCCUGUAUA | 1800 |
| | GGAGAAAGAUGUCAAACGU | 1801 |
| | GAAUGGACAUCCUGUAUAA | 1802 |
| | GUAAACAGCUCGAAUUAAG | 1803 |
| SLC2A4 | CAGAUAGGCUCCGAAGAUG | 1804 |
| | AGACUCGACUCCAGAAGUA | 1805 |
| | GAUCGUUCUUUCAUCUUC | 1806 |
| | CAGGAUCGGUUCUUUCAUC | 1807 |
| NOS2A | CCAGAUAAGUGACAUAAGU | 1808 |
| | UAAGUGACCUGCUUUGUAA | 1809 |

TABLE X-continued

| Gene Symbol | Sequence | SEQ ID |
|---|---|---|
|  | GAAGAGAGAUUCCAUUGAA | 1810 |
|  | UGAAAGAGCUCAACAACAA | 1811 |
| FRAP1 | GAGCAUGCCGUCAAUAAUA | 1812 |
|  | CAAGAGAACUCAUCAUAAG | 1813 |
|  | CCAAAGUGCUGCAGUACUA | 1814 |
|  | UAAGAAAGCUAUCCAGAUU | 1815 |
| FKBP1A | GAAACAAGCGCUUUAAGUU | 1816 |
|  | GAAUUACUCUCCAAGUUGA | 1817 |
|  | CAGCACAAGUGGUAGGUUA | 1818 |
|  | GUUGAGGACUGAAUUAGUC | 1819 |
|  | GAUGGCAGCUGUUUAAAUG | 1820 |
|  | GAGUAUCCUUUCAGUGUUA | 1821 |
| TNFRSF1A | CAAAGGAACCUACUUGUAC | 1822 |
|  | GGAACCUACUUGUACAAUG | 1823 |
|  | GAACCUACUUGUACAAUGA | 1824 |
|  | GAGUGUGUCUCCUGUAGUA | 1825 |
| IL1R1 | GGACAAGAAUCAAUGGAUA | 1826 |
|  | GAACAAGCCUCCAGGAUUC | 1827 |
|  | GGACUUGUGUGCCCUAUA | 1828 |
|  | GAACACAAAGGCACUAUAA | 1829 |
| IRAK1 | CGAAGAAAGUGAUGAAUUU | 1830 |
|  | GCUCUUUGCCCAUCUCUUU | 1831 |
|  | UGAAAGACCUGGUGGAAGA | 1832 |
|  | GCAAUUCAGUUUCUACAUC | 1833 |
| TRAF2 | GAAGACAGAGUUAUUAAAC | 1834 |
|  | UCACGAAGACAGAGUUAUU | 1835 |
|  | AGACAGAGUUAUUAAACCA | 1836 |
|  | CACGAAGACAGAGUUAUUA | 1837 |
|  | GCUGAAGCCUGUCUGAUGU | 1838 |
| TRAF6 | CAAAUGAUCUGAGGCAGUU | 1839 |
|  | GUUCAUAGUUUGAGCGUUA | 1840 |
|  | GGAGAAACCUGUUGUGAUU | 1841 |
|  | GGACAAAGUUGCUGAAAUC | 1842 |
|  | CAAAUGAUCUGAGGCAGUU | 1843 |
|  | GGAGAAACCUGUUGUGAUU | 1844 |
|  | GGACAAAGUUGCUGAAAUC | 1845 |
|  | GUUCAUAGUUUGAGCGUUA | 1846 |
| TRADD | UGAAGCACCUUGAUCUUUG | 1847 |
|  | GGGCAGCGCAUAGCUGUUU | 1848 |
|  | GAGGAGCGCUGUUUGAGUU | 1849 |
|  | GGACGAGGAGCGCUGUUUG | 1850 |
|  | GAGGAGCGCUGUUUGAGUU | 1851 |
|  | GGAUGUCUCUCUCGUCUUU | 1852 |
|  | GCUCACUCCUUUCUACUAA | 1853 |
|  | UGAAGCACCUUGAUCUUUG | 1854 |
| FADD | GCACAGAUAUUUCCAUUUC | 1855 |
|  | GCAGUCCUCUUAUUCCUAA | 1856 |
|  | GAACUCAAGCUGCGUUUAU | 1857 |
|  | GGACGAAUUGAGAUAAUAU | 1858 |
| IKBKE | UAAGAACACUGCUCAUGAA | 1859 |
|  | GAGGCAUCCUGAAGCAUUA | 1860 |
|  | GAAGGCGGCUGCAGAACUG | 1861 |
|  | GGAACAAGGAGAUCAUGUA | 1862 |
| IKBKG | CUAUCGAGGUCGUUAAAUU | 1863 |
|  | GAAUGCAGCUGGAAGAUCU | 1864 |
|  | GCGGCGAGCUGGACUGUUU | 1865 |
|  | CCAGACCGAUGUGUAUUUA | 1866 |
| TNFRSF5 | GGUCUCACCUCGCUAUGGU | 1867 |
|  | GAAAGCGAAUUCCUAGACA | 1868 |
|  | GCACAAACAAGACUGAUGU | 1869 |
|  | GAAGGGCACCUCAGAAACA | 1870 |
|  | UCUCCCAACUUGUAUUAA | 1871 |
| RELA | UCAAGUGUCUUCCAUCAUG | 1872 |
|  | UCAAGUGCCUUAAUAGUAG | 1873 |
|  | GGAGUACCCUGAGGCUAUA | 1874 |
|  | GAUGAGAUCUUCCUACUGU | 1875 |
| ARHA | GAGCUGGGCUAAGUAAAUA | 1876 |
|  | CACCAAAGAUGGAGUGAGA | 1877 |
|  | GGAAGAAACUGGUGAUUGU | 1878 |
|  | GGCUGUAACUACUUUAUAA | 1879 |
| CDC42 | GGACAUUUGUUUGCCAUUU | 1881 |
|  | GAACCAUGCUUUCUCAUG | 1882 |
|  | GAAGACCUGUUAUGUAGAG | 1883 |
|  | GAUCAAGAAUUGCAAUAUC | 1884 |
|  | GAAAAGGGUGACCUAGUA | 1885 |
|  | UGACAAACCUUAUGGAAAA | 1886 |
| ROCK1 | GGAAUGAGCUUCAGAUGCA | 1887 |
|  | GGACACAGCUGUAAGAUUG | 1888 |
|  | GACAAGAGAUUACAGAUAA | 1889 |
|  | GAAGAAACAUUCCCUAUUC | 1890 |
| PAK1 | GAGGGUGGUUUAUGAUUAA | 1891 |
|  | CAACAAAGAACAAUCACUA | 1892 |
|  | GAAGAAAUAUACACGGUUU | 1893 |
|  | UACAUGAGCUUUACAGAUA | 1894 |
| PAK2 | GGUAGGAGAUGAAUUGUUU | 1895 |
|  | AGAAGGAACUGAUCAUUAA | 1896 |
|  | CUACAGACCUCCAAUAUCA | 1897 |
|  | GAAACUGGCCAAACCGUUA | 1898 |
| PAK3 | GAUUAUCGCUGCAAAGGAA | 1899 |
|  | GAGAGUGCCUGCAAGCUUU | 1900 |
|  | GACAAGAGGUGGCCAUAAA | 1901 |
|  | UUAAAUCGCUGUCUUGAGA | 1902 |
| PAK4 | ACUAAGAGGUGAACAUGUA | 1903 |
|  | GAUCAUGAAUGUCCGAAGA | 1904 |
|  | GAUGAGACCCUACUACUGA | 1905 |
|  | CAGCAAAGGUGCCAAAGAU | 1906 |
| PAK6 | UAAAGGCAGUUGUCCACUA | 1907 |
|  | GAAGGGACCUGCUUUCUUG | 1908 |
|  | GCAAAGACGUCCCUAAGAG | 1909 |
|  | CCAAUGGGCUGGCUGCAAA | 1910 |
| PAK7 | GAGCACGGCUUUAAUAAGU | 1911 |
|  | CAAACUCCGUUAUGAUAUA | 1912 |
|  | GGAUAAAGUUGUCUGAAUU | 1913 |
|  | GGAAAUGCCUCCAUAAAUA | 1914 |
| HDAC1 | GGACAUCGCUGUGAAUUGG | 1915 |
|  | AGAAAGAAGUCACCGAAGA | 1916 |
|  | GGACAAGGCCACCCAAUGA | 1917 |
|  | CCACAGCGAUGACUACAUU | 1918 |
| HDAC2 | GCUGUUAAAUUAUGGCUUA | 1919 |
|  | GCAAAGAAAGCUAGAAUUG | 1920 |
|  | CAUCAGAGAGUCUUAUAUA | 1921 |
|  | CCAAUGAGUUGCCAUAUAA | 1922 |
| CREBBP | GGCCAUAGCUUAAUUAAUC | 1923 |
|  | GCACAGCCGUUUACCAUGA | 1924 |
|  | GGACAGCCCUUUAGUCAAG | 1925 |
|  | GAACUGAUUCCUGAAAUAA | 1926 |
| BTRC | CACAUAAACUCGUAUCUUA | 1927 |
|  | GAGAAGGCACUCAAGUUUA | 1928 |
|  | AGACAUAGUUUACAGAGAA | 1929 |
|  | GCAGAGAGAUUUCAUAACU | 1930 |
| RIPK2 | GAACAUACGUGUAAAUCAU | 1931 |
|  | GGACAUCGACCUGUUAUUA | 1932 |

TABLE X-continued

| Gene Symbol | | |
|---|---|---|
| | UAAAUGAACUCCUACAUAG | 1933 |
| | GGAAUUAUCUCUGAACAUA | 1934 |
| VAV1 | GCAGAAAUACAUCUACUAA | 1935 |
| | GCUAUGAGCUGUUCUUCAA | 1936 |
| | CGACAAAGCUCUACUCAUC | 1937 |
| | GCUCAACCCUGGAGACAUU | 1938 |
| VAV2 | GGACAAGACUCGCAGAUUU | 1939 |
| | GCUGAGCGCUUUGCAAUAA | 1940 |
| | CAAGAAGUCUCACGGAAAA | 1941 |
| | UCACAGAGGCCAAGAAAUU | 1942 |
| GRB2 | UGGAAGCCAUCGCCAAAUA | 1942 |
| | CAUCAGUGCAUGACGUUUA | 1943 |
| | UGAAUGAGCUGGUGGAUUA | 1944 |
| | UGCCAAAACUUACCUAUAA | 1945 |
| PLCG1 | GAGCUGCACUCCAAUGAGA | 1946 |
| | GAAACCAAGCCAUUAAUGA | 1947 |
| | CCAAGGAGCUACUGACAUU | 1948 |
| | AGAGAAACAUGGCCCAAUA | 1949 |
| ITGB1 | CCACAGACAUUUACAUUAA | 1950 |
| | GAAGGGAGUUUGCUAAAUU | 1951 |
| | GAACAGAUCGUGAAUGA | 1952 |
| | CAAGAGAGCUGAAGACUAU | 1953 |
| ITGA4 | GCAUAUAUAUUCAGCAUUG | 1954 |
| | CAACUUGACUGCAGUAUUG | 1955 |
| | GAACUUAACUUUCCAUGUU | 1956 |
| | GACAAGACCUGUAGUAAUU | 1957 |
| STAT1 | AGAAAGAGCUUGACAGUAA | 1958 |
| | GGAAGUAGUUCACAAAAUA | 1959 |
| | UGAAGUAUCUGUAUCCAAA | 1960 |
| | GAGCUUCACUCCCUUAGUU | 1961 |
| KRAS2 | UAAGGACUCUGAAGAUGUA | 1962 |
| | GACAAAGUGUGUAAUUAUG | 1963 |
| | GCUCAGGACUUAGCAAGAA | 1964 |
| | GAAACUGAAUACCUAAGAU | 1965 |
| | GAAACUGAAUACCUAAGAU | 1966 |
| | UAAGGACUCUGAAGAUGUA | 1967 |
| | GACAAAGUGUGUAAUUAUG | 1968 |
| | GOUCAGGACUUAGCAAGAA | 1969 |
| HRAS | CCAUCCAGCUGAUCCAGAA | 1970 |
| | GAACCCUCCUGAUGAGAGU | 1971 |
| | GAGGACAUCCACCAGUACA | 1972 |
| BRAF | GAUUAGAGACCAAGGAUUU | |
| | CCACUGAUGUGUGUUAAUU | 1973 |
| | CAAUAGAACCUGUCAAUAU | 1974 |
| | GAAGACAGGAAUCGAAUGA | 1975 |
| ELK1 | GAUGUGAGUAGAAGAGUUA | 1975 |
| | GGAAGAAUUUGUACCAUUU | 1976 |
| | GAACGACCUUUCUUUCUUU | 1977 |
| | GGAGUCAUCUCUUCCUAUA | 1978 |
| RALGDS | GGAGAAGCCUCACCUCUUG | 1979 |
| | GCAGAAAGGACUCAAGAUU | 1980 |
| | GAGAACAACUACUCAUUGA | 1981 |
| | GAACUUCUCGUCACUGUAU | 1982 |
| PRKCA | GGAUUGUUCUUUCUUCAUA | 1983 |
| | GAAGGGUUCUCGUAUGUCA | 1984 |
| | GAAGAAGGAUGUGGUGAUU | 1985 |
| | GGACUGGGAUCGAACAAGA | 1986 |
| MAP2K4 | GGACAGAAGUGGAAAUAUU | 1987 |
| | UCAAAGAGGUGAACAUUAA | 1988 |
| | GACCAAAUCUCAGUUGUUU | 1989 |
| | GGAGAAUGGUGCUGUUUAA | 1990 |
| MAP2K7 | GAAGAGCGGCCACGUCAUU | 1991 |
| | GAAGACCGGCCACGUCAUU | 1992 |
| | GGAAGAGACCAAAGUAUAA | 1993 |
| | GCAUUGAGAUUGACCAGAA | 1994 |
| | UGAGAGAACGAGAAAGUUG | 1995 |
| | GUGAAACCCUGUCUGCAUU | 1996 |
| | GGAUCUCUCUCAACAACUA | 1997 |
| | ACAACUAGGUGAACACAUA | 1998 |
| MAPK8 | UCACAGUCCUGAAACGAUA | 1999 |
| | GAUUGGAGAUUCUACAUUC | 2000 |
| | GCUCAUGGAUGCAAAUCUU | 2001 |
| | GAAGCUAAGCCGAGCAUUU | 2002 |
| MAPK9 | AAAGAGAGCUUAUCGUGAA | 2003 |
| | GAUGAUAGGUUAGAAAUAG | 2004 |
| | ACAAAGAAGCAUGGAUUG | 2005 |
| | GGAGCUGGAUCAUGAAAGA | 2006 |
| AIF1 | GAAAAGGGAUGAUGGGAUU | 2007 |
| | CCUAGACGAUCCCAAAUAU | 2008 |
| | GAGCCAAACCAGGGAUUUA | 2009 |
| | UGAAACGAAUGCUGGAGAA | 2010 |
| | UCACUCACCCAGAGAAAUA | 2011 |
| | CCAAGAAAGCUAUCUCUGA | 2012 |
| | AGACUCACCUAGAGCUAAA | 2013 |
| BBC3 | CCUGGAGGGUCUGUACAA | 2014 |
| | GAGCAAAUGAGCCAAACGU | 2015 |
| | GGAGGGUCCUGUACAAUCU | 2016 |
| | GACUUUCUCUGCACCAUGU | 2017 |
| BCL2L1 | CCAGGGAGCUUGAAAGUUU | 2018 |
| | AAAGUGCAGUUCAGUAAUA | 2019 |
| | GAGAAUCACUAACCAGAGA | 2020 |
| | GAGCCCAUCCCUAUUAUAA | 2021 |
| BCL2L11 | GAGACGAGUUUAACGCUUA | 2022 |
| | AAAGCAACCUUCUGAUGUA | 2023 |
| | CCGAGAAGGUAGACAAUUG | 2024 |
| | GCAAAGCAACCUUCUGAUG | 2025 |
| | AGACAGAGCCACAAGGUAA | 2026 |
| | GCAAGGAGGUUAGAGAAAU | 2027 |
| | CAAGGAGGUUAGAGAAAUA | 2028 |
| | UCUUACGACUGUUACGUUA | 2029 |
| BID | GAAGACAUCAUCCGGAAUA | 2030 |
| | CAACAGCGUUCCUAGAGAA | 2031 |
| | GAAAUGGGAUGGACUGAAC | 2032 |
| | ACGAUGAGCUGCAGACUGA | 2033 |
| BIRC2 | GAAAGAAGGCUGCAUAUAA | 2034 |
| | GAAAUUGACUCUACAUUGU | 2035 |
| | ACAAAUAGCACUUAGGUUA | 2036 |
| | GAAUACACCUGUGGUUAAA | 2037 |
| BIRC3 | GGAGAUGCCUGCCAUUAAA | 2038 |
| | UCAUGAUCUUGUGUUAGA | 2039 |
| | GAAAGAACAUGUAAAGUGU | 2040 |
| | GAAGAAAGAACAUGUAAAG | 2041 |
| BIRC4 | GUAGAUAGAUGGCAAUAUG | 2042 |
| | GAGGAGGCUAACUGAUUG | 2043 |
| | GAGGAACCCUGCCAUGUAU | 2044 |
| | GCACGGAUCUUUACUUUUG | 2045 |
| BIRC5 | GGCGUAAGAUGAUGGAUUU | 2046 |
| | GCAAAGGAAACCAACAAUA | 2047 |
| | GCACAAAGCCAUUCUAAGU | 2048 |
| | CAAAGGAAACGAAGAAUAA | 2049 |
| BRCA1 | CCAUACAGCUUCAUAAAUA | 2050 |
| | GAAGAGAACUUAUCUAGUG | 2051 |
| | GAAGUGGGCUCGAGUAUUA | 2052 |
| | GCAAGAUGCUGAUUCAUUA | 2053 |
| | CCAUACAGCUUCAUAAAUA | 2054 |

TABLE X-continued

| Gene Symbol | | |
|---|---|---|
| CARD4 | GAAAGUUAAUGUCAAGGAA | 2055 |
| | GAGCAACACUGGCAUAACA | 2056 |
| | UAACAGAGAUUUGCCUAAA | 2057 |
| | GCGAAGAGCUGACCAAAUA | 2058 |
| CASP10 | CAAAGGGUUUCUCUGUUUA | 2059 |
| | GAAAUGACCUCCCUAAGUU | 2060 |
| | GAAGGCAGCUGGUAUAUUC | 2061 |
| | GACAUGAUCUUCCUUCUGA | 2062 |
| | GCACUCUUCUGUUCCCUUA | 2063 |
| | GUAUUAAACUCUCCUUUGA | 2064 |
| | GCAAGGAGAUGUCUGAAUA | 2065 |
| | CAACUUCCCUGAUCUUUAA | 2066 |
| | GCUGAAAGAUGUAAUGUAG | 2067 |
| CDKN1A | GAACAAGGAGUCAGACAUU | 2068 |
| | AAACUAGGCGUUGAAUGA | 2069 |
| | GAUGGAACUUCGACUUUGU | 2070 |
| | GUAAACAGAUGGCACUUUG | 2071 |
| CFLAR | GAUGUGUCCUCAUUAAUUU | 2072 |
| | GAAGAGAGAUACAAGAUGA | 2073 |
| | GAGGAUACCUGAAGAGAGA | 2074 |
| | GCUAUGAAGUCCAGAAAUU | 2075 |
| CLK2 | GUGAAUAUGUGAAAUAGUG | 2076 |
| | AAAGCAUGCUAGAGUAUGA | 2077 |
| | UUAAGAAUGUGGAGAAGUA | 2078 |
| | GAUAACAAGCUGACACAUA | 2079 |
| CLSPN | GGAGGUAAUUGAUGAAGUA | 2080 |
| | GCAGAUGGGUUCUUAAAUG | 2081 |
| | CAAAUGAGGUUGAGGAAAU | 2082 |
| | GGAAAUACCUGGAGGAUGA | 2083 |
| CSNK2A1 | GAUCCACGUUUCAAUGAUA | 2084 |
| | GCAUUUAGGUGGAGACUUC | 2085 |
| | GAUGUACGAUUAUAGUUUG | 2086 |
| | UGAAUUAGAUCCACGUUUC | 2087 |
| CTNNB1 | GCACAAGAAUGGAUCACAA | 2088 |
| | GCUGAAACAUGCAGUUGUA | 2089 |
| | GUACGUACCAUGCAGAAUA | 2090 |
| | GAACUUGCAUUGUGAUUGG | 2091 |
| CXCR4 | GAAGCAUGACGGACAAGUA | 2092 |
| | GAACAUUCCAGAGCGUGUA | 2093 |
| | GUUCUUAGUUGCUGUAUGU | 2094 |
| | GAUCAUGGUUGGCCUUAUC | 2095 |
| CXCR6 | GGAACAAACUGGCAAAGCA | 2096 |
| | GAUCAGAGCAGCAGUGAAA | 2097 |
| | GGGCAAAACUGAAUUAUAA | 2098 |
| | GAUCUCAGGUUCUCCUUGA | 2099 |
| DAXX | CUACAGAUCUCCAAUGAAA | 2100 |
| | GCUACAAGCUGGAGAAUGA | 2101 |
| | GGAAACAGCUAUGUGGAAA | 2102 |
| | GGAGUUGGAUCUCUCAGAA | 2103 |
| GAS41 | GUAGUAAGCUAAACUGAAA | 2104 |
| | GACAAUAUGUUCAAGAGAA | 2105 |
| | GACAACAUCUCGUCAGCUA | 2106 |
| | UAUAUGAUGUGUCCAGUAA | 2107 |
| GTSE1 | CAAAGAAGCUCACUUACUG | 2108 |
| | GAACAGCCCUAAAGUGGUU | 2109 |
| | GAACAUGGAUGACCCUAAG | 2110 |
| | GGGCAAAGCUAAAUCAAGU | 2111 |
| HDAC3 | GGAAAGCGAUGUGGAGAUU | 2112 |
| | CCAAGACCGUGGCCUAUUU | 2113 |
| | AAAGCGAUGUGGAGAUUUA | 2114 |
| | GUGAGGAGCUUCCCUAUAG | 2115 |
| HDAC5 | GAAUUCCUCUUGUCGAAGU | 2116 |
| | GUUAUUAGCACCUUUAAGA | 2117 |
| | GGAGGGAGGCCAUGACUUG | 2118 |
| | CAGGAGAGCUCAAGAAUGG | 2119 |
| | GGAUAUGGAUUUCAGUUAA | 2120 |
| | GGAAGUCGGUGGCUUGGUU | 2121 |
| | GGAAGGAGAGGACUGGUUU | 2122 |
| HEC | GCAGAUACUUGCACGGUUU | 2123 |
| | GAGUAGAACUAGAAUGUGA | 2124 |
| | GCGAAUAAAUCAUGAAAGA | 2125 |
| | GAAGAUGGAAUUAUGCAUA | 2126 |
| HIST1H2AA | GGCAAUGCGUCUCGCGAUA | 2127 |
| | GAUCCGCAAUGAUGAGGAA | 2128 |
| | GCAAUGCGUCUGGCGAUAA | 2129 |
| | GAGGAACUCAAUAAGCUUU | 2130 |
| LMNB1 | AAUAGAAGCGUGCAAUUA | 2131 |
| | CAACUGACCUCAUCUGGAA | 2132 |
| | GAAGGAAUCUGAUCUUAAU | 2133 |
| | GGGAAGGGUUUCUCUAUUA | 2134 |
| LMNB2 | GGAGGUUCAUUGAGAAUUG | 2134 |
| | GGCAAUAGCUCACCGUUUA | 2135 |
| | CAAAUACGCUUAGUCUGUGU | 2136 |
| | GGAGAUCGCCUACAAGUUC | 2137 |
| MYB | GCAGAAACACUCCAAUUUA | 2138 |
| | GUAAAUACGUGAAUGCAUU | 2139 |
| | GCACUGAACUUUUGAGAUA | 2140 |
| | GAAGAACAGUCAUUUGAUG | 2141 |
| MYT1 | GAGGUGAGCUGUUAAAUCA | 2142 |
| | GCAGGGUGAUUUCCUAAUA | 2143 |
| | GGGAGAAGAUAUUUAAUUG | 2144 |
| | CAACUUCUCUCCUGAACUU | 2145 |
| NFKBIB | GGACACGGCACUGCACUUG | 2146 |
| | GCACUUGGCUGUGAUUCAU | 2148 |
| | GAGACGAGGGCGAUGAAUA | 2149 |
| | CAUGAACCCUUGCUGGAUU | 2150 |
| NFKBIA | GAACAUGGACUUGUAUAUU | 2151 |
| | GAUGUGGGGUGAAAAGUUA | 2152 |
| | GGACGAGAAAGAUCAUUGA | 2153 |
| | AGGACGAGCUGCCCUAUGA | 2154 |
| NFKBIE | GAAGGGAAGUUUCAGUAAC | 2155 |
| | GGAAGGGAAGUUUCAGUAA | 2156 |
| | GGAAACUGCUGCUGUGUAC | 2157 |
| | GAACCAACCACUCAUGGAA | 2158 |
| NUMA1 | GGGAACAGUUUGAAUAUAA | 2159 |
| | GCAGUAGCCUGAAGCAGAA | 2160 |
| | CGAGAAGGAUGCACAGAUA | 2161 |
| | GCAAGAGGCUGAGAGGAAA | 2162 |
| NUP153 | GAAGACAAAUGAAAGCUAA | 2163 |
| | GAUAAGACUGCUGUUAGA | 2164 |
| | GAGGAGAGCUCUAAUAUUA | 2165 |
| | GAGGAAGCCUGAUUAAAGA | 2166 |
| OPA1 | GAAAGAGCAUGAUGACAUA | 2167 |
| | GAGGAGAGCUCUAUUAUGU | 2168 |
| | GAAACUGAAUGGAAGAAUA | 2169 |
| | AAAGAAGGCUGUACCGUUA | 2170 |
| PARVA | CUACAUGUCUUUGCUGUUA | 2171 |
| | GCUAGUCCUGUAAGAAUA | 2172 |
| | CAAAGGCAAUGUACUGUUU | 2173 |
| | GAACAUGGUGGAUCCAAA | 2174 |
| PIK3CG | AAGUUCAGCUUCUCUAUUA | 2175 |
| | GAAGAAAUCUCUGAUGGAU | 2176 |

TABLE X-continued

| Gene Symbol | | |
|---|---|---|
| | GAACACCUUUACUCUAUAA | 2177 |
| | GCAUGGAGCUGGAGAACUA | 2178 |
| PRKDC | GAUGAAAGCUCUAAAGAUG | 2179 |
| | GAAAGGAGGUUCUAAACUA | 2180 |
| | GGAAGAAGCUCAUUUGAUU | 2181 |
| | GCAAAGAGGUGGCAGUUAA | 2182 |
| | GGAAGAAGAUCCACAUGAA | 2183 |
| RASA1 | GAACAUACUUUCAGAGGUU | 2184 |
| | GAACAUCUUUGCUGUAUA | 2185 |
| | UAACAGAACUGCUUCAACA | 2186 |
| SLC9A1 | GAAGAGAUCCACACACAGU | 2187 |
| | UCAUGAGCUGCUGCACAU | 2188 |
| | GAAGAUAGGUUUCCAUGUG | 2189 |
| | GAAUUACCCUUCCUCAUCU | 2190 |
| TEGT | CUACAGAGCUUCAGUGUGA | 2191 |
| | GAAGAUAUUUGAUCGAAAG | 2192 |
| | GAGCAAACCUAGAUAAGGA | 2193 |
| | GCAUUGAUCUCUUCUUAGA | 2194 |
| TERT | GGAAGACAGUGGUGAACUU | 2195 |
| | GCAAAGCAUUGGAAUCAGA | 2196 |
| | GAGCUGACGUGGAAGAUGA | 2197 |
| | GAACGGGCCUGGAACCAUA | 2198 |
| TNFRSF 6 | GAUACUAACUGCUCUCAGA | 2199 |
| | GAAAGAAUGGCUGCAAUGA | 2200 |
| | UCAAUAAUGUCCCAUGUAA | 2201 |
| | UCAUGAAUCUCCAACCUUA | 2202 |
| | GAUGUUGACUUGAGUAAAU | 2203 |
| TOP1 | GAAAGGAAAUGACUAAUGA | 2204 |
| | GAAGAAGGCUGUUCAGAGA | 2205 |
| | GGAAGUAGCUACGUUCUUU | 2206 |
| | GGACAUAAGUGGAAAGAAG | 2207 |
| TOP2A | GAAAGAGUCCAUCAGAUUU | 2208 |
| | CAAACUACAUUGGCAUUUA | 2209 |
| | AAACAGACAUGGAUGGAUA | 2210 |
| | CGAAAGGAAUGGUUAACUA | 2211 |
| TOP3A | CCAGAAAUGUUCCACAGAA | 2212 |
| | GAAACUAUCUGGAUGUGUA | 2213 |
| | CCACAAAGAUGGUAUCGUA | 2214 |
| | GGAAAUGGCUGUGGUAACA | 2215 |
| TOP3B | GAGACAAGAUGAAGACUGU | 2216 |
| | GCACAUGGGCUGCGUCUUU | 2217 |
| | CCAGUGCGCUUCAAGAUGA | 2218 |
| | GAACAUCUGCUUUGAGGUU | 2219 |
| WEE1 | GGUAUUGCCUUGUGAAUUU | 2220 |
| | GCAGAACAAUUACGAAUAG | 2221 |
| | GUACAUAGCUGUUUGAAAU | 2222 |
| | GCUGUAAACUUGUAGCAUU | 2223 |

In addition, to identifying functional siRNA against gene families or pathways, it is possible to design duplexes against genes known to be involved in specific diseases. For example when dealing with human disorders associated with allergies, it will be beneficial to develop siRNA against a number of genes including but not limited to:

the interleukin 4 receptor gene (SEQ. ID NO. 2224: UAGAGGUGCUCAUUCAUUU,
SEQ. ID NO. 2225: GGUAUAAGCCUUUCCAAGA,
SEQ. ID NO. 2225: ACACACAGCUGGAAGAAAU,
SEQ. ID NO. 2226: UAACAGAGCUUCCUUAGGU), the Beta-arrestin-2
(SEQ. ID NO. 2227: GGAUGAAGGAUGACGACUA,
SEQ. ID NO. 2228: ACACCAACCUCAUUGAAUU,
SEQ. ID NO. 2229: CGAACAAGAUGACCAGGUA,
SEQ. ID NO. 2230: GAUGAAGGAUGACGACUAU,), the interferon-gamma receptor 1 gene
(SEQ. ID NO. 2231: CAGCAUGGCUCUCCUCUUU,
SEQ. ID NO. 2232: GUAAAGAACUAUGGUGUUA,
SEQ. ID NO. 2233: GAAACUACCUGUUACAUUA,
SEQ. ID NO. 2234: GAAGUGAGAUCCAGUAUAA), the matrix metalloproteinase MMP-9
(SEQ. ID NO. 2235: GGAACCAGCUGUAUUGUU,
SEQ. ID NO. 2236: GUUGGAGUGUUUCUAAUAA,
SEQ. ID NO. 2237: GCGCUGGGCUUAGAUCAUU,
SEQ. ID NO. 2238: GGAGCCAGUUUGCCGGAUA), the Slc11a1 (Nramp1) gene
(SEQ. ID NO. 2239: CCAAUGGCCUGCUGAACAA,
SEQ. ID NO. 2240: GGGCCUGGCUUCCUCAUGA,
SEQ. ID NO. 2241: GGGCAGAGCUCCACCAUGA,
SEQ. ID NO. 2242: GCACGGCCAUUGCAUUCAA), SPINK5
(SEQ. ID NO. 2243: CCAACUGCCUGUUCAAUAA,
SEQ. ID NO. 2244: GGAUACAUGUGAUGAGUUU,
SEQ. ID NO. 2245: GGACGAAUGUGCUGAGUAU,
SEQ. ID NO. 2246: GAGCUUGCUUAUUUGCUA,), the CYP1A2 gene
(SEQ. ID NO. 2247: GAAAUGCUGUGUCUUCGUA,
SEQ. ID NO. 2248: GGACAGCACUUCCUGAA,
SEQ. ID NO. 2249: GAAGCACCACCAUUCUGA,
SEQ. ID NO. 2250: GGCCAGAGCUUGACCUUCA), thymosin-beta4Y
(SEQ. ID NO. 2251: GGACAGGCCUGCGUUGUUU,
SEQ. ID NO. 2252: GGAAAGAGGAAGCUCAUGA,
SEQ. ID NO. 2253: GCAAACACGUUGGAUGAGU,
SEQ. ID NO. 2254: GGACUAUGCUGCCCUUUUG, activin A receptor IB
(SEQ. ID NO. 2255: ACAAGACGCUCCAGGAUCU,
SEQ. ID NO. 2254: GCAACAGGAUCGACUUGAG,
SEQ. ID NO. 2255: GAAGCUGCGUCCCAACAUC,
SEQ. ID NO. 2256: GCAUAGGCCUGUAAUCGUA,
SEQ. ID NO. 2257: UCAGAGAGUUCGAGACAAA,
SEQ. ID NO. 2258: UGCGAAAGUUGUAUGUGA,
SEQ. ID NO. 2259: GCAACAGGAUCGACUUGAG,
SEQ. ID NO. 2260: GAAUAGCGUUGUGUGUUAU,
SEQ. ID NO. 2261: UGAAUAGCGUUGUGUGUUA,
SEQ. ID NO. 2262: GGGAUCAGUUUGUUGAAUA,
SEQ. ID NO. 2263: GAGCCUGAAUCAUCGUUUA,), ADAM33
(SEQ. ID NO. 2264: GGAAGUACCUGGAACUGUA,
SEQ. ID NO. 2265: GGACAGAGGGAACCAUUUA,
SEQ. ID NO. 2266: GGUGAGAGGUAGCUCCUAA,
SEQ. ID NO. 2267: AAAGACAGGUGGCCACUGA), the TAP1 gene
(SEQ. ID NO. 2268: GAAAGAUGAUCAGCUAUUU,
SEQ. ID NO. 2269: CAACAGAACCAGACAGGUA,
SEQ. ID NO. 2270: UGAGAAAUGUUCAGAAUGU,
SEQ. ID NO. 2271: UACCUUCACUCGAAACUUA, COX-2
(SEQ. ID NO. 2272: GAACGAAAGUAAAGAUGUU,
SEQ. ID NO. 2273: GGACUUAUGGGUAAUGUUA,
SEQ. ID NO. 2274: UGAAAGGACUUAUGGGUAA,
SEQ. ID NO. 2275: GAUCAGAGUUCACUUUCUU), ADPRT
(SEQ. ID NO. 2276: GGAAAGAUGUUAAGCAUUU,
SEQ. ID NO. 2277: CAUGGGAGCUCUUGAAAUA,
SEQ. ID NO. 2278: GAACAAGGAUGAAGUGAAG,
SEQ. ID NO. 2279: UGAAGAAGCUCACAGUAAA,), -continued HDC
(SEQ. ID NO. 2280: CAGCAGACCUUCAGUGUGA,
SEQ. ID NO. 2281: GGAGAGAGAUGGUGGAUUA,
SEQ. ID NO. 2282: GUACAGAGCUGGAGAUGAA,
SEQ. ID NO. 2283: GAACGUCCCUUCAGUCUGU), HnmT
(SEQ. ID NO. 2284: CAAAUUCUCUCCAAAGUUC,
SEQ. ID NO. 2285: GGAUAUAUCUGACUGCUUU,
SEQ. ID NO. 2286: GAGCAGAGCUUGCGAAAGA,
SEQ. ID NO. 2287: GAUAUGAGAUGUAGCAAAU), GATA-3
(SEQ. ID NO. 2288: GAACUGCUUUCUUUCGUUU,
SEQ. ID NO. 2289: OCAGUAUCAUGAAGCCUAA,
SEQ. ID NO. 2290: GAAACUAGGUCUGAUAUUC,
SEQ. ID NO. 2291: GUACAGCUCCGGACUCUUC), Gab2
(SEQ. ID NO. 2292: GCACAACCAUUCUGAAGUU,
SEQ. ID NO. 2293: GGACUUAGAUGCCCAGAUG,
SEQ. ID NO. 2294: GAAGGUGGAUUCUAGGAAA,
SEQ. ID NO. 2295: GGACUAGCCCUGCUGUUUA),
and STAT6
(SEQ. ID NO. 2296: GAUAGAAACUCCUGCUAAU,
SEQ. ID NO. 2297: GGACAUUUAUUCCCAGCUA,
SEQ. ID NO. 2298: GGACAGAGCUACAGACCUA,
SEQ. ID NO. 2299: GGAUGGCUCUCCACAGAUA).

In addition, rationally designed siRNA or siRNA pools can be directed against genes involved in anemia, hemophila or hypercholesterolemia. Such genes would include, but are not be limited to:

APOA5
(SEQ. ID NO. 2300: GAAAGACAGCCUUGAGCAA,
SEQ. ID NO. 2301: GGACAGGGAGGCCACCAAA,
SEQ. ID NO. 2302: GGACGAGGCUUGGGCUUUG,
SEQ. ID NO. 2303: AGCAAGACCUCAACAAUAU),

HMG-CoA reductase
(SEQ. ID NO. 2304: GAAUGAAGCUUUGCCCUUU,
SEQ. ID NO. 2305: GAACACAGUUUAGUGCUUU,
SEQ. ID NO. 2306: UAUCAGAGCUCUUAAUGUU,
SEQ. ID NO. 2307: UGAAGAAUGUCUACAGAUA), NOS3
(SEQ. ID NO. 2308: UGAAGCACCUGGAGAAUGA,
SEQ. ID NO. 2309: CGGAACAGCACAAGAGUUA,
SEQ. ID NO. 2310: GGAAGAAGACCUUUAAAGA,
SEQ. ID NO. 2309: GCACAAGAGUUAUAAGAUC), ARH
(SEQ. ID NO. 2310: CGAUACAGCUUGGCACUUU,
SEQ. ID NO. 2311: GAGAAGCGCUGCCCUGUGA,
SEQ. ID NO. 2312: GAAUCAUGCUGUUCUCUUU,
SEQ. ID NO. 2313: GGAGUAACCGGACACCUUA), CYP7A1
(SEQ. ID NO. 2314: UAAGGUGACUCGAGUGUUU,
SEQ. ID NO. 2315: AAACGACACUUUCAUCAAA,
SEQ. ID NO. 2316: GGACUCAAGUUAAAGUAUU,
SEQ. ID NO. 2317: GUAAUGGACUCAAGUUAAA), FANCA
(SEQ. ID NO. 2318: GGACAUCACUGCCCACUUC,
SEQ. ID NO. 2319: AGAGGAAGAUGUUCACUUA,
SEQ. ID NO. 2320: GAUCGUGGCUCUUCAGGAA,
SEQ. ID NO. 2321: GGACAGAGGCAGAUAAGAA), FANCG
(SEQ. ID NO. 2322: GCACUAAGCAGCCUUCAUG,
SEQ. ID NO. 2323: GCAAGCAGGUGCCUACAGA,
SEQ. ID NO. 2324: GGAAUUAGAUGCUCCAUUG,
SEQ. ID NO. 2325: GGACAUCUCUGCCAAAGUC), ALAS
(SEQ. ID NO. 2326: CAAUAUGCCUGGAAACUAU,
SEQ. ID NO. 2327: GGUUAAGACUCACCAGUUC,
SEQ. ID NO. 2328: CAACAGGACUUUAGGUUCA,
SEQ. ID NO. 2329: GCAUAAGAUUGACAUCAUC), PIGA
(SEQ. ID NO. 2330: GAAAGAGGGCAUAAGGUUA,
SEQ. ID NO. 2331: GGACUGAUCUUUAAACUAU,
SEQ. ID NO. 2332: UCAAAUGGCUUACUUCAUC,
SEQ. ID NO. 2333: UCUAAGAACUGAUGUCUAA),
and factor VIII
(SEQ. ID NO. 2334: GCAAAUAGAUCUCCAUUAC,
SEQ. ID NO. 2335: CCAGAUAUGUCGUUCUUUA,
SEQ. ID NO. 2336: GAAAGGCUGUGCUCUCAAA,
SEQ. ID NO. 2337: GGAGAAACCUGCAUGAAAG,
SEQ. ID NO. 2338: CUUGAAGCCUCCUGAAUUA,
SEQ. ID NO. 2339: GAGCAAGCAUCCAAAGAUU,
SEQ. ID NO. 2340: GAUAGGAGAUACAAACUUU).

Furthermore, rationally designed siRNA or siRNA pools can be directed against genes involved in disorders of the brain and nervous system. Such genes would include, but are not be limited to:

APBB1
(SEQ. ID NO. 2341: CUACGUAGCUCGUGAUAAG,
SEQ. ID NO. 2342: GCAGAGAUGUCCACACGUU,
SEQ. ID NO. 2343: CAUGAGAUCUGCUCUAAGA,
SEQ. ID NO. 2344: GGGCACCUCUGCUGUAUUG),

BACE1
(SEQ. ID NO. 2345: CCACAGAGCAAGUGAUUUA,
SEQ. ID NO. 2346: GCAGAAAGGAGAUCAUUUA,
SEQ. ID NO. 2347: GUAGCAAGAUCUUUACAUA,
SEQ. ID NO. 2348: UGUCAGAGCUUGAUUAGAA),

PSEN1
(SEQ. ID NO. 2349: GAGCUGACAUUGAAAUAUG,
SEQ. ID NO. 2350: GUACAGCUAUUUCUCAUCA,
SEQ. ID NO. 2351: GAGGUUAGGUGAAGUGGUU,
SEQ. ID NO. 2352: GAAAGGGAGUCACAAGACA,
SEQ. ID NO. 2353: GAACUGGAGUGGAGUAGGA,
SEQ. ID NO. 2354: CAGCAGGCAUAUCUCAUUA,
SEQ. ID NO. 2355: UCAAGUACCUCCCUGAAUG),

PSEN2
(SEQ. ID NO. 2356: GCUGGGAAGUGGCUUAAUA,
SEQ. ID NO. 2357: CAUAUUCCCUGCCCUGAUA,
SEQ. ID NO. 2358: GGGAAGUGCUCAAGACCUA,
SEQ. ID NO. 2359: CAUAGAAAGUGACGUGUUA),

MASS1
(SEQ. ID NO. 2360: GGAAGGAGCUGUUAUGAGA,
SEQ. ID NO. 2361: GAAAGGAGAAGCUAAAUUA,
SEQ. ID NO. 2362: GGAGGAAGGUCAAGAUUUA,
SEQ. ID NO. 2363: GGAAAUAGCUGAGAUAAUG,),

ARX
(SEQ. ID NO. 2364: CCAGACGCCUGAUAUUGAA,
SEQ. ID NO. 2365: CAGCACCACUCAAGACCAA,
SEQ. ID NO. 2366: CGCCUGAUAUUGAAGUAAA,
SEQ. ID NO. 2367: CAACAUCCACUCUCUCUUG)
and NNMT
(SEQ. ID NO. 2368: GGGCAGUGCUCCAGUGGUA,
SEQ. ID NO. 2369: GAAAGAGGCUGGCUACACA,
SEQ. ID NO. 2370: GUACAGAAGUGAGACAUAA,
SEQ. ID NO. 2371: GAGGUGAUCUCGCNAAGUU).

In addition, rationally designed siRNA or siRNA pools can be directed against genes involved in hypertension and related disorders. Such genes would include, but are not be limited to:

```
angiotensin II type 1 receptor
(SEQ. ID NO. 2372: CAAGAAGCCUGCACCAUGU,
SEQ. ID NO. 2373: GGACUUCACUACCAAAUGA,
SEQ. ID NO. 2374: GCACUGGUCCCAAGUAGUA,
SEQ. ID NO. 2375: CCAAAGGGCAGUAAAGUUU,
SEQ. ID NO. 2376: GCUCAGAGGAGGUGUAUUU,
SEQ. ID NO. 2377: GCACUUCACUACCAAAUGA,
SEQ. ID NO. 2378: AAAGGGCAGUAAAGUUU), AGTR2
(SEQ. ID NO. 2379: GAACAUCUCUGGCAACAAU,
SEQ. ID NO. 2380: GGUGAUAUAUCUCAAAUUG,
SEQ. ID NO. 2381: GCAAGCAUCUUAUAUAGUU,
SEQ. ID NO. 2382: GAACCAGUCUUUCAACUCA),
``` and other related targets.

Example XIII

Validation of Multigene Knockout Using Rab5 and Eps

Two or more genes having similar, overlapping functions often leads to genetic redundancy. Mutations that knockout only one of, e.g., a pair of such genes (also referred to as homologs) results in little or no phenotype due to the fact that the remaining intact gene is capable of fulfilling the role of the disrupted counterpart. To fully understand the function of such genes in cellular physiology, it is often necessary to knockout or knockdown both homologs simultaneously. Unfortunately, concomitant knockdown of two or more genes is frequently difficult to achieve in higher organisms (e.g. mice) thus it is necessary to introduce new technologies dissect gene function. One such approach to knocking down multiple genes simultaneously is by using siRNA. For example, FIG. 11 showed that rationally designed siRNA directed against a number of genes involved in the clathrin-mediated endocytosis pathway resulted in significant levels of protein reduction (e.g. >80%). To determine the effects of gene knockdown on clathrin-related endocytosis, internalization assays were performed using epidermal growth factor and transferrin. Specifically, mouse receptor-grade EGF (Collaborative Research Inc.) and iron-saturated human transferrin (Sigma) were iodinated as described previously (Jiang, X., Huang, F., Marusyk, A. & Sorkin, A. (2003) *Mol Biol Cell* 14, 858-70). HeLa cells grown in 12-well dishes were incubated with $^{125}$I-EGF (1 ng/ml) or $^{125}$I-transferrin (1 μg/ml) in binding medium (DMEM, 0.1% bovine serum albumin) at 37° C., and the ratio of internalized and surface radioactivity was determined during 5-min time course to calculate specific internalization rate constant $k_e$ as described previously (Jiang, X et al.). The measurements of the uptakes of radiolabeled transferrin and EGF were performed using short time-course assays to avoid influence of the recycling on the uptake kinetics, and using low ligand concentration to avoid saturation of the clathrin-dependent pathway (for EGF Lund, K. A., Opresko, L. K., Strarbuck, C., Walsh, B. J. & Wiley, H. S. (1990) *J. Biol. Chem.* 265, 15713-13723).

Figure 22:
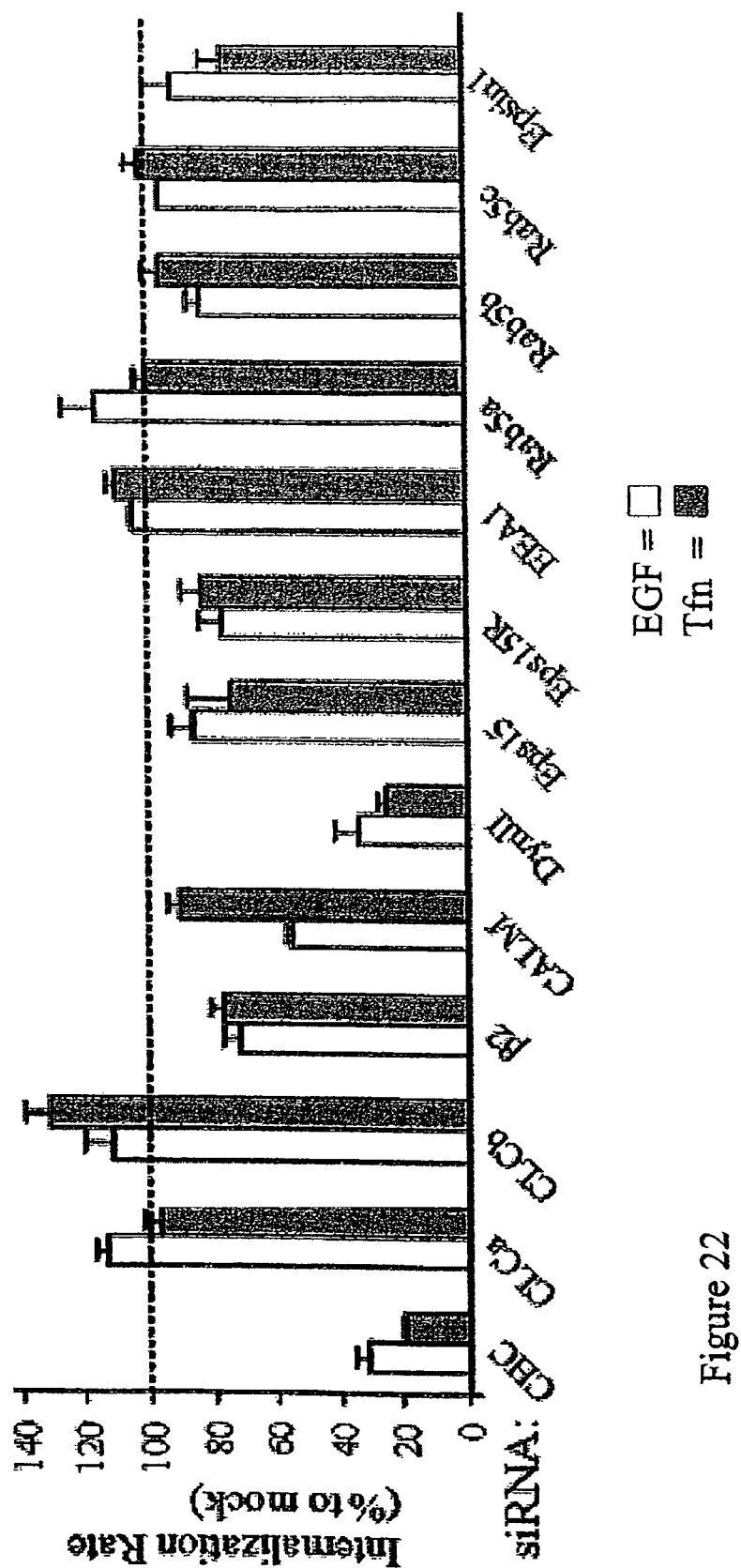
FIG. 22 showS the results of an EGFR and TfnR internalization assay when single gene knockdowns are performed. The Y-axis represents percent internalization relative to control.
Figure 23:
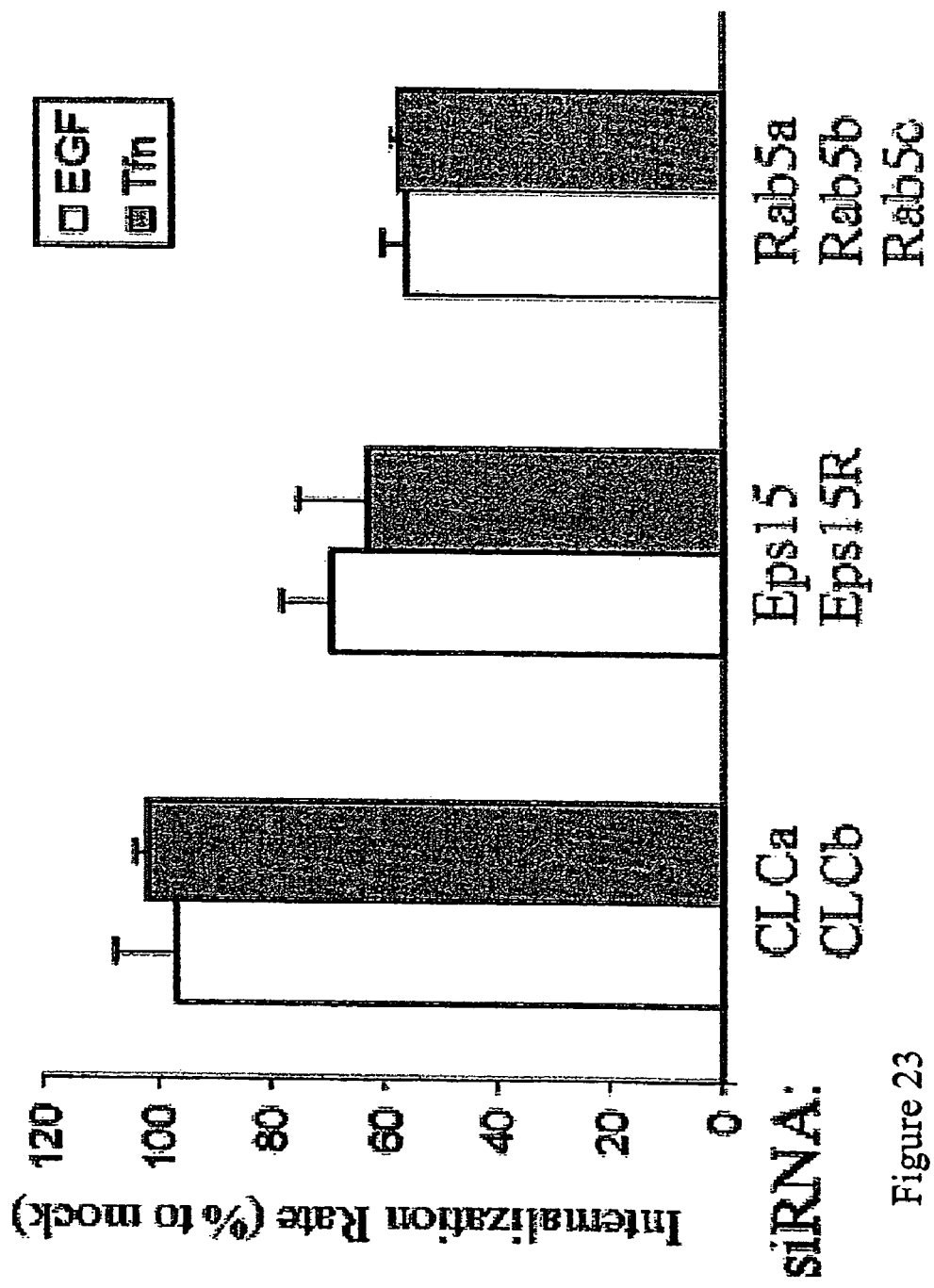
FIG. 23 shows the results of an EGFR and TfnR internalization assay when multiple genes are knocked down (e.g. Rab5a, b, c). The Y-axis represents the percent internalization relative to control.

The effects of knocking down Rab5a, 5b, 5c, Eps, or Eps 15R (individually) are shown in FIG. 22 and demonstrate that disruption of single genes has little or no effect on EGF or Tfn internalization. In contrast, simultaneous knock down of Rab5a, 5b, and 5c, or Eps and Eps 15R, leads to a distinct phenotype (note: total concentration of siRNA in these experiments remained constant with that in experiments in which a single siRNA was introduced, see FIG. 23). These experiments demonstrate the effectiveness of using rationally designed siRNA to knockdown multiple genes and validates the utility of these reagents to override genetic redundancy.

Example XIV

Validation of Multigene Targeting Using G6PD, GAPDH, PLK, and UQC

Figure 24:
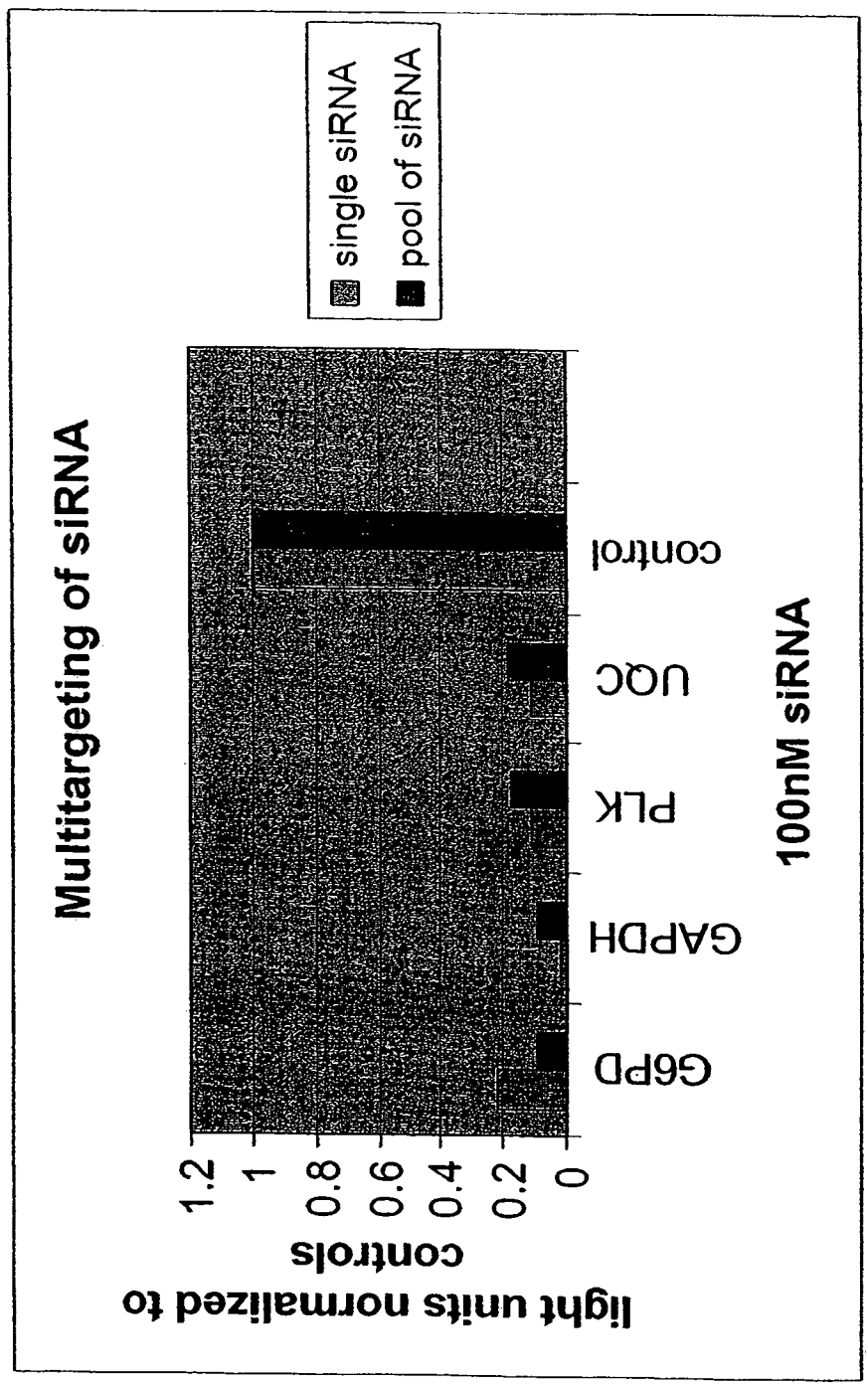
FIG. 24 shows the simultaneous knockdown of four different genes. SiRNAs directed against G6PD, GAPDH, PLK, and UBQ were simultaneously introduced into cells. Twenty-four hours later, cultures were harvested and assayed for mRNA target levels for each of the four genes. A comparison is made between cells transfected with individual siRNAs vs. a pool of siRNAs directed against all four genes.

Further demonstration of the ability to knock down expression of multiple genes using rationally designed siRNA was performed using pools of siRNA directed against four separate genes. To achieve this, siRNA were transfected into cells (total siRNA concentration of 100 nM) and assayed twenty-four hours later by B-DNA. Results shown in FIG. 24 show that pools of rationally designed molecules are capable of simultaneously silencing four different genes.

Example XV

Validation of Multigene Knockouts as Demonstrated by Gene Expression Profiling, a Prophetic Example To further demonstrate the ability to concomitantly knockdown the expression of multiple gene targets, single siRNA or siRNA pools directed against a collection of genes (e.g. 4, 8, 16, or 23 different targets) are simultaneously transfected into cells and cultured for twenty-four hours. Subsequently, mRNA is harvested from treated (and untreated) cells and labeled with one of two fluorescent probes dyes (e.g. a red fluorescent probe for the treated cells, a green fluorescent probe for the control cells.). Equivalent amounts of labeled RNA from each sample is then mixed together and hybridized to sequences that have been linked to a solid support (e.g. a slide, "DNA CHIP"). Following hybridization, the slides are washed and analyzed to assess changes in the levels of target genes induced by siRNA.

Example XVI

Identifying Hyperfunctional siRNA

Identification of Hyperfunctional Bcl-2 siRNA

Figure 25:
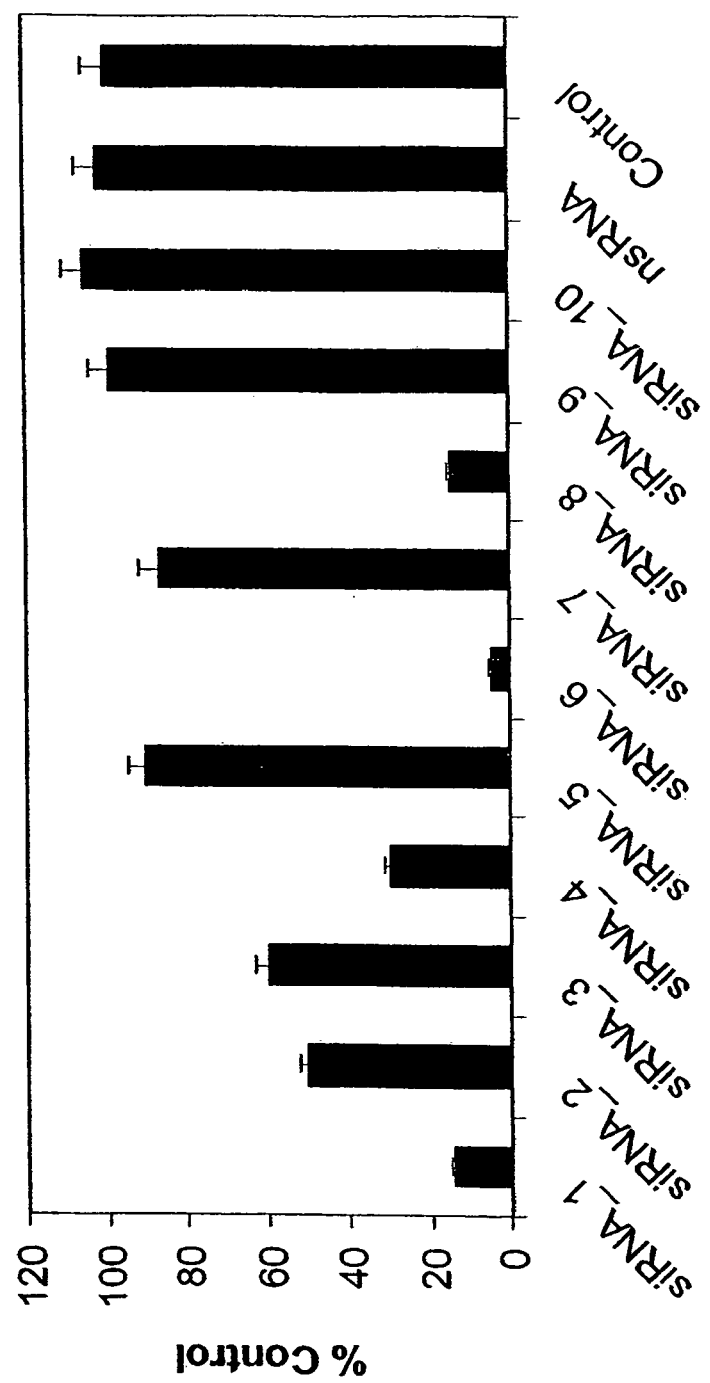
FIG. 25 shows the functionality of ten siRNAs at 0.3 nM concentrations.

The ten rationally designed Bcl2 siRNA (identified in FIG. 13, 14) were tested to identify hyperpotent reagents. To accomplish this, each of the ten Bcl-2 siRNA were individually transfected into cells at a 300 pM (0.3 nM) concentrations. Twenty-four hours later, transcript levels were assessed by B-DNA assays and compared with relevant controls. As shown in FIG. 25, while the majority of Bcl-2 siRNA failed to induce functional levels of silencing at this concentration siRNA 1 and 8 induced >80% silencing, and siRNA 6 exhibited greater than 90% silencing at this subnanomolar concentration.

By way of prophetic examples, similar assays could be performed with any of the groups of rationally designed genes described in Example VII or Example VIII. Thus for instance, rationally designed siRNA sequences directed against

```
PDGFA
(SEQ. ID NO. 2383: GGUAAGAUAUUGUGCUUUA,
SEQ. ID NO. 2384: CCGCAAAUAUGCAGAAUUA,
SEQ. ID NO. 2385: GGAUGUACAUGGCGUGUUA,
SEQ. ID NO. 2386: GGUGAAGUUUGUAUGUUUA),
```

-continued

```
or

PDGFB
(SEQ. ID NO. 2387: GCUCCGCGCUUUCCGAUUU,
 SEQ. ID NO. 2388: GAGCAGGAAUGGUGAGAUG,
 SEQ. ID NO. 2389: GAACUUGGGAUAAGAGUGU,
 SEQ. ID NO. 2390: CCGAGGAGCUUUAUGAGAU,
 SEQ. ID NO. 2391: UUUAUGAGAUGCUGAGUGA)
``` could be introduced into cells at increasingly limiting concentrations to determine whether any of the duplexes are hyperfunctional. Similarly, rationally designed sequences directed against

```
HIF1 alpha
(SEQ. ID NO. 2392: GAAGGAACCUGAUGCUUUA,
 SEQ. ID NO. 2393: GCAUAUAUCUAGAAGGUAU,
 SEQ. ID NO. 2394: GAACAAAUACAUGGGAUUA,
 SEQ. ID NO. 2395: GGACACAGAUUUAGACUUG),
or VEGF
(SEQ. ID NO. 2396: GAACGUACUUGCAGAUGUG,
 SEQ. ID NO. 2397: GAGAAAGCAUUUGUUUGUA,
 SEQ. ID NO. 2398: GGAGAAAGCAUUUGUUUGU,
 SEQ. ID NO. 2399: CGAGGCAGCUUGAGUUAAA)
``` could be introduced into cells at increasingly limiting concentrations and screened for hyperfunctional duplexes.

Example XVII

Gene Silencing: Prophetic Example

Below is an example of how one might transfect a cell.
  a. Select a cell line. The selection of a cell line is usually determined by the desired application. The most important feature to RNAi is the level of expression of the gene of interest. It is highly recommended to use cell lines for which siRNA transfection conditions have been specified and validated.
  b. Plate the cells. Approximately 24 hours prior to transfection, plate the cells at the appropriate density so that they will be approximately 70-90% confluent, or approximately $1 \times 10^5$ cells/ml at the time of transfection. Cell densities that are too low may lead to toxicity due to excess exposure and uptake of transfection reagent-siRNA complexes. Cell densities that are too high may lead to low transfection efficiencies and little or no silencing. Incubate the cells overnight. Standard incubation conditions for mammalian cells are 37° C. in 5% $CO_2$. Other cell types, such as insect cells, require different temperatures and $CO_2$ concentrations that are readily ascertainable by persons skilled in the art. Use conditions appropriate for the cell type of interest.
  c. SiRNA re-suspension. Add 20 µl siRNA universal buffer to each siRNA to generate a final concentration of 50 µM.
  d. SiRNA-lipid complex formation. Use RNase-free solutions and tubes. Using the following table, Table XI:
  e.

TABLE XI

|  | 96 well | 24 well |
|---|---|---|
| Mixture 1 (TransIT-TKO-Plasmid dilution mixture) | | |
| Opti-MEM | 9.3 µl | 46.5 µl |
| TransIT-TKO (1 µg/µl) | 0.5 µl | 2.5 µl |
| Mixture 1 Final Volume | 10.0 µl | 50.0 µl |

TABLE XI-continued

|  | 96 well | 24 well |
|---|---|---|
| Mixture 2 (siRNA dilation mixture) | | |
| Opti-MEM | 9.0 µl | 45.0 µl |
| siRNA (1 µM) | 1.0 µl | 5.0 µl |
| Mixture 2 Final Volume | 10.0 µl | 50.0 µl |
| Mixture 3 (siRNA-Transfection reagent mixture) | | |
| Mixture 1 | 10 µl | 50 µl |
| Mixture 2 | 10 µl | 50 µl |
| Mixture 3 Final Volume | 20 µl | 100 µl |
| Incubate 20 minutes at room temperature. | | |
| Mixture 4 (Media-siRNA/Transfection reagent mixture) | | |
| Mixture 3 | 20 µl | 100 µl |
| Complete media | 80 µl | 400 µl |
| Mixture 4 Final Volume | 100 µl | 500 µl |
| Incubate 48 hours at 37° C. | | |

Transfection. Create a Mixture 1 by combining the specified amounts of OPTI-MEM serum free media and transfection reagent in a sterile polystyrene tube. Create a Mixture 2 by combining specified amounts of each siRNA with OPTI-MEM media in sterile 1 ml tubes. Create a Mixture 3 by combining specified amounts of Mixture 1 and Mixture 2. Mix gently (do not vortex) and incubate at room temperature for 20 minutes. Create a Mixture 4 by combining specified amounts of Mixture 3 to complete media. Add appropriate volume to each cell culture well. Incubate cells with transfection reagent mixture for 24-72 hours at 37° C. This incubation time is flexible. The ratio of silencing will remain consistent at any point in the time period. Assay for gene silencing using an appropriate detection method such as RT-PCR, Western blot analysis, immunohistochemistry, phenotypic analysis, mass spectrometry, fluorescence, radioactive decay, or any other method that is now known or that comes to be known to persons skilled in the art and that from reading this disclosure would useful with the present invention. The optimal window for observing a knockdown phenotype is related to the mRNA turnover of the gene of interest, although 24-72 hours is standard. Final Volume reflects amount needed in each well for the desired cell culture format. When adjusting volumes for a Stock Mix, an additional 10% should be used to accommodate variability in pipetting, etc. Duplicate or triplicate assays should be carried out when possible.

While the invention has been described in connection with specific embodiments thereof, it will be understood that it is capable of further modifications and this application is intended to cover any variations, uses, or adaptations of the invention following, in general, the principles of the invention and including such departure from the present disclosure as come within known or customary practice within the art to which the invention pertains and as may be applied to the essential features hereinbefore set forth and as follows in the scope of the appended claims.

SEQUENCE LISTING (1591911 sequences)

SEQ ID NO: 1 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnanannnnucnaannnna

SEQ ID NO: 2 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnanannnnugnaannnna

SEQ ID NO: 3 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnanannnnuunaannnna

SEQ ID NO: 4 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnanannnnucncannnna

SEQ ID NO: 5 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnanannnnugncannnna

SEQ ID NO: 6 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnanannnnuuncannnna

SEQ ID NO: 7 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnanannnnucnuannnna

SEQ ID NO: 8 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnanannnnugnuannnna

SEQ ID NO: 9 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnanannnnuunuannnna

SEQ ID NO: 10 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnancnnnnucnaannnna

SEQ ID NO: 11 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnancnnnnugnaannnna

SEQ ID NO: 12 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnancnnnnuunaannnna

SEQ ID NO: 13 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnancnnnnucncannnna

SEQ ID NO: 14 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnancnnnnugncannnna

SEQ ID NO: 15 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnancnnnnuuncannnna

SEQ ID NO: 16 - RNA, 18 nt, Artificial Sequence
  siRNA sense strand
  misc_feature (1)...(1): n is any nucleotide
  misc_feature (3)...(3): n is any nucleotide
  misc_feature (5)...(8): n is any nucleotide
  misc_feature (11)...(11): n is any nucleotide
  misc_feature (14)...(18): n is any nucleotide
nancnnnnucnuannnna

SEQ ID NO: 17 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnancnnnnugnuannnna

SEQ ID NO: 18 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnancnnnnuunuannnna

SEQ ID NO: 19 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(19): n is any nucleotide
nnangnnnnucnaannnna

SEQ ID NO: 20 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnangnnnnugnaannnna

SEQ ID NO: 21 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(19): n is any nucleotide
nnangnnnnuunaannnna

SEQ ID NO: 22 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnangnnnnucncannnna

SEQ ID NO: 23 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnangnnnnugncannnna

SEQ ID NO: 24 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnangnnnnuuncannnna

SEQ ID NO: 25 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnangnnnnucnuannnna

SEQ ID NO: 26 - RNA, 19 nt, Artificial Sequence
  siRNA sense strand
  misc_feature (1)...(2): n is any nucleotide
  misc_feature (4)...(4): n is any nucleotide
  misc_feature (6)...(9): n is any nucleotide
  misc_feature (12)...(12): n is any nucleotide
  misc_feature (15)...(18): n is any nucleotide
nnangnnnnugnuannnna

SEQ ID NO: 27 - RNA, 19 nt, Artificial Sequence
  siRNA sense strand
  misc_feature (1)...(2): n is any nucleotide
  misc_feature (4)...(4): n is any nucleotide
  misc_feature (6)...(10): n is any nucleotide
  misc_feature (12)...(12): n is any nucleotide
  misc_feature (15)...(18): n is any nucleotide
nnangnnnnnunuannnna

SEQ ID NO: 28 - RNA, 22 nt, Artificial Sequence
  siRNA sense strand
  misc_feature (4)...(5): n is any nucleotide
  misc_feature (7)...(7): n is any nucleotide
  misc_feature (9)...(12): n is any nucleotide
  misc_feature (14)...(14): n is any nucleotide
  misc_feature (17)...(20): n is any nucleotide
gucnnanannnnucnaannnna

SEQ ID NO: 29 - RNA, 208 nt, Homo sapiens
  misc_RNA (1)...(208): human cyclophilin mRNA fragment
guuccaaaaacaguggauaauuuuguggccuuagcuacaggagagaaaggauuuggcuacaaaaacagcaaauuccaucguguaaucaaggacuucaugauccagggcggagacuucaccaggggagauggcacaggaggaaagagcaucuacggugagcgcuuccccgaugagaacuucaaacugaagcacuacgggccuggcuggg

SEQ ID NO: 30 - RNA, 200 nt, photinus pyralis
  misc_RNA (1)...(200): firefly luciferase mRNA fragment
ugaacuucccgccgccguuguuguuuuggagcacggaaagacgaugacggaaaaagagaucguggauuacgucgccagucaaguaacaaccgcgaaaaaguugcgcggaggaguuguguuuguggacgaaguaccgaaaggucuuaccggaaaacucgacgcaagaaaaaucagagagauccucauaaaggccaagaagg

SEQ ID NO: 31 - RNA, 108 nt, Homo sapiens
  misc_RNA (1)...(108): human DBL mRNA fragment
acgggcaaggccaagugggaugccuggaaugagcugaaagggacuuccaaggaagaugccaugaaagcuuacaucaacaaaguagaagagcuaaagaaaaaauacggg

SEQ ID NO: 32 - RNA, 19 nt, Homo sapiens
guuccaaaaacaguggaua

SEQ ID NO: 33 - RNA, 19 nt, Homo sapiens
uccaaaaacaguggauaau

SEQ ID NO: 34 - RNA, 19 nt, Homo sapiens
caaaaacaguggauaauuu

SEQ ID NO: 35 - RNA, 19 nt, Homo sapiens
aaaacaguggauaauuuug

SEQ ID NO: 36 - RNA, 19 nt, Homo sapiens
aacaguggauaauuuugug

SEQ ID NO: 37 - RNA, 19 nt, Homo sapiens
caguggauaauuuuguggc

SEQ ID NO: 38 - RNA, 19 nt, Homo sapiens
  misc_RNA (1)...(19): siRNA sense strand
guggauaauuuuguggccu

SEQ ID NO: 39 - RNA, 19 nt, Homo sapiens
ggauaauuuuguggccuua

SEQ ID NO: 40 - RNA, 19 nt, Homo sapiens
auaauuuuguggccuuagc

SEQ ID NO: 41 - RNA, 19 nt, Homo sapiens
aauuuuguggccuuagcua

SEQ ID NO: 42 - RNA, 19 nt, Homo sapiens
uuuuguggccuuagcuaca

SEQ ID NO: 43 - RNA, 19 nt, Homo sapiens
uuguggccuuagcuacagg

SEQ ID NO: 44 - RNA, 19 nt, Homo sapiens
guggccuuagcuacaggag

SEQ ID NO: 45 - RNA, 19 nt, Homo sapiens
ggccuuagcuacaggagag

SEQ ID NO: 46 - RNA, 19 nt, Homo sapiens
ccuuagcuacaggagagaa

SEQ ID NO: 47 - RNA, 19 nt, Homo sapiens
uuagcuacaggagagaaag

SEQ ID NO: 48 - RNA, 19 nt, Homo sapiens
agcuacaggagagaaagga

SEQ ID NO: 49 - RNA, 19 nt, Homo sapiens
cuacaggagagaaaggauu

SEQ ID NO: 50 - RNA, 19 nt, Homo sapiens
acaggagagaaaggauuug

SEQ ID NO: 51 - RNA, 19 nt, Homo sapiens
aggagagaaaggauuuggc

SEQ ID NO: 52 - RNA, 19 nt, Homo sapiens
gagagaaaggauuuggcua

SEQ ID NO: 53 - RNA, 19 nt, Homo sapiens
gagaaaggauuuggcuaca

SEQ ID NO: 54 - RNA, 19 nt, Homo sapiens
gaaaggauuuggcuacaaa

SEQ ID NO: 55 - RNA, 19 nt, Homo sapiens
aaggauuuggcuacaaaaa

SEQ ID NO: 56 - RNA, 19 nt, Homo sapiens
ggauuuggcuacaaaaaca

SEQ ID NO: 57 - RNA, 19 nt, Homo sapiens
auuuggcuacaaaaacagc

SEQ ID NO: 58 - RNA, 19 nt, Homo sapiens
uuggcuacaaaaacagcaa

SEQ ID NO: 59 - RNA, 19 nt, Homo sapiens
ggcuacaaaaacagcaaau

SEQ ID NO: 60 - RNA, 19 nt, Homo sapiens
cuacaaaaacagcaaauuc

SEQ ID NO: 61 - RNA, 19 nt, Homo sapiens
acaaaaacagcaaauucca

SEQ ID NO: 62 - RNA, 19 nt, Homo sapiens
aaaaacagcaaauuccauc

SEQ ID NO: 63 - RNA, 19 nt, Homo sapiens
aaacagcaaauuccaucgu

SEQ ID NO: 64 - RNA, 19 nt, Homo sapiens
acagcaaauuccaucgugu

SEQ ID NO: 65 - RNA, 19 nt, Homo sapiens
agcaaauuccaucguguaa

SEQ ID NO: 66 - RNA, 19 nt, Homo sapiens
caaauuccaucguguaauc

SEQ ID NO: 67 - RNA, 19 nt, Homo sapiens
aauuccaucguguaaucaa

SEQ ID NO: 68 - RNA, 19 nt, Homo sapiens
uuccaucguguaaucaagg

SEQ ID NO: 69 - RNA, 19 nt, Homo sapiens
ccaucguguaaucaaggac

SEQ ID NO: 70 - RNA, 19 nt, Homo sapiens
aucguguaaucaaggacuu

SEQ ID NO: 71 - RNA, 19 nt, Homo sapiens
cguguaaucaaggacuuca

SEQ ID NO: 72 - RNA, 19 nt, Homo sapiens
uguaaucaaggacuucaug

SEQ ID NO: 73 - RNA, 19 nt, Homo sapiens
uaaucaaggacuucaugau

SEQ ID NO: 74 - RNA, 19 nt, Homo sapiens
aucaaggacuucaugaucc

SEQ ID NO: 75 - RNA, 19 nt, Homo sapiens
caaggacuucaugauccag

SEQ ID NO: 76 - RNA, 19 nt, Homo sapiens
aggacuucaugauccaggg

SEQ ID NO: 77 - RNA, 19 nt, Homo sapiens
gacuucaugauccagggcg

SEQ ID NO: 78 - RNA, 19 nt, Homo sapiens
cuucaugauccagggcgga

SEQ ID NO: 79 - RNA, 19 nt, Homo sapiens
ucaugauccagggcggaga

SEQ ID NO: 80 - RNA, 19 nt, Homo sapiens
augauccagggcggagacu

SEQ ID NO: 81 - RNA, 19 nt, Homo sapiens
gauccagggcggagacuuc

SEQ ID NO: 82 - RNA, 19 nt, Homo sapiens
uccagggcggagacuucac

SEQ ID NO: 83 - RNA, 19 nt, Homo sapiens
cagggcggagacuucacca

SEQ ID NO: 84 - RNA, 19 nt, Homo sapiens
gggcggagacuucaccagg

SEQ ID NO: 85 - RNA, 19 nt, Homo sapiens
gcggagacuucaccagggg

SEQ ID NO: 86 - RNA, 19 nt, Homo sapiens
ggagacuucaccaggggag

SEQ ID NO: 87 - RNA, 19 nt, Homo sapiens
agacuucaccaggggagau

SEQ ID NO: 88 - RNA, 19 nt, Homo sapiens
acuucaccaggggagaugg

SEQ ID NO: 89 - RNA, 19 nt, Homo sapiens
uucaccaggggagauggca

SEQ ID NO: 90 - RNA, 19 nt, Homo sapiens
caccaggggagauggcaca

SEQ ID NO: 91 - RNA, 19 nt, Homo sapiens
ccaggggagauggcacagg

SEQ ID NO: 92 - RNA, 19 nt, Homo sapiens
aggggagauggcacaggag

SEQ ID NO: 93 - RNA, 19 nt, Homo sapiens
gggagauggcacaggagga

SEQ ID NO: 94 - RNA, 19 nt, Homo sapiens
gagauggcacaggaggaaa

SEQ ID NO: 95 - RNA, 19 nt, Homo sapiens
gauggcacaggaggaaaga

SEQ ID NO: 96 - RNA, 19 nt, Homo sapiens
gcacaggaggaaagagcau

SEQ ID NO: 97 - RNA, 19 nt, Homo sapiens
acaggaggaaagagcaucu

SEQ ID NO: 98 - RNA, 19 nt, Homo sapiens
aggaggaaagagcaucuac

SEQ ID NO: 99 - RNA, 19 nt, Homo sapiens
gaggaaagagcaucuacgg

SEQ ID NO: 100 - RNA, 19 nt, Homo sapiens
ggaaagagcaucuacggug

SEQ ID NO: 101 - RNA, 19 nt, Homo sapiens
aaagagcaucuacggugag

SEQ ID NO: 102 - RNA, 19 nt, Homo sapiens
agagcaucuacggugagcg

SEQ ID NO: 103 - RNA, 19 nt, Homo sapiens
agcaucuacggugagcgcu

SEQ ID NO: 104 - RNA, 19 nt, Homo sapiens
caucuacggugagcgcuuc

SEQ ID NO: 105 - RNA, 19 nt, Homo sapiens
ucuacggugagcgcuuccc

SEQ ID NO: 106 - RNA, 19 nt, Homo sapiens
uacggugagcgcuuccccg

SEQ ID NO: 107 - RNA, 19 nt, Homo sapiens
cggugagcgcuuccccgau

SEQ ID NO: 108 - RNA, 19 nt, Homo sapiens
gugagcgcuuccccgauga

SEQ ID NO: 109 - RNA, 19 nt, Homo sapiens
gagcgcuuccccgaugaga

SEQ ID NO: 110 - RNA, 19 nt, Homo sapiens
gcgcuuccccgaugagaac

SEQ ID NO: 111 - RNA, 19 nt, Homo sapiens
gcuuccccgaugagaacuu

SEQ ID NO: 112 - RNA, 19 nt, Homo sapiens
uuccccgaugagaacuuca

SEQ ID NO: 113 - RNA, 19 nt, Homo sapiens
ccccgaugagaacuucaaa

SEQ ID NO: 114 - RNA, 19 nt, Homo sapiens
ccgaugagaacuucaaacu

SEQ ID NO: 115 - RNA, 19 nt, Homo sapiens
gaugagaacuucaaacuga

SEQ ID NO: 116 - RNA, 19 nt, Homo sapiens
ugagaacuucaaacugaag

SEQ ID NO: 117 - RNA, 19 nt, Homo sapiens
agaacuucaaacugaagca

SEQ ID NO: 118 - RNA, 19 nt, Homo sapiens
aacuucaaacugaagcacu

SEQ ID NO: 119 - RNA, 19 nt, Homo sapiens
cuucaaacugaagcacuac

SEQ ID NO: 120 - RNA, 19 nt, Homo sapiens
ucaaacugaagcacuacgg

SEQ ID NO: 121 - RNA, 19 nt, Homo sapiens
acgggcaaggccaaguggg

SEQ ID NO: 122 - RNA, 19 nt, Homo sapiens
cgggcaaggccaaguggga

SEQ ID NO: 123 - RNA, 19 nt, Homo sapiens
gggcaaggccaagugggau

SEQ ID NO: 124 - RNA, 19 nt, Homo sapiens
ggcaaggccaagugggaug

SEQ ID NO: 125 - RNA, 19 nt, Homo sapiens
gcaaggccaagugggaugc

SEQ ID NO: 126 - RNA, 19 nt, Homo sapiens
caaggccaagugggaugcc

SEQ ID NO: 127 - RNA, 19 nt, Homo sapiens
aaggccaagugggaugccu

SEQ ID NO: 128 - RNA, 19 nt, Homo sapiens
aggccaagugggaugccug

SEQ ID NO: 129 - RNA, 19 nt, Homo sapiens
ggccaagugggaugccugg

SEQ ID NO: 130 - RNA, 19 nt, Homo sapiens
gccaagugggaugccugga

SEQ ID NO: 131 - RNA, 19 nt, Homo sapiens
ccaagugggaugccuggaa

SEQ ID NO: 132 - RNA, 19 nt, Homo sapiens
caagugggaugccuggaau

SEQ ID NO: 133 - RNA, 19 nt, Homo sapiens
aagugggaugccuggaaug

SEQ ID NO: 134 - RNA, 19 nt, Homo sapiens
agugggaugccuggaauga

SEQ ID NO: 135 - RNA, 19 nt, Homo sapiens
gugggaugccuggaaugag

SEQ ID NO: 136 - RNA, 19 nt, Homo sapiens
ugggaugccuggaaugagc

SEQ ID NO: 137 - RNA, 19 nt, Homo sapiens
gggaugccuggaaugagcu

SEQ ID NO: 138 - RNA, 19 nt, Homo sapiens
ggaugccuggaaugagcug

SEQ ID NO: 139 - RNA, 19 nt, Homo sapiens
gaugccuggaaugagcuga

SEQ ID NO: 140 - RNA, 19 nt, Homo sapiens
augccuggaaugagcugaa

SEQ ID NO: 141 - RNA, 19 nt, Homo sapiens
ugccuggaaugagcugaaa

SEQ ID NO: 142 - RNA, 19 nt, Homo sapiens
gccuggaaugagcugaaag

SEQ ID NO: 143 - RNA, 19 nt, Homo sapiens
ccuggaaugagcugaaagg

SEQ ID NO: 144 - RNA, 19 nt, Homo sapiens
cuggaaugagcugaaaggg

SEQ ID NO: 145 - RNA, 19 nt, Homo sapiens
uggaaugagcugaaaggga

SEQ ID NO: 146 - RNA, 19 nt, Homo sapiens
ggaaugagcugaaagggac

SEQ ID NO: 147 - RNA, 19 nt, Homo sapiens
gaaugagcugaaagggacu

SEQ ID NO: 148 - RNA, 19 nt, Homo sapiens
aaugagcugaaagggacuu

SEQ ID NO: 149 - RNA, 19 nt, Homo sapiens
augagcugaaagggacuuc

SEQ ID NO: 150 - RNA, 19 nt, Homo sapiens
ugagcugaaagggacuucc

SEQ ID NO: 151 - RNA, 19 nt, Homo sapiens
gagcugaaagggacuucca

SEQ ID NO: 152 - RNA, 19 nt, Homo sapiens
agcugaaagggacuuccaa

SEQ ID NO: 153 - RNA, 19 nt, Homo sapiens
gcugaaagggacuuccaag

SEQ ID NO: 154 - RNA, 19 nt, Homo sapiens
cugaaagggacuuccaagg

SEQ ID NO: 155 - RNA, 19 nt, Homo sapiens
ugaaagggacuuccaagga

SEQ ID NO: 156 - RNA, 19 nt, Homo sapiens
gaaagggacuuccaaggaa

SEQ ID NO: 157 - RNA, 19 nt, Homo sapiens
aaagggacuuccaaggaag

SEQ ID NO: 158 - RNA, 19 nt, Homo sapiens
aagggacuuccaaggaaga

SEQ ID NO: 159 - RNA, 19 nt, Homo sapiens
agggacuuccaaggaagau

SEQ ID NO: 160 - RNA, 19 nt, Homo sapiens
gggacuuccaaggaagaug

SEQ ID NO: 161 - RNA, 19 nt, Homo sapiens
ggacuuccaaggaagaugc

SEQ ID NO: 162 - RNA, 19 nt, Homo sapiens
gacuuccaaggaagaugcc

SEQ ID NO: 163 - RNA, 19 nt, Homo sapiens
acuuccaaggaagaugcca

SEQ ID NO: 164 - RNA, 19 nt, Homo sapiens
cuuccaaggaagaugccau

SEQ ID NO: 165 - RNA, 19 nt, Homo sapiens
uuccaaggaagaugccaug

SEQ ID NO: 166 - RNA, 19 nt, Homo sapiens
uccaaggaagaugccauga

SEQ ID NO: 167 - RNA, 19 nt, Homo sapiens
ccaaggaagaugccaugaa

SEQ ID NO: 168 - RNA, 19 nt, Homo sapiens
caaggaagaugccaugaaa

SEQ ID NO: 169 - RNA, 19 nt, Homo sapiens
aaggaagaugccaugaaag

SEQ ID NO: 170 - RNA, 19 nt, Homo sapiens
aggaagaugccaugaaagc

SEQ ID NO: 171 - RNA, 19 nt, Homo sapiens
ggaagaugccaugaaagcu

SEQ ID NO: 172 - RNA, 19 nt, Homo sapiens
gaagaugccaugaaagcuu

SEQ ID NO: 173 - RNA, 19 nt, Homo sapiens
aagaugccaugaaagcuua

SEQ ID NO: 174 - RNA, 19 nt, Homo sapiens
agaugccaugaaagcuuac

SEQ ID NO: 175 - RNA, 19 nt, Homo sapiens
gaugccaugaaagcuuaca

SEQ ID NO: 176 - RNA, 19 nt, Homo sapiens
augccaugaaagcuuacau

SEQ ID NO: 177 - RNA, 19 nt, Homo sapiens
ugccaugaaagcuuacauc

SEQ ID NO: 178 - RNA, 19 nt, Homo sapiens
gccaugaaagcuuacauca

SEQ ID NO: 179 - RNA, 19 nt, Homo sapiens
ccaugaaagcuuacaucaa

SEQ ID NO: 180 - RNA, 19 nt, Homo sapiens
caugaaagcuuacaucaac

SEQ ID NO: 181 - RNA, 19 nt, Homo sapiens
augaaagcuuacaucaaca

SEQ ID NO: 182 - RNA, 19 nt, Homo sapiens
ugaaagcuuacaucaacaa

SEQ ID NO: 183 - RNA, 19 nt, Homo sapiens
gaaagcuuacaucaacaaa

SEQ ID NO: 184 - RNA, 19 nt, Homo sapiens
aaagcuuacaucaacaaag

SEQ ID NO: 185 - RNA, 19 nt, Homo sapiens
aagcuuacaucaacaaagu

SEQ ID NO: 186 - RNA, 19 nt, Homo sapiens
agcuuacaucaacaaagua

SEQ ID NO: 187 - RNA, 19 nt, Homo sapiens
gcuuacaucaacaaaguag

SEQ ID NO: 188 - RNA, 19 nt, Homo sapiens
cuuacaucaacaaaguaga

SEQ ID NO: 189 - RNA, 19 nt, Homo sapiens
uuacaucaacaaaguagaa

SEQ ID NO: 190 - RNA, 19 nt, Homo sapiens
uacaucaacaaaguagaag

SEQ ID NO: 191 - RNA, 19 nt, Homo sapiens
acaucaacaaaguagaaga

SEQ ID NO: 192 - RNA, 19 nt, Homo sapiens
caucaacaaaguagaagag

SEQ ID NO: 193 - RNA, 19 nt, Homo sapiens
aucaacaaaguagaagagc

SEQ ID NO: 194 - RNA, 19 nt, Homo sapiens
ucaacaaaguagaagagcu

SEQ ID NO: 195 - RNA, 19 nt, Homo sapiens
caacaaaguagaagagcua

SEQ ID NO: 196 - RNA, 19 nt, Homo sapiens
aacaaaguagaagagcuaa

SEQ ID NO: 197 - RNA, 19 nt, Homo sapiens
acaaaguagaagagcuaaa

SEQ ID NO: 198 - RNA, 19 nt, Homo sapiens
caaaguagaagagcuaaag

SEQ ID NO: 199 - RNA, 19 nt, Homo sapiens
aaaguagaagagcuaaaga

SEQ ID NO: 200 - RNA, 19 nt, Homo sapiens
aaguagaagagcuaaagaa

SEQ ID NO: 201 - RNA, 19 nt, Homo sapiens
aguagaagagcuaaagaaa

SEQ ID NO: 202 - RNA, 19 nt, Homo sapiens
guagaagagcuaaagaaaa

SEQ ID NO: 203 - RNA, 19 nt, Homo sapiens
uagaagagcuaaagaaaaa

SEQ ID NO: 204 - RNA, 19 nt, Homo sapiens
agaagagcuaaagaaaaaa

SEQ ID NO: 205 - RNA, 19 nt, Homo sapiens
gaagagcuaaagaaaaaau

SEQ ID NO: 206 - RNA, 19 nt, Homo sapiens
aagagcuaaagaaaaaaua

SEQ ID NO: 207 - RNA, 19 nt, Homo sapiens
agagcuaaagaaaaaauac

SEQ ID NO: 208 - RNA, 19 nt, Homo sapiens
gagcuaaagaaaaaauacg

SEQ ID NO: 209 - RNA, 19 nt, Homo sapiens
agcuaaagaaaaaauacgg

SEQ ID NO: 210 - RNA, 19 nt, Homo sapiens
gcuaaagaaaaaauacggg

SEQ ID NO: 211 - RNA, 19 nt, Photinus pyralis
auccucauaaaggccaaga

SEQ ID NO: 212 - RNA, 19 nt, Photinus pyralis
agauccucauaaaggccaa

SEQ ID NO: 213 - RNA, 19 nt, Photinus pyralis
agagauccucauaaaggcc

SEQ ID NO: 214 - RNA, 19 nt, Photinus pyralis
agagagauccucauaaagg

SEQ ID NO: 215 - RNA, 19 nt, Photinus pyralis
ucagagagauccucauaaa

SEQ ID NO: 216 - RNA, 19 nt, Photinus pyralis
aaucagagagauccucaua

SEQ ID NO: 217 - RNA, 19 nt, Photinus pyralis
aaaaucagagagauccuca

SEQ ID NO: 218 - RNA, 19 nt, Photinus pyralis
gaaaaaucagagagauccu

SEQ ID NO: 219 - RNA, 19 nt, Homo sapiens
aagaaaaaucagagagauc

SEQ ID NO: 220 - RNA, 19 nt, Photinus pyralis
gcaagaaaaaucagagaga

SEQ ID NO: 221 - RNA, 19 nt, Photinus pyralis
acgcaagaaaaaucagaga

SEQ ID NO: 222 - RNA, 19 nt, Photinus pyralis
cgacgcaagaaaaaucaga

SEQ ID NO: 223 - RNA, 19 nt, Photinus pyralis
cucgacgcaagaaaaauca

SEQ ID NO: 224 - RNA, 19 nt, Photinus pyralis
aacucgacgcaagaaaaau

SEQ ID NO: 225 - RNA, 19 nt, Photinus pyralis
aaaacucgacgcaagaaaa

SEQ ID NO: 226 - RNA, 19 nt, Photinus pyralis
ggaaaacucgacgcaagaa

SEQ ID NO: 227 - RNA, 19 nt, Photinus pyralis
ccggaaaacucgacgcaag

SEQ ID NO: 228 - RNA, 19 nt, Photinus pyralis
uaccggaaaacucgacgca

SEQ ID NO: 229 - RNA, 19 nt, Photinus pyralis
cuuaccggaaaacucgacg

SEQ ID NO: 230 - RNA, 19 nt, Photinus pyralis
gucuuaccggaaaacucga

SEQ ID NO: 231 - RNA, 19 nt, Photinus pyralis
aggucuuaccggaaaacuc

SEQ ID NO: 232 - RNA, 19 nt, Photinus pyralis
aaaggucuuaccggaaaac

SEQ ID NO: 233 - RNA, 19 nt, Photinus pyralis
cgaaaggucuuaccggaaa

SEQ ID NO: 234 - RNA, 19 nt, Photinus pyralis
accgaaaggucuuaccgga

SEQ ID NO: 235 - RNA, 19 nt, Photinus pyralis
guaccgaaaggucuuaccg

SEQ ID NO: 236 - RNA, 19 nt, Photinus pyralis
aaguaccgaaaggucuuac

SEQ ID NO: 237 - RNA, 19 nt, Photinus pyralis
cgaaguaccgaaaggucuu

SEQ ID NO: 238 - RNA, 19 nt, Photinus pyralis
gacgaaguaccgaaagguc

SEQ ID NO: 239 - RNA, 19 nt, Photinus pyralis
uggacgaaguaccgaaagg

SEQ ID NO: 240 - RNA, 19 nt, Photinus pyralis
uguggacgaaguaccgaaa

SEQ ID NO: 241 - RNA, 19 nt, Photinus pyralis
uuuguggacgaaguaccga

SEQ ID NO: 242 - RNA, 19 nt, Photinus pyralis
uguuuguggacgaaguacc

SEQ ID NO: 243 - RNA, 19 nt, Photinus pyralis
uguguuuguggacgaagua

SEQ ID NO: 244 - RNA, 19 nt, Photinus pyralis
guuguguuuguggacgaag

SEQ ID NO: 245 - RNA, 19 nt, Photinus pyralis
gaguuguguuuguggacga

SEQ ID NO: 246 - RNA, 19 nt, Photinus pyralis
aggaguuguguuuguggac

SEQ ID NO: 247 - RNA, 19 nt, Photinus pyralis
ggaggaguuguguuugugg

SEQ ID NO: 248 - RNA, 19 nt, Photinus pyralis
gcggaggaguuguguuugu

SEQ ID NO: 249 - RNA, 19 nt, Photinus pyralis
gcgcggaggaguuguguuu

SEQ ID NO: 250 - RNA, 19 nt, Photinus pyralis
uugcgcggaggaguugugu

SEQ ID NO: 251 - RNA, 19 nt, Photinus pyralis
aguugcgcggaggaguugu

SEQ ID NO: 252 - RNA, 19 nt, Photinus pyralis
aaaguugcgcggaggaguu

SEQ ID NO: 253 - RNA, 19 nt, Photinus pyralis
aaaaaguugcgcggaggag

SEQ ID NO: 254 - RNA, 19 nt, Photinus pyralis
cgaaaaaguugcgcggagg

SEQ ID NO: 255 - RNA, 19 nt, Photinus pyralis
cgcgaaaaaguugcgcgga

SEQ ID NO: 256 - RNA, 19 nt, Photinus pyralis
accgcgaaaaaguugcgcg

SEQ ID NO: 257 - RNA, 19 nt, Photinus pyralis
caaccgcgaaaaaguugcg

SEQ ID NO: 258 - RNA, 19 nt, Photinus pyralis
aacaaccgcgaaaaaguug

SEQ ID NO: 259 - RNA, 19 nt, Photinus pyralis
guaacaaccgcgaaaaagu

SEQ ID NO: 260 - RNA, 19 nt, Photinus pyralis
aaguaacaaccgcgaaaaa

SEQ ID NO: 261 - RNA, 19 nt, Photinus pyralis
ucaaguaacaaccgcgaaa

SEQ ID NO: 262 - RNA, 19 nt, Photinus pyralis
agucaaguaacaaccgcga

SEQ ID NO: 263 - RNA, 19 nt, Photinus pyralis
ccagucaaguaacaaccgc

SEQ ID NO: 264 - RNA, 19 nt, Photinus pyralis
cgccagucaaguaacaacc

SEQ ID NO: 265 - RNA, 19 nt, Photinus pyralis
gucgccagucaaguaacaa

SEQ ID NO: 266 - RNA, 19 nt, Photinus pyralis
acgucgccagucaaguaac

SEQ ID NO: 267 - RNA, 19 nt, Photinus pyralis
uuacgucgccagucaagua

SEQ ID NO: 268 - RNA, 19 nt, Photinus pyralis
gauuacgucgccagucaag

SEQ ID NO: 269 - RNA, 19 nt, Photinus pyralis
uggauuacgucgccaguca

SEQ ID NO: 270 - RNA, 19 nt, Photinus pyralis
cguggauuacgucgccagu

SEQ ID NO: 271 - RNA, 19 nt, Photinus pyralis
aucguggauuacgucgcca

SEQ ID NO: 272 - RNA, 19 nt, Photinus pyralis
agaucguggauuacgucgc

SEQ ID NO: 273 - RNA, 19 nt, Photinus pyralis
agagaucguggauuacguc

SEQ ID NO: 274 - RNA, 19 nt, Photinus pyralis
aaagagaucguggauuacg

SEQ ID NO: 275 - RNA, 19 nt, Photinus pyralis
aaaaagagaucguggauua

SEQ ID NO: 276 - RNA, 19 nt, Photinus pyralis
ggaaaaagagaucguggau

SEQ ID NO: 277 - RNA, 19 nt, Photinus pyralis
acggaaaaagagaucgugg

SEQ ID NO: 278 - RNA, 19 nt, Photinus pyralis
ugacggaaaaagagaucgu

SEQ ID NO: 279 - RNA, 19 nt, Photinus pyralis
gaugacggaaaaagagauc

SEQ ID NO: 280 - RNA, 19 nt, Photinus pyralis
acgaugacggaaaaagaga

SEQ ID NO: 281 - RNA, 19 nt, Photinus pyralis
agacgaugacggaaaaaga

SEQ ID NO: 282 - RNA, 19 nt, Photinus pyralis
aaagacgaugacggaaaaa

SEQ ID NO: 283 - RNA, 19 nt, Photinus pyralis
ggaaagacgaugacggaaa

SEQ ID NO: 284 - RNA, 19 nt, Photinus pyralis
acggaaagacgaugacgga

SEQ ID NO: 285 - RNA, 19 nt, Photinus pyralis
gcacggaaagacgaugacg

SEQ ID NO: 286 - RNA, 19 nt, Photinus pyralis
gagcacggaaagacgauga

SEQ ID NO: 287 - RNA, 19 nt, Photinus pyralis
uggagcacggaaagacgau

SEQ ID NO: 288 - RNA, 19 nt, Photinus pyralis
uuuggagcacggaaagacg

SEQ ID NO: 289 - RNA, 19 nt, Photinus pyralis
guuuuggagcacggaaaga

SEQ ID NO: 290 - RNA, 19 nt, Photinus pyralis
uuguuuuggagcacggaaa

SEQ ID NO: 291 - RNA, 19 nt, Photinus pyralis
uguuguuuuggagcacgga

SEQ ID NO: 292 - RNA, 19 nt, Photinus pyralis
guuguuguuuuggagcacg

SEQ ID NO: 293 - RNA, 19 nt, Photinus pyralis
ccguuguuguuuuggagca

SEQ ID NO: 294 - RNA, 19 nt, Photinus pyralis
cgccguuguuguuuuggag

SEQ ID NO: 295 - RNA, 19 nt, Photinus pyralis
gccgccguuguuguuuugg

SEQ ID NO: 296 - RNA, 19 nt, Photinus pyralis
ccgccgccguuguuguuuu

SEQ ID NO: 297 - RNA, 19 nt, Photinus pyralis
ucccgccgccguuguuguu

SEQ ID NO: 298 - RNA, 19 nt, Photinus pyralis
cuucccgccgccguuguug

SEQ ID NO: 299 - RNA, 19 nt, Photinus pyralis
aacuucccgccgccguugu

SEQ ID NO: 300 - RNA, 19 nt, Photinus pyralis
ugaacuucccgccgccguu

SEQ ID NO: 301 - RNA, 19 nt, Homo sapiens
gggagauagugaugaagua

SEQ ID NO: 302 - RNA, 19 nt, Homo sapiens
gaaguacauccauuauaag

SEQ ID NO: 303 - RNA, 19 nt, Homo sapiens
guacgacaaccgggagaua

SEQ ID NO: 304 - RNA, 19 nt, Homo sapiens
agauagugaugaaguacau

SEQ ID NO: 305 - RNA, 19 nt, Homo sapiens
ugaagacucugcucaguuu

SEQ ID NO: 306 - RNA, 19 nt, Homo sapiens
gcaugcggccucuguuuga

SEQ ID NO: 307 - RNA, 19 nt, Homo sapiens
ugcggccucuguuugauuu

SEQ ID NO: 308 - RNA, 19 nt, Homo sapiens
gagauagugaugaaguaca

SEQ ID NO: 309 - RNA, 19 nt, Homo sapiens
ggagauagugaugaaguac

SEQ ID NO: 310 - RNA, 19 nt, Homo sapiens
gaagacucugcucaguuug

SEQ ID NO: 311 - RNA, 19 nt, Homo sapiens
ggaaccagcgccagaguga

SEQ ID NO: 312 - RNA, 19 nt, Homo sapiens
gagcgagauugcaggcaua

SEQ ID NO: 313 - RNA, 19 nt, Homo sapiens
guuaguaucugaugacuug

SEQ ID NO: 314 - RNA, 19 nt, Homo sapiens
gaaauggaaccacuaagaa

SEQ ID NO: 315 - RNA, 19 nt, Homo sapiens
ggaaauggaaccacuaaga

SEQ ID NO: 316 - RNA, 19 nt, Homo sapiens
caacuacacuuuccaaugc

SEQ ID NO: 317 - RNA, 19 nt, Homo sapiens
ccaccaagauuucaugaua

SEQ ID NO: 318 - RNA, 19 nt, Homo sapiens
gaucggaacuccaacaaga

SEQ ID NO: 319 - RNA, 19 nt, Homo sapiens
aaacggagcuacagauuau

SEQ ID NO: 320 - RNA, 19 nt, Homo sapiens
ccacacagcauucuuguaa

SEQ ID NO: 321 - RNA, 19 nt, Homo sapiens
gaaguuaccuugagcaauc

SEQ ID NO: 322 - RNA, 19 nt, Homo sapiens
ggacuuggccgauccagaa

SEQ ID NO: 323 - RNA, 19 nt, Homo sapiens
gcacuuggaucgagaugag

SEQ ID NO: 324 - RNA, 19 nt, Homo sapiens
caaagaccaauucgcguua

SEQ ID NO: 325 - RNA, 19 nt, Homo sapiens
ccgaaucaaucgcaucuuc

SEQ ID NO: 326 - RNA, 19 nt, Homo sapiens
gacaugauccugcaguuca

SEQ ID NO: 327 - RNA, 19 nt, Homo sapiens
gagcgaaucgucaccacuu

SEQ ID NO: 328 - RNA, 19 nt, Homo sapiens
ccuccgagcuggcgucuac

SEQ ID NO: 329 - RNA, 19 nt, Homo sapiens
ucacaugguuaaccucuaa

SEQ ID NO: 330 - RNA, 19 nt, Homo sapiens
gaugagggacgccauaauc

SEQ ID NO: 331 - RNA, 19 nt, Homo sapiens
ccucuaacuacaaaucuua

SEQ ID NO: 332 - RNA, 19 nt, Homo sapiens
ggaaggugcuauccaaaau

SEQ ID NO: 333 - RNA, 19 nt, Homo sapiens
gcaagcaaguccuaacauu

SEQ ID NO: 334 - RNA, 19 nt, Homo sapiens
ggaagaggaguagaccuua

SEQ ID NO: 335 - RNA, 19 nt, Homo sapiens
aggaaucaguguuguagua

SEQ ID NO: 336 - RNA, 19 nt, Homo sapiens
gaagaggaguagaccuuac

SEQ ID NO: 337 - RNA, 19 nt, Homo sapiens
gaaagucaagccugguauu

SEQ ID NO: 338 - RNA, 19 nt, Homo sapiens
aaagucaagccugguauua

SEQ ID NO: 339 - RNA, 19 nt, Homo sapiens
gcuaugaacgugaaugauc

SEQ ID NO: 340 - RNA, 19 nt, Homo sapiens
caagccugguauuacguuu

SEQ ID NO: 341 - RNA, 19 nt, Homo sapiens
ggaacaagaucugucaauu

SEQ ID NO: 342 - RNA, 19 nt, Homo sapiens
gcaaugaacgugaacgaaa

SEQ ID NO: 343 - RNA, 19 nt, Homo sapiens
caaugaacgugaacgaaau

SEQ ID NO: 344 - RNA, 19 nt, Homo sapiens
ggacaggagcgguaucaca

SEQ ID NO: 345 - RNA, 19 nt, Homo sapiens
agacagagcuugagaauaa

SEQ ID NO: 346 - RNA, 19 nt, Homo sapiens
gagaagaucuuuaugcaaa

SEQ ID NO: 347 - RNA, 19 nt, Homo sapiens
gaagagaaaucagcagaua

SEQ ID NO: 348 - RNA, 19 nt, Homo sapiens
gcaaguaacucaacuaaca

SEQ ID NO: 349 - RNA, 19 nt, Homo sapiens
gagcuaaucugccacauug

SEQ ID NO: 350 - RNA, 19 nt, Homo sapiens
gcagaugaguuacuagaaa

SEQ ID NO: 351 - RNA, 19 nt, Homo sapiens
caacuuaauuguccagaaa

SEQ ID NO: 352 - RNA, 19 nt, Homo sapiens
caacacaggauucugauaa

SEQ ID NO: 353 - RNA, 19 nt, Homo sapiens
agauugugccuaagucucu

SEQ ID NO: 354 - RNA, 19 nt, Homo sapiens
augaagaucuggaggugaa

SEQ ID NO: 355 - RNA, 19 nt, Homo sapiens
uuugagacuucuugccuaa

SEQ ID NO: 356 - RNA, 19 nt, Homo sapiens
agaucacccuccuuaaaua

SEQ ID NO: 357 - RNA, 19 nt, Homo sapiens
caacggauuuggucguauu

SEQ ID NO: 358 - RNA, 19 nt, Homo sapiens
gaaaucccaucaccaucuu

SEQ ID NO: 359 - RNA, 19 nt, Homo sapiens
gaccucaacuacaugguuu

SEQ ID NO: 360 - RNA, 19 nt, Homo sapiens
ugguuuacauguuccaaua

SEQ ID NO: 361 - RNA, 19 nt, Homo sapiens
gaagaaaucgauguuguuu

SEQ ID NO: 362 - RNA, 19 nt, Homo sapiens
acacaaacuugaacagcua

SEQ ID NO: 363 - RNA, 19 nt, Homo sapiens
ggaagaaaucgauguuguu

SEQ ID NO: 364 - RNA, 19 nt, Homo sapiens
gaaacgacgagaacaguug

SEQ ID NO: 365 - RNA, 19 nt, Homo sapiens
gcacauggauggagguucu

SEQ ID NO: 366 - RNA, 19 nt, Homo sapiens
gcagagagagcagauuuga

SEQ ID NO: 367 - RNA, 19 nt, Homo sapiens
gagguucucuggaucaagu

SEQ ID NO: 368 - RNA, 19 nt, Homo sapiens
gagcagauuugaagcaacu

SEQ ID NO: 369 - RNA, 19 nt, Homo sapiens
caaagacgaugacuucgaa

SEQ ID NO: 370 - RNA, 19 nt, Homo sapiens
gaucagcauuugcauggaa

SEQ ID NO: 371 - RNA, 19 nt, Homo sapiens
uccaggaguuugucaauaa

SEQ ID NO: 372 - RNA, 19 nt, Homo sapiens
ggaagcugauccaccuuga

SEQ ID NO: 373 - RNA, 19 nt, Homo sapiens
gcagaaaucuaaggauaua

SEQ ID NO: 374 - RNA, 19 nt, Homo sapiens
caacaaggaugaagucuau

SEQ ID NO: 375 - RNA, 19 nt, Homo sapiens
cagcagaaaucuaaggaua

SEQ ID NO: 376 - RNA, 19 nt, Homo sapiens
cuagauggcuuucucagua

SEQ ID NO: 377 - RNA, 19 nt, Homo sapiens
agacaaggucccaaagaca

SEQ ID NO: 378 - RNA, 19 nt, Homo sapiens
ggaauggcaagaccagcaa

SEQ ID NO: 379 - RNA, 19 nt, Homo sapiens
agaauuauuccaggguuua

SEQ ID NO: 380 - RNA, 19 nt, Homo sapiens
gcagacaaggucccaaaga

SEQ ID NO: 381 - RNA, 19 nt, Homo sapiens
agaagcagcuucaggauga

SEQ ID NO: 382 - RNA, 19 nt, Homo sapiens
gagcuugacuuccagaaga

SEQ ID NO: 383 - RNA, 19 nt, Homo sapiens
ccaccgaaguucacccuaa

SEQ ID NO: 384 - RNA, 19 nt, Homo sapiens
gagaagagcuccuccauca

SEQ ID NO: 385 - RNA, 19 nt, Homo sapiens
gaaagagcaucuacgguga

SEQ ID NO: 386 - RNA, 19 nt, Homo sapiens
gaaaggauuuggcuacaaa

SEQ ID NO: 387 - RNA, 19 nt, Homo sapiens
acagcaaauuccaucgugu

SEQ ID NO: 388 - RNA, 19 nt, Homo sapiens
ggaaagacuguuccaaaaa

SEQ ID NO: 389 - RNA, 19 nt, Homo sapiens
caacacgccucauccucua

SEQ ID NO: 390 - RNA, 19 nt, Homo sapiens
caugaaagcuuacaucaac

SEQ ID NO: 391 - RNA, 19 nt, Homo sapiens
aagaugccaugaaagcuua

SEQ ID NO: 392 - RNA, 19 nt, Homo sapiens
gcacauaccgccugagucu

SEQ ID NO: 393 - RNA, 19 nt, Homo sapiens
gaucaaaucugaagaagga

SEQ ID NO: 394 - RNA, 19 nt, Homo sapiens
gccaagaaguuuccuaaua

SEQ ID NO: 395 - RNA, 19 nt, Homo sapiens
cagcauaucuugaaccauu

SEQ ID NO: 396 - RNA, 19 nt, Homo sapiens
gaacaaaggaaacggauga

SEQ ID NO: 397 - RNA, 19 nt, Homo sapiens
cggaaacgguccaggcuau

SEQ ID NO: 398 - RNA, 19 nt, Homo sapiens
gcuucgagcagacaugaua

SEQ ID NO: 399 - RNA, 19 nt, Homo sapiens
ccuacacgguccuccuaua

SEQ ID NO: 400 - RNA, 19 nt, Homo sapiens
gccaagaaccucaucaucu

SEQ ID NO: 401 - RNA, 19 nt, Homo sapiens
gauaugggcugaauacaaa

SEQ ID NO: 402 - RNA, 19 nt, Homo sapiens
gcacucugauugacaaaua

SEQ ID NO: 403 - RNA, 19 nt, Homo sapiens
ugaagucucugauuaagua

SEQ ID NO: 404 - RNA, 19 nt, Homo sapiens
ucagagagauccucauaaa

SEQ ID NO: 405 - RNA, 19 nt, Homo sapiens
gcaagaagaucaccauuuc

SEQ ID NO: 406 - RNA, 19 nt, Homo sapiens
gagagaaauuugaggauga

SEQ ID NO: 407 - RNA, 19 nt, Homo sapiens
gaaaggauuuggcuauaag

SEQ ID NO: 408 - RNA, 19 nt, Homo sapiens
gaaagaaggcaugaacauu

SEQ ID NO: 409 - RNA, 19 nt, Homo sapiens
gggagauagugaugaagua

SEQ ID NO: 410 - RNA, 19 nt, Homo sapiens
gaaguacauccauuauaag

SEQ ID NO: 411 - RNA, 19 nt, Homo sapiens
guacgacaaccgggagaua

SEQ ID NO: 412 - RNA, 19 nt, Homo sapiens
agauagugaugaaguacau

SEQ ID NO: 413 - RNA, 19 nt, Homo sapiens
ugaagacucugcucaguuu

SEQ ID NO: 414 - RNA, 19 nt, Homo sapiens
gcaugcggccucuguuuga

SEQ ID NO: 415 - RNA, 19 nt, Homo sapiens
gcacacagcuuacuacauc

SEQ ID NO: 416 - RNA, 19 nt, Homo sapiens
gaaaugcccugguaucuca

SEQ ID NO: 417 - RNA, 19 nt, Homo sapiens
gaaggaacgugaugugauc

SEQ ID NO: 418 - RNA, 19 nt, Homo sapiens
gcacuacuccuguguguga

SEQ ID NO: 419 - RNA, 19 nt, Homo sapiens
gaacccagcuggagaacuu

SEQ ID NO: 420 - RNA, 19 nt, Homo sapiens
gauauacagugugaucuua

SEQ ID NO: 421 - RNA, 19 nt, Homo sapiens
guacuacgauccugauuau

SEQ ID NO: 422 - RNA, 19 nt, Homo sapiens
gugccgaccuuuacaauuu

SEQ ID NO: 423 - RNA, 19 nt, Homo sapiens
gaaggaaacugaauucaaa

SEQ ID NO: 424 - RNA, 19 nt, Homo sapiens
ggaaauauguacuacgaaa

SEQ ID NO: 425 - RNA, 19 nt, Homo sapiens
ccacaaagcagugaauuua

SEQ ID NO: 426 - RNA, 19 nt, Homo sapiens
guaacaagcucacgcaguu

SEQ ID NO: 427 - RNA, 19 nt, Homo sapiens
ggaaaccucucauugcuaa

SEQ ID NO: 428 - RNA, 19 nt, Homo sapiens
gaaagaaccuugccgauca

SEQ ID NO: 429 - RNA, 19 nt, Homo sapiens
ggaaauacaucagagcuua

SEQ ID NO: 430 - RNA, 19 nt, Homo sapiens
gaaaguaugugucuuaagu

SEQ ID NO: 431 - RNA, 19 nt, Homo sapiens
uggcacaggaggaaagagc

SEQ ID NO: 432 - RNA, 19 nt, Homo sapiens
uggaagccaucgccaaaua

SEQ ID NO: 433 - RNA, 19 nt, Homo sapiens
ugaaacggcugccugauuu

SEQ ID NO: 434 - RNA, 19 nt, Homo sapiens
gaaguuaccucuuacauuu

SEQ ID NO: 435 - RNA, 19 nt, Homo sapiens
guacgaaacuguaugauua

SEQ ID NO: 436 - RNA, 19 nt, Homo sapiens
ggacgaggcuaucauuaug

SEQ ID NO: 437 - RNA, 19 nt, Homo sapiens
gaaggaaccugaugcuuua

SEQ ID NO: 438 - RNA, 19 nt, Homo sapiens
gcauauaucuagaagguau

SEQ ID NO: 439 - RNA, 19 nt, Homo sapiens
gaacaaauacaugggauua

SEQ ID NO: 440 - RNA, 19 nt, Homo sapiens
ggacacagauuuagacuug

SEQ ID NO: 441 - RNA, 19 nt, Homo sapiens
gaacguacuugcagaugug

SEQ ID NO: 442 - RNA, 19 nt, Homo sapiens
gagaaagcauuuguuugua

SEQ ID NO: 443 - RNA, 19 nt, Homo sapiens
ggagaaagcauuuguuugu

SEQ ID NO: 444 - RNA, 19 nt, Homo sapiens
cgaggcagcuugaguuaaa

SEQ ID NO: 445 - RNA, 19 nt, Homo sapiens
gguaagauauugugcuuua

SEQ ID NO: 446 - RNA, 19 nt, Homo sapiens
ccgcaaauaugcagaauua

SEQ ID NO: 447 - RNA, 19 nt, Homo sapiens
ggauguacauggcguguua

SEQ ID NO: 448 - RNA, 19 nt, Homo sapiens
ggugaaguuuguauguuua

SEQ ID NO: 449 - RNA, 19 nt, Homo sapiens
ccgaggagcuuuaugagau

SEQ ID NO: 450 - RNA, 19 nt, Homo sapiens
gcuccgcgcuuuccgauuu

SEQ ID NO: 451 - RNA, 19 nt, Homo sapiens
gagcaggaauggugagaug

SEQ ID NO: 452 - RNA, 19 nt, Homo sapiens
gaacuugggauaagagugu

SEQ ID NO: 453 - RNA, 19 nt, Homo sapiens
ccgaggagcuuuaugagau

SEQ ID NO: 454 - RNA, 19 nt, Homo sapiens
uuuaugagaugcugaguga

SEQ ID NO: 455 - RNA, 19 nt, Homo sapiens
gcaaugauguccagaagaa

SEQ ID NO: 456 - RNA, 19 nt, Homo sapiens
gaagaauauucaggacuua

SEQ ID NO: 457 - RNA, 19 nt, Homo sapiens
gaagagagucggcagauga

SEQ ID NO: 458 - RNA, 19 nt, Homo sapiens
ccaagagugugcuaaagaa

SEQ ID NO: 459 - RNA, 19 nt, Homo sapiens
gagacacucugaaaugaua

SEQ ID NO: 460 - RNA, 19 nt, Homo sapiens
gaaaugauguggauaagag

SEQ ID NO: 461 - RNA, 19 nt, Homo sapiens
gaucaaauccucccugaaa

SEQ ID NO: 462 - RNA, 19 nt, Homo sapiens
ugaaugagcugaugauugu

SEQ ID NO: 463 - RNA, 9 nt, Homo sapiens
gaccaccca

SEQ ID NO: 464 - RNA, 10 nt, Homo sapiens
gaaccaccca

SEQ ID NO: 465 - RNA, 19 nt, Homo sapiens
gacaaggacgggcacauua

SEQ ID NO: 466 - RNA, 19 nt, Homo sapiens
ggacaaggacgggcacauu

SEQ ID NO: 467 - RNA, 19 nt, Homo sapiens
gcuacuuccuccucaagaa

SEQ ID NO: 468 - RNA, 19 nt, Homo sapiens
gaccgccucugcuuuguca

SEQ ID NO: 469 - RNA, 19 nt, Homo sapiens
guacuucgaugaugaauuu

SEQ ID NO: 470 - RNA, 19 nt, Homo sapiens
gcaaagagggcaucaguga

SEQ ID NO: 471 - RNA, 19 nt, Homo sapiens
gggcuaaagugaccaugaa

SEQ ID NO: 472 - RNA, 19 nt, Homo sapiens
gcagaaugccagcugauga

SEQ ID NO: 473 - RNA, 19 nt, Homo sapiens
ggaguaaacuggcaagaug

SEQ ID NO: 474 - RNA, 19 nt, Homo sapiens
gacauuaaauuuccucgaa

SEQ ID NO: 475 - RNA, 19 nt, Homo sapiens
gaccaaagccaaacacauu

SEQ ID NO: 476 - RNA, 19 nt, Homo sapiens
gaggagagaaugaauugua

SEQ ID NO: 477 - RNA, 19 nt, Homo sapiens
ggagacacauuucggauua

SEQ ID NO: 478 - RNA, 19 nt, Homo sapiens
gaucugaccugcaaugauu

SEQ ID NO: 479 - RNA, 19 nt, Homo sapiens
gacaaucccucacaauaaa

SEQ ID NO: 480 - RNA, 19 nt, Homo sapiens
ccagaaagcuuuggucauu

SEQ ID NO: 481 - RNA, 19 nt, Homo sapiens
gaccauaccucauaacaag

SEQ ID NO: 482 - RNA, 19 nt, Homo sapiens
ugaaagaccuccaccaauc

SEQ ID NO: 483 - RNA, 19 nt, Homo sapiens
gaugaaggcuccagguguu

SEQ ID NO: 484 - RNA, 19 nt, Homo sapiens
uaucagcauuuacgacuua

SEQ ID NO: 485 - RNA, 19 nt, Homo sapiens
gcaauagcccagaagauaa

SEQ ID NO: 486 - RNA, 19 nt, Homo sapiens
cgcaauagcccagaagaua

SEQ ID NO: 487 - RNA, 19 nt, Homo sapiens
gagauggacauuuaaagca

SEQ ID NO: 488 - RNA, 19 nt, Homo sapiens
caauagcccagaagauaag

SEQ ID NO: 489 - RNA, 19 nt, Homo sapiens
ccaggcaucucauaacaaa

SEQ ID NO: 490 - RNA, 19 nt, Homo sapiens
ccagaugccuauacaaaca

SEQ ID NO: 491 - RNA, 19 nt, Homo sapiens
ggagguaugagucaguaua

SEQ ID NO: 492 - RNA, 19 nt, Homo sapiens
gagguaugagucaguauaa

SEQ ID NO: 493 - RNA, 19 nt, Homo sapiens
caauagcaacaaguauacc

SEQ ID NO: 494 - RNA, 19 nt, Homo sapiens
ugaaguccaggacgaugau

SEQ ID NO: 495 - RNA, 19 nt, Homo sapiens
ugucacacuaugguaacca

SEQ ID NO: 496 - RNA, 19 nt, Homo sapiens
uguucaaugggagcuugga

SEQ ID NO: 497 - RNA, 19 nt, Homo sapiens
gagaagaaauggaagaaau

SEQ ID NO: 498 - RNA, 19 nt, Homo sapiens
ccaaagugcugcaguacua

SEQ ID NO: 499 - RNA, 19 nt, Homo sapiens
gagcaugccgucaauaaua

SEQ ID NO: 500 - RNA, 19 nt, Homo sapiens
ggucugaacugaaugaaga

SEQ ID NO: 501 - RNA, 19 nt, Homo sapiens
ggacaaagguguucaaauc

SEQ ID NO: 502 - RNA, 19 nt, Homo sapiens
gaacccagcugccuaacaa

SEQ ID NO: 503 - RNA, 19 nt, Homo sapiens
gcgcacagcuucuuugaug

SEQ ID NO: 504 - RNA, 19 nt, Homo sapiens
gcucuagccugcuggagua

SEQ ID NO: 505 - RNA, 19 nt, Homo sapiens
gaagaaagaugaggucuau

SEQ ID NO: 506 - RNA, 19 nt, Homo sapiens
ggacccaaaugucaaacua

SEQ ID NO: 507 - RNA, 19 nt, Homo sapiens
gaaaugaacccaaacuaca

SEQ ID NO: 508 - RNA, 19 nt, Homo sapiens
gaugaggucuaucuuaauc

SEQ ID NO: 509 - RNA, 19 nt, Homo sapiens
ggaaguacauuugaagaac

SEQ ID NO: 510 - RNA, 19 nt, Homo sapiens
agaaggaaguacauuugaa

SEQ ID NO: 511 - RNA, 19 nt, Homo sapiens
ccucaagccugccaaguca

SEQ ID NO: 512 - RNA, 19 nt, Homo sapiens
gguggaugcucuucaguuc

SEQ ID NO: 513 - RNA, 19 nt, Homo sapiens
caacgaagcuucugugaug

SEQ ID NO: 514 - RNA, 19 nt, Homo sapiens
ggccagaaauggagaauaa

SEQ ID NO: 515 - RNA, 19 nt, Homo sapiens
gaagcacccuuuaagaaug

SEQ ID NO: 516 - RNA, 19 nt, Homo sapiens
gcagacaccuacaacauca

SEQ ID NO: 517 - RNA, 19 nt, Homo sapiens
ggaauugcguuuacacuua

SEQ ID NO: 518 - RNA, 19 nt, Homo sapiens
ggaaacugaucauuaagaa

SEQ ID NO: 519 - RNA, 19 nt, Homo sapiens
cgacagggaugaaguacaa

SEQ ID NO: 520 - RNA, 19 nt, Homo sapiens
aaacgcagcugcccaucua

SEQ ID NO: 521 - RNA, 19 nt, Homo sapiens
ggaagacguuugaggauua

SEQ ID NO: 522 - RNA, 19 nt, Homo sapiens
gaacaaggcucccgagagu

SEQ ID NO: 523 - RNA, 19 nt, Homo sapiens
ggagagaccuuggaaauug

SEQ ID NO: 524 - RNA, 19 nt, Homo sapiens
ggacggaacccaccuauuu

SEQ ID NO: 525 - RNA, 19 nt, Homo sapiens
aaagaggucuggcaaguga

SEQ ID NO: 526 - RNA, 19 nt, Homo sapiens
gaaccugauugguaucuac

SEQ ID NO: 527 - RNA, 19 nt, Homo sapiens
ccacggcgaucuagugcuu

SEQ ID NO: 528 - RNA, 19 nt, Homo sapiens
gucagucugucguccagua

SEQ ID NO: 529 - RNA, 19 nt, Homo sapiens
ggacuggacuucaacuuug

SEQ ID NO: 530 - RNA, 19 nt, Homo sapiens
ccacgaagcaguucaaaug

SEQ ID NO: 531 - RNA, 19 nt, Homo sapiens
gagaagcgacugacacuug

SEQ ID NO: 532 - RNA, 19 nt, Homo sapiens
gaccagagaucgcuaacca

SEQ ID NO: 533 - RNA, 19 nt, Homo sapiens
caagagaccucguggagaa

SEQ ID NO: 534 - RNA, 19 nt, Homo sapiens
gaccagaggccaagaauuu

SEQ ID NO: 535 - RNA, 19 nt, Homo sapiens
ggaaacgaguaucuuauau

SEQ ID NO: 536 - RNA, 19 nt, Homo sapiens
gagaagcgacauaucauaa

SEQ ID NO: 537 - RNA, 19 nt, Homo sapiens
gcuaucaucugaacaauua

SEQ ID NO: 538 - RNA, 19 nt, Homo sapiens
ggauagaggccaaauaaua

SEQ ID NO: 539 - RNA, 19 nt, Homo sapiens
ggacaacuguuucauauag

SEQ ID NO: 540 - RNA, 19 nt, Homo sapiens
gccaguaccucauggauua

SEQ ID NO: 541 - RNA, 19 nt, Homo sapiens
cgacaagacugccgagaga

SEQ ID NO: 542 - RNA, 19 nt, Homo sapiens
ucaagugucuccuaauaug

SEQ ID NO: 543 - RNA, 19 nt, Homo sapiens
ggauucaguuggagugauu

SEQ ID NO: 544 - RNA, 19 nt, Homo sapiens
uuucaagugucuccuaaua

SEQ ID NO: 545 - RNA, 19 nt, Homo sapiens
ggaaauauggcuucucuga

SEQ ID NO: 546 - RNA, 19 nt, Homo sapiens
gaaagacgagagaccaaua

SEQ ID NO: 547 - RNA, 19 nt, Homo sapiens
guaaagcauugugucauaa

SEQ ID NO: 548 - RNA, 19 nt, Homo sapiens
ggaucaaguugucaaagaa

SEQ ID NO: 549 - RNA, 19 nt, Homo sapiens
ggaaaggcgggaacaauaa

SEQ ID NO: 550 - RNA, 19 nt, Homo sapiens
gaugaagcguacugcaauu

SEQ ID NO: 551 - RNA, 19 nt, Homo sapiens
ggacagcgaaucucacuac

SEQ ID NO: 552 - RNA, 19 nt, Homo sapiens
gcaagauccgagaccagua

SEQ ID NO: 553 - RNA, 19 nt, Homo sapiens
gaaugcagcuuacuuucuu

SEQ ID NO: 554 - RNA, 19 nt, Homo sapiens
gaccgaagcugacauuauc

SEQ ID NO: 555 - RNA, 19 nt, Homo sapiens
ucgauuaccugaagaguuu

SEQ ID NO: 556 - RNA, 19 nt, Homo sapiens
ccugaagaguuuagaaaua

SEQ ID NO: 557 - RNA, 19 nt, Homo sapiens
gugaagaucuugaccaaug

SEQ ID NO: 558 - RNA, 19 nt, Homo sapiens
gaucagcauacacaaauua

SEQ ID NO: 559 - RNA, 19 nt, Homo sapiens
ggcgcuauguguauuauua

SEQ ID NO: 560 - RNA, 19 nt, Homo sapiens
guauagagcgugcagauaa

SEQ ID NO: 561 - RNA, 19 nt, Homo sapiens
gccagaaacucauugaagu

SEQ ID NO: 562 - RNA, 19 nt, Homo sapiens
ggauauuccuggacugacu

SEQ ID NO: 563 - RNA, 19 nt, Homo sapiens
ccaaggagaacuggagaaa

SEQ ID NO: 564 - RNA, 19 nt, Homo sapiens
gcguauggccacagaaguu

SEQ ID NO: 565 - RNA, 19 nt, Homo sapiens
gaugacaccuucuacuuug

SEQ ID NO: 566 - RNA, 19 nt, Homo sapiens
gagaaugggcuccucauga

SEQ ID NO: 567 - RNA, 19 nt, Homo sapiens
caagcgggauccuucagaa

SEQ ID NO: 568 - RNA, 19 nt, Homo sapiens
ccaccggccugauggaaga

SEQ ID NO: 569 - RNA, 19 nt, Homo sapiens
gaagggaaguuguaucuua

SEQ ID NO: 570 - RNA, 19 nt, Homo sapiens
gaaaguauguguauguagu

SEQ ID NO: 571 - RNA, 19 nt, Homo sapiens
ggacagcauccaaacauua

SEQ ID NO: 572 - RNA, 19 nt, Homo sapiens
ggaggugaauugcuggaua

SEQ ID NO: 573 - RNA, 19 nt, Homo sapiens
uuaaugguggagaguuguu

SEQ ID NO: 574 - RNA, 19 nt, Homo sapiens
auuaacugggaugaucuca

SEQ ID NO: 575 - RNA, 19 nt, Homo sapiens
gaagaaagcaauccugaaa

SEQ ID NO: 576 - RNA, 19 nt, Homo sapiens
aaacacagcugaaauguac

SEQ ID NO: 577 - RNA, 19 nt, Homo sapiens
gaagauggcuauucugugu

SEQ ID NO: 578 - RNA, 19 nt, Homo sapiens
uaugaaggcucgagaguua

SEQ ID NO: 579 - RNA, 19 nt, Homo sapiens
cgacacggcugauaacuga

SEQ ID NO: 580 - RNA, 19 nt, Homo sapiens
cggcugauguuguuaaaua

SEQ ID NO: 581 - RNA, 19 nt, Homo sapiens
gcauuaaucucuuaccaua

SEQ ID NO: 582 - RNA, 19 nt, Homo sapiens
ccaauguccucuugucuuu

SEQ ID NO: 583 - RNA, 19 nt, Homo sapiens
ggagacacaucaccuacuu

SEQ ID NO: 584 - RNA, 19 nt, Homo sapiens
ucaccaggcucaucaagaa

SEQ ID NO: 585 - RNA, 19 nt, Homo sapiens
gaaagucucugucaaaaua

SEQ ID NO: 586 - RNA, 19 nt, Homo sapiens
gcaauaggcuccauuagug

SEQ ID NO: 587 - RNA, 19 nt, Homo sapiens
ggaacaugaucaacuuaua

SEQ ID NO: 588 - RNA, 19 nt, Homo sapiens
ggauacagauuccauaaau

SEQ ID NO: 589 - RNA, 19 nt, Homo sapiens
ggaaaucagugacauagug

SEQ ID NO: 590 - RNA, 19 nt, Homo sapiens
gguccacacugcaauguuu

SEQ ID NO: 591 - RNA, 19 nt, Homo sapiens
gaaggaaaucagugacaua

SEQ ID NO: 592 - RNA, 19 nt, Homo sapiens
ucacugaguucaugaccua

SEQ ID NO: 593 - RNA, 19 nt, Homo sapiens
gaaauggagcgaacagaua

SEQ ID NO: 594 - RNA, 19 nt, Homo sapiens
gagccaaauuuccuauuaa

SEQ ID NO: 595 - RNA, 19 nt, Homo sapiens
guaauaagccuacagucua

SEQ ID NO: 596 - RNA, 19 nt, Homo sapiens
ggagugaaguucgcucuaa

SEQ ID NO: 597 - RNA, 19 nt, Homo sapiens
aaacgcaagucguggauga

SEQ ID NO: 598 - RNA, 19 nt, Homo sapiens
gcaagucguggaugaguaa

SEQ ID NO: 599 - RNA, 19 nt, Homo sapiens
gagcacuaccucagaauga

SEQ ID NO: 600 - RNA, 19 nt, Homo sapiens
ucagcagcacccacuauua

SEQ ID NO: 601 - RNA, 19 nt, Homo sapiens
gacaagauccugcagaaua

SEQ ID NO: 602 - RNA, 19 nt, Homo sapiens
ggaagagucuggcaguuga

SEQ ID NO: 603 - RNA, 19 nt, Homo sapiens
gcacguggcucgggacauu

SEQ ID NO: 604 - RNA, 19 nt, Homo sapiens
gaacugcagugaaggaaca

SEQ ID NO: 605 - RNA, 19 nt, Homo sapiens
ggucagagcuggaggauuu

SEQ ID NO: 606 - RNA, 19 nt, Homo sapiens
gaaagaaggagacccguua

SEQ ID NO: 607 - RNA, 19 nt, Homo sapiens
ccaagaagaucuacaaugg

SEQ ID NO: 608 - RNA, 19 nt, Homo sapiens
ggaacugcaugcugaauga

SEQ ID NO: 609 - RNA, 19 nt, Homo sapiens
gaggaugccugcuggauuu

SEQ ID NO: 610 - RNA, 19 nt, Homo sapiens
acaugaagguggccauuaa

SEQ ID NO: 611 - RNA, 19 nt, Homo sapiens
ggucagcgcccaagacaag

SEQ ID NO: 612 - RNA, 19 nt, Homo sapiens
gaaacucgggucuggacaa

SEQ ID NO: 613 - RNA, 19 nt, Homo sapiens
aaacaaaccuuuccuacua

SEQ ID NO: 614 - RNA, 19 nt, Homo sapiens
gaaggagcauuuaugguua

SEQ ID NO: 615 - RNA, 19 nt, Homo sapiens
gagaagagauuaccuuguu

SEQ ID NO: 616 - RNA, 19 nt, Homo sapiens
guaaggcugugaaugauaa

SEQ ID NO: 617 - RNA, 19 nt, Homo sapiens
gaacaggaauggaagcuua

SEQ ID NO: 618 - RNA, 19 nt, Homo sapiens
gcuaugggcugccaaauuu

SEQ ID NO: 619 - RNA, 19 nt, Homo sapiens
gaaagcaacuuaccauggu

SEQ ID NO: 620 - RNA, 19 nt, Homo sapiens
gguaaacgaucaaggaguu

SEQ ID NO: 621 - RNA, 19 nt, Homo sapiens
caacuuagccaagacaauu

SEQ ID NO: 622 - RNA, 19 nt, Homo sapiens
gaaauugaaggcucaguga

SEQ ID NO: 623 - RNA, 19 nt, Homo sapiens
uggaacagcugaacauugu

SEQ ID NO: 624 - RNA, 19 nt, Homo sapiens
gcuuccaacugcuuauaua

SEQ ID NO: 625 - RNA, 19 nt, Homo sapiens
ggagagcucugacguuuga

SEQ ID NO: 626 - RNA, 19 nt, Homo sapiens
caacaacgcuaccuuccaa

SEQ ID NO: 627 - RNA, 19 nt, Homo sapiens
ccacgcagcugccuuacaa

SEQ ID NO: 628 - RNA, 19 nt, Homo sapiens
ggaacaaccugcaguuugg

SEQ ID NO: 629 - RNA, 19 nt, Homo sapiens
cagaauguauugccaagua

SEQ ID NO: 630 - RNA, 19 nt, Homo sapiens
gaacaaagucgccgucaag

SEQ ID NO: 631 - RNA, 19 nt, Homo sapiens
gcgagugccuuauccaaga

SEQ ID NO: 632 - RNA, 19 nt, Homo sapiens
ggagaagggcuacaagaug

SEQ ID NO: 633 - RNA, 19 nt, Homo sapiens
ggagauggaguuugaguuu

SEQ ID NO: 634 - RNA, 19 nt, Homo sapiens
cagaggcccugucaucuuu

SEQ ID NO: 635 - RNA, 19 nt, Homo sapiens
gcugguagcugucaagauc

SEQ ID NO: 636 - RNA, 19 nt, Homo sapiens
ugaaagaggugaagaucau

SEQ ID NO: 637 - RNA, 19 nt, Homo sapiens
gguaagaacuacacaauca

SEQ ID NO: 638 - RNA, 19 nt, Homo sapiens
gaacgagagugccaccaau

SEQ ID NO: 639 - RNA, 19 nt, Homo sapiens
acaccaaucugaaguuuau

SEQ ID NO: 640 - RNA, 19 nt, Homo sapiens
caacaagaaugccaggaau

SEQ ID NO: 641 - RNA, 19 nt, Homo sapiens
ccuagaagcugccauuaaa

SEQ ID NO: 642 - RNA, 19 nt, Homo sapiens
gauuaggccuggcuuauga

SEQ ID NO: 643 - RNA, 19 nt, Homo sapiens
cccaguagcugcacacaua

SEQ ID NO: 644 - RNA, 19 nt, Homo sapiens
ggugguaccugaacuguau

SEQ ID NO: 645 - RNA, 19 nt, Homo sapiens
gaaggaaacugaauucaaa

SEQ ID NO: 646 - RNA, 19 nt, Homo sapiens
ggaaauauguacuacgaaa

SEQ ID NO: 647 - RNA, 19 nt, Homo sapiens
ccacaaagcagugaauuua

SEQ ID NO: 648 - RNA, 19 nt, Homo sapiens
guaacaagcucacgcaguu

SEQ ID NO: 649 - RNA, 19 nt, Homo sapiens
gaccagagcuucaccauuc

SEQ ID NO: 650 - RNA, 19 nt, Homo sapiens
gcaagacuguggccauuaa

SEQ ID NO: 651 - RNA, 19 nt, Homo sapiens
gggcgaaccugaccuauga

SEQ ID NO: 652 - RNA, 19 nt, Homo sapiens
gauuguagccgucaucuuu

SEQ ID NO: 653 - RNA, 19 nt, Homo sapiens
ggagggaucuggcaacuug

SEQ ID NO: 654 - RNA, 19 nt, Homo sapiens
gcagcaaggugcacgaauu

SEQ ID NO: 655 - RNA, 19 nt, Homo sapiens
ggagaaggauggcgaguuc

SEQ ID NO: 656 - RNA, 19 nt, Homo sapiens
gaaguucacuaccgagauc

SEQ ID NO: 657 - RNA, 19 nt, Homo sapiens
gaucggaccuccagaaaua

SEQ ID NO: 658 - RNA, 19 nt, Homo sapiens
gaacucagcucagaagauu

SEQ ID NO: 659 - RNA, 19 nt, Homo sapiens
gcaagaggcacaaauguua

SEQ ID NO: 660 - RNA, 19 nt, Homo sapiens
gagcaucaguuuacaaaga

SEQ ID NO: 661 - RNA, 19 nt, Homo sapiens
ggucugggaugaaguauuu

SEQ ID NO: 662 - RNA, 19 nt, Homo sapiens
gaaugaaguuaccuuauug

SEQ ID NO: 663 - RNA, 19 nt, Homo sapiens
gaacuuggguggauagcaa

SEQ ID NO: 664 - RNA, 19 nt, Homo sapiens
gagauuaaauucaccuuga

SEQ ID NO: 665 - RNA, 19 nt, Homo sapiens
gaaaagagauguugcagua

SEQ ID NO: 666 - RNA, 19 nt, Homo sapiens
cuagaugccuccuguauua

SEQ ID NO: 667 - RNA, 19 nt, Homo sapiens
agaagaagguuaucguuua

SEQ ID NO: 668 - RNA, 19 nt, Homo sapiens
uagcaaagcugaccaagaa

SEQ ID NO: 669 - RNA, 19 nt, Homo sapiens
gaagaugcacuaucagaau

SEQ ID NO: 670 - RNA, 19 nt, Homo sapiens
gagaagaugcacuaucaga

SEQ ID NO: 671 - RNA, 19 nt, Homo sapiens
aaccugaucuccaguguga

SEQ ID NO: 672 - RNA, 19 nt, Homo sapiens
ucucagaccugggcuaugu

SEQ ID NO: 673 - RNA, 19 nt, Homo sapiens
gcgauaagcuccagcauua

SEQ ID NO: 674 - RNA, 19 nt, Homo sapiens
gaaacgggcuuauagcaaa

SEQ ID NO: 675 - RNA, 19 nt, Homo sapiens
ggaugaagaucuacauuga

SEQ ID NO: 676 - RNA, 19 nt, Homo sapiens
gcacgucucugucaacauc

SEQ ID NO: 677 - RNA, 19 nt, Homo sapiens
acuaugagcugcaguacua

SEQ ID NO: 678 - RNA, 19 nt, Homo sapiens
guacaacgccacagccaua

SEQ ID NO: 679 - RNA, 19 nt, Homo sapiens
ggaaagcaaugacuguucu

SEQ ID NO: 680 - RNA, 19 nt, Homo sapiens
cggacaagcugcaacacua

SEQ ID NO: 681 - RNA, 19 nt, Homo sapiens
ggugugaucuccaauguga

SEQ ID NO: 682 - RNA, 19 nt, Homo sapiens
gggaugaccuccuguacaa

SEQ ID NO: 683 - RNA, 19 nt, Homo sapiens
cagaagaccugcuccguau

SEQ ID NO: 684 - RNA, 19 nt, Homo sapiens
gagaugaaguacuuugaga

SEQ ID NO: 685 - RNA, 19 nt, Homo sapiens
ggacaaacacggacaguau

SEQ ID NO: 686 - RNA, 19 nt, Homo sapiens
guacuaaggucuacaucga

SEQ ID NO: 687 - RNA, 19 nt, Homo sapiens
ggagagaagcagaauauuc

SEQ ID NO: 688 - RNA, 19 nt, Homo sapiens
gccaauagccacucuaaca

SEQ ID NO: 689 - RNA, 19 nt, Homo sapiens
ggaagucgauccugcuuau

SEQ ID NO: 690 - RNA, 19 nt, Homo sapiens
ggaccaagguggacacaau

SEQ ID NO: 691 - RNA, 19 nt, Homo sapiens
ugugggaagugaugaguua

SEQ ID NO: 692 - RNA, 19 nt, Homo sapiens
cgggagaccuucacccuuu

SEQ ID NO: 693 - RNA, 19 nt, Homo sapiens
ggacgaauucugcacaaug

SEQ ID NO: 694 - RNA, 19 nt, Homo sapiens
gacgaauucugcacaaugg

SEQ ID NO: 695 - RNA, 19 nt, Homo sapiens
cuacaacacagacacguuu

SEQ ID NO: 696 - RNA, 19 nt, Homo sapiens
agacgaagcauacgugaug

SEQ ID NO: 697 - RNA, 19 nt, Homo sapiens
aagaggaugucaacgguua

SEQ ID NO: 698 - RNA, 19 nt, Homo sapiens
gaagacugccagacauuga

SEQ ID NO: 699 - RNA, 19 nt, Homo sapiens
gacaaacacuggugcugau

SEQ ID NO: 700 - RNA, 19 nt, Homo sapiens
gcaguggauucgagaagug

SEQ ID NO: 701 - RNA, 19 nt, Homo sapiens
gaggaaagaugccaauuaa

SEQ ID NO: 702 - RNA, 19 nt, Homo sapiens
gcaggaaacaucuauauua

SEQ ID NO: 703 - RNA, 19 nt, Homo sapiens
gaucacaacugcugcuuaa

SEQ ID NO: 704 - RNA, 19 nt, Homo sapiens
ccucaaagauaccuaguua

SEQ ID NO: 705 - RNA, 19 nt, Homo sapiens
ggagugaccugaagaauuc

SEQ ID NO: 706 - RNA, 19 nt, Homo sapiens
uaaagcagauucccauuaa

SEQ ID NO: 707 - RNA, 19 nt, Homo sapiens
ggaaaguacuguccaaaug

SEQ ID NO: 708 - RNA, 19 nt, Homo sapiens
gaacaacggcugcuaaaga

SEQ ID NO: 709 - RNA, 19 nt, Homo sapiens
cgaggauccugaagcagua

SEQ ID NO: 710 - RNA, 19 nt, Homo sapiens
aggaauaccuggagauuag

SEQ ID NO: 711 - RNA, 19 nt, Homo sapiens
caacaggagcuccggaaug

SEQ ID NO: 712 - RNA, 19 nt, Homo sapiens
gguguugggugagcagauu

SEQ ID NO: 713 - RNA, 19 nt, Homo sapiens
uaagaaaugucuccuuuga

SEQ ID NO: 714 - RNA, 19 nt, Homo sapiens
gaagacugcuggaguuaau

SEQ ID NO: 715 - RNA, 19 nt, Homo sapiens
gauggucccuuguauguca

SEQ ID NO: 716 - RNA, 19 nt, Homo sapiens
cuuaagaaaugucuccuuu

SEQ ID NO: 717 - RNA, 19 nt, Homo sapiens
ccaaaucucucaaccagaa

SEQ ID NO: 718 - RNA, 19 nt, Homo sapiens
gaacaguauucaccuaguu

SEQ ID NO: 719 - RNA, 19 nt, Homo sapiens
ggccaacacugucaaguuu

SEQ ID NO: 720 - RNA, 19 nt, Homo sapiens
gugaagauguugaaagaug

SEQ ID NO: 721 - RNA, 19 nt, Homo sapiens
ugucggaccuggugucuga

SEQ ID NO: 722 - RNA, 19 nt, Homo sapiens
gcaucaagcugcggcauca

SEQ ID NO: 723 - RNA, 19 nt, Homo sapiens
ggacggcacacccuacguu

SEQ ID NO: 724 - RNA, 19 nt, Homo sapiens
ugcacaaccucgacuacua

SEQ ID NO: 725 - RNA, 19 nt, Homo sapiens
gcacuggagucucgugaug

SEQ ID NO: 726 - RNA, 19 nt, Homo sapiens
cauagggaccucucgaaua

SEQ ID NO: 727 - RNA, 19 nt, Homo sapiens
auacggacaucauccugua

SEQ ID NO: 728 - RNA, 19 nt, Homo sapiens
auagggaccucucgaauag

SEQ ID NO: 729 - RNA, 19 nt, Homo sapiens
gcgaucaugugaagcauua

SEQ ID NO: 730 - RNA, 19 nt, Homo sapiens
ucacugagcucaucaccaa

SEQ ID NO: 731 - RNA, 19 nt, Homo sapiens
gaagagugguacuuuggaa

SEQ ID NO: 732 - RNA, 19 nt, Homo sapiens
cccagaagcugcccucuuu

SEQ ID NO: 733 - RNA, 19 nt, Homo sapiens
gagcaaacgugacuuauuu

SEQ ID NO: 734 - RNA, 19 nt, Homo sapiens
ccaaauggguuucauguua

SEQ ID NO: 735 - RNA, 19 nt, Homo sapiens
caacaaggaugcagcacua

SEQ ID NO: 736 - RNA, 19 nt, Homo sapiens
ggacguaacugaagaggau

SEQ ID NO: 737 - RNA, 19 nt, Homo sapiens
gaaggcaucuacaccauua

SEQ ID NO: 738 - RNA, 19 nt, Homo sapiens
gaaggagucuggaauagaa

SEQ ID NO: 739 - RNA, 19 nt, Homo sapiens
gaauuuaagucguguguuc

SEQ ID NO: 740 - RNA, 19 nt, Homo sapiens
ggaauucauuucacucuga

SEQ ID NO: 741 - RNA, 19 nt, Homo sapiens
gcaagaacgugcaucuguu

SEQ ID NO: 742 - RNA, 19 nt, Homo sapiens
gcgaauaccuguccuacga

SEQ ID NO: 743 - RNA, 19 nt, Homo sapiens
gaagacauuugaggaauuc

SEQ ID NO: 744 - RNA, 19 nt, Homo sapiens
gagcagccauucaucaaca

SEQ ID NO: 745 - RNA, 19 nt, Homo sapiens
gaaacagacucuucauauu

SEQ ID NO: 746 - RNA, 19 nt, Homo sapiens
gaacaauaccacuccagua

SEQ ID NO: 747 - RNA, 19 nt, Homo sapiens
caagaccgguuccuuucua

SEQ ID NO: 748 - RNA, 19 nt, Homo sapiens
gcaagaauaucuccaaaau

SEQ ID NO: 749 - RNA, 19 nt, Homo sapiens
ggaauggacucauaugcaa

SEQ ID NO: 750 - RNA, 19 nt, Homo sapiens
gcagaagagugguacuuug

SEQ ID NO: 751 - RNA, 19 nt, Homo sapiens
caaaggaaguuuacuggau

SEQ ID NO: 752 - RNA, 19 nt, Homo sapiens
gaagagugguacuuuggaa

SEQ ID NO: 753 - RNA, 19 nt, Homo sapiens
gagauaccgugaaacauua

SEQ ID NO: 754 - RNA, 19 nt, Homo sapiens
gcagggagauaccgugaaa

SEQ ID NO: 755 - RNA, 19 nt, Homo sapiens
caucgugguugcccuguau

SEQ ID NO: 756 - RNA, 19 nt, Homo sapiens
uguguaagauugcugacuu

SEQ ID NO: 757 - RNA, 19 nt, Homo sapiens
caaauaaucuggaaaccua

SEQ ID NO: 758 - RNA, 19 nt, Homo sapiens
gaagaaacgaggaauaaua

SEQ ID NO: 759 - RNA, 19 nt, Homo sapiens
gaaacucucucaucccaaa

SEQ ID NO: 760 - RNA, 19 nt, Homo sapiens
ggaaugggcaugaaggaua

SEQ ID NO: 761 - RNA, 19 nt, Homo sapiens
ccacauagcugaucugaaa

SEQ ID NO: 762 - RNA, 19 nt, Homo sapiens
ugaaaucacucacauugua

SEQ ID NO: 763 - RNA, 19 nt, Homo sapiens
uaaggaaccucuaucauga

SEQ ID NO: 764 - RNA, 19 nt, Homo sapiens
gcagguggcuguuaaaucu

SEQ ID NO: 765 - RNA, 19 nt, Homo sapiens
gcaaauagauccaguucuu

SEQ ID NO: 766 - RNA, 19 nt, Homo sapiens
gagcaaagauccaagacua

SEQ ID NO: 767 - RNA, 19 nt, Homo sapiens
gccagaaacuugaaacuua

SEQ ID NO: 768 - RNA, 19 nt, Homo sapiens
guacagauuucgcagauuu

SEQ ID NO: 769 - RNA, 19 nt, Homo sapiens
gcgccuaucuuucuccuuu

SEQ ID NO: 770 - RNA, 19 nt, Homo sapiens
ccagaaaucguagacauua

SEQ ID NO: 771 - RNA, 19 nt, Homo sapiens
ccucaucucuucagacuau

SEQ ID NO: 772 - RNA, 19 nt, Homo sapiens
uguacgagcucuucaccua

SEQ ID NO: 773 - RNA, 19 nt, Homo sapiens
ggaaaucucuugcaagcua

SEQ ID NO: 774 - RNA, 19 nt, Homo sapiens
gauuacagaucuccauuua

SEQ ID NO: 775 - RNA, 19 nt, Homo sapiens
gcagacagaucuacguuug

SEQ ID NO: 776 - RNA, 19 nt, Homo sapiens
gcgauggccucuucuguaa

SEQ ID NO: 777 - RNA, 19 nt, Homo sapiens
gaaauucucucaacugaug

SEQ ID NO: 778 - RNA, 19 nt, Homo sapiens
gcagaggucuucacacuuu

SEQ ID NO: 779 - RNA, 19 nt, Homo sapiens
uaaaugaucuucagacaga

SEQ ID NO: 780 - RNA, 19 nt, Homo sapiens
gagcagcccuacucugaua

SEQ ID NO: 781 - RNA, 19 nt, Homo sapiens
aaacacggcuuaagcaauu

SEQ ID NO: 782 - RNA, 19 nt, Homo sapiens
gaacagaaccuucacugau

SEQ ID NO: 783 - RNA, 19 nt, Homo sapiens
gggaagcccucaugucuga

SEQ ID NO: 784 - RNA, 19 nt, Homo sapiens
gcaauuccauuuauguguu

SEQ ID NO: 785 - RNA, 19 nt, Homo sapiens
gaacugccauuaucccaua

SEQ ID NO: 786 - RNA, 19 nt, Homo sapiens
gagagguggugaaacauua

SEQ ID NO: 787 - RNA, 19 nt, Homo sapiens
gggccaaguuucccauuaa

SEQ ID NO: 788 - RNA, 19 nt, Homo sapiens
gcacgcugcucauccgaaa

SEQ ID NO: 789 - RNA, 19 nt, Homo sapiens
ugaauucacuccugccaau

SEQ ID NO: 790 - RNA, 19 nt, Homo sapiens
guggcaaccucaacacuga

SEQ ID NO: 791 - RNA, 19 nt, Homo sapiens
ggagcuagcuguggauaac

SEQ ID NO: 792 - RNA, 19 nt, Homo sapiens
gcaaguuucgccaucagaa

SEQ ID NO: 793 - RNA, 19 nt, Homo sapiens
gcagauggcuugugcagaa

SEQ ID NO: 794 - RNA, 19 nt, Homo sapiens
ggagaaggcuuguauuagu

SEQ ID NO: 795 - RNA, 19 nt, Homo sapiens
gaugagcucuaugacauua

SEQ ID NO: 796 - RNA, 19 nt, Homo sapiens
ggugcuaaguucccuauua

SEQ ID NO: 797 - RNA, 19 nt, Homo sapiens
ugaagaauaucaaguguga

SEQ ID NO: 798 - RNA, 19 nt, Homo sapiens
ccgcucagcuccugcaguu

SEQ ID NO: 799 - RNA, 19 nt, Homo sapiens
uacugaaccugcagcauuu

SEQ ID NO: 800 - RNA, 19 nt, Homo sapiens
ugggaggucuucucauaug

SEQ ID NO: 801 - RNA, 19 nt, Homo sapiens
gaacuuaccuuacauagcu

SEQ ID NO: 802 - RNA, 19 nt, Homo sapiens
ggaccugcauacuuacuua

SEQ ID NO: 803 - RNA, 19 nt, Homo sapiens
ugacaggaaucuucuaauu

SEQ ID NO: 804 - RNA, 19 nt, Homo sapiens
gguaauggcucagucauga

SEQ ID NO: 805 - RNA, 19 nt, Homo sapiens
gaaagaaccucucaacauu

SEQ ID NO: 806 - RNA, 19 nt, Homo sapiens
ggacaaggcugaccauaug

SEQ ID NO: 807 - RNA, 19 nt, Homo sapiens
ccaaugaccugcugaaauu

SEQ ID NO: 808 - RNA, 19 nt, Homo sapiens
gagcauacauuaaaccaaa

SEQ ID NO: 809 - RNA, 19 nt, Homo sapiens
ggauggagcugcuggcuuu

SEQ ID NO: 810 - RNA, 19 nt, Homo sapiens
cugcagaccuauagauuua

SEQ ID NO: 811 - RNA, 19 nt, Homo sapiens
gcaccugucucacucuuga

SEQ ID NO: 812 - RNA, 19 nt, Homo sapiens
gaaagaguccauccagcua

SEQ ID NO: 813 - RNA, 19 nt, Homo sapiens
gaagaagccucggcagaua

SEQ ID NO: 814 - RNA, 19 nt, Homo sapiens
guaauaaucuccaucaugu

SEQ ID NO: 815 - RNA, 19 nt, Homo sapiens
ggaaugaacugaaaguagu

SEQ ID NO: 816 - RNA, 19 nt, Homo sapiens
gagauuuccuggacuagaa

SEQ ID NO: 817 - RNA, 19 nt, Homo sapiens
ggacaacccuuucgaguuc

SEQ ID NO: 818 - RNA, 19 nt, Homo sapiens
ccagugaccucaacaggaa

SEQ ID NO: 819 - RNA, 19 nt, Homo sapiens
ccacaauacuucagugaug

SEQ ID NO: 820 - RNA, 19 nt, Homo sapiens
gaagaguggucuccguuuc

SEQ ID NO: 821 - RNA, 19 nt, Homo sapiens
gaacagaaguaaugaaauc

SEQ ID NO: 822 - RNA, 19 nt, Homo sapiens
guaaugcuguuucugcuua

SEQ ID NO: 823 - RNA, 19 nt, Homo sapiens
gcaagacacuccaaguuug

SEQ ID NO: 824 - RNA, 19 nt, Homo sapiens
gaaagucuaucacauuauc

SEQ ID NO: 825 - RNA, 19 nt, Homo sapiens
gagcgaaucugcuagugaa

SEQ ID NO: 826 - RNA, 19 nt, Homo sapiens
gaaguucacuacagagagu

SEQ ID NO: 827 - RNA, 19 nt, Homo sapiens
ggucgacgguccaaauuug

SEQ ID NO: 828 - RNA, 19 nt, Homo sapiens
gaauaucacuuccauacac

SEQ ID NO: 829 - RNA, 19 nt, Homo sapiens
gaaacuuccuggacuauuu

SEQ ID NO: 830 - RNA, 19 nt, Homo sapiens
gagauuuggucaacuauuu

SEQ ID NO: 831 - RNA, 19 nt, Homo sapiens
gcacgccgcuuccugauau

SEQ ID NO: 832 - RNA, 19 nt, Homo sapiens
caucagagcuggaucuaga

SEQ ID NO: 833 - RNA, 19 nt, Homo sapiens
gaaaggagacgucaaauau

SEQ ID NO: 834 - RNA, 19 nt, Homo sapiens
ggaaugagguggucaacuu

SEQ ID NO: 835 - RNA, 19 nt, Homo sapiens
caacgagucuccagugcua

SEQ ID NO: 836 - RNA, 19 nt, Homo sapiens
gagaggaccugccgagcaa

SEQ ID NO: 837 - RNA, 19 nt, Homo sapiens
gaaguuggguugucuagaa

SEQ ID NO: 838 - RNA, 19 nt, Homo sapiens
gaagaacaaugauguaauc

SEQ ID NO: 839 - RNA, 19 nt, Homo sapiens
ggaaauugcuuugaaguug

SEQ ID NO: 840 - RNA, 19 nt, Homo sapiens
gguucaagcuggauuauuu

SEQ ID NO: 841 - RNA, 19 nt, Homo sapiens
gaacauggcugaccucaua

SEQ ID NO: 842 - RNA, 19 nt, Homo sapiens
ggaccacgcugcucuauuu

SEQ ID NO: 843 - RNA, 19 nt, Homo sapiens
ggacgaggacuauuacaaa

SEQ ID NO: 844 - RNA, 19 nt, Homo sapiens
uggcagagcucaucaacaa

SEQ ID NO: 845 - RNA, 19 nt, Homo sapiens
gagaaaguccugcccguuu

SEQ ID NO: 846 - RNA, 19 nt, Homo sapiens
ugaagaagcugcggcacaa

SEQ ID NO: 847 - RNA, 19 nt, Homo sapiens
ccgcgacucugaugagaaa

SEQ ID NO: 848 - RNA, 19 nt, Homo sapiens
ugcccgagcuugugaacua

SEQ ID NO: 849 - RNA, 19 nt, Homo sapiens
gagagaagcccacuauuaa

SEQ ID NO: 850 - RNA, 19 nt, Homo sapiens
cgagagaagcccacuauua

SEQ ID NO: 851 - RNA, 19 nt, Homo sapiens
ggagggaguuggagauguu

SEQ ID NO: 852 - RNA, 19 nt, Homo sapiens
gaagacaugccgcuauuug

SEQ ID NO: 853 - RNA, 19 nt, Homo sapiens
gaagaacuacgacagauua

SEQ ID NO: 854 - RNA, 19 nt, Homo sapiens
gaaggagacuauuuagagu

SEQ ID NO: 855 - RNA, 19 nt, Homo sapiens
gagcggaugcuguauucua

SEQ ID NO: 856 - RNA, 19 nt, Homo sapiens
cugcagacuuccuuuauga

SEQ ID NO: 857 - RNA, 19 nt, Homo sapiens
agagagagcuccagcagau

SEQ ID NO: 858 - RNA, 19 nt, Homo sapiens
uuaacgaggugaagacaga

SEQ ID NO: 859 - RNA, 19 nt, Homo sapiens
acacagagcccacggaugu

SEQ ID NO: 860 - RNA, 19 nt, Homo sapiens
gcugggaucaggacuauga

SEQ ID NO: 861 - RNA, 19 nt, Homo sapiens
gcaaagaccuggagaagau

SEQ ID NO: 862 - RNA, 19 nt, Homo sapiens
gcacacggcugcaugagaa

SEQ ID NO: 863 - RNA, 19 nt, Homo sapiens
gaacuggccuggagagagu

SEQ ID NO: 864 - RNA, 19 nt, Homo sapiens
uuaaauggauggcaauuga

SEQ ID NO: 865 - RNA, 19 nt, Homo sapiens
gcaagcaucuuuacuagga

SEQ ID NO: 866 - RNA, 19 nt, Homo sapiens
gagcaaggcuaaagagcua

SEQ ID NO: 867 - RNA, 19 nt, Homo sapiens
gagagcaacuucauguaaa

SEQ ID NO: 868 - RNA, 19 nt, Homo sapiens
gagaauguccugugucaaa

SEQ ID NO: 869 - RNA, 19 nt, Homo sapiens
ggaacucgcugcugccuau

SEQ ID NO: 870 - RNA, 19 nt, Homo sapiens
gcaggugccuccucagaug

SEQ ID NO: 871 - RNA, 19 nt, Homo sapiens
gcaaugugcuaguguacga

SEQ ID NO: 872 - RNA, 19 nt, Homo sapiens
gaagacagaauaugguuca

SEQ ID NO: 873 - RNA, 19 nt, Homo sapiens
gaggagaccuucuuacuua

SEQ ID NO: 874 - RNA, 19 nt, Homo sapiens
uuacagagguucaggauua

SEQ ID NO: 875 - RNA, 19 nt, Homo sapiens
gaacaaaccuaagcaugaa

SEQ ID NO: 876 - RNA, 19 nt, Homo sapiens
gaaagagcacuucaaauaa

SEQ ID NO: 877 - RNA, 19 nt, Homo sapiens
gaaagaugguuaccgaaua

SEQ ID NO: 878 - RNA, 19 nt, Homo sapiens
caaaguagauucugaaguu

SEQ ID NO: 879 - RNA, 19 nt, Homo sapiens
ucacuacgcucuauccuuu

SEQ ID NO: 880 - RNA, 19 nt, Homo sapiens
ggugaaggauauagcaaua

SEQ ID NO: 881 - RNA, 19 nt, Homo sapiens
gagaaccuggugugcaaag

SEQ ID NO: 882 - RNA, 19 nt, Homo sapiens
gagagaaccuggugugcaa

SEQ ID NO: 883 - RNA, 19 nt, Homo sapiens
ggaguuugcuggacuuucu

SEQ ID NO: 884 - RNA, 19 nt, Homo sapiens
gaaagugagaccacgaaag

SEQ ID NO: 885 - RNA, 19 nt, Homo sapiens
ggaauaaucucaagaauca

SEQ ID NO: 886 - RNA, 19 nt, Homo sapiens
gaacugggcucugguaauu

SEQ ID NO: 887 - RNA, 19 nt, Homo sapiens
ggaagaaucugagcaaauu

SEQ ID NO: 888 - RNA, 19 nt, Homo sapiens
gaacagacaugucaaggau

SEQ ID NO: 889 - RNA, 19 nt, Homo sapiens
gaaauugucuaguaaguga

SEQ ID NO: 890 - RNA, 19 nt, Homo sapiens
caccugaaguguuuaauua

SEQ ID NO: 891 - RNA, 19 nt, Homo sapiens
guacaaagucgcaaucaaa

SEQ ID NO: 892 - RNA, 19 nt, Homo sapiens
uggaggagauucuuauuaa

SEQ ID NO: 893 - RNA, 19 nt, Homo sapiens
gaaagaauaugccuccaaa

SEQ ID NO: 894 - RNA, 19 nt, Homo sapiens
ggaaugacaucaaauuuca

SEQ ID NO: 895 - RNA, 19 nt, Homo sapiens
ugaaguaccugauauucua

SEQ ID NO: 896 - RNA, 19 nt, Homo sapiens
cgaaagaccuacgugaaua

SEQ ID NO: 897 - RNA, 19 nt, Homo sapiens
gagaggagguuuaugugaa

SEQ ID NO: 898 - RNA, 19 nt, Homo sapiens
gggacagccucuacccuua

SEQ ID NO: 899 - RNA, 19 nt, Homo sapiens
gaaguucugugcaaauugg

SEQ ID NO: 900 - RNA, 19 nt, Homo sapiens
caacauggccucagaacug

SEQ ID NO: 901 - RNA, 19 nt, Homo sapiens
guucugggccuaagucuaa

SEQ ID NO: 902 - RNA, 19 nt, Homo sapiens
gaacugggucuacaagauc

SEQ ID NO: 903 - RNA, 19 nt, Homo sapiens
cgagagguaucggucauga

SEQ ID NO: 904 - RNA, 19 nt, Homo sapiens
ggcgcauccuggagcauua

SEQ ID NO: 905 - RNA, 19 nt, Homo sapiens
gaacaucuauugagacaag

SEQ ID NO: 906 - RNA, 19 nt, Homo sapiens
ucaaggcacuuuaugauuu

SEQ ID NO: 907 - RNA, 19 nt, Homo sapiens
ggagaggaauggcuauauu

SEQ ID NO: 908 - RNA, 19 nt, Homo sapiens
ggauauaugugaaggaaug

SEQ ID NO: 909 - RNA, 19 nt, Homo sapiens
gaggagauccaccacuuua

SEQ ID NO: 910 - RNA, 19 nt, Homo sapiens
gcauccacauugcacauaa

SEQ ID NO: 911 - RNA, 19 nt, Homo sapiens
ucaaauaccuagccacacu

SEQ ID NO: 912 - RNA, 19 nt, Homo sapiens
caaucuugcugacgucuug

SEQ ID NO: 913 - RNA, 19 nt, Homo sapiens
gguagaaggugugccauuu

SEQ ID NO: 914 - RNA, 19 nt, Homo sapiens
acgcugagauuuacaacua

SEQ ID NO: 915 - RNA, 19 nt, Homo sapiens
ggauggcuccuuugugaaa

SEQ ID NO: 916 - RNA, 19 nt, Homo sapiens
gagaggaacuacgaagauc

SEQ ID NO: 917 - RNA, 19 nt, Homo sapiens
gaaggacccugaugaaaga

SEQ ID NO: 918 - RNA, 19 nt, Homo sapiens
uaagaagggugaaagauuu

SEQ ID NO: 919 - RNA, 19 nt, Homo sapiens
ucaagaagcucagauaaug

SEQ ID NO: 920 - RNA, 19 nt, Homo sapiens
cagaaucccuccaugaauu

SEQ ID NO: 921 - RNA, 19 nt, Homo sapiens
gcaaggaccucuucaucaa

SEQ ID NO: 922 - RNA, 19 nt, Homo sapiens
gagaagaaguccacacuau

SEQ ID NO: 923 - RNA, 19 nt, Homo sapiens
ggaaugccaucucccaaug

SEQ ID NO: 924 - RNA, 19 nt, Homo sapiens
caacacgugugacaucauc

SEQ ID NO: 925 - RNA, 19 nt, Homo sapiens
gcaagcagcugaaacaaau

SEQ ID NO: 926 - RNA, 19 nt, Homo sapiens
gaauguugcuuucugaauu

SEQ ID NO: 927 - RNA, 19 nt, Homo sapiens
gaccugaagucuuauuuaa

SEQ ID NO: 928 - RNA, 19 nt, Homo sapiens
agacagaauucccaaauaa

SEQ ID NO: 929 - RNA, 19 nt, Homo sapiens
gaacaacacugcugguuug

SEQ ID NO: 930 - RNA, 19 nt, Homo sapiens
gaagucaucuguucauuau

SEQ ID NO: 931 - RNA, 19 nt, Homo sapiens
gaaauaagguagacucaau

SEQ ID NO: 932 - RNA, 19 nt, Homo sapiens
caacauaaauccaagaaga

SEQ ID NO: 933 - RNA, 19 nt, Homo sapiens
caaagaaucagcuagcaaa

SEQ ID NO: 934 - RNA, 19 nt, Homo sapiens
gaagagaguuauucauaga

SEQ ID NO: 935 - RNA, 19 nt, Homo sapiens
caaaugcccugucuuacug

SEQ ID NO: 936 - RNA, 19 nt, Homo sapiens
ucucgugacucagcaaauu

SEQ ID NO: 937 - RNA, 19 nt, Homo sapiens
gaaccuggcuaaguacgua

SEQ ID NO: 938 - RNA, 19 nt, Homo sapiens
gcagauccauucuugaaau

SEQ ID NO: 939 - RNA, 19 nt, Homo sapiens
ucacaagaaucagguguua

SEQ ID NO: 940 - RNA, 19 nt, Homo sapiens
cauaaagcguaccuugaua

SEQ ID NO: 941 - RNA, 19 nt, Homo sapiens
gcugugaacuacauugaua

SEQ ID NO: 942 - RNA, 19 nt, Homo sapiens
gaugauaccuacaccaaga

SEQ ID NO: 943 - RNA, 19 nt, Homo sapiens
gcuguuagccucaaaguuu

SEQ ID NO: 944 - RNA, 19 nt, Homo sapiens
aagcuggccugaaucauua

SEQ ID NO: 945 - RNA, 19 nt, Homo sapiens
caacauuaccugucauaua

SEQ ID NO: 946 - RNA, 19 nt, Homo sapiens
ccaaauaccugauggaacu

SEQ ID NO: 947 - RNA, 19 nt, Homo sapiens
gaaauguacccuccagaaa

SEQ ID NO: 948 - RNA, 19 nt, Homo sapiens
gcaccuggcuaagaaugua

SEQ ID NO: 949 - RNA, 19 nt, Homo sapiens
caacaaaugucaacaaaca

SEQ ID NO: 950 - RNA, 19 nt, Homo sapiens
gcagcaaacuccugaagau

SEQ ID NO: 951 - RNA, 19 nt, Homo sapiens
ccagugauuuggagaauau

SEQ ID NO: 952 - RNA, 19 nt, Homo sapiens
gugacuacguuaaggauau

SEQ ID NO: 953 - RNA, 19 nt, Homo sapiens
ugaacaaacugcugacuuu

SEQ ID NO: 954 - RNA, 19 nt, Homo sapiens
gcuagcugcugccuccuua

SEQ ID NO: 955 - RNA, 19 nt, Homo sapiens
caacucaccucguguggau

SEQ ID NO: 956 - RNA, 19 nt, Homo sapiens
guggaucucuaccuaauga

SEQ ID NO: 957 - RNA, 19 nt, Homo sapiens
gcagagcucccacuauuug

SEQ ID NO: 958 - RNA, 19 nt, Homo sapiens
ggaguaguuucaaauacaa

SEQ ID NO: 959 - RNA, 19 nt, Homo sapiens
gaccuuugcuccaguaugu

SEQ ID NO: 960 - RNA, 19 nt, Homo sapiens
gagauucuaugccagguau

SEQ ID NO: 961 - RNA, 19 nt, Homo sapiens
ugaacaagcucaaguggaa

SEQ ID NO: 962 - RNA, 19 nt, Homo sapiens
ccagagugaucaaguguga

SEQ ID NO: 963 - RNA, 19 nt, Homo sapiens
guucguggccucuaagaug

SEQ ID NO: 964 - RNA, 19 nt, Homo sapiens
ccgagaagcugugcaucua

SEQ ID NO: 965 - RNA, 19 nt, Homo sapiens
ugaauuaccuggaccguuu

SEQ ID NO: 966 - RNA, 19 nt, Homo sapiens
cggagaagcugugcauuua

SEQ ID NO: 967 - RNA, 19 nt, Homo sapiens
cuacagacgugcgggauau

SEQ ID NO: 968 - RNA, 19 nt, Homo sapiens
caacacagacguggauugu

SEQ ID NO: 969 - RNA, 19 nt, Homo sapiens
ggaccuggcugcugugauu

SEQ ID NO: 970 - RNA, 19 nt, Homo sapiens
gauuauaccuuugccaugu

SEQ ID NO: 971 - RNA, 19 nt, Homo sapiens
gaccagcacuccuacagau

SEQ ID NO: 972 - RNA, 19 nt, Homo sapiens
ugcggaagaugcuggcuua

SEQ ID NO: 973 - RNA, 19 nt, Homo sapiens
guacugagcugggcaaaua

SEQ ID NO: 974 - RNA, 19 nt, Homo sapiens
ggaaaucuauccuccaaag

SEQ ID NO: 975 - RNA, 19 nt, Homo sapiens
ggaggugugugaagucuau

SEQ ID NO: 976 - RNA, 19 nt, Homo sapiens
cuaaaugacuuacaugaag

SEQ ID NO: 977 - RNA, 19 nt, Homo sapiens
ggauggaacucauuauauu

SEQ ID NO: 978 - RNA, 19 nt, Homo sapiens
gcagauauguucaugacaa

SEQ ID NO: 979 - RNA, 19 nt, Homo sapiens
cauaauauccagacacaua

SEQ ID NO: 980 - RNA, 19 nt, Homo sapiens
uaagaaagccucagguuug

SEQ ID NO: 981 - RNA, 19 nt, Homo sapiens
ucacaaagcauccauauug

SEQ ID NO: 982 - RNA, 19 nt, Homo sapiens
gaagucauguuuacagugu

SEQ ID NO: 983 - RNA, 19 nt, Homo sapiens
uagccuaccucuacaauga

SEQ ID NO: 984 - RNA, 19 nt, Homo sapiens
gcacccgguuuaucaguaa

SEQ ID NO: 985 - RNA, 19 nt, Homo sapiens
gauaauggccucagaauga

SEQ ID NO: 986 - RNA, 19 nt, Homo sapiens
gcacggcaauugaagcaua

SEQ ID NO: 987 - RNA, 19 nt, Homo sapiens
ggaauagaaugucuucaga

SEQ ID NO: 988 - RNA, 19 nt, Homo sapiens
uaacucaccuuccaacaau

SEQ ID NO: 989 - RNA, 19 nt, Homo sapiens
ggagagaguugguuucuaa

SEQ ID NO: 990 - RNA, 19 nt, Homo sapiens
ggugaaaccuaaacauuug

SEQ ID NO: 991 - RNA, 19 nt, Homo sapiens
gaaauacugagccuugaua

SEQ ID NO: 992 - RNA, 19 nt, Homo sapiens
ugccaaaguugaagauuua

SEQ ID NO: 993 - RNA, 19 nt, Homo sapiens
gcugaugacuuucuuaaua

SEQ ID NO: 994 - RNA, 19 nt, Homo sapiens
caacuuaauuuccaccuua

SEQ ID NO: 995 - RNA, 19 nt, Homo sapiens
auacacaccuucccaaauu

SEQ ID NO: 996 - RNA, 19 nt, Homo sapiens
gcuaugaagaugaugauua

SEQ ID NO: 997 - RNA, 19 nt, Homo sapiens
gcaagcagaccucuacuaa

SEQ ID NO: 998 - RNA, 19 nt, Homo sapiens
ugagagaauuccaguacua

SEQ ID NO: 999 - RNA, 19 nt, Homo sapiens
ggaaucaaacggcucuaua

SEQ ID NO: 1000 - RNA, 19 nt, Homo sapiens
gaauugggaucuucacaca

SEQ ID NO: 1001 - RNA, 19 nt, Homo sapiens
uaucaacacugcuauagua

SEQ ID NO: 1002 - RNA, 19 nt, Homo sapiens
gaacaaacguccuggugau

SEQ ID NO: 1003 - RNA, 19 nt, Homo sapiens
gcacaagacucacccaucu

SEQ ID NO: 1004 - RNA, 19 nt, Homo sapiens
gcacagacuucuuacuuca

SEQ ID NO: 1005 - RNA, 19 nt, Homo sapiens
gcacagacauccuauuuca

SEQ ID NO: 1006 - RNA, 19 nt, Homo sapiens
gcagggaccuucuauauca

SEQ ID NO: 1007 - RNA, 19 nt, Homo sapiens
gaacagcuauauucacaga

SEQ ID NO: 1008 - RNA, 19 nt, Homo sapiens
uuauauagcugcccaggua

SEQ ID NO: 1009 - RNA, 19 nt, Homo sapiens
gcacagacauccuauuuca

SEQ ID NO: 1010 - RNA, 19 nt, Homo sapiens
gcagggaccuucuauauca

SEQ ID NO: 1011 - RNA, 19 nt, Homo sapiens
gaacagcuauauucacaga

SEQ ID NO: 1012 - RNA, 19 nt, Homo sapiens
ggugaaauguacccaguua

SEQ ID NO: 1013 - RNA, 19 nt, Homo sapiens
guagauggcuugcaagaga

SEQ ID NO: 1014 - RNA, 19 nt, Homo sapiens
uaaaguagcuucacucucu

SEQ ID NO: 1015 - RNA, 19 nt, Homo sapiens
gcuacaagcuuacuucugu

SEQ ID NO: 1016 - RNA, 19 nt, Homo sapiens
uggaagagcccaucaauaa

SEQ ID NO: 1017 - RNA, 19 nt, Homo sapiens
guacagaucuccagaagua

SEQ ID NO: 1018 - RNA, 19 nt, Homo sapiens
gaucaacucuucaggauuu

SEQ ID NO: 1019 - RNA, 19 nt, Homo sapiens
gguuauaucucaucuuuga

SEQ ID NO: 1020 - RNA, 19 nt, Homo sapiens
gaacuucgucauccaaaua

SEQ ID NO: 1021 - RNA, 19 nt, Homo sapiens
gggaauauauauccucugu

SEQ ID NO: 1022 - RNA, 19 nt, Homo sapiens
gaaacggcuucgaaauaug

SEQ ID NO: 1023 - RNA, 19 nt, Homo sapiens
gaagaccugccguuacauu

SEQ ID NO: 1024 - RNA, 19 nt, Homo sapiens
caccagugaucgacacauu

SEQ ID NO: 1025 - RNA, 19 nt, Homo sapiens
gaaauuauggcaucuguuu

SEQ ID NO: 1026 - RNA, 19 nt, Homo sapiens
uacaaggaguucuuuauga

SEQ ID NO: 1027 - RNA, 19 nt, Homo sapiens
ccacgaggacuuuaaagaa

SEQ ID NO: 1028 - RNA, 19 nt, Homo sapiens
ugggaaacaucaggauuua

SEQ ID NO: 1029 - RNA, 19 nt, Homo sapiens
gcagauaccccuaugaaua

SEQ ID NO: 1030 - RNA, 19 nt, Homo sapiens
cuaggucgcuucucucuga

SEQ ID NO: 1031 - RNA, 19 nt, Homo sapiens
gagagcugauuggagauua

SEQ ID NO: 1032 - RNA, 19 nt, Homo sapiens
aaaaggaccucgucaugua

SEQ ID NO: 1033 - RNA, 19 nt, Homo sapiens
gagcagaaguggccuauau

SEQ ID NO: 1034 - RNA, 19 nt, Homo sapiens
cagaagagauuucagauga

SEQ ID NO: 1035 - RNA, 19 nt, Homo sapiens
ccagggagccuuaaacuua

SEQ ID NO: 1036 - RNA, 19 nt, Homo sapiens
gaaacuugguggacaguga

SEQ ID NO: 1037 - RNA, 19 nt, Homo sapiens
caugcaagcugaaagaaua

SEQ ID NO: 1038 - RNA, 19 nt, Homo sapiens
caacacaaguaccuaauca

SEQ ID NO: 1039 - RNA, 19 nt, Homo sapiens
ggagauggauccuauuuac

SEQ ID NO: 1040 - RNA, 19 nt, Homo sapiens
gaaaagccaugaugauauu

SEQ ID NO: 1041 - RNA, 19 nt, Homo sapiens
gcucagaccucuucuacga

SEQ ID NO: 1042 - RNA, 19 nt, Homo sapiens
ggacgagggcgaucuauac

SEQ ID NO: 1043 - RNA, 19 nt, Homo sapiens
gaucgggaguacacagaca

SEQ ID NO: 1044 - RNA, 19 nt, Homo sapiens
ugaacgagcccaacaccuu

SEQ ID NO: 1045 - RNA, 19 nt, Homo sapiens
gcgaggagacagccaauua

SEQ ID NO: 1046 - RNA, 19 nt, Homo sapiens
cacaagaccuucguggaaa

SEQ ID NO: 1047 - RNA, 19 nt, Homo sapiens
acaaucgucaugcaauuua

SEQ ID NO: 1048 - RNA, 19 nt, Homo sapiens
gaggagaaaugugcacuca

SEQ ID NO: 1049 - RNA, 19 nt, Homo sapiens
gcacacggaucuccuuuga

SEQ ID NO: 1050 - RNA, 19 nt, Homo sapiens
gcaaacaccugcucaaguc

SEQ ID NO: 1051 - RNA, 19 nt, Homo sapiens
ugaagagucugcaaauaaa

SEQ ID NO: 1052 - RNA, 19 nt, Homo sapiens
ggacguggaugcucugugu

SEQ ID NO: 1053 - RNA, 19 nt, Homo sapiens
gaacacagcugucccagau

SEQ ID NO: 1054 - RNA, 19 nt, Homo sapiens
gagcagagauguccacuga

SEQ ID NO: 1055 - RNA, 19 nt, Homo sapiens
ggaaauaucuuagcuacug

SEQ ID NO: 1056 - RNA, 19 nt, Homo sapiens
ggacgaagauugguauuug

SEQ ID NO: 1057 - RNA, 19 nt, Homo sapiens
ggaaugagguaccugauga

SEQ ID NO: 1058 - RNA, 19 nt, Homo sapiens
caggaaagguguucacaaa

SEQ ID NO: 1059 - RNA, 19 nt, Homo sapiens
cuacacaaaugcacaaauu

SEQ ID NO: 1060 - RNA, 19 nt, Homo sapiens
guacgggaauauaugcuua

SEQ ID NO: 1061 - RNA, 19 nt, Homo sapiens
gaacugcuguugggaacca

SEQ ID NO: 1062 - RNA, 19 nt, Homo sapiens
ggaagcagcccuacaacaa

SEQ ID NO: 1063 - RNA, 19 nt, Homo sapiens
gcacgcccagugagaacau

SEQ ID NO: 1064 - RNA, 19 nt, Homo sapiens
ggaagcagcccuacaacaa

SEQ ID NO: 1065 - RNA, 19 nt, Homo sapiens
gagcuuaaccauccuaaua

SEQ ID NO: 1066 - RNA, 19 nt, Homo sapiens
gagcuuaaccauccuaaua

SEQ ID NO: 1067 - RNA, 19 nt, Homo sapiens
guaccgagcuccugaaauc

SEQ ID NO: 1068 - RNA, 19 nt, Homo sapiens
gagaggugguggcgcuuaa

SEQ ID NO: 1069 - RNA, 19 nt, Homo sapiens
gagcauugguugcaucuuu

SEQ ID NO: 1070 - RNA, 19 nt, Homo sapiens
gaucggagagggcaccuau

SEQ ID NO: 1071 - RNA, 19 nt, Homo sapiens
gaagcucuaucugguguuu

SEQ ID NO: 1072 - RNA, 19 nt, Homo sapiens
gcagagauggugacucgaa

SEQ ID NO: 1073 - RNA, 19 nt, Homo sapiens
gcagcacucuuaucuacau

SEQ ID NO: 1074 - RNA, 19 nt, Homo sapiens
ggaggaggccuucccauca

SEQ ID NO: 1075 - RNA, 19 nt, Homo sapiens
ucgaaagccucucuucugu

SEQ ID NO: 1076 - RNA, 19 nt, Homo sapiens
guaccgagcucccgaaguu

SEQ ID NO: 1077 - RNA, 19 nt, Homo sapiens
ugaccaagcugccagacua

SEQ ID NO: 1078 - RNA, 19 nt, Homo sapiens
gagcugaaauuggcugauu

SEQ ID NO: 1079 - RNA, 19 nt, Homo sapiens
caacaucccuggugaacgu

SEQ ID NO: 1080 - RNA, 19 nt, Homo sapiens
ggauucccguccgcuguua

SEQ ID NO: 1081 - RNA, 19 nt, Homo sapiens
gcaaagaccuacuucugaa

SEQ ID NO: 1082 - RNA, 19 nt, Homo sapiens
gaagaagacuggccuagag

SEQ ID NO: 1083 - RNA, 19 nt, Homo sapiens
ggucuggacuuucuucauu

SEQ ID NO: 1084 - RNA, 19 nt, Homo sapiens
uaacagauaucgaugaacu

SEQ ID NO: 1085 - RNA, 19 nt, Homo sapiens
ggacauagaucagaagcua

SEQ ID NO: 1086 - RNA, 19 nt, Homo sapiens
caauagagcuuauacacau

SEQ ID NO: 1087 - RNA, 19 nt, Homo sapiens
cauacaaggcuuauucuua

SEQ ID NO: 1088 - RNA, 19 nt, Homo sapiens
ggagacgacuuacuagauc

SEQ ID NO: 1089 - RNA, 19 nt, Homo sapiens
ccacaguacucacaucaga

SEQ ID NO: 1090 - RNA, 19 nt, Homo sapiens
gcaauaaccacacuaaugg

SEQ ID NO: 1091 - RNA, 19 nt, Homo sapiens
gaagaaagugagaguuguu

SEQ ID NO: 1092 - RNA, 19 nt, Homo sapiens
gaacaugaccucuggcaua

SEQ ID NO: 1093 - RNA, 19 nt, Homo sapiens
ggccaaacguggacaacua

SEQ ID NO: 1094 - RNA, 19 nt, Homo sapiens
ugacguccauguucgagua

SEQ ID NO: 1095 - RNA, 19 nt, Homo sapiens
ccaaccagacggaguuuga

SEQ ID NO: 1096 - RNA, 19 nt, Homo sapiens
gaagguggcucugaagaag

SEQ ID NO: 1097 - RNA, 19 nt, Homo sapiens
gaccagaaccgcugggauu

SEQ ID NO: 1098 - RNA, 19 nt, Homo sapiens
ggaccgaaguggacagcga

SEQ ID NO: 1099 - RNA, 19 nt, Homo sapiens
gcaagagaucagcgccuga

SEQ ID NO: 1100 - RNA, 19 nt, Homo sapiens
ccgcugggauuacgacuuc

SEQ ID NO: 1101 - RNA, 19 nt, Homo sapiens
gcgaggagaacaagggcau

SEQ ID NO: 1102 - RNA, 19 nt, Homo sapiens
ccaacggagucaaccguuu

SEQ ID NO: 1103 - RNA, 19 nt, Homo sapiens
cgauccaggucaugaugau

SEQ ID NO: 1104 - RNA, 19 nt, Homo sapiens
ccuggaagccggcgcggau

SEQ ID NO: 1105 - RNA, 19 nt, Homo sapiens
ggacaccgccugugauuug

SEQ ID NO: 1106 - RNA, 19 nt, Homo sapiens
gccaggagacugcuacuua

SEQ ID NO: 1107 - RNA, 19 nt, Homo sapiens
ugaaagaccgaacugguuu

SEQ ID NO: 1108 - RNA, 19 nt, Homo sapiens
gaaccugcccuugcacuug

SEQ ID NO: 1109 - RNA, 19 nt, Homo sapiens
uggcaguucaagaggguca

SEQ ID NO: 1110 - RNA, 19 nt, Homo sapiens
cucaggaccucguggacau

SEQ ID NO: 1111 - RNA, 19 nt, Homo sapiens
ugaagguccuaguggagca

SEQ ID NO: 1112 - RNA, 19 nt, Homo sapiens
agacggcgcugcaggucau

SEQ ID NO: 1113 - RNA, 19 nt, Homo sapiens
ccaaggaggcacagaagca

SEQ ID NO: 1114 - RNA, 19 nt, Homo sapiens
gcuucaacguggaugaagu

SEQ ID NO: 1115 - RNA, 19 nt, Homo sapiens
ucuccgggccagaagauaa

SEQ ID NO: 1116 - RNA, 19 nt, Homo sapiens
gcgcaauguuggccagauc

SEQ ID NO: 1117 - RNA, 19 nt, Homo sapiens
gcacacaccucuugauaag

SEQ ID NO: 1118 - RNA, 19 nt, Homo sapiens
gcaagagaaauauguguua

SEQ ID NO: 1119 - RNA, 19 nt, Homo sapiens
uuacaugcaggccgaguua

SEQ ID NO: 1120 - RNA, 19 nt, Homo sapiens
gagacaagguuggcuaaag

SEQ ID NO: 1121 - RNA, 19 nt, Homo sapiens
ggacauagccgccugcuuu

SEQ ID NO: 1122 - RNA, 19 nt, Homo sapiens
gcacgauccugaagaacaa

SEQ ID NO: 1123 - RNA, 19 nt, Homo sapiens
ggaggagggugauguugau

SEQ ID NO: 1124 - RNA, 19 nt, Homo sapiens
ccgaauggcugcagagucu

SEQ ID NO: 1125 - RNA, 19 nt, Homo sapiens
gcgaauagauuaucaagga

SEQ ID NO: 1126 - RNA, 19 nt, Homo sapiens
gaacagaauccaucacaaa

SEQ ID NO: 1127 - RNA, 19 nt, Homo sapiens
ccauaaaccucacccagua

SEQ ID NO: 1128 - RNA, 19 nt, Homo sapiens
caagagaacacguuugaaa

SEQ ID NO: 1129 - RNA, 19 nt, Homo sapiens
gaagacagcucaaauaaua

SEQ ID NO: 1130 - RNA, 19 nt, Homo sapiens
caacaaagcuacuaaauca

SEQ ID NO: 1131 - RNA, 19 nt, Homo sapiens
ggaaagaagugcuaccaua

SEQ ID NO: 1132 - RNA, 19 nt, Homo sapiens
ggaaagaaaugacacaguu

SEQ ID NO: 1133 - RNA, 19 nt, Homo sapiens
gcgaauaucugaauuagaa

SEQ ID NO: 1134 - RNA, 19 nt, Homo sapiens
ggaaauuaaugcauccuua

SEQ ID NO: 1135 - RNA, 19 nt, Homo sapiens
gagcgaggcuggugguuua

SEQ ID NO: 1136 - RNA, 19 nt, Homo sapiens
caagucaucuuucaucuaa

SEQ ID NO: 1137 - RNA, 19 nt, Homo sapiens
gaaagaagagauugcaauu

SEQ ID NO: 1138 - RNA, 19 nt, Homo sapiens
cagaacaaauuaugcaaga

SEQ ID NO: 1139 - RNA, 19 nt, Homo sapiens
cuagugugcucauggauaa

SEQ ID NO: 1140 - RNA, 19 nt, Homo sapiens
gaaacaccuauuagagcua

SEQ ID NO: 1141 - RNA, 19 nt, Homo sapiens
caaauuggaugcagacaaa

SEQ ID NO: 1142 - RNA, 19 nt, Homo sapiens
gcaacaguauuucgguaua

SEQ ID NO: 1143 - RNA, 19 nt, Homo sapiens
ggacuucucuccaguaaac

SEQ ID NO: 1144 - RNA, 19 nt, Homo sapiens
aaagauagaugguacaaca

SEQ ID NO: 1145 - RNA, 19 nt, Homo sapiens
cucuuacauugcauacaua

SEQ ID NO: 1146 - RNA, 19 nt, Homo sapiens
uaaacgccugaaagaagcu

SEQ ID NO: 1147 - RNA, 19 nt, Homo sapiens
gcauaggacucaaguguca

SEQ ID NO: 1148 - RNA, 19 nt, Homo sapiens
gaaauugcacugucacuaa

SEQ ID NO: 1149 - RNA, 19 nt, Homo sapiens
gcgagaagauccuaaauga

SEQ ID NO: 1150 - RNA, 19 nt, Homo sapiens
gcaaguggguugacuacuc

SEQ ID NO: 1151 - RNA, 19 nt, Homo sapiens
gcacauccguuggccauca

SEQ ID NO: 1152 - RNA, 19 nt, Homo sapiens
gaccucaaguugggaaauu

SEQ ID NO: 1153 - RNA, 19 nt, Homo sapiens
gugaugagauuauugauag

SEQ ID NO: 1154 - RNA, 19 nt, Homo sapiens
ggacgagggcgaggaauuu

SEQ ID NO: 1155 - RNA, 19 nt, Homo sapiens
ggaaacggagccuugcuaa

SEQ ID NO: 1156 - RNA, 19 nt, Homo sapiens
ucaaucgucugaccgaaga

SEQ ID NO: 1157 - RNA, 19 nt, Homo sapiens
gaacagggccacugacucu

SEQ ID NO: 1158 - RNA, 19 nt, Homo sapiens
uggaccaccugaugaauau

SEQ ID NO: 1159 - RNA, 19 nt, Homo sapiens
cccaggaggucacuucuga

SEQ ID NO: 1160 - RNA, 19 nt, Homo sapiens
ggcuggaccuggaaacuga

SEQ ID NO: 1161 - RNA, 19 nt, Homo sapiens
gggagaagacucgguauga

SEQ ID NO: 1162 - RNA, 19 nt, Homo sapiens
gaggacaaccugcagauau

SEQ ID NO: 1163 - RNA, 19 nt, Homo sapiens
ugaaggagcugaugaacac

SEQ ID NO: 1164 - RNA, 19 nt, Homo sapiens
ccaagaaguucauuuaccu

SEQ ID NO: 1165 - RNA, 19 nt, Homo sapiens
gaaauuagaugaacugauc

SEQ ID NO: 1166 - RNA, 19 nt, Homo sapiens
ugaagugccugacucaaua

SEQ ID NO: 1167 - RNA, 19 nt, Homo sapiens
gaacaaggcagcagaagug

SEQ ID NO: 1168 - RNA, 19 nt, Homo sapiens
gaaacacacaguccaauga

SEQ ID NO: 1169 - RNA, 19 nt, Homo sapiens
ggagauugcugacaaacug

SEQ ID NO: 1170 - RNA, 19 nt, Homo sapiens
gaagguaucgggcuaaucg

SEQ ID NO: 1171 - RNA, 19 nt, Homo sapiens
gugcagaaguccagggaau

SEQ ID NO: 1172 - RNA, 19 nt, Homo sapiens
ggacaguggugagcucagu

SEQ ID NO: 1173 - RNA, 19 nt, Homo sapiens
gcagaugacuacaacuuua

SEQ ID NO: 1174 - RNA, 19 nt, Homo sapiens
gacaucagcuacagauaua

SEQ ID NO: 1175 - RNA, 19 nt, Homo sapiens
caacaugucucugaaagaa

SEQ ID NO: 1176 - RNA, 19 nt, Homo sapiens
gaagacaucuguaauugcu

SEQ ID NO: 1177 - RNA, 19 nt, Homo sapiens
uaaacaagguugcaacgaa

SEQ ID NO: 1178 - RNA, 19 nt, Homo sapiens
uagcauaugugaccuauca

SEQ ID NO: 1179 - RNA, 19 nt, Homo sapiens
gaaaccagauuggauguuc

SEQ ID NO: 1180 - RNA, 19 nt, Homo sapiens
ggaacuuucugacuuauca

SEQ ID NO: 1181 - RNA, 19 nt, Homo sapiens
gggauagccucucuuacua

SEQ ID NO: 1182 - RNA, 19 nt, Homo sapiens
gaacaguuaucuccagaag

SEQ ID NO: 1183 - RNA, 19 nt, Homo sapiens
ggagacagaccaacuagaa

SEQ ID NO: 1184 - RNA, 19 nt, Homo sapiens
agaccgagcccuuugauga

SEQ ID NO: 1185 - RNA, 19 nt, Homo sapiens
gagaaucacuccaaucgaa

SEQ ID NO: 1186 - RNA, 19 nt, Homo sapiens
agacagggauuaagucaaa

SEQ ID NO: 1187 - RNA, 19 nt, Homo sapiens
ggacaaagacaacuagguu

SEQ ID NO: 1188 - RNA, 19 nt, Homo sapiens
gcacacacgucaaaucaug

SEQ ID NO: 1189 - RNA, 19 nt, Homo sapiens
acaaaggccuuaugcaaua

SEQ ID NO: 1190 - RNA, 19 nt, Homo sapiens
gaagugcacauagauauua

SEQ ID NO: 1191 - RNA, 19 nt, Homo sapiens
aagcuuaacuucauccuuu

SEQ ID NO: 1192 - RNA, 19 nt, Homo sapiens
gaacuucuucaacgaauuu

SEQ ID NO: 1193 - RNA, 19 nt, Homo sapiens
uggaaacgaccuucuauga

SEQ ID NO: 1194 - RNA, 19 nt, Homo sapiens
gaacugcacagccagaaca

SEQ ID NO: 1195 - RNA, 19 nt, Homo sapiens
gagcuggagcgccugauaa

SEQ ID NO: 1196 - RNA, 19 nt, Homo sapiens
uaacgcagcaguugcaaac

SEQ ID NO: 1197 - RNA, 19 nt, Homo sapiens
gcaucaaaguggagcgcaa

SEQ ID NO: 1198 - RNA, 19 nt, Homo sapiens
uggaagaccaagagcgcau

SEQ ID NO: 1199 - RNA, 19 nt, Homo sapiens
cauacacagcuacgggaua

SEQ ID NO: 1200 - RNA, 19 nt, Homo sapiens
ccaucaacauggaagacca

SEQ ID NO: 1201 - RNA, 19 nt, Homo sapiens
ggagaaaggcgcuguauga

SEQ ID NO: 1202 - RNA, 19 nt, Homo sapiens
gaauaguucugucccaaga

SEQ ID NO: 1203 - RNA, 19 nt, Homo sapiens
gaacauguacaguauaugg

SEQ ID NO: 1204 - RNA, 19 nt, Homo sapiens
gcagaaacaagaagaaauc

SEQ ID NO: 1205 - RNA, 19 nt, Homo sapiens
gaaagauggcaguuugaua

SEQ ID NO: 1206 - RNA, 19 nt, Homo sapiens
uaaauaaugugguggaaca

SEQ ID NO: 1207 - RNA, 19 nt, Homo sapiens
gaaauccguucagugauca

SEQ ID NO: 1208 - RNA, 19 nt, Homo sapiens
uuacucgagugcagaaaua

SEQ ID NO: 1209 - RNA, 19 nt, Homo sapiens
ggaagagcgcgcucauaaa

SEQ ID NO: 1210 - RNA, 19 nt, Homo sapiens
uggaagagcgcgcucauaa

SEQ ID NO: 1211 - RNA, 19 nt, Homo sapiens
agccacuccuggagaagaa

SEQ ID NO: 1212 - RNA, 19 nt, Homo sapiens
uggagaaauucgucuuuga

SEQ ID NO: 1213 - RNA, 19 nt, Homo sapiens
gaagaucuuugccagcauu

SEQ ID NO: 1214 - RNA, 19 nt, Homo sapiens
ggauaaggcucgucagauc

SEQ ID NO: 1215 - RNA, 19 nt, Homo sapiens
cagagcaggugacauauca

SEQ ID NO: 1216 - RNA, 19 nt, Homo sapiens
gccgugggcuccuguauga

SEQ ID NO: 1217 - RNA, 19 nt, Homo sapiens
ggacaucaauauucuucua

SEQ ID NO: 1218 - RNA, 19 nt, Homo sapiens
gccaggacaucuccaguua

SEQ ID NO: 1219 - RNA, 19 nt, Homo sapiens
gcagguaugaccaguauaa

SEQ ID NO: 1220 - RNA, 19 nt, Homo sapiens
ggaaaugccucaaguacac

SEQ ID NO: 1221 - RNA, 19 nt, Homo sapiens
ggacauaucuauucuuacu

SEQ ID NO: 1222 - RNA, 19 nt, Homo sapiens
gauguuaguucaccacuga

SEQ ID NO: 1223 - RNA, 19 nt, Homo sapiens
ccagcugccucauacuuua

SEQ ID NO: 1224 - RNA, 19 nt, Homo sapiens
gaaaguacaagaucgguau

SEQ ID NO: 1225 - RNA, 19 nt, Homo sapiens
gaagaucccuggcaucauc

SEQ ID NO: 1226 - RNA, 19 nt, Homo sapiens
gaacaggguuaccaucaug

SEQ ID NO: 1227 - RNA, 19 nt, Homo sapiens
ggacaacauugacuucaug

SEQ ID NO: 1228 - RNA, 19 nt, Homo sapiens
ccaaggagguagcugauga

SEQ ID NO: 1229 - RNA, 19 nt, Homo sapiens
ggaaagagcucagagauga

SEQ ID NO: 1230 - RNA, 19 nt, Homo sapiens
gagcagcgauggagaaauu

SEQ ID NO: 1231 - RNA, 19 nt, Homo sapiens
ggaaacaccugaugucaau

SEQ ID NO: 1232 - RNA, 19 nt, Homo sapiens
ccaaacaucugccgaaauc

SEQ ID NO: 1233 - RNA, 19 nt, Homo sapiens
ggaaauaucccucguagua

SEQ ID NO: 1234 - RNA, 19 nt, Homo sapiens
ggaagaagcaguucaagua

SEQ ID NO: 1235 - RNA, 19 nt, Homo sapiens
caacaagccucgugugauc

SEQ ID NO: 1236 - RNA, 19 nt, Homo sapiens
ggagagaacacaaggauug

SEQ ID NO: 1237 - RNA, 19 nt, Homo sapiens
ggagauauguugugaaaga

SEQ ID NO: 1238 - RNA, 19 nt, Homo sapiens
ccacaaaucugauaguauu

SEQ ID NO: 1239 - RNA, 19 nt, Homo sapiens
gaugagguauaucaaguua

SEQ ID NO: 1240 - RNA, 19 nt, Homo sapiens
ggaagaaacccaagacaaa

SEQ ID NO: 1241 - RNA, 19 nt, Homo sapiens
gcacaaagcuugguuauaa

SEQ ID NO: 1242 - RNA, 19 nt, Homo sapiens
ccuaagaccugaacuauuu

SEQ ID NO: 1243 - RNA, 19 nt, Homo sapiens
caaagaggaacacaaauua

SEQ ID NO: 1244 - RNA, 19 nt, Homo sapiens
guaaaugggucuguuauug

SEQ ID NO: 1245 - RNA, 19 nt, Homo sapiens
ggaagaagcuuuagaagug

SEQ ID NO: 1246 - RNA, 19 nt, Homo sapiens
uagaugagcuggagaguuc

SEQ ID NO: 1247 - RNA, 19 nt, Homo sapiens
ggaccuugcuggaggcuau

SEQ ID NO: 1248 - RNA, 19 nt, Homo sapiens
gcagauagagacauaugga

SEQ ID NO: 1249 - RNA, 19 nt, Homo sapiens
cagagaagcuggccuccua

SEQ ID NO: 1250 - RNA, 19 nt, Homo sapiens
gaaacgacgagaacaguug

SEQ ID NO: 1251 - RNA, 19 nt, Homo sapiens
cgacgagaccuucaucaaa

SEQ ID NO: 1252 - RNA, 19 nt, Homo sapiens
ccacacaucagcacaacua

SEQ ID NO: 1253 - RNA, 19 nt, Homo sapiens
gaacaggaauuccaagaca

SEQ ID NO: 1254 - RNA, 19 nt, Homo sapiens
uaagaaacgugcucgagua

SEQ ID NO: 1255 - RNA, 19 nt, Homo sapiens
gagaucaccucaccuucua

SEQ ID NO: 1256 - RNA, 19 nt, Homo sapiens
gcagagagcccuucuugga

SEQ ID NO: 1257 - RNA, 19 nt, Homo sapiens
gaagaaaccuccuaugaga

SEQ ID NO: 1258 - RNA, 19 nt, Homo sapiens
gaagggaacugauggagua

SEQ ID NO: 1259 - RNA, 19 nt, Homo sapiens
gaagaaugauccugagauu

SEQ ID NO: 1260 - RNA, 19 nt, Homo sapiens
gaagagauguucaagaauc

SEQ ID NO: 1261 - RNA, 19 nt, Homo sapiens
ggacugcuguguagauaua

SEQ ID NO: 1262 - RNA, 19 nt, Homo sapiens
gaacugaugaccauacuug

SEQ ID NO: 1263 - RNA, 19 nt, Homo sapiens
aaagaucucucugccaaua

SEQ ID NO: 1264 - RNA, 19 nt, Homo sapiens
cagcacagcuaagagaaua

SEQ ID NO: 1265 - RNA, 19 nt, Homo sapiens
gaaagcacauuccguuuau

SEQ ID NO: 1266 - RNA, 19 nt, Homo sapiens
ugaaagaacucauggaaau

SEQ ID NO: 1267 - RNA, 19 nt, Homo sapiens
gcugagaaguggaaugaaa

SEQ ID NO: 1268 - RNA, 19 nt, Homo sapiens
ccagugaucuucauauuag

SEQ ID NO: 1269 - RNA, 19 nt, Homo sapiens
gaaauaaccugugaaacau

SEQ ID NO: 1270 - RNA, 19 nt, Homo sapiens
cagauuaccucucuaguga

SEQ ID NO: 1271 - RNA, 19 nt, Homo sapiens
gaacuuccauauuacucua

SEQ ID NO: 1272 - RNA, 19 nt, Homo sapiens
guauucagcugauuucuau

SEQ ID NO: 1273 - RNA, 19 nt, Homo sapiens
gaacauggcuucaaagaua

SEQ ID NO: 1274 - RNA, 19 nt, Homo sapiens
ggacagggcuuauuuaauu

SEQ ID NO: 1275 - RNA, 19 nt, Homo sapiens
gaaagaagauagugguuga

SEQ ID NO: 1276 - RNA, 19 nt, Homo sapiens
uaucagagcugucuuaaau

SEQ ID NO: 1277 - RNA, 19 nt, Homo sapiens
gaucgaggaugaagaagga

SEQ ID NO: 1278 - RNA, 19 nt, Homo sapiens
gccgagaucucagccauau

SEQ ID NO: 1279 - RNA, 19 nt, Homo sapiens
gaggccugcugggauauua

SEQ ID NO: 1280 - RNA, 19 nt, Homo sapiens
guggagaacuuggaaaugg

SEQ ID NO: 1281 - RNA, 19 nt, Homo sapiens
caaccaaagucgaauauga

SEQ ID NO: 1282 - RNA, 19 nt, Homo sapiens
caagaagaaugaauacagu

SEQ ID NO: 1283 - RNA, 19 nt, Homo sapiens
gaagauguccauggaaaua

SEQ ID NO: 1284 - RNA, 19 nt, Homo sapiens
caacacgccucauccucua

SEQ ID NO: 1285 - RNA, 19 nt, Homo sapiens
ggaccaaggaggaggcccu

SEQ ID NO: 1286 - RNA, 19 nt, Homo sapiens
cguccuggcggcaggagaa

SEQ ID NO: 1287 - RNA, 19 nt, Homo sapiens
cgggagaggaggacuuuga

SEQ ID NO: 1288 - RNA, 19 nt, Homo sapiens
agucgggagaggaggacuu

SEQ ID NO: 1289 - RNA, 19 nt, Homo sapiens
cgaccuggcggcaggaaau

SEQ ID NO: 1290 - RNA, 19 nt, Homo sapiens
aggcaggagagaaggacuu

SEQ ID NO: 1291 - RNA, 19 nt, Homo sapiens
gcuacauccagaagaucaa

SEQ ID NO: 1292 - RNA, 19 nt, Homo sapiens
ggacaguguucacggauuc

SEQ ID NO: 1293 - RNA, 19 nt, Homo sapiens
gaagauggacaaauauguu

SEQ ID NO: 1294 - RNA, 19 nt, Homo sapiens
ggaagagucuguuacuuuu

SEQ ID NO: 1295 - RNA, 19 nt, Homo sapiens
gauaacagaggcuuccuuu

SEQ ID NO: 1296 - RNA, 19 nt, Homo sapiens
gcauuaguccuaucuugua

SEQ ID NO: 1297 - RNA, 19 nt, Homo sapiens
gaaucaagcuuccauaugu

SEQ ID NO: 1298 - RNA, 19 nt, Homo sapiens
caacaaagcccgaggauau

SEQ ID NO: 1299 - RNA, 19 nt, Homo sapiens
acacaugccuggagacuua

SEQ ID NO: 1300 - RNA, 19 nt, Homo sapiens
cuacauagauuucuucaug

SEQ ID NO: 1301 - RNA, 19 nt, Homo sapiens
ucagcaaacuugaaucuua

SEQ ID NO: 1302 - RNA, 19 nt, Homo sapiens
gacauugacucuuacauga

SEQ ID NO: 1303 - RNA, 19 nt, Homo sapiens
ggaaaccacuauaggcaau

SEQ ID NO: 1304 - RNA, 19 nt, Homo sapiens
cggacgacuuugccaauga

SEQ ID NO: 1305 - RNA, 19 nt, Homo sapiens
gaaaggacaugugaacuua

SEQ ID NO: 1306 - RNA, 19 nt, Homo sapiens
gaagaaguaugauguauug

SEQ ID NO: 1307 - RNA, 19 nt, Homo sapiens
gaaaugacuucuacucgaa

SEQ ID NO: 1308 - RNA, 19 nt, Homo sapiens
ggagggaacaucuauauuu

SEQ ID NO: 1309 - RNA, 19 nt, Homo sapiens
caaagaagcugaauaaacu

SEQ ID NO: 1310 - RNA, 19 nt, Homo sapiens
caacacauauggcggauuu

SEQ ID NO: 1311 - RNA, 19 nt, Homo sapiens
ggacaaaccuagaaagaag

SEQ ID NO: 1312 - RNA, 19 nt, Homo sapiens
gaaaggcacucucucuguu

SEQ ID NO: 1313 - RNA, 19 nt, Homo sapiens
caagagaaguuguggcaua

SEQ ID NO: 1314 - RNA, 19 nt, Homo sapiens
cagcagcacuccauuuaua

SEQ ID NO: 1315 - RNA, 19 nt, Homo sapiens
acagaaaggucuaucauuu

SEQ ID NO: 1316 - RNA, 19 nt, Homo sapiens
ggacauaaaguuacaauuc

SEQ ID NO: 1317 - RNA, 19 nt, Homo sapiens
gagcagagcuuaaucgaau

SEQ ID NO: 1318 - RNA, 19 nt, Homo sapiens
gagaauagcccuuguguga

SEQ ID NO: 1319 - RNA, 19 nt, Homo sapiens
ggacuuaguuuauggaaau

SEQ ID NO: 1320 - RNA, 19 nt, Homo sapiens
gaauuuagaugagcggaua

SEQ ID NO: 1321 - RNA, 19 nt, Homo sapiens
gagacaagcuccagugugu

SEQ ID NO: 1322 - RNA, 19 nt, Homo sapiens
gcaagcaaguauucaagaa

SEQ ID NO: 1323 - RNA, 19 nt, Homo sapiens
gcaggacggugaccauaug

SEQ ID NO: 1324 - RNA, 19 nt, Homo sapiens
gcaagugcaugacaacagu

SEQ ID NO: 1325 - RNA, 19 nt, Homo sapiens
ggaagugguuggaagagua

SEQ ID NO: 1326 - RNA, 19 nt, Homo sapiens
gaagauagccauccuuuug

SEQ ID NO: 1327 - RNA, 19 nt, Homo sapiens
caugcuagcucaauucauc

SEQ ID NO: 1328 - RNA, 19 nt, Homo sapiens
gaucuuggacuuuacaaug

SEQ ID NO: 1329 - RNA, 19 nt, Homo sapiens
ggagagauauuugaaguug

SEQ ID NO: 1330 - RNA, 19 nt, Homo sapiens
gggaauggaugaugaagga

SEQ ID NO: 1331 - RNA, 19 nt, Homo sapiens
caaacaaucugugacuauu

SEQ ID NO: 1332 - RNA, 19 nt, Homo sapiens
ucaauuaaguugcagaguu

SEQ ID NO: 1333 - RNA, 19 nt, Homo sapiens
caucuagacuuaagugaua

SEQ ID NO: 1334 - RNA, 19 nt, Homo sapiens
gaaaucagaucucucuacu

SEQ ID NO: 1335 - RNA, 19 nt, Homo sapiens
cuaaaggucucugguguuu

SEQ ID NO: 1336 - RNA, 19 nt, Homo sapiens
gaugguacccuucaacugu

SEQ ID NO: 1337 - RNA, 19 nt, Homo sapiens
gaagacaucuacaagcuua

SEQ ID NO: 1338 - RNA, 19 nt, Homo sapiens
gaaauaccuucaugaacaa

SEQ ID NO: 1339 - RNA, 19 nt, Homo sapiens
gaaggucaauggcucauau

SEQ ID NO: 1340 - RNA, 19 nt, Homo sapiens
ccggagaucucgcggauua

SEQ ID NO: 1341 - RNA, 19 nt, Homo sapiens
cagaagagcugcacauuug

SEQ ID NO: 1342 - RNA, 19 nt, Homo sapiens
ccaaacugcucaggcauaa

SEQ ID NO: 1343 - RNA, 19 nt, Homo sapiens
acgcggcacuucacaauug

SEQ ID NO: 1344 - RNA, 19 nt, Homo sapiens
ugggacacccgacaucuua

SEQ ID NO: 1345 - RNA, 19 nt, Homo sapiens
ggaagcagcucuugccaaa

SEQ ID NO: 1346 - RNA, 19 nt, Homo sapiens
gaggagacuugaaagaaua

SEQ ID NO: 1347 - RNA, 19 nt, Homo sapiens
gaacuuagagguggaaaga

SEQ ID NO: 1348 - RNA, 19 nt, Homo sapiens
gcgagaaggugcagaggaa

SEQ ID NO: 1349 - RNA, 19 nt, Homo sapiens
gaaagugugugagaaaguu

SEQ ID NO: 1350 - RNA, 19 nt, Homo sapiens
cacaggaccuucuugguua

SEQ ID NO: 1351 - RNA, 19 nt, Homo sapiens
cgaaaucccuggugccaaa

SEQ ID NO: 1352 - RNA, 19 nt, Homo sapiens
ugagauccaugaugacaua

SEQ ID NO: 1353 - RNA, 19 nt, Homo sapiens
gagguuggcucugacugua

SEQ ID NO: 1354 - RNA, 19 nt, Homo sapiens
cagucuaccucccgccaua

SEQ ID NO: 1355 - RNA, 19 nt, Homo sapiens
gcacagaggaagagaaucu

SEQ ID NO: 1356 - RNA, 19 nt, Homo sapiens
gaagaaaccacuggaugga

SEQ ID NO: 1357 - RNA, 19 nt, Homo sapiens
caucaugucuggacuauuu

SEQ ID NO: 1358 - RNA, 19 nt, Homo sapiens
caaacaagauugagauuag

SEQ ID NO: 1359 - RNA, 19 nt, Homo sapiens
gcacacagacaaaugaauu

SEQ ID NO: 1360 - RNA, 19 nt, Homo sapiens
cgacagucuuguacaauuu

SEQ ID NO: 1361 - RNA, 19 nt, Homo sapiens
gcaagcagcccaucaagga

SEQ ID NO: 1362 - RNA, 19 nt, Homo sapiens
gagacgaggacacguacua

SEQ ID NO: 1363 - RNA, 19 nt, Homo sapiens
cugcagaaccugaccauug

SEQ ID NO: 1364 - RNA, 19 nt, Homo sapiens
ggccaugccuguuuacaag

SEQ ID NO: 1365 - RNA, 19 nt, Homo sapiens
gcaaggagcugaauuaucc

SEQ ID NO: 1366 - RNA, 19 nt, Homo sapiens
uaagagauaucugcaauga

SEQ ID NO: 1367 - RNA, 19 nt, Homo sapiens
gacggaaggugcugagaaa

SEQ ID NO: 1368 - RNA, 19 nt, Homo sapiens
agagcaaagucuucuauuu

SEQ ID NO: 1369 - RNA, 19 nt, Homo sapiens
ggaacucgaucguaucauu

SEQ ID NO: 1370 - RNA, 19 nt, Homo sapiens
caagggagguuacaccaaa

SEQ ID NO: 1371 - RNA, 19 nt, Homo sapiens
ucaaggaacucgaucguau

SEQ ID NO: 1372 - RNA, 19 nt, Homo sapiens
gaaaugauugcacuauuga

SEQ ID NO: 1373 - RNA, 19 nt, Homo sapiens
gaaugugccuggcuagaga

SEQ ID NO: 1374 - RNA, 19 nt, Homo sapiens
caugagagcugccaaccuu

SEQ ID NO: 1375 - RNA, 19 nt, Homo sapiens
agagaaagauuggccagua

SEQ ID NO: 1376 - RNA, 19 nt, Homo sapiens
caaggagacucgcuacugu

SEQ ID NO: 1377 - RNA, 19 nt, Homo sapiens
gaacaucugcucaacauga

SEQ ID NO: 1378 - RNA, 19 nt, Homo sapiens
gcacggcuccauauacaua

SEQ ID NO: 1379 - RNA, 19 nt, Homo sapiens
caagaagauucccggcuuu

SEQ ID NO: 1380 - RNA, 19 nt, Homo sapiens
ggaaaugcguagaaggaau

SEQ ID NO: 1381 - RNA, 19 nt, Homo sapiens
ggccuucgcugaggacuua

SEQ ID NO: 1382 - RNA, 19 nt, Homo sapiens
ugaaugcacuggugucuca

SEQ ID NO: 1383 - RNA, 19 nt, Homo sapiens
gcauugagccucucuacau

SEQ ID NO: 1384 - RNA, 19 nt, Homo sapiens
ccagacagcgggcaaagug

SEQ ID NO: 1385 - RNA, 19 nt, Homo sapiens
uaccugagcuuacaaauuu

SEQ ID NO: 1386 - RNA, 19 nt, Homo sapiens
gcacuucuauagcgucaaa

SEQ ID NO: 1387 - RNA, 19 nt, Homo sapiens
caacuccgauuccauguac

SEQ ID NO: 1388 - RNA, 19 nt, Homo sapiens
ggacucgccacccauguuu

SEQ ID NO: 1389 - RNA, 19 nt, Homo sapiens
aaacaaagaucgacacauu

SEQ ID NO: 1390 - RNA, 19 nt, Homo sapiens
ucaggaaacuguaugauga

SEQ ID NO: 1391 - RNA, 19 nt, Homo sapiens
gaagaccaguccaaauuag

SEQ ID NO: 1392 - RNA, 19 nt, Homo sapiens
augaagcgcugcaggauua

SEQ ID NO: 1393 - RNA, 19 nt, Homo sapiens
cgacaucacuggagcauau

SEQ ID NO: 1394 - RNA, 19 nt, Homo sapiens
gaaggaagccguccagaau

SEQ ID NO: 1395 - RNA, 19 nt, Homo sapiens
ccaaguacaucccagcuuu

SEQ ID NO: 1396 - RNA, 19 nt, Homo sapiens
ggacauggccgacuacagu

SEQ ID NO: 1397 - RNA, 19 nt, Homo sapiens
gcacugacauaaacguuaa

SEQ ID NO: 1398 - RNA, 19 nt, Homo sapiens
acaaagagauccaugaugu

SEQ ID NO: 1399 - RNA, 19 nt, Homo sapiens
agagauccaugauguauaa

SEQ ID NO: 1400 - RNA, 19 nt, Homo sapiens
aaaugaacgugacagaaua

SEQ ID NO: 1401 - RNA, 19 nt, Homo sapiens
gaaugaaucuacaccuuug

SEQ ID NO: 1402 - RNA, 19 nt, Homo sapiens
ggaaauacguggagacacu

SEQ ID NO: 1403 - RNA, 19 nt, Homo sapiens
ccagauaacuacggcgaua

SEQ ID NO: 1404 - RNA, 19 nt, Homo sapiens
uggcguaccuucucauuga

SEQ ID NO: 1405 - RNA, 19 nt, Homo sapiens
cagcauggaugauaugaug

SEQ ID NO: 1406 - RNA, 19 nt, Homo sapiens
cugcugagauucaucaaug

SEQ ID NO: 1407 - RNA, 19 nt, Homo sapiens
acagauucaucgaacuuaa

SEQ ID NO: 1408 - RNA, 19 nt, Homo sapiens
gaacguggcgcuccuguac

SEQ ID NO: 1409 - RNA, 19 nt, Homo sapiens
gaauaugccugccugaaag

SEQ ID NO: 1410 - RNA, 19 nt, Homo sapiens
ggaauaugccugccugaaa

SEQ ID NO: 1411 - RNA, 19 nt, Homo sapiens
cguagccgcugccuaugua

SEQ ID NO: 1412 - RNA, 19 nt, Homo sapiens
gccauucucuacgcacuuc

SEQ ID NO: 1413 - RNA, 19 nt, Homo sapiens
caacacagguggcgucauc

SEQ ID NO: 1414 - RNA, 19 nt, Homo sapiens
ggcaugguguuacugugua

SEQ ID NO: 1415 - RNA, 19 nt, Homo sapiens
caacaugcauuccgagaag

SEQ ID NO: 1416 - RNA, 19 nt, Homo sapiens
gcgcuuugcuucguuguuc

SEQ ID NO: 1417 - RNA, 19 nt, Homo sapiens
gaacagauccggaagaaga

SEQ ID NO: 1418 - RNA, 19 nt, Homo sapiens
gaagaacagauccggaaga

SEQ ID NO: 1419 - RNA, 19 nt, Homo sapiens
cuaagcaagugccugguuu

SEQ ID NO: 1420 - RNA, 19 nt, Homo sapiens
gcuaacagcggcucaagaa

SEQ ID NO: 1421 - RNA, 19 nt, Homo sapiens
gaacagauccgccugaaga

SEQ ID NO: 1422 - RNA, 19 nt, Homo sapiens
ggagauaguugacuuugcu

SEQ ID NO: 1423 - RNA, 19 nt, Homo sapiens
gaguuugccuugcucauug

SEQ ID NO: 1424 - RNA, 19 nt, Homo sapiens
ugacuuugcuaaacagcua

SEQ ID NO: 1425 - RNA, 19 nt, Homo sapiens
caagugaccucgacaacaa

SEQ ID NO: 1426 - RNA, 19 nt, Homo sapiens
gaaagaauucgaaauagug

SEQ ID NO: 1427 - RNA, 19 nt, Homo sapiens
caacagacucuucuacauu

SEQ ID NO: 1428 - RNA, 19 nt, Homo sapiens
gaaccauacucgcaauaca

SEQ ID NO: 1429 - RNA, 19 nt, Homo sapiens
gaaccaugcugacuuugua

SEQ ID NO: 1430 - RNA, 19 nt, Homo sapiens
gauggacgcucagaugaaa

SEQ ID NO: 1431 - RNA, 19 nt, Homo sapiens
caaccuacauguucaaagg

SEQ ID NO: 1432 - RNA, 19 nt, Homo sapiens
caggagcaauucgccauua

SEQ ID NO: 1433 - RNA, 19 nt, Homo sapiens
ggaaaucugucacaucgua

SEQ ID NO: 1434 - RNA, 19 nt, Homo sapiens
ucgcagacaucaacacuuu

SEQ ID NO: 1435 - RNA, 19 nt, Homo sapiens
ccucuucgcuacacaauug

SEQ ID NO: 1436 - RNA, 19 nt, Homo sapiens
gaacaguuugugcaguuua

SEQ ID NO: 1437 - RNA, 19 nt, Homo sapiens
ugacagcacuugaucauaa

SEQ ID NO: 1438 - RNA, 19 nt, Homo sapiens
ggaaggaaguguacaccua

SEQ ID NO: 1439 - RNA, 19 nt, Homo sapiens
gagcacaucuucaaacuac

SEQ ID NO: 1440 - RNA, 19 nt, Homo sapiens
gaagaaauugcacaucaaa

SEQ ID NO: 1441 - RNA, 19 nt, Homo sapiens
gaacaacggugacacuuca

SEQ ID NO: 1442 - RNA, 19 nt, Homo sapiens
cugaugagcuccaacauaa

SEQ ID NO: 1443 - RNA, 19 nt, Homo sapiens
caaccuaagugaaucuuug

SEQ ID NO: 1444 - RNA, 19 nt, Homo sapiens
gaagacaccuaccgauugg

SEQ ID NO: 1445 - RNA, 19 nt, Homo sapiens
gaucauaucugaaauacag

SEQ ID NO: 1446 - RNA, 19 nt, Homo sapiens
caagacugcuuucagauau

SEQ ID NO: 1447 - RNA, 19 nt, Homo sapiens
guuagaugcuacugaauuu

SEQ ID NO: 1448 - RNA, 19 nt, Homo sapiens
caauguaucucuaugaagu

SEQ ID NO: 1449 - RNA, 19 nt, Homo sapiens
gagaagcuccuuugugaua

SEQ ID NO: 1450 - RNA, 19 nt, Homo sapiens
gaagcacuauggcaucuau

SEQ ID NO: 1451 - RNA, 19 nt, Homo sapiens
gaaggauccugagcacgua

SEQ ID NO: 1452 - RNA, 19 nt, Homo sapiens
gaagcuccuuugugauaug

SEQ ID NO: 1453 - RNA, 19 nt, Homo sapiens
gaaacucucauccgcgaua

SEQ ID NO: 1454 - RNA, 19 nt, Homo sapiens
ucucauccgcgauauguua

SEQ ID NO: 1455 - RNA, 19 nt, Homo sapiens
caagaagugccucaaagug

SEQ ID NO: 1456 - RNA, 19 nt, Homo sapiens
ggaacuuaacuuacacaug

SEQ ID NO: 1457 - RNA, 19 nt, Homo sapiens
guaccuguccggauauauu

SEQ ID NO: 1458 - RNA, 19 nt, Homo sapiens
ccaaccagccgacgagauu

SEQ ID NO: 1459 - RNA, 19 nt, Homo sapiens
acucguaccuguccggaua

SEQ ID NO: 1460 - RNA, 19 nt, Homo sapiens
ggccguauauggcaauuca

SEQ ID NO: 1461 - RNA, 19 nt, Homo sapiens
cgacgccuguggccucuca

SEQ ID NO: 1462 - RNA, 19 nt, Homo sapiens
cagccgguguccgaacuga

SEQ ID NO: 1463 - RNA, 19 nt, Homo sapiens
caaccgugacugccagauc

SEQ ID NO: 1464 - RNA, 19 nt, Homo sapiens
guacugccgucucaagaag

SEQ ID NO: 1465 - RNA, 19 nt, Homo sapiens
gaggacagauguaccacua

SEQ ID NO: 1466 - RNA, 19 nt, Homo sapiens
gauaagaccaugaguauug

SEQ ID NO: 1467 - RNA, 19 nt, Homo sapiens
gaagacgauucauuccuuu

SEQ ID NO: 1468 - RNA, 19 nt, Homo sapiens
ggacagauguaccacuaug

SEQ ID NO: 1469 - RNA, 19 nt, Homo sapiens
gcaaacagaugauccaagu

SEQ ID NO: 1470 - RNA, 19 nt, Homo sapiens
cagcuaagauuuaucagaa

SEQ ID NO: 1471 - RNA, 19 nt, Homo sapiens
gcacgaaagucaaagaagu

SEQ ID NO: 1472 - RNA, 19 nt, Homo sapiens
gguauccggucuuagaaua

SEQ ID NO: 1473 - RNA, 19 nt, Homo sapiens
gaaggaaguuguccgaaca

SEQ ID NO: 1474 - RNA, 19 nt, Homo sapiens
caggagaguuugacaccuu

SEQ ID NO: 1475 - RNA, 19 nt, Homo sapiens
caguggcucugacuacuau

SEQ ID NO: 1476 - RNA, 19 nt, Homo sapiens
gaaggccgcugugcugugu

SEQ ID NO: 1477 - RNA, 19 nt, Homo sapiens
gcaaugcguucguggcuuu

SEQ ID NO: 1478 - RNA, 19 nt, Homo sapiens
cggcuacacaggagaguuu

SEQ ID NO: 1479 - RNA, 19 nt, Homo sapiens
ccacgugacuuucaacaau

SEQ ID NO: 1480 - RNA, 19 nt, Homo sapiens
gaauacagcuccgauuucu

SEQ ID NO: 1481 - RNA, 19 nt, Homo sapiens
caaagaagaucagacauua

SEQ ID NO: 1482 - RNA, 19 nt, Homo sapiens
gaucagacauuacuuauug

SEQ ID NO: 1483 - RNA, 19 nt, Homo sapiens
ccagagaucuugauuauuc

SEQ ID NO: 1484 - RNA, 19 nt, Homo sapiens
gaaguuguccguacagaua

SEQ ID NO: 1485 - RNA, 19 nt, Homo sapiens
gauuugaaguuccugaaua

SEQ ID NO: 1486 - RNA, 19 nt, Homo sapiens
ggagcgagcugcugguguu

SEQ ID NO: 1487 - RNA, 19 nt, Homo sapiens
ggagguggccgaccagaug

SEQ ID NO: 1488 - RNA, 19 nt, Homo sapiens
caacgugccugagcucauc

SEQ ID NO: 1489 - RNA, 19 nt, Homo sapiens
ccaaacauauggccacuuu

SEQ ID NO: 1490 - RNA, 19 nt, Homo sapiens
ucagagaacuuaagguuga

SEQ ID NO: 1491 - RNA, 19 nt, Homo sapiens
ggauccaucuuccugguua

SEQ ID NO: 1492 - RNA, 19 nt, Homo sapiens
aagaauaccucuacuacaa

SEQ ID NO: 1493 - RNA, 19 nt, Homo sapiens
caacgaaccugucucauuu

SEQ ID NO: 1494 - RNA, 19 nt, Homo sapiens
gaagaacuacacagauuua

SEQ ID NO: 1495 - RNA, 19 nt, Homo sapiens
gaagauggauacgcuguga

SEQ ID NO: 1496 - RNA, 19 nt, Homo sapiens
aaacgauacugguacauuu

SEQ ID NO: 1497 - RNA, 19 nt, Homo sapiens
gaagaaugaucgaauagau

SEQ ID NO: 1498 - RNA, 19 nt, Homo sapiens
gaacauggagcaauauaau

SEQ ID NO: 1499 - RNA, 19 nt, Homo sapiens
gaggagcucuuggccuuua

SEQ ID NO: 1500 - RNA, 19 nt, Homo sapiens
uaaacaacaugcacucuga

SEQ ID NO: 1501 - RNA, 19 nt, Homo sapiens
gagaugaggucaagcuaca

SEQ ID NO: 1502 - RNA, 19 nt, Homo sapiens
cagcguuucuaucaacuua

SEQ ID NO: 1503 - RNA, 19 nt, Homo sapiens
agauaacucucauucagua

SEQ ID NO: 1504 - RNA, 19 nt, Homo sapiens
guagucaaguggucuaaau

SEQ ID NO: 1505 - RNA, 19 nt, Homo sapiens
ucacggagcucacggaauu

SEQ ID NO: 1506 - RNA, 19 nt, Homo sapiens
gaacaugacauagaagauu

SEQ ID NO: 1507 - RNA, 19 nt, Homo sapiens
ggauaguucuggaagcuuu

SEQ ID NO: 1508 - RNA, 19 nt, Homo sapiens
gacucaagcugguguauga

SEQ ID NO: 1509 - RNA, 19 nt, Homo sapiens
gagcgcagcugcaagauuc

SEQ ID NO: 1510 - RNA, 19 nt, Homo sapiens
gcaugaagcuggaguacga

SEQ ID NO: 1511 - RNA, 19 nt, Homo sapiens
ggaagcaguuggugaaugg

SEQ ID NO: 1512 - RNA, 19 nt, Homo sapiens
gcugcaagauucagaagaa

SEQ ID NO: 1513 - RNA, 19 nt, Homo sapiens
agacucagcucuacaauaa

SEQ ID NO: 1514 - RNA, 19 nt, Homo sapiens
gauugaagcuuaucuauga

SEQ ID NO: 1515 - RNA, 19 nt, Homo sapiens
aaguaacucuccucaaaua

SEQ ID NO: 1516 - RNA, 19 nt, Homo sapiens
gcauuucuacuccacauua

SEQ ID NO: 1517 - RNA, 19 nt, Homo sapiens
gacaagaacugcaucauca

SEQ ID NO: 1518 - RNA, 19 nt, Homo sapiens
gcaaauacacuacgaacaa

SEQ ID NO: 1519 - RNA, 19 nt, Homo sapiens
gaacaacagcucagaacaa

SEQ ID NO: 1520 - RNA, 19 nt, Homo sapiens
gagcagcaguucugaagag

SEQ ID NO: 1521 - RNA, 19 nt, Homo sapiens
gcacacugcucaaucaauu

SEQ ID NO: 1522 - RNA, 19 nt, Homo sapiens
gcagaaguauucagaagaa

SEQ ID NO: 1523 - RNA, 19 nt, Homo sapiens
ggaaugacaggaacaagaa

SEQ ID NO: 1524 - RNA, 19 nt, Homo sapiens
gcacaguccuagcaucuca

SEQ ID NO: 1525 - RNA, 19 nt, Homo sapiens
gaaaugaccggaacaagaa

SEQ ID NO: 1526 - RNA, 19 nt, Homo sapiens
uagaagagcucaucaccaa

SEQ ID NO: 1527 - RNA, 19 nt, Homo sapiens
caaggaagcugugcgaaau

SEQ ID NO: 1528 - RNA, 19 nt, Homo sapiens
ucagugagcuggcuaccaa

SEQ ID NO: 1529 - RNA, 19 nt, Homo sapiens
ggaaagaguuuauguucua

SEQ ID NO: 1530 - RNA, 19 nt, Homo sapiens
caagaucuguggagacaaa

SEQ ID NO: 1531 - RNA, 19 nt, Homo sapiens
gcaccugacugaagaugaa

SEQ ID NO: 1532 - RNA, 19 nt, Homo sapiens
ccgagaagauggaauacua

SEQ ID NO: 1533 - RNA, 19 nt, Homo sapiens
gcacagaacaucauuaagu

SEQ ID NO: 1534 - RNA, 19 nt, Homo sapiens
ccacaccuaugaagaaauu

SEQ ID NO: 1535 - RNA, 19 nt, Homo sapiens
gaucaaauucuacuucuga

SEQ ID NO: 1536 - RNA, 19 nt, Homo sapiens
ucaaacagauaaagcaaga

SEQ ID NO: 1537 - RNA, 19 nt, Homo sapiens
uagaacagcugcaguacaa

SEQ ID NO: 1538 - RNA, 19 nt, Homo sapiens
ucaccgaggccauucagua

SEQ ID NO: 1539 - RNA, 19 nt, Homo sapiens
gaacagcugcaguacaauc

SEQ ID NO: 1540 - RNA, 19 nt, Homo sapiens
ccucaugccaccuugaaua

SEQ ID NO: 1541 - RNA, 19 nt, Homo sapiens
ugacggagcuuguguccaa

SEQ ID NO: 1542 - RNA, 19 nt, Homo sapiens
caacaaggacugccugauu

SEQ ID NO: 1543 - RNA, 19 nt, Homo sapiens
gcaaggaccugaccuacac

SEQ ID NO: 1544 - RNA, 19 nt, Homo sapiens
gcaaggaccggaacgagaa

SEQ ID NO: 1545 - RNA, 19 nt, Homo sapiens
gcaaagaccuuacauacuc

SEQ ID NO: 1546 - RNA, 19 nt, Homo sapiens
gcaaucauucuguuuaauc

SEQ ID NO: 1547 - RNA, 19 nt, Homo sapiens
ucacaccgauccauugaug

SEQ ID NO: 1548 - RNA, 19 nt, Homo sapiens
gcaaacggcuaugugcaau

SEQ ID NO: 1549 - RNA, 19 nt, Homo sapiens
ggaaggaccucaucuacac

SEQ ID NO: 1550 - RNA, 19 nt, Homo sapiens
ccggaucucugguuaaaca

SEQ ID NO: 1551 - RNA, 19 nt, Homo sapiens
gcgagccauuguacucuuu

SEQ ID NO: 1552 - RNA, 19 nt, Homo sapiens
gagccauuguacucuuuaa

SEQ ID NO: 1553 - RNA, 19 nt, Homo sapiens
ggacaaagacgagcagugu

SEQ ID NO: 1554 - RNA, 19 nt, Homo sapiens
ggaaacagaggcggaaauu

SEQ ID NO: 1555 - RNA, 19 nt, Homo sapiens
guaagcugauugagcagaa

SEQ ID NO: 1556 - RNA, 19 nt, Homo sapiens
gaaccuccaucccaccuau

SEQ ID NO: 1557 - RNA, 19 nt, Homo sapiens
gaaugucgcuuuaagaaau

SEQ ID NO: 1558 - RNA, 19 nt, Homo sapiens
gaacagucgucgccacauc

SEQ ID NO: 1559 - RNA, 19 nt, Homo sapiens
ggacaagcaccaauaguca

SEQ ID NO: 1560 - RNA, 19 nt, Homo sapiens
guggaaagguugacuugga

SEQ ID NO: 1561 - RNA, 19 nt, Homo sapiens
ugaagaagcugaacuugca

SEQ ID NO: 1562 - RNA, 19 nt, Homo sapiens
gcaaccaagacuacaagua

SEQ ID NO: 1563 - RNA, 19 nt, Homo sapiens
ucaaugcuaugaccuguga

SEQ ID NO: 1564 - RNA, 19 nt, Homo sapiens
ccauugaggucaucauguu

SEQ ID NO: 1565 - RNA, 19 nt, Homo sapiens
gaccauaaauguaagguuu

SEQ ID NO: 1566 - RNA, 19 nt, Homo sapiens
uagaagaucugaugucaaa

SEQ ID NO: 1567 - RNA, 19 nt, Homo sapiens
gaaauguucacuucaguua

SEQ ID NO: 1568 - RNA, 19 nt, Homo sapiens
gaagaucgcuacugaagca

SEQ ID NO: 1569 - RNA, 19 nt, Homo sapiens
ggaagcaacugcagagaca

SEQ ID NO: 1570 - RNA, 19 nt, Homo sapiens
gaugacaccucucaacaaa

SEQ ID NO: 1571 - RNA, 19 nt, Homo sapiens
uaaaguugcucaucaaguu

SEQ ID NO: 1572 - RNA, 19 nt, Homo sapiens
caacgagucugccgaagga

SEQ ID NO: 1573 - RNA, 19 nt, Homo sapiens
gcagaugccuucuucguua

SEQ ID NO: 1574 - RNA, 19 nt, Homo sapiens
aggcaaaucuucguuauua

SEQ ID NO: 1575 - RNA, 19 nt, Homo sapiens
gggaagaaaucuggucuaa

SEQ ID NO: 1576 - RNA, 19 nt, Homo sapiens
ugacucaucccaacauuua

SEQ ID NO: 1577 - RNA, 19 nt, Homo sapiens
ccgacgugcugccugagua

SEQ ID NO: 1578 - RNA, 19 nt, Homo sapiens
gagaagagcagcgacacuu

SEQ ID NO: 1579 - RNA, 19 nt, Homo sapiens
gaucauagcaccuaagaua

SEQ ID NO: 1580 - RNA, 19 nt, Homo sapiens
gcuauuuacugcucuuauu

SEQ ID NO: 1581 - RNA, 19 nt, Homo sapiens
ucacugggcuccuuuaauu

SEQ ID NO: 1582 - RNA, 19 nt, Homo sapiens
gugcgagccuucugaauau

SEQ ID NO: 1583 - RNA, 19 nt, Homo sapiens
gcuaagcuauacuacugua

SEQ ID NO: 1584 - RNA, 19 nt, Homo sapiens
ugacggcgcucuacuucac

SEQ ID NO: 1585 - RNA, 19 nt, Homo sapiens
gagaugaauuccuuugaaa

SEQ ID NO: 1586 - RNA, 19 nt, Homo sapiens
gaagaacgcaugaaacgaa

SEQ ID NO: 1587 - RNA, 19 nt, Homo sapiens
gauaaagacacgauugaaa

SEQ ID NO: 1588 - RNA, 19 nt, Homo sapiens
gcugagaggucuauuuaaa

SEQ ID NO: 1589 - RNA, 19 nt, Homo sapiens
gaacaacaauggcuaugaa

SEQ ID NO: 1590 - RNA, 19 nt, Homo sapiens
guacauaccuggcuggauu

SEQ ID NO: 1591 - RNA, 19 nt, Homo sapiens
gaacagcucacaaguauau

SEQ ID NO: 1592 - RNA, 19 nt, Homo sapiens
ggaaacgugugucuauauu

SEQ ID NO: 1593 - RNA, 19 nt, Homo sapiens
ggaggugggaggacaguua

SEQ ID NO: 1594 - RNA, 19 nt, Homo sapiens
ucacagcccugguggauga

SEQ ID NO: 1595 - RNA, 19 nt, Homo sapiens
gaagcuggcuccuauguuc

SEQ ID NO: 1596 - RNA, 19 nt, Homo sapiens
ggucaacacuaccaacaug

SEQ ID NO: 1597 - RNA, 19 nt, Homo sapiens
gaacacaaggucaacauug

SEQ ID NO: 1598 - RNA, 19 nt, Homo sapiens
agaaggagcuggccuagug

SEQ ID NO: 1599 - RNA, 19 nt, Homo sapiens
cggaaacucuucacauuug

SEQ ID NO: 1600 - RNA, 19 nt, Homo sapiens
caacaaauuugacaacaac

SEQ ID NO: 1601 - RNA, 19 nt, Homo sapiens
guacaucuccaucuuauuu

SEQ ID NO: 1602 - RNA, 19 nt, Homo sapiens
ggaaguggcugaguuauua

SEQ ID NO: 1603 - RNA, 19 nt, Homo sapiens
gaagggaggcucaauguaa

SEQ ID NO: 1604 - RNA, 19 nt, Homo sapiens
gaaggaaguggcugaguua

SEQ ID NO: 1605 - RNA, 19 nt, Homo sapiens
guagaaacaggagcuauua

SEQ ID NO: 1606 - RNA, 19 nt, Homo sapiens
caagauuacugucaaacaa

SEQ ID NO: 1607 - RNA, 19 nt, Homo sapiens
gcacaagaguauuugguaa

SEQ ID NO: 1608 - RNA, 19 nt, Homo sapiens
gcaaaugucccuucuguau

SEQ ID NO: 1609 - RNA, 19 nt, Homo sapiens
gcaugacuccuauauaaua

SEQ ID NO: 1610 - RNA, 19 nt, Homo sapiens
aaacagcaauuucccuuaa

SEQ ID NO: 1611 - RNA, 19 nt, Homo sapiens
gaaaaugccucuucaggaa

SEQ ID NO: 1612 - RNA, 19 nt, Homo sapiens
guucaucgcucuccucuuu

SEQ ID NO: 1613 - RNA, 19 nt, Homo sapiens
ggaucaagcuguuucugaa

SEQ ID NO: 1614 - RNA, 19 nt, Homo sapiens
ggacugcaguuuguacuug

SEQ ID NO: 1615 - RNA, 19 nt, Homo sapiens
gagugaaacugaccuaugg

SEQ ID NO: 1616 - RNA, 19 nt, Homo sapiens
gaacgcugcucccguggaa

SEQ ID NO: 1617 - RNA, 19 nt, Homo sapiens
gaaagccacucuaucaaag

SEQ ID NO: 1618 - RNA, 19 nt, Homo sapiens
gaaaccaggugccuucaga

SEQ ID NO: 1619 - RNA, 19 nt, Homo sapiens
ccucacagcuguauucaug

SEQ ID NO: 1620 - RNA, 19 nt, Homo sapiens
ccacggagcugcuggucau

SEQ ID NO: 1621 - RNA, 19 nt, Homo sapiens
ggguugacaucuuauuuga

SEQ ID NO: 1622 - RNA, 19 nt, Homo sapiens
gcacgagggucucuguguu

SEQ ID NO: 1623 - RNA, 19 nt, Homo sapiens
ggccaucgccuacucauug

SEQ ID NO: 1624 - RNA, 19 nt, Homo sapiens
caacacccauggcaauuaa

SEQ ID NO: 1625 - RNA, 19 nt, Homo sapiens
gaggaaagaucuugcugau

SEQ ID NO: 1626 - RNA, 19 nt, Homo sapiens
gagcaagcguccuccaaau

SEQ ID NO: 1627 - RNA, 19 nt, Homo sapiens
gcaacacccauggcaauua

SEQ ID NO: 1628 - RNA, 19 nt, Homo sapiens
ccaaagaacucaaugaaca

SEQ ID NO: 1629 - RNA, 19 nt, Homo sapiens
acaagaaccuucagacuaa

SEQ ID NO: 1630 - RNA, 19 nt, Homo sapiens
gaagguagauagaagaaug

SEQ ID NO: 1631 - RNA, 19 nt, Homo sapiens
guauugaacuguacuguaa

SEQ ID NO: 1632 - RNA, 19 nt, Homo sapiens
gcaauucucuucauuuauc

SEQ ID NO: 1633 - RNA, 19 nt, Homo sapiens
ggaaagauguccacugaaa

SEQ ID NO: 1634 - RNA, 19 nt, Homo sapiens
ggacaaagccuucuucaau

SEQ ID NO: 1635 - RNA, 19 nt, Homo sapiens
ggaaugggauccagcaauu

SEQ ID NO: 1636 - RNA, 19 nt, Homo sapiens
ugaaagccauugacauuug

SEQ ID NO: 1637 - RNA, 19 nt, Homo sapiens
cagacacgcuggaguuuaa

SEQ ID NO: 1638 - RNA, 19 nt, Homo sapiens
caauagcgcuuucugguuu

SEQ ID NO: 1639 - RNA, 19 nt, Homo sapiens
gcagguagcagauggacua

SEQ ID NO: 1640 - RNA, 19 nt, Homo sapiens
ucagagugcugucuuaugu

SEQ ID NO: 1641 - RNA, 19 nt, Homo sapiens
caacuuguuugacgacgaa

SEQ ID NO: 1642 - RNA, 19 nt, Homo sapiens
ugacagagccugcugauac

SEQ ID NO: 1643 - RNA, 19 nt, Homo sapiens
aggcggcucuguaccauuu

SEQ ID NO: 1644 - RNA, 19 nt, Homo sapiens
gaaacaugcugugauauug

SEQ ID NO: 1645 - RNA, 19 nt, Homo sapiens
gcagauguuuccuuauaua

SEQ ID NO: 1646 - RNA, 19 nt, Homo sapiens
caacagagaugccaugaua

SEQ ID NO: 1647 - RNA, 19 nt, Homo sapiens
gaaaggcgcuacauugaga

SEQ ID NO: 1648 - RNA, 19 nt, Homo sapiens
gaccugagcuucccaacaa

SEQ ID NO: 1649 - RNA, 19 nt, Homo sapiens
gcgacuggcucaacaauua

SEQ ID NO: 1650 - RNA, 19 nt, Homo sapiens
gagauugcguggcuauuua

SEQ ID NO: 1651 - RNA, 19 nt, Homo sapiens
gacagcaacuggacacuua

SEQ ID NO: 1652 - RNA, 19 nt, Homo sapiens
ggaagagacucgugcaaug

SEQ ID NO: 1653 - RNA, 19 nt, Homo sapiens
ggaaccaugugccaaguug

SEQ ID NO: 1654 - RNA, 19 nt, Homo sapiens
gaaguaacuccucauucaa

SEQ ID NO: 1655 - RNA, 19 nt, Homo sapiens
gaacuccuauagauuucug

SEQ ID NO: 1656 - RNA, 19 nt, Homo sapiens
cauagaagcuuuaccaaga

SEQ ID NO: 1657 - RNA, 19 nt, Homo sapiens
gaauggaggaugaagauua

SEQ ID NO: 1658 - RNA, 19 nt, Homo sapiens
ggucaaugcucuaagugaa

SEQ ID NO: 1659 - RNA, 19 nt, Homo sapiens
gagaggacuucuaugaaug

SEQ ID NO: 1660 - RNA, 19 nt, Homo sapiens
caucaugccuucugaauaa

SEQ ID NO: 1661 - RNA, 19 nt, Homo sapiens
caacagcucaucacgauuu

SEQ ID NO: 1662 - RNA, 19 nt, Homo sapiens
gcaacaacuucucuuaugu

SEQ ID NO: 1663 - RNA, 19 nt, Homo sapiens
ggucuucgcuagcaucuca

SEQ ID NO: 1664 - RNA, 19 nt, Homo sapiens
ggaccuagcuguuguaaag

SEQ ID NO: 1665 - RNA, 19 nt, Homo sapiens
gaaagaccaugcauuuaaa

SEQ ID NO: 1666 - RNA, 19 nt, Homo sapiens
gcaggaagauguaugcuuu

SEQ ID NO: 1667 - RNA, 19 nt, Homo sapiens
gaauaaaccaguaucguua

SEQ ID NO: 1668 - RNA, 19 nt, Homo sapiens
ggacccagauauccaaaua

SEQ ID NO: 1669 - RNA, 19 nt, Homo sapiens
gcaauacuauccuaacuga

SEQ ID NO: 1670 - RNA, 19 nt, Homo sapiens
gaauauagauuagcguuug

SEQ ID NO: 1671 - RNA, 19 nt, Homo sapiens
gaugaggcaugacuacuaa

SEQ ID NO: 1672 - RNA, 19 nt, Homo sapiens
gcgagucuguccacuauac

SEQ ID NO: 1673 - RNA, 19 nt, Homo sapiens
gagaacggccacccacuga

SEQ ID NO: 1674 - RNA, 19 nt, Homo sapiens
gaacggccacccacugaug

SEQ ID NO: 1675 - RNA, 19 nt, Homo sapiens
ggucaaugcugcuguguac

SEQ ID NO: 1676 - RNA, 19 nt, Homo sapiens
uccaggaacacuauaauua

SEQ ID NO: 1677 - RNA, 19 nt, Homo sapiens
gugaccaucuucuccauca

SEQ ID NO: 1678 - RNA, 19 nt, Homo sapiens
cauccucuguugcgccauu

SEQ ID NO: 1679 - RNA, 19 nt, Homo sapiens
ccaacaagguccaggaaca

SEQ ID NO: 1680 - RNA, 19 nt, Homo sapiens
acacugauacugucgauga

SEQ ID NO: 1681 - RNA, 19 nt, Homo sapiens
aauaggagcaacacugaua

SEQ ID NO: 1682 - RNA, 19 nt, Homo sapiens
cagcaggaguuaccuuguu

SEQ ID NO: 1683 - RNA, 19 nt, Homo sapiens
ggacacccaugaagcuaau

SEQ ID NO: 1684 - RNA, 19 nt, Homo sapiens
gcacagaacuccacucaaa

SEQ ID NO: 1685 - RNA, 19 nt, Homo sapiens
ggacagcaguucauuguua

SEQ ID NO: 1686 - RNA, 19 nt, Homo sapiens
gagaagaggcuauguuuaa

SEQ ID NO: 1687 - RNA, 19 nt, Homo sapiens
ggacaaacuucgacccuuu

SEQ ID NO: 1688 - RNA, 19 nt, Homo sapiens
ucgcuacccugcuguuauu

SEQ ID NO: 1689 - RNA, 19 nt, Homo sapiens
gcuacaagaacuaccgaua

SEQ ID NO: 1690 - RNA, 19 nt, Homo sapiens
caagaaagcuuccuucaac

SEQ ID NO: 1691 - RNA, 19 nt, Homo sapiens
gagaagaaauacagucaau

SEQ ID NO: 1692 - RNA, 19 nt, Homo sapiens
caauauaucugaagagcua

SEQ ID NO: 1693 - RNA, 19 nt, Homo sapiens
gaacuggacuguggcauug

SEQ ID NO: 1694 - RNA, 19 nt, Homo sapiens
gugagaagaugguauauuu

SEQ ID NO: 1695 - RNA, 19 nt, Homo sapiens
gaggguacuuuaagacaua

SEQ ID NO: 1696 - RNA, 19 nt, Homo sapiens
caugaggugucaacuguua

SEQ ID NO: 1697 - RNA, 19 nt, Homo sapiens
gaagugaaaugcuuuaaug

SEQ ID NO: 1698 - RNA, 19 nt, Homo sapiens
aaauauggcuccuccuuag

SEQ ID NO: 1699 - RNA, 19 nt, Homo sapiens
gcaaucacauuuaugcaua

SEQ ID NO: 1700 - RNA, 19 nt, Homo sapiens
caacauaacugagguggau

SEQ ID NO: 1701 - RNA, 19 nt, Homo sapiens
caugguacauucaagauuu

SEQ ID NO: 1702 - RNA, 19 nt, Homo sapiens
gaacucuacuucagucaau

SEQ ID NO: 1703 - RNA, 19 nt, Homo sapiens
gggcaaaugcaucauaaua

SEQ ID NO: 1704 - RNA, 19 nt, Homo sapiens
caacagagggaguuuaaua

SEQ ID NO: 1705 - RNA, 19 nt, Homo sapiens
gaacaaagccacugacuga

SEQ ID NO: 1706 - RNA, 19 nt, Homo sapiens
gaagugaacuaugaaguaa

SEQ ID NO: 1707 - RNA, 19 nt, Homo sapiens
caacaaggaugacaagaaa

SEQ ID NO: 1708 - RNA, 19 nt, Homo sapiens
ggacaaaguuuaccaaaug

SEQ ID NO: 1709 - RNA, 19 nt, Homo sapiens
gagggucgaucaucuauua

SEQ ID NO: 1710 - RNA, 19 nt, Homo sapiens
gaauauagagggcuuauga

SEQ ID NO: 1711 - RNA, 19 nt, Homo sapiens
caacgacuaugaagaauuc

SEQ ID NO: 1712 - RNA, 19 nt, Homo sapiens
gaagugagcagaucagaau

SEQ ID NO: 1713 - RNA, 19 nt, Homo sapiens
gaggaaaucuccaaaugca

SEQ ID NO: 1714 - RNA, 19 nt, Homo sapiens
ccaggcagcugaucauaga

SEQ ID NO: 1715 - RNA, 19 nt, Homo sapiens
ucucagguguugccaaaua

SEQ ID NO: 1716 - RNA, 19 nt, Homo sapiens
gaacagcuguaaucuauga

SEQ ID NO: 1717 - RNA, 19 nt, Homo sapiens
ccacuggucuguagggauu

SEQ ID NO: 1718 - RNA, 19 nt, Homo sapiens
ucguaaagcuguugauauc

SEQ ID NO: 1719 - RNA, 19 nt, Homo sapiens
gaggagaucuuugaugaca

SEQ ID NO: 1720 - RNA, 19 nt, Homo sapiens
guaaagcuguugauaucga

SEQ ID NO: 1721 - RNA, 19 nt, Homo sapiens
gaucguaaagcuguugaua

SEQ ID NO: 1722 - RNA, 19 nt, Homo sapiens
agacgaaggugauuuacca

SEQ ID NO: 1723 - RNA, 19 nt, Homo sapiens
ugugagagcuaccuaguca

SEQ ID NO: 1724 - RNA, 19 nt, Homo sapiens
gaagaaauuucagaugaca

SEQ ID NO: 1725 - RNA, 19 nt, Homo sapiens
uaauaggcauuuccucuuu

SEQ ID NO: 1726 - RNA, 19 nt, Homo sapiens
gugaagaucuugaccaaug

SEQ ID NO: 1727 - RNA, 19 nt, Homo sapiens
gaucagcauacacaaauua

SEQ ID NO: 1728 - RNA, 19 nt, Homo sapiens
gaaugaaccuucugcaaca

SEQ ID NO: 1729 - RNA, 19 nt, Homo sapiens
ggcgcuauguguauuauua

SEQ ID NO: 1730 - RNA, 19 nt, Homo sapiens
guacaaagcugguauaucc

SEQ ID NO: 1731 - RNA, 19 nt, Homo sapiens
gaaagacucccaguguaua

SEQ ID NO: 1732 - RNA, 19 nt, Homo sapiens
ggaaguccaucucaucgaa

SEQ ID NO: 1733 - RNA, 19 nt, Homo sapiens
ccaaagacaugacgacguu

SEQ ID NO: 1734 - RNA, 19 nt, Homo sapiens
guaaagaggagacugaaug

SEQ ID NO: 1735 - RNA, 19 nt, Homo sapiens
ggucugugauggucccuaa

SEQ ID NO: 1736 - RNA, 19 nt, Homo sapiens
caaagaugccuacgacaug

SEQ ID NO: 1737 - RNA, 19 nt, Homo sapiens
gggcgaugccugaggguua

SEQ ID NO: 1738 - RNA, 19 nt, Homo sapiens
ucacacaaguuuaugguuu

SEQ ID NO: 1739 - RNA, 19 nt, Homo sapiens
caacagccgugaccacuuu

SEQ ID NO: 1740 - RNA, 19 nt, Homo sapiens
uaaccaagcugcaaucaug

SEQ ID NO: 1741 - RNA, 19 nt, Homo sapiens
gaacuugacgauacucuaa

SEQ ID NO: 1742 - RNA, 19 nt, Homo sapiens
gaagagaggucguucuaag

SEQ ID NO: 1743 - RNA, 19 nt, Homo sapiens
aagcagaugugcaugauua

SEQ ID NO: 1744 - RNA, 19 nt, Homo sapiens
ucuaauaacugcaguguuu

SEQ ID NO: 1745 - RNA, 19 nt, Homo sapiens
guaaagggcccucuaauaa

SEQ ID NO: 1746 - RNA, 19 nt, Homo sapiens
gaaagaauaugcccaaguu

SEQ ID NO: 1747 - RNA, 19 nt, Homo sapiens
gaagaagaaugccacaaug

SEQ ID NO: 1748 - RNA, 19 nt, Homo sapiens
gcaggaagauuaugaugug

SEQ ID NO: 1749 - RNA, 19 nt, Homo sapiens
aaagaaagcccauguacua

SEQ ID NO: 1750 - RNA, 19 nt, Homo sapiens
gggaaagagcugcauauua

SEQ ID NO: 1751 - RNA, 19 nt, Homo sapiens
gcuuagaacucuuuacuga

SEQ ID NO: 1752 - RNA, 19 nt, Homo sapiens
uauaagagcuugaccaaug

SEQ ID NO: 1753 - RNA, 19 nt, Homo sapiens
gcagauaucucuaugauug

SEQ ID NO: 1754 - RNA, 19 nt, Homo sapiens
caacucauguccaauacug

SEQ ID NO: 1755 - RNA, 19 nt, Homo sapiens
ggaaugagccagauguuua

SEQ ID NO: 1756 - RNA, 19 nt, Homo sapiens
ggagacagcuguacguugu

SEQ ID NO: 1757 - RNA, 19 nt, Homo sapiens
uccaagagcugacaacuga

SEQ ID NO: 1758 - RNA, 19 nt, Homo sapiens
guaaggagaagcaauauaa

SEQ ID NO: 1759 - RNA, 19 nt, Homo sapiens
aagaugagcuuuccaugua

SEQ ID NO: 1760 - RNA, 19 nt, Homo sapiens
ggacaucuaucucaucauu

SEQ ID NO: 1761 - RNA, 19 nt, Homo sapiens
gacaagagcccacagagua

SEQ ID NO: 1762 - RNA, 19 nt, Homo sapiens
guacuucccucaggccuau

SEQ ID NO: 1763 - RNA, 19 nt, Homo sapiens
gcugugccuugacuacgua

SEQ ID NO: 1764 - RNA, 19 nt, Homo sapiens
guacuucccucaggccuau

SEQ ID NO: 1765 - RNA, 19 nt, Homo sapiens
ggucaggugccucgagauc

SEQ ID NO: 1766 - RNA, 19 nt, Homo sapiens
cagcguaacuucauucuuc

SEQ ID NO: 1767 - RNA, 19 nt, Homo sapiens
uaacuucauucuucaggua

SEQ ID NO: 1768 - RNA, 19 nt, Homo sapiens
cagcugcucuuacccauuu

SEQ ID NO: 1769 - RNA, 19 nt, Homo sapiens
gauugaagcuauuacugaa

SEQ ID NO: 1770 - RNA, 19 nt, Homo sapiens
uagaagagcuccgucagaa

SEQ ID NO: 1771 - RNA, 19 nt, Homo sapiens
ccacauaugcguugauuga

SEQ ID NO: 1772 - RNA, 19 nt, Homo sapiens
gcgcagggcucucuaccua

SEQ ID NO: 1773 - RNA, 19 nt, Homo sapiens
gaacagccuucaaaucaaa

SEQ ID NO: 1774 - RNA, 19 nt, Homo sapiens
gauguucucuacuauguua

SEQ ID NO: 1775 - RNA, 19 nt, Homo sapiens
gcaaauacuggaaggauua

SEQ ID NO: 1776 - RNA, 19 nt, Homo sapiens
caggaaagcucguaauuua

SEQ ID NO: 1777 - RNA, 19 nt, Homo sapiens
ccacacggcugaccucaua

SEQ ID NO: 1778 - RNA, 19 nt, Homo sapiens
cagcagaauuccucuuaua

SEQ ID NO: 1779 - RNA, 19 nt, Homo sapiens
gcagaauuccucuuauaaa

SEQ ID NO: 1780 - RNA, 19 nt, Homo sapiens
gaucgggauuuauuucuau

SEQ ID NO: 1781 - RNA, 19 nt, Homo sapiens
ugugggagcugaugacuuu

SEQ ID NO: 1782 - RNA, 19 nt, Homo sapiens
ucacagagaucuugaaagg

SEQ ID NO: 1783 - RNA, 19 nt, Homo sapiens
uggaagagaucacagguua

SEQ ID NO: 1784 - RNA, 19 nt, Homo sapiens
gcucaucgcucacaaccaa

SEQ ID NO: 1785 - RNA, 19 nt, Homo sapiens
gagcaccacuucuaugauu

SEQ ID NO: 1786 - RNA, 19 nt, Homo sapiens
caaagaagcuguucaauau

SEQ ID NO: 1787 - RNA, 19 nt, Homo sapiens
ugaaagcccucccuuauua

SEQ ID NO: 1788 - RNA, 19 nt, Homo sapiens
gaaauagcauggagaagga

SEQ ID NO: 1789 - RNA, 19 nt, Homo sapiens
ccauacagcuucauaaaua

SEQ ID NO: 1790 - RNA, 19 nt, Homo sapiens
gaagagaacuuaucuagug

SEQ ID NO: 1791 - RNA, 19 nt, Homo sapiens
gaagugggcuccaguauua

SEQ ID NO: 1792 - RNA, 19 nt, Homo sapiens
gcaagaugcugauucauua

SEQ ID NO: 1793 - RNA, 19 nt, Homo sapiens
gaagugggcuccaguauua

SEQ ID NO: 1794 - RNA, 19 nt, Homo sapiens
gaacggacacugaaauauu

SEQ ID NO: 1795 - RNA, 19 nt, Homo sapiens
gcagauaguucuaccagua

SEQ ID NO: 1796 - RNA, 19 nt, Homo sapiens
gaacaaggagucagacauu

SEQ ID NO: 1797 - RNA, 19 nt, Homo sapiens
aaacuaggcgguugaauga

SEQ ID NO: 1798 - RNA, 19 nt, Homo sapiens
gauggaacuucgacuuugu

SEQ ID NO: 1799 - RNA, 19 nt, Homo sapiens
guaaacagauggcacuuug

SEQ ID NO: 1800 - RNA, 19 nt, Homo sapiens
ggaauggacauccuguaua

SEQ ID NO: 1801 - RNA, 19 nt, Homo sapiens
ggagaaagaugucaaacgu

SEQ ID NO: 1802 - RNA, 19 nt, Homo sapiens
gaauggacauccuguauaa

SEQ ID NO: 1803 - RNA, 19 nt, Homo sapiens
guaaacagcucgaauuaag

SEQ ID NO: 1804 - RNA, 19 nt, Homo sapiens
cagauaggcuccgaagaug

SEQ ID NO: 1805 - RNA, 19 nt, Homo sapiens
agacucagcuccagaauac

SEQ ID NO: 1806 - RNA, 19 nt, Homo sapiens
gaucgguucuuucaucuuc

SEQ ID NO: 1807 - RNA, 19 nt, Homo sapiens
caggaucgguucuuucauc

SEQ ID NO: 1808 - RNA, 19 nt, Homo sapiens
ccagauaagugacauaagu

SEQ ID NO: 1809 - RNA, 19 nt, Homo sapiens
uaagugaccugcuuuguaa

SEQ ID NO: 1810 - RNA, 19 nt, Homo sapiens
gaagagagauuccauugaa

SEQ ID NO: 1811 - RNA, 19 nt, Homo sapiens
ugaaagagcucaacaacaa

SEQ ID NO: 1812 - RNA, 19 nt, Homo sapiens
gagcaugccgucaauaaua

SEQ ID NO: 1813 - RNA, 19 nt, Homo sapiens
caagagaacucaucauaag

SEQ ID NO: 1814 - RNA, 19 nt, Homo sapiens
ccaaagugcugcaguacua

SEQ ID NO: 1815 - RNA, 19 nt, Homo sapiens
uaagaaagcuauccagauu

SEQ ID NO: 1816 - RNA, 19 nt, Homo sapiens
gaaacaagcccuuuaaguu

SEQ ID NO: 1817 - RNA, 19 nt, Homo sapiens
gaauuacucuccaaguuga

SEQ ID NO: 1818 - RNA, 19 nt, Homo sapiens
cagcacaagugguagguua

SEQ ID NO: 1819 - RNA, 19 nt, Homo sapiens
guugaggacugaauuacuc

SEQ ID NO: 1820 - RNA, 19 nt, Homo sapiens
gauggcagcuguuuaaaug

SEQ ID NO: 1821 - RNA, 19 nt, Homo sapiens
gaguauccuuucaguguua

SEQ ID NO: 1822 - RNA, 19 nt, Homo sapiens
caaaggaaccuacuuguac

SEQ ID NO: 1823 - RNA, 19 nt, Homo sapiens
ggaaccuacuuguacaaug

SEQ ID NO: 1824 - RNA, 19 nt, Homo sapiens
gaaccuacuuguacaauga

SEQ ID NO: 1825 - RNA, 19 nt, Homo sapiens
gagugugucuccuguagua

SEQ ID NO: 1826 - RNA, 19 nt, Homo sapiens
ggacaagaaucaauggaua

SEQ ID NO: 1827 - RNA, 19 nt, Homo sapiens
gaacaagccuccaggauuc

SEQ ID NO: 1828 - RNA, 19 nt, Homo sapiens
ggacuugugugcccuuaua

SEQ ID NO: 1829 - RNA, 19 nt, Homo sapiens
gaacacaaaggcacuauaa

SEQ ID NO: 1830 - RNA, 19 nt, Homo sapiens
cgaagaaagugaugaauuu

SEQ ID NO: 1831 - RNA, 19 nt, Homo sapiens
gcucuuugcccaucucuuu

SEQ ID NO: 1832 - RNA, 19 nt, Homo sapiens
ugaaagaccugguggaaga

SEQ ID NO: 1833 - RNA, 19 nt, Homo sapiens
gcaauucaguuucuacauc

SEQ ID NO: 1834 - RNA, 19 nt, Homo sapiens
gaagacagaguuauuaaac

SEQ ID NO: 1835 - RNA, 19 nt, Homo sapiens
ucacgaagacagaguuauu

SEQ ID NO: 1836 - RNA, 19 nt, Homo sapiens
agacagaguuauuaaacca

SEQ ID NO: 1837 - RNA, 19 nt, Homo sapiens
cacgaagacagaguuauua

SEQ ID NO: 1838 - RNA, 19 nt, Homo sapiens
gcugaagccugucugaugu

SEQ ID NO: 1839 - RNA, 19 nt, Homo sapiens
caaaugaucugaggcaguu

SEQ ID NO: 1840 - RNA, 19 nt, Homo sapiens
guucauaguuugagcguua

SEQ ID NO: 1841 - RNA, 19 nt, Homo sapiens
ggagaaaccuguugugauu

SEQ ID NO: 1842 - RNA, 19 nt, Homo sapiens
ggacaaaguugcugaaauc

SEQ ID NO: 1843 - RNA, 19 nt, Homo sapiens
caaaugaucugaggcaguu

SEQ ID NO: 1844 - RNA, 19 nt, Homo sapiens
ggagaaaccuguugugauu

SEQ ID NO: 1845 - RNA, 19 nt, Homo sapiens
ggacaaaguugcugaaauc

SEQ ID NO: 1846 - RNA, 19 nt, Homo sapiens
guucauaguuugagcguua

SEQ ID NO: 1847 - RNA, 19 nt, Homo sapiens
ugaagcaccuugaucuuug

SEQ ID NO: 1848 - RNA, 19 nt, Homo sapiens
gggcagcgcauaccuguuu

SEQ ID NO: 1849 - RNA, 19 nt, Homo sapiens
gaggagcgcuguuugaguu

SEQ ID NO: 1850 - RNA, 19 nt, Homo sapiens
ggacgaggagcgcuguuug

SEQ ID NO: 1851 - RNA, 19 nt, Homo sapiens
gaggagcgcuguuugaguu

SEQ ID NO: 1852 - RNA, 19 nt, Homo sapiens
ggaugucucucuccucuuu

SEQ ID NO: 1853 - RNA, 19 nt, Homo sapiens
gcucacuccuuucuacuaa

SEQ ID NO: 1854 - RNA, 19 nt, Homo sapiens
ugaagcaccuugaucuuug

SEQ ID NO: 1855 - RNA, 19 nt, Homo sapiens
gcacagauauuuccauuuc

SEQ ID NO: 1856 - RNA, 19 nt, Homo sapiens
gcaguccucuuauuccuaa

SEQ ID NO: 1857 - RNA, 19 nt, Homo sapiens
gaacucaagcugcguuuau

SEQ ID NO: 1858 - RNA, 19 nt, Homo sapiens
ggacgaauugagauaauau

SEQ ID NO: 1859 - RNA, 19 nt, Homo sapiens
uaagaacacugcucaugaa

SEQ ID NO: 1860 - RNA, 19 nt, Homo sapiens
gaggcauccugaagcauua

SEQ ID NO: 1861 - RNA, 19 nt, Homo sapiens
gaaggcggcugcagaacug

SEQ ID NO: 1862 - RNA, 19 nt, Homo sapiens
ggaacaaggagaucaugua

SEQ ID NO: 1863 - RNA, 19 nt, Homo sapiens
cuaucgaggucguuaaauu

SEQ ID NO: 1864 - RNA, 19 nt, Homo sapiens
gaaugcagcuggaagaucu

SEQ ID NO: 1865 - RNA, 19 nt, Homo sapiens
gcggcgagcuggacuguuu

SEQ ID NO: 1866 - RNA, 19 nt, Homo sapiens
ccagaccgauguguauuua

SEQ ID NO: 1867 - RNA, 19 nt, Homo sapiens
ggucucaccucgcuauggu

SEQ ID NO: 1868 - RNA, 19 nt, Homo sapiens
gaaagcgaauuccuagaca

SEQ ID NO: 1869 - RNA, 19 nt, Homo sapiens
gcacaaacaagacugaugu

SEQ ID NO: 1870 - RNA, 19 nt, Homo sapiens
gaagggcaccucagaaaca

SEQ ID NO: 1871 - RNA, 19 nt, Homo sapiens
ucucccaacuuguauuaaa

SEQ ID NO: 1872 - RNA, 19 nt, Homo sapiens
ucaagugucuuccaucaug

SEQ ID NO: 1873 - RNA, 19 nt, Homo sapiens
ucaagugccuuaauaguag

SEQ ID NO: 1874 - RNA, 19 nt, Homo sapiens
ggaguacccugaggcuaua

SEQ ID NO: 1875 - RNA, 19 nt, Homo sapiens
gaugagaucuuccuacugu

SEQ ID NO: 1876 - RNA, 19 nt, Homo sapiens
gagcugggcuaaguaaaua

SEQ ID NO: 1877 - RNA, 19 nt, Homo sapiens
gaccaaagauggagugaga

SEQ ID NO: 1878 - RNA, 19 nt, Homo sapiens
ggaagaaacuggugauugu

SEQ ID NO: 1879 - RNA, 19 nt, Homo sapiens
ggcuguaacuacuuuauaa

SEQ ID NO: 1880 - RNA, 19 nt, Homo sapiens
ggacauuuguuugccauuu

SEQ ID NO: 1881 - RNA, 19 nt, Homo sapiens
ggagaaccauauacucuug

SEQ ID NO: 1882 - RNA, 19 nt, Homo sapiens
gaaccaaugcuuucucaug

SEQ ID NO: 1883 - RNA, 19 nt, Homo sapiens
gaagaccuguuauguagag

SEQ ID NO: 1884 - RNA, 19 nt, Homo sapiens
gaucaagaauugcaauauc

SEQ ID NO: 1885 - RNA, 19 nt, Homo sapiens
gaaaaggggugaccuagua

SEQ ID NO: 1886 - RNA, 19 nt, Homo sapiens
ugacaaaccuuauggaaaa

SEQ ID NO: 1887 - RNA, 19 nt, Homo sapiens
ggaaugagcuucagaugca

SEQ ID NO: 1888 - RNA, 19 nt, Homo sapiens
ggacacagcuguaagauug

SEQ ID NO: 1889 - RNA, 19 nt, Homo sapiens
gacaagagauuacagauaa

SEQ ID NO: 1890 - RNA, 19 nt, Homo sapiens
gaagaaacauucccuauuc

SEQ ID NO: 1891 - RNA, 19 nt, Homo sapiens
gagggugguuuaugauuaa

SEQ ID NO: 1892 - RNA, 19 nt, Homo sapiens
caacaaagaacaaucacua

SEQ ID NO: 1893 - RNA, 19 nt, Homo sapiens
gaagaaauauacacgguuu

SEQ ID NO: 1894 - RNA, 19 nt, Homo sapiens
uacaugagcuuuacagaua

SEQ ID NO: 1895 - RNA, 19 nt, Homo sapiens
gguaggagaugaauuguuu

SEQ ID NO: 1896 - RNA, 19 nt, Homo sapiens
agaaggaacugaucauuaa

SEQ ID NO: 1897 - RNA, 19 nt, Homo sapiens
cuacagaccuccaauauca

SEQ ID NO: 1898 - RNA, 19 nt, Homo sapiens
gaaacuggccaaaccguua

SEQ ID NO: 1899 - RNA, 19 nt, Homo sapiens
gauuaucgcugcaaaggaa

SEQ ID NO: 1900 - RNA, 19 nt, Homo sapiens
gagagugccugcaagcuuu

SEQ ID NO: 1901 - RNA, 19 nt, Homo sapiens
gacaagagguggccauaaa

SEQ ID NO: 1902 - RNA, 19 nt, Homo sapiens
uuaaaucgcugucuugaga

SEQ ID NO: 1903 - RNA, 19 nt, Homo sapiens
acuaagaggugaacaugua

SEQ ID NO: 1904 - RNA, 19 nt, Homo sapiens
gaucaugaauguccgaaga

SEQ ID NO: 1905 - RNA, 19 nt, Homo sapiens
gaugagacccuacuacuga

SEQ ID NO: 1906 - RNA, 19 nt, Homo sapiens
cagcaaaggugccaaagau

SEQ ID NO: 1907 - RNA, 19 nt, Homo sapiens
uaaaggcaguuguccacua

SEQ ID NO: 1908 - RNA, 19 nt, Homo sapiens
gaagggaccugcuuucuug

SEQ ID NO: 1909 - RNA, 19 nt, Homo sapiens
gcaaagacgucccuaagag

SEQ ID NO: 1910 - RNA, 19 nt, Homo sapiens
ccaaugggcuggcugcaaa

SEQ ID NO: 1911 - RNA, 19 nt, Homo sapiens
gagcacggcuuuaauaagu

SEQ ID NO: 1912 - RNA, 19 nt, Homo sapiens
caaacuccguuaugauaua

SEQ ID NO: 1913 - RNA, 19 nt, Homo sapiens
ggauaaaguugucugauuu

SEQ ID NO: 1914 - RNA, 19 nt, Homo sapiens
ggaaaugccuccauaaaua

SEQ ID NO: 1915 - RNA, 19 nt, Homo sapiens
ggacaucgcugugaauugg

SEQ ID NO: 1916 - RNA, 19 nt, Homo sapiens
agaaagaagucaccgaaga

SEQ ID NO: 1917 - RNA, 19 nt, Homo sapiens
ggacaaggccacccaauga

SEQ ID NO: 1918 - RNA, 19 nt, Homo sapiens
ccacagcgaugacuacauu

SEQ ID NO: 1919 - RNA, 19 nt, Homo sapiens
gcuguuaaauuauggcuua

SEQ ID NO: 1920 - RNA, 19 nt, Homo sapiens
gcaaagaaagcuagaauug

SEQ ID NO: 1921 - RNA, 19 nt, Homo sapiens
caucagagagucuuauaua

SEQ ID NO: 1922 - RNA, 19 nt, Homo sapiens
ccaaugaguugccauauaa

SEQ ID NO: 1923 - RNA, 19 nt, Homo sapiens
ggccauagcuuaauuaauc

SEQ ID NO: 1924 - RNA, 19 nt, Homo sapiens
gcacagccguuuaccauga

SEQ ID NO: 1925 - RNA, 19 nt, Homo sapiens
ggacagcccuuuagucaag

SEQ ID NO: 1926 - RNA, 19 nt, Homo sapiens
gaacugauuccugaaauaa

SEQ ID NO: 1927 - RNA, 19 nt, Homo sapiens
cacauaaacucguaucuua

SEQ ID NO: 1928 - RNA, 19 nt, Homo sapiens
gagaaggcacucaaguuua

SEQ ID NO: 1929 - RNA, 19 nt, Homo sapiens
agacauaguuuacagagaa

SEQ ID NO: 1930 - RNA, 19 nt, Homo sapiens
gcagagagauuucauaacu

SEQ ID NO: 1931 - RNA, 19 nt, Homo sapiens
gaacauaccuguaaaucau

SEQ ID NO: 1932 - RNA, 19 nt, Homo sapiens
ggacaucgaccuguuauua

SEQ ID NO: 1933 - RNA, 19 nt, Homo sapiens
uaaaugaacuccuacauag

SEQ ID NO: 1934 - RNA, 19 nt, Homo sapiens
ggaauuaucucugaacaua

SEQ ID NO: 1935 - RNA, 19 nt, Homo sapiens
gcagaaauacaucuacuaa

SEQ ID NO: 1936 - RNA, 19 nt, Homo sapiens
gcuaugagcuguucuucaa

SEQ ID NO: 1937 - RNA, 19 nt, Homo sapiens
cgacaaagcucuacucauc

SEQ ID NO: 1938 - RNA, 19 nt, Homo sapiens
gcucaacccuggagacauu

SEQ ID NO: 1939 - RNA, 19 nt, Homo sapiens
ggacaagacucgcagauuu

SEQ ID NO: 1940 - RNA, 19 nt, Homo sapiens
gcugagcgcuuugcaauaa

SEQ ID NO: 1941 - RNA, 19 nt, Homo sapiens
caagaagucucacgggaaa

SEQ ID NO: 1942 - RNA, 19 nt, Homo sapiens
ucacagaggccaagaaauu

SEQ ID NO: 1943 - RNA, 19 nt, Homo sapiens
caucagugcaugacguuua

SEQ ID NO: 1944 - RNA, 19 nt, Homo sapiens
ugaaugagcugguggauua

SEQ ID NO: 1945 - RNA, 19 nt, Homo sapiens
ugccaaaacuuaccuauaa

SEQ ID NO: 1946 - RNA, 19 nt, Homo sapiens
gagcugcacuccaaugaga

SEQ ID NO: 1947 - RNA, 19 nt, Homo sapiens
gaaaccaagccauuaauga

SEQ ID NO: 1948 - RNA, 19 nt, Homo sapiens
ccaaggagcuacugacauu

SEQ ID NO: 1949 - RNA, 19 nt, Homo sapiens
agagaaacauggcccaaua

SEQ ID NO: 1950 - RNA, 19 nt, Homo sapiens
ccacagacauuuacauuaa

SEQ ID NO: 1951 - RNA, 19 nt, Homo sapiens
gaagggaguuugcuaaauu

SEQ ID NO: 1952 - RNA, 19 nt, Homo sapiens
gaacagaucugaugaauga

SEQ ID NO: 1953 - RNA, 19 nt, Homo sapiens
caagagagcugaagacuau

SEQ ID NO: 1954 - RNA, 19 nt, Homo sapiens
gcauauauauucagcauug

SEQ ID NO: 1955 - RNA, 19 nt, Homo sapiens
caacuugacugcaguauug

SEQ ID NO: 1956 - RNA, 19 nt, Homo sapiens
gaacuuaacuuuccauguu

SEQ ID NO: 1957 - RNA, 19 nt, Homo sapiens
gacaagaccuguaguaauu

SEQ ID NO: 1958 - RNA, 19 nt, Homo sapiens
agaaagagcuugacaguaa

SEQ ID NO: 1959 - RNA, 19 nt, Homo sapiens
ggaaguaguucacaaaaua

SEQ ID NO: 1960 - RNA, 19 nt, Homo sapiens
ugaaguaucuguauccaaa

SEQ ID NO: 1961 - RNA, 19 nt, Homo sapiens
gagcuucacucccuuaguu

SEQ ID NO: 1962 - RNA, 19 nt, Homo sapiens
uaaggacucugaagaugua

SEQ ID NO: 1963 - RNA, 19 nt, Homo sapiens
gacaaaguguguaauuaug

SEQ ID NO: 1964 - RNA, 19 nt, Homo sapiens
gcucaggacuuagcaagaa

SEQ ID NO: 1965 - RNA, 19 nt, Homo sapiens
gaaacugaauaccuaagau

SEQ ID NO: 1966 - RNA, 19 nt, Homo sapiens
gaaacugaauaccuaagau

SEQ ID NO: 1967 - RNA, 19 nt, Homo sapiens
uaaggacucugaagaugua

SEQ ID NO: 1968 - RNA, 19 nt, Homo sapiens
gacaaaguguguaauuaug

SEQ ID NO: 1969 - RNA, 19 nt, Homo sapiens
gcucaggacuuagcaagaa

SEQ ID NO: 1970 - RNA, 19 nt, Homo sapiens
ccauccagcugauccagaa

SEQ ID NO: 1971 - RNA, 19 nt, Homo sapiens
gaacccuccugaugagagu

SEQ ID NO: 1972 - RNA, 19 nt, Homo sapiens
gaggacauccaccaguaca

SEQ ID NO: 1973 - RNA, 19 nt, Homo sapiens
ccacugauguguguuaauu

SEQ ID NO: 1974 - RNA, 19 nt, Homo sapiens
caauagaaccugucaauau

SEQ ID NO: 1975 - RNA, 19 nt, Homo sapiens
gaagacaggaaucgaauga

SEQ ID NO: 1976 - RNA, 19 nt, Homo sapiens
ggaagaauuuguaccauuu

SEQ ID NO: 1977 - RNA, 19 nt, Homo sapiens
gaacgaccuuucuuucuuu

SEQ ID NO: 1978 - RNA, 19 nt, Homo sapiens
ggagucaucucuuccuaua

SEQ ID NO: 1979 - RNA, 19 nt, Homo sapiens
ggagaagccucaccucuug

SEQ ID NO: 1980 - RNA, 19 nt, Homo sapiens
gcagaaaggacucaagauu

SEQ ID NO: 1981 - RNA, 19 nt, Homo sapiens
gagaacaacuacucauuga

SEQ ID NO: 1982 - RNA, 19 nt, Homo sapiens
gaacuucucgucacuguau

SEQ ID NO: 1983 - RNA, 19 nt, Homo sapiens
ggauuguucuuucuucaua

SEQ ID NO: 1984 - RNA, 19 nt, Homo sapiens
gaaggguucucguauguca

SEQ ID NO: 1985 - RNA, 19 nt, Homo sapiens
gaagaaggauguggugauu

SEQ ID NO: 1986 - RNA, 19 nt, Homo sapiens
ggacugggaucgaacaaca

SEQ ID NO: 1987 - RNA, 19 nt, Homo sapiens
ggacagaaguggaaauauu

SEQ ID NO: 1988 - RNA, 19 nt, Homo sapiens
ucaaagaggugaacauuaa

SEQ ID NO: 1989 - RNA, 19 nt, Homo sapiens
gaccaaaucucaguuguuu

SEQ ID NO: 1990 - RNA, 19 nt, Homo sapiens
ggagaauggugcuguuuaa

SEQ ID NO: 1991 - RNA, 19 nt, Homo sapiens
gaagagaccaaaguauaau

SEQ ID NO: 1992 - RNA, 19 nt, Homo sapiens
gaagaccggccacgucauu

SEQ ID NO: 1993 - RNA, 19 nt, Homo sapiens
ggaagagaccaaaguauaa

SEQ ID NO: 1994 - RNA, 19 nt, Homo sapiens
gcauugagauugaccagaa

SEQ ID NO: 1995 - RNA, 19 nt, Homo sapiens
ugagagaacgagaaaguug

SEQ ID NO: 1996 - RNA, 19 nt, Homo sapiens
gugaaacccugucugcauu

SEQ ID NO: 1997 - RNA, 19 nt, Homo sapiens
ggaucucucucaacaacua

SEQ ID NO: 1998 - RNA, 19 nt, Homo sapiens
acaacuaggugaacacaua

SEQ ID NO: 1999 - RNA, 19 nt, Homo sapiens
ucacaguccugaaacgaua

SEQ ID NO: 2000 - RNA, 19 nt, Homo sapiens
gauuggagauucuacauuc

SEQ ID NO: 2001 - RNA, 19 nt, Homo sapiens
gcucauggaugcaaaucuu

SEQ ID NO: 2002 - RNA, 19 nt, Homo sapiens
gaagcuaagccgaccauuu

SEQ ID NO: 2003 - RNA, 19 nt, Homo sapiens
aaagagagcuuaucgugaa

SEQ ID NO: 2004 - RNA, 19 nt, Homo sapiens
gaugauagguuagaaauag

SEQ ID NO: 2005 - RNA, 19 nt, Homo sapiens
acaaagaagucauggauug

SEQ ID NO: 2006 - RNA, 19 nt, Homo sapiens
ggagcuggaucaugaaaga

SEQ ID NO: 2007 - RNA, 19 nt, Homo sapiens
gaaaagggaugaugggauu

SEQ ID NO: 2008 - RNA, 19 nt, Homo sapiens
ccuagacgaucccaaauau

SEQ ID NO: 2009 - RNA, 19 nt, Homo sapiens
gagccaaaccagggauuua

SEQ ID NO: 2010 - RNA, 19 nt, Homo sapiens
ugaaacgaaugcuggagaa

SEQ ID NO: 2011 - RNA, 19 nt, Homo sapiens
ucacucacccagagaaaua

SEQ ID NO: 2012 - RNA, 19 nt, Homo sapiens
ccaagaaagcuaucucuga

SEQ ID NO: 2013 - RNA, 19 nt, Homo sapiens
agacucaccuagagcuaaa

SEQ ID NO: 2014 - RNA, 19 nt, Homo sapiens
ccuggaggguccuguacaa

SEQ ID NO: 2015 - RNA, 19 nt, Homo sapiens
gagcaaaugagccaaacgu

SEQ ID NO: 2016 - RNA, 19 nt, Homo sapiens
ggaggguccuguacaaucu

SEQ ID NO: 2017 - RNA, 19 nt, Homo sapiens
gacuuucucugcaccaugu

SEQ ID NO: 2018 - RNA, 19 nt, Homo sapiens
ccagggagcuugaaaguuu

SEQ ID NO: 2019 - RNA, 19 nt, Homo sapiens
aaagugcaguucaguaaua

SEQ ID NO: 2020 - RNA, 19 nt, Homo sapiens
gagaaucacuaaccagaga

SEQ ID NO: 2021 - RNA, 19 nt, Homo sapiens
gagcccaucccuauuauaa

SEQ ID NO: 2022 - RNA, 19 nt, Homo sapiens
gagacgaguuuaacgcuua

SEQ ID NO: 2023 - RNA, 19 nt, Homo sapiens
aaagcaaccuucugaugua

SEQ ID NO: 2024 - RNA, 19 nt, Homo sapiens
ccgagaagguagacaauug

SEQ ID NO: 2025 - RNA, 19 nt, Homo sapiens
gcaaagcaaccuucugaug

SEQ ID NO: 2026 - RNA, 19 nt, Homo sapiens
agacagagccacaagguaa

SEQ ID NO: 2027 - RNA, 19 nt, Homo sapiens
gcaaggagguuagagaaau

SEQ ID NO: 2028 - RNA, 19 nt, Homo sapiens
caaggagguuagagaaaua

SEQ ID NO: 2029 - RNA, 19 nt, Homo sapiens
ucuuacgacuguuacguua

SEQ ID NO: 2030 - RNA, 19 nt, Homo sapiens
gaagacaucauccggaaua

SEQ ID NO: 2031 - RNA, 19 nt, Homo sapiens
caacagcguuccuagagaa

SEQ ID NO: 2032 - RNA, 19 nt, Homo sapiens
gaaaugggauggacugaac

SEQ ID NO: 2033 - RNA, 19 nt, Homo sapiens
acgaugagcugcagacuga

SEQ ID NO: 2034 - RNA, 19 nt, Homo sapiens
gaaagaagccugcauauaa

SEQ ID NO: 2035 - RNA, 19 nt, Homo sapiens
gaaauugacucuacauugu

SEQ ID NO: 2036 - RNA, 19 nt, Homo sapiens
acaaauagcacuuagguua

SEQ ID NO: 2037 - RNA, 19 nt, Homo sapiens
gaauacaccugugguuaaa

SEQ ID NO: 2038 - RNA, 19 nt, Homo sapiens
ggagaugccugccauuaaa

SEQ ID NO: 2039 - RNA, 19 nt, Homo sapiens
ucaaugaucuuguguuaga

SEQ ID NO: 2040 - RNA, 19 nt, Homo sapiens
gaaagaacauguaaagugu

SEQ ID NO: 2041 - RNA, 19 nt, Homo sapiens
gaagaaagaacauguaaag

SEQ ID NO: 2042 - RNA, 19 nt, Homo sapiens
guagauagauggcaauaug

SEQ ID NO: 2043 - RNA, 19 nt, Homo sapiens
gaggagggcuaacugauug

SEQ ID NO: 2044 - RNA, 19 nt, Homo sapiens
gaggaacccugccauguau

SEQ ID NO: 2045 - RNA, 19 nt, Homo sapiens
gcacggaucuuuacuuuug

SEQ ID NO: 2046 - RNA, 19 nt, Homo sapiens
ggcguaagaugauggauuu

SEQ ID NO: 2047 - RNA, 19 nt, Homo sapiens
gcaaaggaaaccaacaaua

SEQ ID NO: 2048 - RNA, 19 nt, Homo sapiens
gcacaaagccauucuaagu

SEQ ID NO: 2049 - RNA, 19 nt, Homo sapiens
caaaggaaaccaacaauaa

SEQ ID NO: 2050 - RNA, 19 nt, Homo sapiens
ccauacagcuucauaaaua

SEQ ID NO: 2051 - RNA, 19 nt, Homo sapiens
gaagagaacuuaucuagug

SEQ ID NO: 2052 - RNA, 19 nt, Homo sapiens
gaagugggcuccaguauua

SEQ ID NO: 2053 - RNA, 19 nt, Homo sapiens
gcaagaugcugauucauua

SEQ ID NO: 2054 - RNA, 19 nt, Homo sapiens
ccauacagcuucauaaaua

SEQ ID NO: 2055 - RNA, 19 nt, Homo sapiens
gaaaguuaaugucaaggaa

SEQ ID NO: 2056 - RNA, 19 nt, Homo sapiens
gagcaacacuggcauaaca

SEQ ID NO: 2057 - RNA, 19 nt, Homo sapiens
uaacagagauuugccuaaa

SEQ ID NO: 2058 - RNA, 19 nt, Homo sapiens
gcgaagagcugaccaaaua

SEQ ID NO: 2059 - RNA, 19 nt, Homo sapiens
caaaggguuucucuguuua

SEQ ID NO: 2060 - RNA, 19 nt, Homo sapiens
gaaaugaccucccuaaguu

SEQ ID NO: 2061 - RNA, 19 nt, Homo sapiens
gaaggcagcugguauauuc

SEQ ID NO: 2062 - RNA, 19 nt, Homo sapiens
gacaugaucuuccuucuga

SEQ ID NO: 2063 - RNA, 19 nt, Homo sapiens
gcacucuucuguucccuua

SEQ ID NO: 2064 - RNA, 19 nt, Homo sapiens
guauuaaacucuccuuuga

SEQ ID NO: 2065 - RNA, 19 nt, Homo sapiens
gcaaggagaugucugaaua

SEQ ID NO: 2066 - RNA, 19 nt, Homo sapiens
caacuucccugaucuuuaa

SEQ ID NO: 2067 - RNA, 19 nt, Homo sapiens
gcucaaagauguaauguag

SEQ ID NO: 2068 - RNA, 19 nt, Homo sapiens
gaacaaggagucagacauu

SEQ ID NO: 2069 - RNA, 19 nt, Homo sapiens
aaacuaggcgguugaauga

SEQ ID NO: 2070 - RNA, 19 nt, Homo sapiens
gauggaacuucgacuuugu

SEQ ID NO: 2071 - RNA, 19 nt, Homo sapiens
guaaacagauggcacuuug

SEQ ID NO: 2072 - RNA, 19 nt, Homo sapiens
gauguguccucauuaauuu

SEQ ID NO: 2073 - RNA, 19 nt, Homo sapiens
gaagagagauacaagauga

SEQ ID NO: 2074 - RNA, 19 nt, Homo sapiens
gagcauaccugaagagaga

SEQ ID NO: 2075 - RNA, 19 nt, Homo sapiens
gcuaugaaguccagaaauu

SEQ ID NO: 2076 - RNA, 19 nt, Homo sapiens
gugaauaugugaaauagug

SEQ ID NO: 2077 - RNA, 19 nt, Homo sapiens
aaagcaugcuagaguauga

SEQ ID NO: 2078 - RNA, 19 nt, Homo sapiens
uuaagaauguggagaagua

SEQ ID NO: 2079 - RNA, 19 nt, Homo sapiens
gauaacaagcugacacaua

SEQ ID NO: 2080 - RNA, 19 nt, Homo sapiens
ggacguaauugaugaagua

SEQ ID NO: 2081 - RNA, 19 nt, Homo sapiens
gcagauggguucuuaaaug

SEQ ID NO: 2082 - RNA, 19 nt, Homo sapiens
caaaugagguugaggaaau

SEQ ID NO: 2083 - RNA, 19 nt, Homo sapiens
ggaaauaccuggaggauga

SEQ ID NO: 2084 - RNA, 19 nt, Homo sapiens
gauccacguuucaaugaua

SEQ ID NO: 2085 - RNA, 19 nt, Homo sapiens
gcauuuagguggagacuuc

SEQ ID NO: 2086 - RNA, 19 nt, Homo sapiens
gauguacgauuauaguuug

SEQ ID NO: 2087 - RNA, 19 nt, Homo sapiens
ugaauuagauccacguuuc

SEQ ID NO: 2088 - RNA, 19 nt, Homo sapiens
gcacaagaauggaucacaa

SEQ ID NO: 2089 - RNA, 19 nt, Homo sapiens
gcugaaacaugcaguugua

SEQ ID NO: 2090 - RNA, 19 nt, Homo sapiens
guacguaccaugcagaaua

SEQ ID NO: 2091 - RNA, 19 nt, Homo sapiens
gaacuugcauugugauugg

SEQ ID NO: 2092 - RNA, 19 nt, Homo sapiens
gaagcaugacggacaagua

SEQ ID NO: 2093 - RNA, 19 nt, Homo sapiens
gaacauuccagagcgugua

SEQ ID NO: 2094 - RNA, 19 nt, Homo sapiens
guucuuaguugcuguaugu

SEQ ID NO: 2095 - RNA, 19 nt, Homo sapiens
caucaugguuggccuuauc

SEQ ID NO: 2096 - RNA, 19 nt, Homo sapiens
ggaacaaacuggcaaagca

SEQ ID NO: 2097 - RNA, 19 nt, Homo sapiens
gaucagagcagcagugaaa

SEQ ID NO: 2098 - RNA, 19 nt, Homo sapiens
gggcaaaacugaauuauaa

SEQ ID NO: 2099 - RNA, 19 nt, Homo sapiens
gaucucagguucuccuuga

SEQ ID NO: 2100 - RNA, 19 nt, Homo sapiens
cuacagaucuccaaugaaa

SEQ ID NO: 2101 - RNA, 19 nt, Homo sapiens
gcuacaagcuggagaauga

SEQ ID NO: 2102 - RNA, 19 nt, Homo sapiens
ggaaacagcuauguggaaa

SEQ ID NO: 2103 - RNA, 19 nt, Homo sapiens
ggaguuggaucucucagaa

SEQ ID NO: 2104 - RNA, 19 nt, Homo sapiens
guaguaagcuaaacugaaa

SEQ ID NO: 2105 - RNA, 19 nt, Homo sapiens
gacaauauguucaagagaa

SEQ ID NO: 2106 - RNA, 19 nt, Homo sapiens
gacaacaucucgucagcua

SEQ ID NO: 2107 - RNA, 19 nt, Homo sapiens
uauaugauguguccaguaa

SEQ ID NO: 2108 - RNA, 19 nt, Homo sapiens
caaagaagcucacuuacug

SEQ ID NO: 2109 - RNA, 19 nt, Homo sapiens
gaacagcccuaaagugguu

SEQ ID NO: 2110 - RNA, 19 nt, Homo sapiens
gaacauggaugacccuaag

SEQ ID NO: 2111 - RNA, 19 nt, Homo sapiens
gggcaaagcuaaaucaagu

SEQ ID NO: 2112 - RNA, 19 nt, Homo sapiens
ggaaagcgauguggagauu

SEQ ID NO: 2113 - RNA, 19 nt, Homo sapiens
ccaagaccguggccuauuu

SEQ ID NO: 2114 - RNA, 19 nt, Homo sapiens
aaagcgauguggagauuua

SEQ ID NO: 2115 - RNA, 19 nt, Homo sapiens
gugaggagcuucccuauag

SEQ ID NO: 2116 - RNA, 19 nt, Homo sapiens
gaauuccucuugucgaagu

SEQ ID NO: 2117 - RNA, 19 nt, Homo sapiens
guuauuagcaccuuuaaga

SEQ ID NO: 2118 - RNA, 19 nt, Homo sapiens
ggagggaggccaugacuug

SEQ ID NO: 2119 - RNA, 19 nt, Homo sapiens
caggagagcucaagaaugg

SEQ ID NO: 2120 - RNA, 19 nt, Homo sapiens
ggauauggauuucaguuaa

SEQ ID NO: 2121 - RNA, 19 nt, Homo sapiens
ggaagucggugccuugguu

SEQ ID NO: 2122 - RNA, 19 nt, Homo sapiens
ggaaggagaggacugguuu

SEQ ID NO: 2123 - RNA, 19 nt, Homo sapiens
gcagauacuugcacgguuu

SEQ ID NO: 2124 - RNA, 19 nt, Homo sapiens
gaguagaacuagaauguga

SEQ ID NO: 2125 - RNA, 19 nt, Homo sapiens
gcgaauaaaucaugaaaga

SEQ ID NO: 2126 - RNA, 19 nt, Homo sapiens
gaagauggaauuaugcaua

SEQ ID NO: 2127 - RNA, 19 nt, Homo sapiens
ggcaaugcgucucgcgaua

SEQ ID NO: 2128 - RNA, 19 nt, Homo sapiens
gauccgcaaugaugaggaa

SEQ ID NO: 2129 - RNA, 19 nt, Homo sapiens
gcaaugcgucucgcgauaa

SEQ ID NO: 2130 - RNA, 19 nt, Homo sapiens
gaggaacucaauaagcuuu

SEQ ID NO: 2131 - RNA, 19 nt, Homo sapiens
aauagaagcugugcaauua

SEQ ID NO: 2132 - RNA, 19 nt, Homo sapiens
caacugaccucaucuggaa

SEQ ID NO: 2133 - RNA, 19 nt, Homo sapiens
gaaggaaucugaucuuaau

SEQ ID NO: 2134 - RNA, 19 nt, Homo sapiens
gggaaggguuucucuauua

SEQ ID NO: 2135 - RNA, 19 nt, Homo sapiens
ggagguucauugagaauug

SEQ ID NO: 2136 - RNA, 19 nt, Homo sapiens
ggcaauagcucaccguuua

SEQ ID NO: 2137 - RNA, 19 nt, Homo sapiens
caaauacgcuuagcugugu

SEQ ID NO: 2138 - RNA, 19 nt, Homo sapiens
ggagaucgccuacaaguuc

SEQ ID NO: 2139 - RNA, 19 nt, Homo sapiens
gcagaaacacuccaauuua

SEQ ID NO: 2140 - RNA, 19 nt, Homo sapiens
guaaauacgugaaugcauu

SEQ ID NO: 2141 - RNA, 19 nt, Homo sapiens
gcacugaacuuuugagaua

SEQ ID NO: 2142 - RNA, 19 nt, Homo sapiens
gaagaacagucauuugaug

SEQ ID NO: 2143 - RNA, 19 nt, Homo sapiens
gaggugagcuguuaaauca

SEQ ID NO: 2144 - RNA, 19 nt, Homo sapiens
gcagggugauuuccuaaua

SEQ ID NO: 2145 - RNA, 19 nt, Homo sapiens
gggagaagauauuuaauug

SEQ ID NO: 2146 - RNA, 19 nt, Homo sapiens
caacuucucuccugaacuu

SEQ ID NO: 2147 - RNA, 19 nt, Homo sapiens
ggacacggcacugcacuug

SEQ ID NO: 2148 - RNA, 19 nt, Homo sapiens
gcacuuggcugugauucau

SEQ ID NO: 2149 - RNA, 19 nt, Homo sapiens
gagacgagggcgaugaaua

SEQ ID NO: 2150 - RNA, 19 nt, Homo sapiens
caugaacccuuccuggauu

SEQ ID NO: 2151 - RNA, 19 nt, Homo sapiens
gaacauggacuuguauauu

SEQ ID NO: 2152 - RNA, 19 nt, Homo sapiens
gauguggggugaaaaguua

SEQ ID NO: 2153 - RNA, 19 nt, Homo sapiens
ggacgagaaagaucauuga

SEQ ID NO: 2154 - RNA, 19 nt, Homo sapiens
aggacgagcugcccuauga

SEQ ID NO: 2155 - RNA, 19 nt, Homo sapiens
gaagggaaguuucaguaac

SEQ ID NO: 2156 - RNA, 19 nt, Homo sapiens
ggaagggaaguuucaguaa

SEQ ID NO: 2157 - RNA, 19 nt, Homo sapiens
ggaaacugcugcuguguac

SEQ ID NO: 2158 - RNA, 19 nt, Homo sapiens
gaaccaaccacucauggaa

SEQ ID NO: 2159 - RNA, 19 nt, Homo sapiens
gggaacaguuugaauauaa

SEQ ID NO: 2160 - RNA, 19 nt, Homo sapiens
gcaguagccugaagcagaa

SEQ ID NO: 2161 - RNA, 19 nt, Homo sapiens
cgagaaggaugcacagaua

SEQ ID NO: 2162 - RNA, 19 nt, Homo sapiens
gcaagaggcugagaggaaa

SEQ ID NO: 2163 - RNA, 19 nt, Homo sapiens
gaagacaaaugaaagcuaa

SEQ ID NO: 2164 - RNA, 19 nt, Homo sapiens
gauaaagacugcuguuaga

SEQ ID NO: 2165 - RNA, 19 nt, Homo sapiens
gaggagagcucuaauauua

SEQ ID NO: 2166 - RNA, 19 nt, Homo sapiens
gaggaagccugauuaaaga

SEQ ID NO: 2167 - RNA, 19 nt, Homo sapiens
gaaagagcaugaugacaua

SEQ ID NO: 2168 - RNA, 19 nt, Homo sapiens
gaggagagcucuauuaugu

SEQ ID NO: 2169 - RNA, 19 nt, Homo sapiens
gaaacugaauggaagaaua

SEQ ID NO: 2170 - RNA, 19 nt, Homo sapiens
aaagaaggcuguaccguua

SEQ ID NO: 2171 - RNA, 19 nt, Homo sapiens
cuacaugucuuugcucuua

SEQ ID NO: 2172 - RNA, 19 nt, Homo sapiens
gcuaaguccuguaagaaua

SEQ ID NO: 2173 - RNA, 19 nt, Homo sapiens
caaaggcaauguacuguuu

SEQ ID NO: 2174 - RNA, 19 nt, Homo sapiens
gaacaaugguggauccaaa

SEQ ID NO: 2175 - RNA, 19 nt, Homo sapiens
aaguucagcuucucuauua

SEQ ID NO: 2176 - RNA, 19 nt, Homo sapiens
gaagaaaucucugauggau

SEQ ID NO: 2177 - RNA, 19 nt, Homo sapiens
gaacaccuuuacucuauaa

SEQ ID NO: 2178 - RNA, 19 nt, Homo sapiens
gcauggagcuggagaacua

SEQ ID NO: 2179 - RNA, 19 nt, Homo sapiens
gaugaaagcucuaaagaug

SEQ ID NO: 2180 - RNA, 19 nt, Homo sapiens
gaaaggagguucuaaacua

SEQ ID NO: 2181 - RNA, 19 nt, Homo sapiens
ggaagaagcucauuugauu

SEQ ID NO: 2182 - RNA, 19 nt, Homo sapiens
gcaaagagguggcaguuaa

SEQ ID NO: 2183 - RNA, 19 nt, Homo sapiens
ggaagaagauccacaugaa

SEQ ID NO: 2184 - RNA, 19 nt, Homo sapiens
gaacauacuuucagagcuu

SEQ ID NO: 2185 - RNA, 19 nt, Homo sapiens
gaacaaucuuugcuguaua

SEQ ID NO: 2186 - RNA, 19 nt, Homo sapiens
uaacagaacugcuucaaca

SEQ ID NO: 2187 - RNA, 19 nt, Homo sapiens
gaagagauccacacacagu

SEQ ID NO: 2188 - RNA, 19 nt, Homo sapiens
ucaaugagcugcugcacau

SEQ ID NO: 2189 - RNA, 19 nt, Homo sapiens
gaagauagguuuccaugug

SEQ ID NO: 2190 - RNA, 19 nt, Homo sapiens
gaauuacccuuccucaucu

SEQ ID NO: 2191 - RNA, 19 nt, Homo sapiens
cuacagagcuucaguguga

SEQ ID NO: 2192 - RNA, 19 nt, Homo sapiens
gaacauauuugaucgaaag

SEQ ID NO: 2193 - RNA, 19 nt, Homo sapiens
gagcaaaccuagauaagga

SEQ ID NO: 2194 - RNA, 19 nt, Homo sapiens
gcauugaucucuucuuaga

SEQ ID NO: 2195 - RNA, 19 nt, Homo sapiens
ggaagacaguggugaacuu

SEQ ID NO: 2196 - RNA, 19 nt, Homo sapiens
gcaaagcauuggaaucaga

SEQ ID NO: 2197 - RNA, 19 nt, Homo sapiens
gagcugacguggaagauga

SEQ ID NO: 2198 - RNA, 19 nt, Homo sapiens
gaacgggccuggaaccaua

SEQ ID NO: 2199 - RNA, 19 nt, Homo sapiens
gauacuaacugcucucaga

SEQ ID NO: 2200 - RNA, 19 nt, Homo sapiens
gaaagaauggugucaauga

SEQ ID NO: 2201 - RNA, 19 nt, Homo sapiens
ucaauaaugucccauguaa

SEQ ID NO: 2202 - RNA, 19 nt, Homo sapiens
ucaugaaucuccaaccuua

SEQ ID NO: 2203 - RNA, 19 nt, Homo sapiens
gauguugacuugaguaaau

SEQ ID NO: 2204 - RNA, 19 nt, Homo sapiens
gaaaggaaaugacuaauga

SEQ ID NO: 2205 - RNA, 19 nt, Homo sapiens
gaagaaggcuguucagaga

SEQ ID NO: 2206 - RNA, 19 nt, Homo sapiens
ggaaguagcuacguucuuu

SEQ ID NO: 2207 - RNA, 19 nt, Homo sapiens
ggacauaaguggaaagaag

SEQ ID NO: 2208 - RNA, 19 nt, Homo sapiens
gaaagaguccaucagauuu

SEQ ID NO: 2209 - RNA, 19 nt, Homo sapiens
caaacuacauuggcauuua

SEQ ID NO: 2210 - RNA, 19 nt, Homo sapiens
aaacagacauggauggaua

SEQ ID NO: 2211 - RNA, 19 nt, Homo sapiens
cgaaaggaaugguuaacua

SEQ ID NO: 2212 - RNA, 19 nt, Homo sapiens
ccagaaaucuuccacagaa

SEQ ID NO: 2213 - RNA, 19 nt, Homo sapiens
gaaacuaucuggaugugua

SEQ ID NO: 2214 - RNA, 19 nt, Homo sapiens
ccacaaagaugguaucgua

SEQ ID NO: 2215 - RNA, 19 nt, Homo sapiens
ggaaauggcugugguaaca

SEQ ID NO: 2216 - RNA, 19 nt, Homo sapiens
gagacaagaugaagacugu

SEQ ID NO: 2217 - RNA, 19 nt, Homo sapiens
gcacaugggcugcgucuuu

SEQ ID NO: 2218 - RNA, 19 nt, Homo sapiens
ccagugcgcuucaagauga

SEQ ID NO: 2219 - RNA, 19 nt, Homo sapiens
gaacaucugcuuugagguu

SEQ ID NO: 2220 - RNA, 19 nt, Homo sapiens
gguauugccuugugaauuu

SEQ ID NO: 2221 - RNA, 19 nt, Homo sapiens
gcagaacaauuacgaauag

SEQ ID NO: 2222 - RNA, 19 nt, Homo sapiens
guacauagcuguuugaaau

SEQ ID NO: 2223 - RNA, 19 nt, Homo sapiens
gcuguaaacuuguagcauu

SEQ ID NO: 2224 - RNA, 19 nt, Homo sapiens
uagaggugcucauucauuu

SEQ ID NO: 2225 - RNA, 19 nt, Homo sapiens
gguauaagccuuuccaaga

SEQ ID NO: 2226 - RNA, 19 nt, Homo sapiens
uaacagagcuuccuuaggu

SEQ ID NO: 2227 - RNA, 19 nt, Homo sapiens
ggaugaaggaugacgacua

SEQ ID NO: 2228 - RNA, 19 nt, Homo sapiens
acaccaaccucauugaauu

SEQ ID NO: 2229 - RNA, 19 nt, Homo sapiens
cgaacaagaugaccaggua

SEQ ID NO: 2230 - RNA, 19 nt, Homo sapiens
gaugaaggaugacgacuau

SEQ ID NO: 2231 - RNA, 19 nt, Homo sapiens
cagcauggcucuccucuuu

SEQ ID NO: 2232 - RNA, 19 nt, Homo sapiens
guaaagaacuaugguguua

SEQ ID NO: 2233 - RNA, 19 nt, Homo sapiens
gaaacuaccuguuacauua

SEQ ID NO: 2234 - RNA, 19 nt, Homo sapiens
gaagugagauccaguauaa

SEQ ID NO: 2235 - RNA, 19 nt, Homo sapiens
ggaaccagcuguauuuguu

SEQ ID NO: 2236 - RNA, 19 nt, Homo sapiens
guuggaguguuucuaauaa

SEQ ID NO: 2237 - RNA, 19 nt, Homo sapiens
gcgcugggcuuagaucauu

SEQ ID NO: 2238 - RNA, 19 nt, Homo sapiens
ggagccaguuugccggaua

SEQ ID NO: 2239 - RNA, 19 nt, Homo sapiens
ccaauggccugcugaacaa

SEQ ID NO: 2240 - RNA, 19 nt, Homo sapiens
gggccuggcuuccucauga

SEQ ID NO: 2241 - RNA, 19 nt, Homo sapiens
gggcagagcuccaccauga

SEQ ID NO: 2242 - RNA, 19 nt, Homo sapiens
gcacggccauugcauucaa

SEQ ID NO: 2243 - RNA, 19 nt, Homo sapiens
ccaacugccuguucaauaa

SEQ ID NO: 2244 - RNA, 19 nt, Homo sapiens
ggauacaugugaugaguuu

SEQ ID NO: 2245 - RNA, 19 nt, Homo sapiens
ggacgaaugugcugaguau

SEQ ID NO: 2246 - RNA, 19 nt, Homo sapiens
gagcuugucuuauuugcua

SEQ ID NO: 2247 - RNA, 19 nt, Homo sapiens
gaaaugcugugucuucgua

SEQ ID NO: 2248 - RNA, 19 nt, Homo sapiens
ggacagcacuucccugaga

SEQ ID NO: 2249 - RNA, 19 nt, Homo sapiens
gaagacaccaccauucuga

SEQ ID NO: 2250 - RNA, 19 nt, Homo sapiens
ggccagagcuugaccuuca

SEQ ID NO: 2251 - RNA, 19 nt, Homo sapiens
ggacaggccugcguuguuu

SEQ ID NO: 2252 - RNA, 19 nt, Homo sapiens
ggaaagaggaagcucauga

SEQ ID NO: 2253 - RNA, 19 nt, Homo sapiens
gcaaacacguuggaugagu

SEQ ID NO: 2254 - RNA, 19 nt, Homo sapiens
ggacuaugcugcccuuuug

SEQ ID NO: 2255 - RNA, 19 nt, Homo sapiens
acaagacgcuccaggaucu

SEQ ID NO: 2256 - RNA, 19 nt, Homo sapiens
gcauaggccuguaaucgua

SEQ ID NO: 2257 - RNA, 19 nt, Homo sapiens
ucagagaguucgagacaaa

SEQ ID NO: 2258 - RNA, 19 nt, Homo sapiens
ugcgaaagguuguauguga

SEQ ID NO: 2259 - RNA, 19 nt, Homo sapiens
gcaacaggaucgacuugag

SEQ ID NO: 2260 - RNA, 19 nt, Homo sapiens
gaauagcguuguguguuau

SEQ ID NO: 2261 - RNA, 19 nt, Homo sapiens
ugaauagcguuguguguua

SEQ ID NO: 2262 - RNA, 19 nt, Homo sapiens
gggaucaguuuguugaaua

SEQ ID NO: 2263 - RNA, 19 nt, Homo sapiens
gagccugaaucaucguuua

SEQ ID NO: 2264 - RNA, 19 nt, Homo sapiens
ggaaguaccuggaacugua

SEQ ID NO: 2265 - RNA, 19 nt, Homo sapiens
ggacagagggaaccauuua

SEQ ID NO: 2266 - RNA, 19 nt, Homo sapiens
ggugagagguagcuccuaa

SEQ ID NO: 2267 - RNA, 19 nt, Homo sapiens
aaagacagguggccacuga

SEQ ID NO: 2268 - RNA, 19 nt, Homo sapiens
gaaagaugaucagcuauuu

SEQ ID NO: 2269 - RNA, 19 nt, Homo sapiens
caacagaaccagacaggua

SEQ ID NO: 2270 - RNA, 19 nt, Homo sapiens
ugagaaauguucagaaugu

SEQ ID NO: 2271 - RNA, 19 nt, Homo sapiens
uaccuucacucgaaacuua

SEQ ID NO: 2272 - RNA, 19 nt, Homo sapiens
gaacgaaaguaaagauguu

SEQ ID NO: 2273 - RNA, 19 nt, Homo sapiens
ggacuuauggguaauguua

SEQ ID NO: 2274 - RNA, 19 nt, Homo sapiens
ugaaaggacuuauggguaa

SEQ ID NO: 2275 - RNA, 19 nt, Homo sapiens
gaucagaguucacuuucuu

SEQ ID NO: 2276 - RNA, 19 nt, Homo sapiens
ggaaagauguuaagcauuu

SEQ ID NO: 2277 - RNA, 19 nt, Homo sapiens
caugggagcucuugaaaua

SEQ ID NO: 2278 - RNA, 19 nt, Homo sapiens
gaacaaggaugaagugaag

SEQ ID NO: 2279 - RNA, 19 nt, Homo sapiens
ugaagaagcucacaguaaa

SEQ ID NO: 2280 - RNA, 19 nt, Homo sapiens
cagcagaccuucaguguga

SEQ ID NO: 2281 - RNA, 19 nt, Homo sapiens
ggagagagaugguggauua

SEQ ID NO: 2282 - RNA, 19 nt, Homo sapiens
guacagagcuggagaugaa

SEQ ID NO: 2283 - RNA, 19 nt, Homo sapiens
gaacgucccuucagucugu

SEQ ID NO: 2284 - RNA, 19 nt, Homo sapiens
caaauucucuccaaaguuc

SEQ ID NO: 2285 - RNA, 19 nt, Homo sapiens
ggauauaucugacugcuuu

SEQ ID NO: 2286 - RNA, 19 nt, Homo sapiens
gagcagagcuugggaaaga

SEQ ID NO: 2287 - RNA, 19 nt, Homo sapiens
gauaugagauguagcaaau

SEQ ID NO: 2288 - RNA, 19 nt, Homo sapiens
gaacugcuuucuuucguuu

SEQ ID NO: 2289 - RNA, 19 nt, Homo sapiens
gcaguaucaugaagccuaa

SEQ ID NO: 2290 - RNA, 19 nt, Homo sapiens
gaaacuaggucugauauuc

SEQ ID NO: 2291 - RNA, 19 nt, Homo sapiens
guacagcuccggacucuuc

SEQ ID NO: 2292 - RNA, 19 nt, Homo sapiens
gcacaaccauucugaaguu

SEQ ID NO: 2293 - RNA, 19 nt, Homo sapiens
ggacuuagaugcccagaug

SEQ ID NO: 2294 - RNA, 19 nt, Homo sapiens
gaagguggauucuaggaaa

SEQ ID NO: 2295 - RNA, 19 nt, Homo sapiens
ggacuagcccugcuguuua

SEQ ID NO: 2296 - RNA, 19 nt, Homo sapiens
gauagaaacuccugcuaau

SEQ ID NO: 2297 - RNA, 19 nt, Homo sapiens
ggacauuuauucccagcua

SEQ ID NO: 2298 - RNA, 19 nt, Homo sapiens
ggacagagcuacagaccua

SEQ ID NO: 2299 - RNA, 19 nt, Homo sapiens
ggauggcucuccacagaua

SEQ ID NO: 2300 - RNA, 19 nt, Homo sapiens
gaaagacagccuugagcaa

SEQ ID NO: 2301 - RNA, 19 nt, Homo sapiens
ggacagggaggccaccaaa

SEQ ID NO: 2302 - RNA, 19 nt, Homo sapiens
ggacgaggcuugggcuuug

SEQ ID NO: 2303 - RNA, 19 nt, Homo sapiens
agcaagaccucaacaauau

SEQ ID NO: 2304 - RNA, 19 nt, Homo sapiens
gaaugaagcuuugcccuuu

SEQ ID NO: 2305 - RNA, 19 nt, Homo sapiens
gaacacaguuuagugcuuu

SEQ ID NO: 2306 - RNA, 19 nt, Homo sapiens
uaucagagcucuuaauguu

SEQ ID NO: 2307 - RNA, 19 nt, Homo sapiens
ugaagaaugucuacagaua

SEQ ID NO: 2308 - RNA, 19 nt, Homo sapiens
ugaagcaccuggagaauga

SEQ ID NO: 2309 - RNA, 19 nt, Homo sapiens
cggaacagcacaagaguua

SEQ ID NO: 2310 - RNA, 19 nt, Homo sapiens
ggaagaagaccuuuaaaga

SEQ ID NO: 2311 - RNA, 19 nt, Homo sapiens
gagaagcgcugcccuguga

SEQ ID NO: 2312 - RNA, 19 nt, Homo sapiens
gaaucaugcuguucucuuu

SEQ ID NO: 2313 - RNA, 19 nt, Homo sapiens
ggaguaaccggacaccuua

SEQ ID NO: 2314 - RNA, 19 nt, Homo sapiens
uaaggugacucgaguguuu

SEQ ID NO: 2315 - RNA, 19 nt, Homo sapiens
aaacgacacuuucaucaaa

SEQ ID NO: 2316 - RNA, 19 nt, Homo sapiens
ggacucaaguuaaaguauu

SEQ ID NO: 2317 - RNA, 19 nt, Homo sapiens
guaauggacucaaguuaaa

SEQ ID NO: 2318 - RNA, 19 nt, Homo sapiens
ggacaucacugcccacuuc

SEQ ID NO: 2319 - RNA, 19 nt, Homo sapiens
agaggaagauguucacuua

SEQ ID NO: 2320 - RNA, 19 nt, Homo sapiens
gaucguggcucuucaggaa

SEQ ID NO: 2321 - RNA, 19 nt, Homo sapiens
ggacagaggcagauaagaa

SEQ ID NO: 2322 - RNA, 19 nt, Homo sapiens
gcacuaagcagccuucaug

SEQ ID NO: 2323 - RNA, 19 nt, Homo sapiens
gcaagcaggugccuacaga

SEQ ID NO: 2324 - RNA, 19 nt, Homo sapiens
ggaauuagaugcuccauug

SEQ ID NO: 2325 - RNA, 19 nt, Homo sapiens
ggacaucucugccaaaguc

SEQ ID NO: 2326 - RNA, 19 nt, Homo sapiens
caauaugccuggaaacuau

SEQ ID NO: 2327 - RNA, 19 nt, Homo sapiens
gguuaagacucaccaguuc

SEQ ID NO: 2328 - RNA, 19 nt, Homo sapiens
caacaggacuuuagguuca

SEQ ID NO: 2329 - RNA, 19 nt, Homo sapiens
gcauaagauugacaucauc

SEQ ID NO: 2330 - RNA, 19 nt, Homo sapiens
gaaagagggcauaagguua

SEQ ID NO: 2331 - RNA, 19 nt, Homo sapiens
ggacugaucuuuaaacuau

SEQ ID NO: 2332 - RNA, 19 nt, Homo sapiens
ucaaauggcuuacuucauc

SEQ ID NO: 2333 - RNA, 19 nt, Homo sapiens
ucuaagaacugaugucuaa

SEQ ID NO: 2334 - RNA, 19 nt, Homo sapiens
gcaaauagaucuccauuac

SEQ ID NO: 2335 - RNA, 19 nt, Homo sapiens
ccagauaugucguucuuua

SEQ ID NO: 2336 - RNA, 19 nt, Homo sapiens
gaaaggcugugcucucaaa

SEQ ID NO: 2337 - RNA, 19 nt, Homo sapiens
ggagaaaccugcaugaaag

SEQ ID NO: 2338 - RNA, 19 nt, Homo sapiens
cuugaagccuccugaauua

SEQ ID NO: 2339 - RNA, 19 nt, Homo sapiens
gaggaagcauccaaagauu

SEQ ID NO: 2340 - RNA, 19 nt, Homo sapiens
gauaggagauacaaacuuu

SEQ ID NO: 2341 - RNA, 19 nt, Homo sapiens
cuacguagcucgugauaag

SEQ ID NO: 2342 - RNA, 19 nt, Homo sapiens
gcagagauguccacacguu

SEQ ID NO: 2343 - RNA, 19 nt, Homo sapiens
caugagaucugcucuaaga

SEQ ID NO: 2344 - RNA, 19 nt, Homo sapiens
gggcaccucugcuguauug

SEQ ID NO: 2345 - RNA, 19 nt, Homo sapiens
ccacagagcaagugauuua

SEQ ID NO: 2346 - RNA, 19 nt, Homo sapiens
gcagaaaggagaucauuua

SEQ ID NO: 2347 - RNA, 19 nt, Homo sapiens
guagcaagaucuuuacaua

SEQ ID NO: 2348 - RNA, 19 nt, Homo sapiens
ugucagagcuugauuagaa

SEQ ID NO: 2349 - RNA, 19 nt, Homo sapiens
gagcugacauugaaauaug

SEQ ID NO: 2350 - RNA, 19 nt, Homo sapiens
guacagcuauuucucauca

SEQ ID NO: 2351 - RNA, 19 nt, Homo sapiens
gagguuaggugaagugguu

SEQ ID NO: 2352 - RNA, 19 nt, Homo sapiens
gaaagggagucacaagaca

SEQ ID NO: 2353 - RNA, 19 nt, Homo sapiens
gaacuggaguggaguagga

SEQ ID NO: 2354 - RNA, 19 nt, Homo sapiens
cagcaggcauaucucauua

SEQ ID NO: 2355 - RNA, 19 nt, Homo sapiens
ucaaguaccucccugaaug

SEQ ID NO: 2356 - RNA, 19 nt, Homo sapiens
gcugggaaguggcuuaaua

SEQ ID NO: 2357 - RNA, 19 nt, Homo sapiens
cauauucccugcccugaua

SEQ ID NO: 2358 - RNA, 19 nt, Homo sapiens
gggaagugcucaagaccua

SEQ ID NO: 2359 - RNA, 19 nt, Homo sapiens
cauagaaagugacguguua

SEQ ID NO: 2360 - RNA, 19 nt, Homo sapiens
ggaaggagcuguuaugaga

SEQ ID NO: 2361 - RNA, 19 nt, Homo sapiens
gaaaggagaagcuaaauua

SEQ ID NO: 2362 - RNA, 19 nt, Homo sapiens
ggaggaaggucaagauuua

SEQ ID NO: 2363 - RNA, 19 nt, Homo sapiens
ggaaauagcugagauaaug

SEQ ID NO: 2364 - RNA, 19 nt, Homo sapiens
ccagacgccugauauugaa

SEQ ID NO: 2365 - RNA, 19 nt, Homo sapiens
cagcaccacucaagaccaa

SEQ ID NO: 2366 - RNA, 19 nt, Homo sapiens
cgccugauauugaaguaaa

SEQ ID NO: 2367 - RNA, 19 nt, Homo sapiens
caacauccacucucucuug

SEQ ID NO: 2368 - RNA, 19 nt, Homo sapiens
gggcagugcuccaguggua

SEQ ID NO: 2369 - RNA, 19 nt, Homo sapiens
gaaagaggcuggcuacaca

SEQ ID NO: 2370 - RNA, 19 nt, Homo sapiens
guacagaagugagacauaa

SEQ ID NO: 2371 - RNA, 19 nt, Homo sapiens
gaggugaucucgcaaaguu

SEQ ID NO: 2372 - RNA, 19 nt, Homo sapiens
caagaagccugcaccaugu

SEQ ID NO: 2373 - RNA, 19 nt, Homo sapiens
gcacuucacuaccaaauga

SEQ ID NO: 2374 - RNA, 19 nt, Homo sapiens
gcacuggucccaaguagua

SEQ ID NO: 2375 - RNA, 19 nt, Homo sapiens
ccaaagggcaguaaaguuu

SEQ ID NO: 2376 - RNA, 19 nt, Homo sapiens
gcucagaggagguguauuu

SEQ ID NO: 2377 - RNA, 19 nt, Homo sapiens
gcacuucacuaccaaauga

SEQ ID NO: 2378 - RNA, 17 nt, Homo sapiens
aaagggcaguaaaguuu

SEQ ID NO: 2379 - RNA, 19 nt, Homo sapiens
gaacaucucuggcaacaau

SEQ ID NO: 2380 - RNA, 19 nt, Homo sapiens
ggugauauaucucaaauug

SEQ ID NO: 2381 - RNA, 19 nt, Homo sapiens
gcaagcaucuuauauaguu

SEQ ID NO: 2382 - RNA, 19 nt, Homo sapiens
gaaccagucuuucaacuca

SEQ ID NO: 2383 - RNA, 19 nt, Homo sapiens
gguaagauauugugcuuua

SEQ ID NO: 2384 - RNA, 19 nt, Homo sapiens
ccgcaaauaugcagaauua

SEQ ID NO: 2385 - RNA, 19 nt, Homo sapiens
ggauguacauggcguguua

SEQ ID NO: 2386 - RNA, 19 nt, Homo sapiens
ggugaaguuuguauguuua

SEQ ID NO: 2387 - RNA, 19 nt, Homo sapiens
gcuccgcgcuuuccgauuu

SEQ ID NO: 2388 - RNA, 19 nt, Homo sapiens
gagcaggaauggugagaug

SEQ ID NO: 2389 - RNA, 19 nt, Homo sapiens
gaacuugggauaagagugu

SEQ ID NO: 2390 - RNA, 19 nt, Homo sapiens
ccgaggagcuuuaugagau

SEQ ID NO: 2391 - RNA, 19 nt, Homo sapiens
uuuaugagaugcugaguga

SEQ ID NO: 2392 - RNA, 19 nt, Homo sapiens
gaaggaaccugaugcuuua

SEQ ID NO: 2393 - RNA, 19 nt, Homo sapiens
gcauauaucuagaagguau

SEQ ID NO: 2394 - RNA, 19 nt, Homo sapiens
gaacaaauacaugggauua

SEQ ID NO: 2395 - RNA, 19 nt, Homo sapiens
ggacacagauuuagacuug

SEQ ID NO: 2396 - RNA, 19 nt, Homo sapiens
gaacguacuugcagaugug

SEQ ID NO: 2397 - RNA, 19 nt, Homo sapiens
gagaaagcauuuguuugua

SEQ ID NO: 2398 - RNA, 19 nt, Homo sapiens
ggagaaagcauuuguuugu

SEQ ID NO: 2399 - RNA, 19 nt, Homo sapiens
cgaggcagcuugaguuaaa

SEQ ID NO: 2400 - RNA, 19 nt, Homo sapiens
gaaagaaucuguagagaaa

SEQ ID NO: 2401 - RNA, 19 nt, Homo sapiens
gcaaugagcuguuugaaga

SEQ ID NO: 2402 - RNA, 19 nt, Homo sapiens
ugacaaagguggauaaauu

SEQ ID NO: 2403 - RNA, 19 nt, Homo sapiens
ggaaauggaucucuuugaa

SEQ ID NO: 2404 - RNA, 19 nt, Homo sapiens
ggaaaguaaugguccaaca

SEQ ID NO: 2405 - RNA, 19 nt, Homo sapiens
agacaguuaugcagcuauu

SEQ ID NO: 2406 - RNA, 19 nt, Homo sapiens
ccaauucucggaagcaaga

SEQ ID NO: 2407 - RNA, 19 nt, Homo sapiens
gaaaguaaugguccaacag

SEQ ID NO: 2408 - RNA, 19 nt, Homo sapiens
gcgccagagugaacaagua

SEQ ID NO: 2409 - RNA, 19 nt, Homo sapiens
gaagguggcccagcuaugu

SEQ ID NO: 2410 - RNA, 19 nt, Homo sapiens
gauuagagaccaaggauuu

SEQ ID NO: 2411 - RNA, 19 nt, Homo sapiens
gaugugaguagaagaguua

SEQ ID NO: 2412 - RNA, 19 nt, Homo sapiens
acacacagcuggaagaaau

SEQ ID NO: 2413 - RNA, 19 nt, Homo sapiens
gcaacaggaucgacuugag

SEQ ID NO: 2414 - RNA, 19 nt, Homo sapiens
gaagcugcgucccaacauc

SEQ ID NO: 2415 - RNA, 19 nt, Homo sapiens
gcacaagaguuauaagauc

SEQ ID NO: 2416 - RNA, 19 nt, Homo sapiens
cgauacagcuuggcacuuu

SEQ ID NO: 2417 - RNA, 19 nt, Homo sapiens
gcuagugguuuaucaauuu

SEQ ID NO: 2418 - RNA, 19 nt, Homo sapiens
gacagaagcagccauauuu

SEQ ID NO: 2419 - RNA, 19 nt, Homo sapiens
gaagaugcguaucaguauu

SEQ ID NO: 2420 - RNA, 19 nt, Homo sapiens
guggagaacuggcucuuaa

SEQ ID NO: 2421 - RNA, 19 nt, Homo sapiens
gcuugaggcuccagacaua

SEQ ID NO: 2422 - RNA, 19 nt, Homo sapiens
gaucugguuuacugccuua

SEQ ID NO: 2423 - RNA, 19 nt, Homo sapiens
ggagggcgaccaugaguuu

SEQ ID NO: 2424 - RNA, 19 nt, Homo sapiens
cugaugauguuaagcauuu

SEQ ID NO: 2425 - RNA, 19 nt, Homo sapiens
cagaagaugcguaucagua

SEQ ID NO: 2426 - RNA, 19 nt, Homo sapiens
gugcuuaguugccaucuau

SEQ ID NO: 2427 - RNA, 19 nt, Homo sapiens
gcacacagaagaugcguau

SEQ ID NO: 2428 - RNA, 19 nt, Homo sapiens
ggagaaagagcugcuggua

SEQ ID NO: 2429 - RNA, 19 nt, Homo sapiens
gcgcuacugugaccauuga

SEQ ID NO: 2430 - RNA, 19 nt, Homo sapiens
ggauuccucuguguucuuu

SEQ ID NO: 2431 - RNA, 19 nt, Homo sapiens
ggagugagcgcgaccauca

SEQ ID NO: 2432 - RNA, 19 nt, Homo sapiens
cuuaaugucugaugauguu

SEQ ID NO: 2433 - RNA, 19 nt, Homo sapiens
cuagugaucugguuuacug

SEQ ID NO: 2434 - RNA, 19 nt, Homo sapiens
caacgaauuugcuagugau

SEQ ID NO: 2435 - RNA, 19 nt, Homo sapiens
ucaacgaauuugcuaguga

SEQ ID NO: 2436 - RNA, 19 nt, Homo sapiens
ucuguguucuuucccauua

SEQ ID NO: 2437 - RNA, 19 nt, Homo sapiens
gcuggacgcuguggaaaug

SEQ ID NO: 2438 - RNA, 19 nt, Homo sapiens
ggagaacuggcucuuaaga

SEQ ID NO: 2439 - RNA, 19 nt, Homo sapiens
ccaucuauauagcaucuuu

SEQ ID NO: 2440 - RNA, 19 nt, Homo sapiens
ggagugcaauggcgugauc

SEQ ID NO: 2441 - RNA, 19 nt, Homo sapiens
gcacaguuuucuuuucuuu

SEQ ID NO: 2442 - RNA, 19 nt, Homo sapiens
guagaggaguggagaacug

SEQ ID NO: 2443 - RNA, 19 nt, Homo sapiens
ccaaagugcugggauuaca

SEQ ID NO: 2444 - RNA, 19 nt, Homo sapiens
cuaauaugccuaugccuuu

SEQ ID NO: 2445 - RNA, 19 nt, Homo sapiens
gaucucguguccucaaagu

SEQ ID NO: 2446 - RNA, 19 nt, Homo sapiens
ugacucaccugccaucaag

SEQ ID NO: 2447 - RNA, 19 nt, Homo sapiens
ugacagaagcagccauauu

SEQ ID NO: 2448 - RNA, 19 nt, Homo sapiens
gaugaugucacuucucuca

SEQ ID NO: 2449 - RNA, 19 nt, Homo sapiens
caccacacccagcuaauuu

SEQ ID NO: 2450 - RNA, 19 nt, Homo sapiens
aagaugcguaucaguauua

SEQ ID NO: 2451 - RNA, 19 nt, Homo sapiens
cccaaccacugccgaguuu

SEQ ID NO: 2452 - RNA, 19 nt, Homo sapiens
guucagggaagcugcauuu

SEQ ID NO: 2453 - RNA, 19 nt, Homo sapiens
ucccaggaauuaauaaaug

SEQ ID NO: 2454 - RNA, 19 nt, Homo sapiens
cgaauuugcuagugaucug

SEQ ID NO: 2455 - RNA, 19 nt, Homo sapiens
gagcccagcgcuacuguga

SEQ ID NO: 2456 - RNA, 19 nt, Homo sapiens
acacagaagaugcguauca

SEQ ID NO: 2457 - RNA, 19 nt, Homo sapiens
ugaaacccuuggccaaugu

SEQ ID NO: 2458 - RNA, 19 nt, Homo sapiens
gcuaccggcugcaugacaa

SEQ ID NO: 2459 - RNA, 19 nt, Homo sapiens
gaacuccuggccuuaagug

SEQ ID NO: 2460 - RNA, 19 nt, Homo sapiens
gauguguccucucucucuu

SEQ ID NO: 2461 - RNA, 19 nt, Homo sapiens
gcucguggucuuucucuug

SEQ ID NO: 2462 - RNA, 19 nt, Homo sapiens
ugacagggccaaaguccuu

SEQ ID NO: 2463 - RNA, 19 nt, Homo sapiens
ccacgucuggcuaauuauu

SEQ ID NO: 2464 - RNA, 19 nt, Homo sapiens
ugaugucacuucucucaag

SEQ ID NO: 2465 - RNA, 19 nt, Homo sapiens
gggaucucguguccucaaa

SEQ ID NO: 2466 - RNA, 19 nt, Homo sapiens
cagaagcagccauauuuua

SEQ ID NO: 2467 - RNA, 19 nt, Homo sapiens
cagggaagcugcauuuugu

SEQ ID NO: 2468 - RNA, 19 nt, Homo sapiens
ccagacauacucaccucua

SEQ ID NO: 2469 - RNA, 19 nt, Homo sapiens
cagcagguaugggcagguu

SEQ ID NO: 2470 - RNA, 19 nt, Homo sapiens
gaaccucgagcugaucuuc

SEQ ID NO: 2471 - RNA, 19 nt, Homo sapiens
gagcugacagggccaaagu

SEQ ID NO: 2472 - RNA, 19 nt, Homo sapiens
ccaccacacccagcuaauu

SEQ ID NO: 2473 - RNA, 19 nt, Homo sapiens
uuuaaugucugcacagucu

SEQ ID NO: 2474 - RNA, 19 nt, Homo sapiens
agaagaugcguaucaguau

SEQ ID NO: 2475 - RNA, 19 nt, Homo sapiens
ccaggaugcugccucuuac

SEQ ID NO: 2476 - RNA, 19 nt, Homo sapiens
uccaggaugcugccucuua

SEQ ID NO: 2477 - RNA, 19 nt, Homo sapiens
cagggccucuuucaucugu

SEQ ID NO: 2478 - RNA, 19 nt, Homo sapiens
ugccucagccucccaagua

SEQ ID NO: 2479 - RNA, 19 nt, Homo sapiens
cggcgaaccucgagcugau

SEQ ID NO: 2480 - RNA, 19 nt, Homo sapiens
ugugccaucugacaucuga

SEQ ID NO: 2481 - RNA, 19 nt, Homo sapiens
caccaugccuggccaacuc

SEQ ID NO: 2482 - RNA, 19 nt, Homo sapiens
gagcacaguuuucuuuucu

SEQ ID NO: 2483 - RNA, 19 nt, Homo sapiens
caacuacagcugcgucuac

SEQ ID NO: 2484 - RNA, 19 nt, Homo sapiens
gagcagcaccagcccagau

SEQ ID NO: 2485 - RNA, 19 nt, Homo sapiens
cuuaguugccaucuauaua

SEQ ID NO: 2486 - RNA, 19 nt, Homo sapiens
cccaggaauuaauaaaugu

SEQ ID NO: 2487 - RNA, 19 nt, Homo sapiens
gcgcgaccaucauguccau

SEQ ID NO: 2488 - RNA, 19 nt, Homo sapiens
ucucagggccucuuucauc

SEQ ID NO: 2489 - RNA, 19 nt, Homo sapiens
cugaguagcugggcugaca

SEQ ID NO: 2490 - RNA, 19 nt, Homo sapiens
cugaaacccuuggccaaug

SEQ ID NO: 2491 - RNA, 19 nt, Homo sapiens
gcugaaacccuuggccaau

SEQ ID NO: 2492 - RNA, 19 nt, Homo sapiens
ccgaaucacugcugaaacc

SEQ ID NO: 2493 - RNA, 19 nt, Homo sapiens
gcuuaguugccaucuauau

SEQ ID NO: 2494 - RNA, 19 nt, Homo sapiens
gcguuuccuuaaugucuga

SEQ ID NO: 2495 - RNA, 19 nt, Homo sapiens
gggcagaguccgaaucacu

SEQ ID NO: 2496 - RNA, 19 nt, Homo sapiens
uguccucucucucuuucuu

SEQ ID NO: 2497 - RNA, 19 nt, Homo sapiens
acuuccagcuguucaagaa

SEQ ID NO: 2498 - RNA, 19 nt, Homo sapiens
guaucaguauuaucaacca

SEQ ID NO: 2499 - RNA, 19 nt, Homo sapiens
gagcuggacgcuguggaaa

SEQ ID NO: 2500 - RNA, 19 nt, Homo sapiens
aggcuggagugcaguguug

SEQ ID NO: 2501 - RNA, 19 nt, Homo sapiens
uuaguugccaucuauauag

SEQ ID NO: 2502 - RNA, 19 nt, Homo sapiens
cagacauacucaccucuac

SEQ ID NO: 2503 - RNA, 19 nt, Homo sapiens
uagccauucuaauagguau

SEQ ID NO: 2504 - RNA, 19 nt, Homo sapiens
ucugaugccuucccaacca

SEQ ID NO: 2505 - RNA, 19 nt, Homo sapiens
gauggacccagcugagcaa

SEQ ID NO: 2506 - RNA, 19 nt, Homo sapiens
cuccuggguucaagugauu

SEQ ID NO: 2507 - RNA, 19 nt, Homo sapiens
ugcuagugguuuaucaauu

SEQ ID NO: 2508 - RNA, 19 nt, Homo sapiens
ccugauguguccucucucu

SEQ ID NO: 2509 - RNA, 19 nt, Homo sapiens
cacagcaccuggccaacca

SEQ ID NO: 2510 - RNA, 19 nt, Homo sapiens
ccaucagccuggcaacuac

SEQ ID NO: 2511 - RNA, 19 nt, Homo sapiens
guugguguccucagaagug

SEQ ID NO: 2512 - RNA, 19 nt, Homo sapiens
gcgucuacguggaccugaa

SEQ ID NO: 2513 - RNA, 19 nt, Homo sapiens
gcguaucaguauuaucaac

SEQ ID NO: 2514 - RNA, 19 nt, Homo sapiens
gcuggauuccucuguguuc

SEQ ID NO: 2515 - RNA, 19 nt, Homo sapiens
aggcuggucuugaacucuu

SEQ ID NO: 2516 - RNA, 19 nt, Homo sapiens
ucuucgagcugcacaacau

SEQ ID NO: 2517 - RNA, 19 nt, Homo sapiens
gcaaccaugucuugauuua

SEQ ID NO: 2518 - RNA, 19 nt, Homo sapiens
gaaggaguaugaaaugaaa

SEQ ID NO: 2519 - RNA, 19 nt, Homo sapiens
gaaauucaguggacagcua

SEQ ID NO: 2520 - RNA, 19 nt, Homo sapiens
gaacuacccuguggccaua

SEQ ID NO: 2521 - RNA, 19 nt, Homo sapiens
uaaacuaccuucccaaaug

SEQ ID NO: 2522 - RNA, 19 nt, Homo sapiens
gcaaagaucuuggaaaugc

SEQ ID NO: 2523 - RNA, 19 nt, Homo sapiens
gaaagucuaugauuacuac

SEQ ID NO: 2524 - RNA, 19 nt, Homo sapiens
ugaagaagcucuccuuuua

SEQ ID NO: 2525 - RNA, 19 nt, Homo sapiens
gauaaggugucaaaucaga

SEQ ID NO: 2526 - RNA, 19 nt, Homo sapiens
cagcaaagaucuuggaaau

SEQ ID NO: 2527 - RNA, 19 nt, Homo sapiens
gaauacagcaugaaaguga

SEQ ID NO: 2528 - RNA, 19 nt, Homo sapiens
ggagaggccuucacacuca

SEQ ID NO: 2529 - RNA, 19 nt, Homo sapiens
ggaaggcaguccagugaaa

SEQ ID NO: 2530 - RNA, 19 nt, Homo sapiens
gaaaucacaagaaccauaa

SEQ ID NO: 2531 - RNA, 19 nt, Homo sapiens
guccacagcuucaacagua

SEQ ID NO: 2532 - RNA, 19 nt, Homo sapiens
ccacagugaugguuaagaa

SEQ ID NO: 2533 - RNA, 19 nt, Homo sapiens
gauggucucuggcuucauu

SEQ ID NO: 2534 - RNA, 19 nt, Homo sapiens
gaaaucgcaucgcacaaug

SEQ ID NO: 2535 - RNA, 19 nt, Homo sapiens
gaaaggaccaacccaagaa

SEQ ID NO: 2536 - RNA, 19 nt, Homo sapiens
acacugagcuuguucuuca

SEQ ID NO: 2537 - RNA, 19 nt, Homo sapiens
ugaaagaucuaaccaugug

SEQ ID NO: 2538 - RNA, 19 nt, Homo sapiens
ugaggaagcugugaagaaa

SEQ ID NO: 2539 - RNA, 19 nt, Homo sapiens
ggacagaagucagcagcaa

SEQ ID NO: 2540 - RNA, 19 nt, Homo sapiens
guacaguucucuaucaaca

SEQ ID NO: 2541 - RNA, 19 nt, Homo sapiens
ggaccaacccaagaauuua

SEQ ID NO: 2542 - RNA, 19 nt, Homo sapiens
caaccaacaucgugaagug

SEQ ID NO: 2543 - RNA, 19 nt, Homo sapiens
ggaaggaaguacucaaguc

SEQ ID NO: 2544 - RNA, 19 nt, Homo sapiens
gaaggacaauggcuguuuc

SEQ ID NO: 2545 - RNA, 19 nt, Homo sapiens
cgaaaguacuucccugaga

SEQ ID NO: 2546 - RNA, 19 nt, Homo sapiens
cagcaaccaugucuugauu

SEQ ID NO: 2547 - RNA, 19 nt, Homo sapiens
gaaagugacaggagaagga

SEQ ID NO: 2548 - RNA, 19 nt, Homo sapiens
gaagaagagaugaauguau

SEQ ID NO: 2549 - RNA, 19 nt, Homo sapiens
agacauggaucugggauuu

SEQ ID NO: 2550 - RNA, 19 nt, Homo sapiens
ccuaugugcuccucgcuua

SEQ ID NO: 2551 - RNA, 19 nt, Homo sapiens
gcucaacaaugccauaaag

SEQ ID NO: 2552 - RNA, 19 nt, Homo sapiens
gcucaucuaugcuguuuua

SEQ ID NO: 2553 - RNA, 19 nt, Homo sapiens
ggaugagcauggccuugua

SEQ ID NO: 2554 - RNA, 19 nt, Homo sapiens
ggaaaugaagcaaacuauu

SEQ ID NO: 2555 - RNA, 19 nt, Homo sapiens
gaacagugguggaauugac

SEQ ID NO: 2556 - RNA, 19 nt, Homo sapiens
ccacagaagacacguguuu

SEQ ID NO: 2557 - RNA, 19 nt, Homo sapiens
ggaaggaguaugaaaugaa

SEQ ID NO: 2558 - RNA, 19 nt, Homo sapiens
uccaugcucuguccaaaua

SEQ ID NO: 2559 - RNA, 19 nt, Homo sapiens
gauaaucaccaucuuggaa

SEQ ID NO: 2560 - RNA, 19 nt, Homo sapiens
acagugaaauuucguguug

SEQ ID NO: 2561 - RNA, 19 nt, Homo sapiens
guacuggauuaucuaaaug

SEQ ID NO: 2562 - RNA, 19 nt, Homo sapiens
gaagaauuaucccugaaac

SEQ ID NO: 2563 - RNA, 19 nt, Homo sapiens
ggaaagacacagucaucaa

SEQ ID NO: 2564 - RNA, 19 nt, Homo sapiens
caaaccagccauagugaaa

SEQ ID NO: 2565 - RNA, 19 nt, Homo sapiens
gaaggaaguacucaaguca

SEQ ID NO: 2566 - RNA, 19 nt, Homo sapiens
acauucaacucccuacuuu

SEQ ID NO: 2567 - RNA, 19 nt, Homo sapiens
gaaagacacagucaucaag

SEQ ID NO: 2568 - RNA, 19 nt, Homo sapiens
aagaagagaugaauguauc

SEQ ID NO: 2569 - RNA, 19 nt, Homo sapiens
ggaagaagagaugaaugua

SEQ ID NO: 2570 - RNA, 19 nt, Homo sapiens
ugaguugauuccacuagua

SEQ ID NO: 2571 - RNA, 19 nt, Homo sapiens
guggugagguuucugaaga

SEQ ID NO: 2572 - RNA, 19 nt, Homo sapiens
gaagaugcuggacuuggua

SEQ ID NO: 2573 - RNA, 19 nt, Homo sapiens
ugaaaugcauggaccugaa

SEQ ID NO: 2574 - RNA, 19 nt, Homo sapiens
guaccucucuuacuguuag

SEQ ID NO: 2575 - RNA, 19 nt, Homo sapiens
cagaagaaaucagguggaa

SEQ ID NO: 2576 - RNA, 19 nt, Homo sapiens
ggaaaucgcaucgcacaau

SEQ ID NO: 2577 - RNA, 19 nt, Homo sapiens
gaggaaggaguaugaaaug

SEQ ID NO: 2578 - RNA, 19 nt, Homo sapiens
caucaagccucuguugguu

SEQ ID NO: 2579 - RNA, 19 nt, Homo sapiens
guaacagugccaaagauaa

SEQ ID NO: 2580 - RNA, 19 nt, Homo sapiens
caaguuugaaguacaagua

SEQ ID NO: 2581 - RNA, 19 nt, Homo sapiens
gaccaacccaagaauuuaa

SEQ ID NO: 2582 - RNA, 19 nt, Homo sapiens
acaggagccucuucacuga

SEQ ID NO: 2583 - RNA, 19 nt, Homo sapiens
gaacaaacuccuucaucca

SEQ ID NO: 2584 - RNA, 19 nt, Homo sapiens
ugaaguggaucacgaagca

SEQ ID NO: 2585 - RNA, 19 nt, Homo sapiens
caaaugugguagaagaauc

SEQ ID NO: 2586 - RNA, 19 nt, Homo sapiens
gaacacggaaggaaagaca

SEQ ID NO: 2587 - RNA, 19 nt, Homo sapiens
gggauuugguggugguaaa

SEQ ID NO: 2588 - RNA, 19 nt, Homo sapiens
ugaaugaccaggacgauga

SEQ ID NO: 2589 - RNA, 19 nt, Homo sapiens
ugaaaucacaagaaccaua

SEQ ID NO: 2590 - RNA, 19 nt, Homo sapiens
gaacuacaaacacuaugau

SEQ ID NO: 2591 - RNA, 19 nt, Homo sapiens
gaggaaaugaagcaaacua

SEQ ID NO: 2592 - RNA, 19 nt, Homo sapiens
caaguaacagugccaaaga

SEQ ID NO: 2593 - RNA, 19 nt, Homo sapiens
ccaaugaggagguaauguu

SEQ ID NO: 2594 - RNA, 19 nt, Homo sapiens
ggaaacaggagccucuuca

SEQ ID NO: 2595 - RNA, 19 nt, Homo sapiens
gagccuacaucuucaucga

SEQ ID NO: 2596 - RNA, 19 nt, Homo sapiens
ccaacaagguggauuugag

SEQ ID NO: 2597 - RNA, 19 nt, Homo sapiens
caagagcuuuguccaccuu

SEQ ID NO: 2598 - RNA, 19 nt, Homo sapiens
uaacagugccaaagauaau

SEQ ID NO: 2599 - RNA, 19 nt, Homo sapiens
gcaagaugucccaguaaga

SEQ ID NO: 2600 - RNA, 19 nt, Homo sapiens
gaucguugaugugaagaug

SEQ ID NO: 2601 - RNA, 19 nt, Homo sapiens
caagaaccauaaccaaacu

SEQ ID NO: 2602 - RNA, 19 nt, Homo sapiens
ugaagaggaaggaguauga

SEQ ID NO: 2603 - RNA, 19 nt, Homo sapiens
cuucugagcuaccugaaug

SEQ ID NO: 2604 - RNA, 19 nt, Homo sapiens
ggucacugcucaacaaugc

SEQ ID NO: 2605 - RNA, 19 nt, Homo sapiens
gcaucaaucgucauaaugu

SEQ ID NO: 2606 - RNA, 19 nt, Homo sapiens
agacaguccaggcacauua

SEQ ID NO: 2607 - RNA, 19 nt, Homo sapiens
ccaaagucuucauccaaug

SEQ ID NO: 2608 - RNA, 19 nt, Homo sapiens
ucacgguucugcaagaugu

SEQ ID NO: 2609 - RNA, 19 nt, Homo sapiens
gaaaaugcuugaaagaucu

SEQ ID NO: 2610 - RNA, 19 nt, Homo sapiens
ggacaagaggaaggaagua

SEQ ID NO: 2611 - RNA, 19 nt, Homo sapiens
cauaaagggaggaguagaa

SEQ ID NO: 2612 - RNA, 19 nt, Homo sapiens
ucacagccuuuguucugaa

SEQ ID NO: 2613 - RNA, 19 nt, Homo sapiens
gcucacagccuuuguucug

SEQ ID NO: 2614 - RNA, 19 nt, Homo sapiens
gaaacugccaccaaaugug

SEQ ID NO: 2615 - RNA, 19 nt, Homo sapiens
gagaaggaaacaacauuca

SEQ ID NO: 2616 - RNA, 19 nt, Homo sapiens
gcuguguccuucugagcua

SEQ ID NO: 2617 - RNA, 19 nt, Homo sapiens
ccacaaaccuuuucaaaua

SEQ ID NO: 2618 - RNA, 19 nt, Homo sapiens
gauccgagcuguucccuuu

SEQ ID NO: 2619 - RNA, 19 nt, Homo sapiens
ggacaauacagaucuaaua

SEQ ID NO: 2620 - RNA, 19 nt, Homo sapiens
caaacauggugauagauuu

SEQ ID NO: 2621 - RNA, 19 nt, Homo sapiens
gaagaaauccuagacauca

SEQ ID NO: 2622 - RNA, 19 nt, Homo sapiens
gcagacaucuccaucaucu

SEQ ID NO: 2623 - RNA, 19 nt, Homo sapiens
gaaagaauuggcuauaaga

SEQ ID NO: 2624 - RNA, 19 nt, Homo sapiens
uaacugacauucuucaaca

SEQ ID NO: 2625 - RNA, 19 nt, Homo sapiens
gaacaaauuggacuuggaa

SEQ ID NO: 2626 - RNA, 19 nt, Homo sapiens
ucauccagcucaccaguua

SEQ ID NO: 2627 - RNA, 19 nt, Homo sapiens
gcccaaacauggugauaga

SEQ ID NO: 2628 - RNA, 19 nt, Homo sapiens
gugguuaucuuggaaauug

SEQ ID NO: 2629 - RNA, 19 nt, Homo sapiens
guuaucaacugacgaccua

SEQ ID NO: 2630 - RNA, 19 nt, Homo sapiens
auacagcacuggcaugauu

SEQ ID NO: 2631 - RNA, 19 nt, Homo sapiens
uaagaagucuaggaacaaa

SEQ ID NO: 2632 - RNA, 19 nt, Homo sapiens
ucaaucaucuucuguacug

SEQ ID NO: 2633 - RNA, 19 nt, Homo sapiens
ggaacaaauuggacuugga

SEQ ID NO: 2634 - RNA, 19 nt, Homo sapiens
uuacagcacuccagccaaa

SEQ ID NO: 2635 - RNA, 19 nt, Homo sapiens
uauaagaagucuaggaaca

SEQ ID NO: 2636 - RNA, 19 nt, Homo sapiens
ucauggacauugaagcaua

SEQ ID NO: 2637 - RNA, 19 nt, Homo sapiens
uaaagaggccugugguuau

SEQ ID NO: 2638 - RNA, 19 nt, Homo sapiens
caucaucuguguuuacuag

SEQ ID NO: 2639 - RNA, 19 nt, Homo sapiens
auacauaccugcagacauc

SEQ ID NO: 2640 - RNA, 19 nt, Homo sapiens
gaauaaggagugaaacaau

SEQ ID NO: 2641 - RNA, 19 nt, Homo sapiens
ugaaagaauuggcuauaag

SEQ ID NO: 2642 - RNA, 19 nt, Homo sapiens
gaaagcuugugcccaaaca

SEQ ID NO: 2643 - RNA, 19 nt, Homo sapiens
cuacucaaauccaagugua

SEQ ID NO: 2644 - RNA, 19 nt, Homo sapiens
uuaaagaggccugugguua

SEQ ID NO: 2645 - RNA, 19 nt, Homo sapiens
aaacauaaccacaaaccuu

SEQ ID NO: 2646 - RNA, 19 nt, Homo sapiens
agaauuggcuauaagaagu

SEQ ID NO: 2647 - RNA, 19 nt, Homo sapiens
uaaggacaauacagaucua

SEQ ID NO: 2648 - RNA, 19 nt, Homo sapiens
gcuauaagaagucuaggaa

SEQ ID NO: 2649 - RNA, 19 nt, Homo sapiens
ccaaacauggugauagauu

SEQ ID NO: 2650 - RNA, 19 nt, Homo sapiens
ucaggugccuugugucuuc

SEQ ID NO: 2651 - RNA, 19 nt, Homo sapiens
gauggugucuccaggucaa

SEQ ID NO: 2652 - RNA, 19 nt, Homo sapiens
uaauuagccuacucaaauc

SEQ ID NO: 2653 - RNA, 19 nt, Homo sapiens
gagaaagcuugugcccaaa

SEQ ID NO: 2654 - RNA, 19 nt, Homo sapiens
ucaucuguguuuacuagua

SEQ ID NO: 2655 - RNA, 19 nt, Homo sapiens
ggaaacauuaacugacauu

SEQ ID NO: 2656 - RNA, 19 nt, Homo sapiens
uaucauguaucuucuguac

SEQ ID NO: 2657 - RNA, 19 nt, Homo sapiens
caacugacgaccuaucaug

SEQ ID NO: 2658 - RNA, 19 nt, Homo sapiens
gaucaaguugugagaagaa

SEQ ID NO: 2659 - RNA, 19 nt, Homo sapiens
ggacauugaagcauaucuu

SEQ ID NO: 2660 - RNA, 19 nt, Homo sapiens
ucuguacccuuaccuuauu

SEQ ID NO: 2661 - RNA, 19 nt, Homo sapiens
uguaucuucuguacccuua

SEQ ID NO: 2662 - RNA, 19 nt, Homo sapiens
gacaauacagaucuaauag

SEQ ID NO: 2663 - RNA, 19 nt, Homo sapiens
ucuuaagccucgaacaauu

SEQ ID NO: 2664 - RNA, 19 nt, Homo sapiens
cauugucgaugcuggguuu

SEQ ID NO: 2665 - RNA, 19 nt, Homo sapiens
caaauuggacuuggaaaca

SEQ ID NO: 2666 - RNA, 19 nt, Homo sapiens
gaucauggacauugaagca

SEQ ID NO: 2667 - RNA, 19 nt, Homo sapiens
gauuuaugcuagaaagcuu

SEQ ID NO: 2668 - RNA, 19 nt, Homo sapiens
aauaaggagugaaacaauc

SEQ ID NO: 2669 - RNA, 19 nt, Homo sapiens
acaaugaaagcacuagaaa

SEQ ID NO: 2670 - RNA, 19 nt, Homo sapiens
cgaccuaucauguaucuuc

SEQ ID NO: 2671 - RNA, 19 nt, Homo sapiens
aauauuuccuugcagagaa

SEQ ID NO: 2672 - RNA, 19 nt, Homo sapiens
ggucaaucaucuucuguac

SEQ ID NO: 2673 - RNA, 19 nt, Homo sapiens
gagcuguucccuuugagaa

SEQ ID NO: 2674 - RNA, 19 nt, Homo sapiens
ggagauucaauuauaagga

SEQ ID NO: 2675 - RNA, 19 nt, Homo sapiens
aaagaggccugugguuauc

SEQ ID NO: 2676 - RNA, 19 nt, Homo sapiens
cauugaagcauaucuugaa

SEQ ID NO: 2677 - RNA, 19 nt, Homo sapiens
cucgaacaauugaagauuu

SEQ ID NO: 2678 - RNA, 19 nt, Homo sapiens
guaucuagaccaaaucaga

SEQ ID NO: 2679 - RNA, 19 nt, Homo sapiens
guggcagccucuggaguua

SEQ ID NO: 2680 - RNA, 19 nt, Homo sapiens
cauaauuagccuacucaaa

SEQ ID NO: 2681 - RNA, 19 nt, Homo sapiens
gacgaccuaucauguaucu

SEQ ID NO: 2682 - RNA, 19 nt, Homo sapiens
cauggacauugaagcauau

SEQ ID NO: 2683 - RNA, 19 nt, Homo sapiens
cagaugggguucacuguuu

SEQ ID NO: 2684 - RNA, 19 nt, Homo sapiens
caaaucagaacccaacagu

SEQ ID NO: 2685 - RNA, 19 nt, Homo sapiens
ccuugugucuuccguuuga

SEQ ID NO: 2686 - RNA, 19 nt, Homo sapiens
ggugauuuaugcuagaaag

SEQ ID NO: 2687 - RNA, 19 nt, Homo sapiens
gaaauccuagacaucaaau

SEQ ID NO: 2688 - RNA, 19 nt, Homo sapiens
gagugaggaagaaauagaa

SEQ ID NO: 2689 - RNA, 19 nt, Homo sapiens
agaagucuaggaacaaauu

SEQ ID NO: 2690 - RNA, 19 nt, Homo sapiens
ugccauggacuuaggcuua

SEQ ID NO: 2691 - RNA, 19 nt, Homo sapiens
gacauugaagcauaucuug

SEQ ID NO: 2692 - RNA, 19 nt, Homo sapiens
uccuagacaucaaaucauu

SEQ ID NO: 2693 - RNA, 19 nt, Homo sapiens
cccauaggagauucaauua

SEQ ID NO: 2694 - RNA, 19 nt, Homo sapiens
aaucagaacccaacaguac

SEQ ID NO: 2695 - RNA, 19 nt, Homo sapiens
ggcagccucuggaguuaau

SEQ ID NO: 2696 - RNA, 19 nt, Homo sapiens
ggacuuggaaacauuaacu

SEQ ID NO: 2697 - RNA, 19 nt, Homo sapiens
cugacgaccuaucauguau

SEQ ID NO: 2698 - RNA, 19 nt, Homo sapiens
ugacggaagagaauggauu

SEQ ID NO: 2699 - RNA, 19 nt, Homo sapiens
ccaggucaaucaucuucug

SEQ ID NO: 2700 - RNA, 19 nt, Homo sapiens
agacaucuccaucaucugu

SEQ ID NO: 2701 - RNA, 19 nt, Homo sapiens
ggacgcucauaccagaugu

SEQ ID NO: 2702 - RNA, 19 nt, Homo sapiens
gauggcaccaacuacauug

SEQ ID NO: 2703 - RNA, 19 nt, Homo sapiens
caaguugugagaagaaauc

SEQ ID NO: 2704 - RNA, 19 nt, Homo sapiens
aacauaaccacaaaccuuu

SEQ ID NO: 2705 - RNA, 19 nt, Homo sapiens
aagaaauccuagacaucaa

SEQ ID NO: 2706 - RNA, 19 nt, Homo sapiens
caacuacauugucgaugcu

SEQ ID NO: 2707 - RNA, 19 nt, Homo sapiens
caaugaaagcacuagaaau

SEQ ID NO: 2708 - RNA, 19 nt, Homo sapiens
gaagucuaggaacaaauug

SEQ ID NO: 2709 - RNA, 19 nt, Homo sapiens
ggccugugguuaucuugga

SEQ ID NO: 2710 - RNA, 19 nt, Homo sapiens
uuggaaacauuaacugaca

SEQ ID NO: 2711 - RNA, 19 nt, Homo sapiens
ccuaucauguaucuucugu

SEQ ID NO: 2712 - RNA, 19 nt, Homo sapiens
aauuggacuuggaaacauu

SEQ ID NO: 2713 - RNA, 19 nt, Homo sapiens
gaauacauaccugcagaca

SEQ ID NO: 2714 - RNA, 19 nt, Homo sapiens
uaucuagaccaaaucagaa

SEQ ID NO: 2715 - RNA, 19 nt, Homo sapiens
guuaauuucugggaaggau

SEQ ID NO: 2716 - RNA, 19 nt, Homo sapiens
agaaauccuagacaucaaa

SEQ ID NO: 2717 - RNA, 19 nt, Homo sapiens
ucacccaacucacuaauua

SEQ ID NO: 2718 - RNA, 19 nt, Homo sapiens
caacuuaugugcuaucaga

SEQ ID NO: 2719 - RNA, 19 nt, Homo sapiens
ggugauggaucccuuacua

SEQ ID NO: 2720 - RNA, 19 nt, Homo sapiens
gauccgggcuguucccuuu

SEQ ID NO: 2721 - RNA, 19 nt, Homo sapiens
ggaagagguugaagaagug

SEQ ID NO: 2722 - RNA, 19 nt, Homo sapiens
gaagggagagcacuuuauu

SEQ ID NO: 2723 - RNA, 19 nt, Homo sapiens
uauaagaacucuaggaaca

SEQ ID NO: 2724 - RNA, 19 nt, Homo sapiens
gaaagaauuggcuauaaga

SEQ ID NO: 2725 - RNA, 19 nt, Homo sapiens
gaacaaauuggacuuggaa

SEQ ID NO: 2726 - RNA, 19 nt, Homo sapiens
ggagagcacuuuauuacag

SEQ ID NO: 2727 - RNA, 19 nt, Homo sapiens
gcuugaaccucgaacaauu

SEQ ID NO: 2728 - RNA, 19 nt, Homo sapiens
ggagagagcaguauauuac

SEQ ID NO: 2729 - RNA, 19 nt, Homo sapiens
guggcagccucuagaauua

SEQ ID NO: 2730 - RNA, 19 nt, Homo sapiens
aauaaacccuuguguaugu

SEQ ID NO: 2731 - RNA, 19 nt, Homo sapiens
auacagaucuggucgaguu

SEQ ID NO: 2732 - RNA, 19 nt, Homo sapiens
ucuccaacaucuucauuua

SEQ ID NO: 2733 - RNA, 19 nt, Homo sapiens
ucacuucccuugcacaguu

SEQ ID NO: 2734 - RNA, 19 nt, Homo sapiens
gcccaaaccuggugaugga

SEQ ID NO: 2735 - RNA, 19 nt, Homo sapiens
uaagaacucuaggaacaaa

SEQ ID NO: 2736 - RNA, 19 nt, Homo sapiens
gagagcacuuuauuacaga

SEQ ID NO: 2737 - RNA, 19 nt, Homo sapiens
ucaaucaacuucuguacug

SEQ ID NO: 2738 - RNA, 19 nt, Homo sapiens
ggaacaaauuggacuugga

SEQ ID NO: 2739 - RNA, 19 nt, Homo sapiens
gauggaucccuuacuauuu

SEQ ID NO: 2740 - RNA, 19 nt, Homo sapiens
ucauggacauugaagcaua

SEQ ID NO: 2741 - RNA, 19 nt, Homo sapiens
auggaucccuuacuauuua

SEQ ID NO: 2742 - RNA, 19 nt, Homo sapiens
gcagacgucuccaacaucu

SEQ ID NO: 2743 - RNA, 19 nt, Homo sapiens
ugaaagaauuggcuauaag

SEQ ID NO: 2744 - RNA, 19 nt, Homo sapiens
ccaaagggaucauggacau

SEQ ID NO: 2745 - RNA, 19 nt, Homo sapiens
ggaagcagagugauucaug

SEQ ID NO: 2746 - RNA, 19 nt, Homo sapiens
gaaacauaaggacacauuu

SEQ ID NO: 2747 - RNA, 19 nt, Homo sapiens
ggaagcuccucccagaugu

SEQ ID NO: 2748 - RNA, 19 nt, Homo sapiens
auacagcacuggcaugguu

SEQ ID NO: 2749 - RNA, 19 nt, Homo sapiens
gcuauaagaacucuaggaa

SEQ ID NO: 2750 - RNA, 19 nt, Homo sapiens
ucucuacccucacguuauu

SEQ ID NO: 2751 - RNA, 19 nt, Homo sapiens
uuacagaccuuggaagcaa

SEQ ID NO: 2752 - RNA, 19 nt, Homo sapiens
ccaacucacuaauuaucaa

SEQ ID NO: 2753 - RNA, 19 nt, Homo sapiens
cagaucuggucgaguuuaa

SEQ ID NO: 2754 - RNA, 19 nt, Homo sapiens
cagaagggguuuacuguuu

SEQ ID NO: 2755 - RNA, 19 nt, Homo sapiens
gagagcaguauauuacaaa

SEQ ID NO: 2756 - RNA, 19 nt, Homo sapiens
gaucacauuguaagaagaa

SEQ ID NO: 2757 - RNA, 19 nt, Homo sapiens
ggaaacauuaacugacauu

SEQ ID NO: 2758 - RNA, 19 nt, Homo sapiens
caaaauaaacccuugugua

SEQ ID NO: 2759 - RNA, 19 nt, Homo sapiens
aggaagagguugaagaagu

SEQ ID NO: 2760 - RNA, 19 nt, Homo sapiens
ggaagggagagcacuuuau

SEQ ID NO: 2761 - RNA, 19 nt, Homo sapiens
gugauuaucuugggaagca

SEQ ID NO: 2762 - RNA, 19 nt, Homo sapiens
gaucauggacauugaagca

SEQ ID NO: 2763 - RNA, 19 nt, Homo sapiens
caaauuggacuuggaaaca

SEQ ID NO: 2764 - RNA, 19 nt, Homo sapiens
ugaggaagagguugaagaa

SEQ ID NO: 2765 - RNA, 19 nt, Homo sapiens
gaaccucgaacaauugaag

SEQ ID NO: 2766 - RNA, 19 nt, Homo sapiens
ccaaagaagaaacaccaaa

SEQ ID NO: 2767 - RNA, 19 nt, Homo sapiens
agaauuggcuauaagaacu

SEQ ID NO: 2768 - RNA, 19 nt, Homo sapiens
uaaagacaauacagaucug

SEQ ID NO: 2769 - RNA, 19 nt, Homo sapiens
agagagcaguauauuacaa

SEQ ID NO: 2770 - RNA, 19 nt, Homo sapiens
uuacaucccuccaguuaac

SEQ ID NO: 2771 - RNA, 19 nt, Homo sapiens
uaaggauggccugugauua

SEQ ID NO: 2772 - RNA, 19 nt, Homo sapiens
ucccuccaguuaacaaaua

SEQ ID NO: 2773 - RNA, 19 nt, Homo sapiens
aaggauggccugugauuau

SEQ ID NO: 2774 - RNA, 19 nt, Homo sapiens
gcacuuuauuacagaccuu

SEQ ID NO: 2775 - RNA, 19 nt, Homo sapiens
ggacauugaagcauauuuu

SEQ ID NO: 2776 - RNA, 19 nt, Homo sapiens
cucgaacaauugaagauuu

SEQ ID NO: 2777 - RNA, 19 nt, Homo sapiens
gaacucuaggaacaaauug

SEQ ID NO: 2778 - RNA, 19 nt, Homo sapiens
cauggacauugaagcauau

SEQ ID NO: 2779 - RNA, 19 nt, Homo sapiens
gauggccugugauuaucuu

SEQ ID NO: 2780 - RNA, 19 nt, Homo sapiens
agaaacauaaggacacauu

SEQ ID NO: 2781 - RNA, 19 nt, Homo sapiens
aaagaaacauaaggacaca

SEQ ID NO: 2782 - RNA, 19 nt, Homo sapiens
ugauggaucccuuacuauu

SEQ ID NO: 2783 - RNA, 19 nt, Homo sapiens
ucucaucuccugccaaaga

SEQ ID NO: 2784 - RNA, 19 nt, Homo sapiens
guauguaucacccaacuca

SEQ ID NO: 2785 - RNA, 19 nt, Homo sapiens
ccucaggugccuugcauuu

SEQ ID NO: 2786 - RNA, 19 nt, Homo sapiens
ccauugacggcaggaauua

SEQ ID NO: 2787 - RNA, 19 nt, Homo sapiens
gguggugucuccaggucaa

SEQ ID NO: 2788 - RNA, 19 nt, Homo sapiens
ggacuuggaaacauuaacu

SEQ ID NO: 2789 - RNA, 19 nt, Homo sapiens
cagagugauucaugcuaga

SEQ ID NO: 2790 - RNA, 19 nt, Homo sapiens
ccaggucaaucaacuucug

SEQ ID NO: 2791 - RNA, 19 nt, Homo sapiens
gaagaaaauccuaaacauc

SEQ ID NO: 2792 - RNA, 19 nt, Homo sapiens
caucaaauacuuucaucca

SEQ ID NO: 2793 - RNA, 19 nt, Homo sapiens
aaagggaucauggacauug

SEQ ID NO: 2794 - RNA, 19 nt, Homo sapiens
aggagagagcaguauauua

SEQ ID NO: 2795 - RNA, 19 nt, Homo sapiens
caggagagagcaguauauu

SEQ ID NO: 2796 - RNA, 19 nt, Homo sapiens
ggcagccucuagaauuaau

SEQ ID NO: 2797 - RNA, 19 nt, Homo sapiens
aagggagagcacuuuauua

SEQ ID NO: 2798 - RNA, 19 nt, Homo sapiens
gaauuacauugucgaugcu

SEQ ID NO: 2799 - RNA, 19 nt, Homo sapiens
cggcaggaauuacauuguc

SEQ ID NO: 2800 - RNA, 19 nt, Homo sapiens
uugagaaccuuaacaugca

SEQ ID NO: 2801 - RNA, 19 nt, Homo sapiens
aauuggacuuggaaacauu

SEQ ID NO: 2802 - RNA, 19 nt, Homo sapiens
aaauaaacccuuguguaug

SEQ ID NO: 2803 - RNA, 19 nt, Homo sapiens
ucacugaggaagagguuga

SEQ ID NO: 2804 - RNA, 19 nt, Homo sapiens
cugcagacgucuccaacau

SEQ ID NO: 2805 - RNA, 19 nt, Homo sapiens
caaagaagaaacaccaaaa

SEQ ID NO: 2806 - RNA, 19 nt, Homo sapiens
gagagagcaguauauuaca

SEQ ID NO: 2807 - RNA, 19 nt, Homo sapiens
uuggaaacauuaacugaca

SEQ ID NO: 2808 - RNA, 19 nt, Homo sapiens
ccauggaguugggcuuaga

SEQ ID NO: 2809 - RNA, 19 nt, Homo sapiens
gggcuguucccuuugagaa

SEQ ID NO: 2810 - RNA, 19 nt, Homo sapiens
uuaaggauggccugugauu

SEQ ID NO: 2811 - RNA, 19 nt, Homo sapiens
uguggcagccucuagaauu

SEQ ID NO: 2812 - RNA, 19 nt, Homo sapiens
gauguggcagccucuagaa

SEQ ID NO: 2813 - RNA, 19 nt, Homo sapiens
auucucaucuccugccaaa

SEQ ID NO: 2814 - RNA, 19 nt, Homo sapiens
aaauuggacuuggaaacau

SEQ ID NO: 2815 - RNA, 19 nt, Homo sapiens
gaaaucucgugcccaaacc

SEQ ID NO: 2816 - RNA, 19 nt, Homo sapiens
gggagagcacuuuauuaca

SEQ ID NO: 2817 - RNA, 19 nt, Homo sapiens
ggucgugucugauguauuu

SEQ ID NO: 2818 - RNA, 19 nt, Homo sapiens
cuaagaagcucaucaacga

SEQ ID NO: 2819 - RNA, 19 nt, Homo sapiens
gaaaugccauguuugucaa

SEQ ID NO: 2820 - RNA, 19 nt, Homo sapiens
gagaauggagagaauguua

SEQ ID NO: 2821 - RNA, 19 nt, Homo sapiens
ggaaaugccauguuuguca

SEQ ID NO: 2822 - RNA, 19 nt, Homo sapiens
caaggaccauugugcguuu

SEQ ID NO: 2823 - RNA, 19 nt, Homo sapiens
ugaugguccuggugaauua

SEQ ID NO: 2824 - RNA, 19 nt, Homo sapiens
gagcagaguugagaaugga

SEQ ID NO: 2825 - RNA, 19 nt, Homo sapiens
ccaagauacucaucaguca

SEQ ID NO: 2826 - RNA, 19 nt, Homo sapiens
guaaggaacuuggaaugca

SEQ ID NO: 2827 - RNA, 19 nt, Homo sapiens
acacguggaccucggauua

SEQ ID NO: 2828 - RNA, 19 nt, Homo sapiens
aaugggagaugcccuuuga

SEQ ID NO: 2829 - RNA, 19 nt, Homo sapiens
uaaggaacuuggaaugcaa

SEQ ID NO: 2830 - RNA, 19 nt, Homo sapiens
uccauaaggucgugucuga

SEQ ID NO: 2831 - RNA, 19 nt, Homo sapiens
guguggcccugucugcuua

SEQ ID NO: 2832 - RNA, 19 nt, Homo sapiens
caagauggaggaaguggaa

SEQ ID NO: 2833 - RNA, 19 nt, Homo sapiens
ggagcagaguugagaaugg

SEQ ID NO: 2834 - RNA, 19 nt, Homo sapiens
aggcagaaauucacucaga

SEQ ID NO: 2835 - RNA, 19 nt, Homo sapiens
caacguggacuucgcuuuc

SEQ ID NO: 2836 - RNA, 19 nt, Homo sapiens
cacccuccuuucugcauua

SEQ ID NO: 2837 - RNA, 19 nt, Homo sapiens
ucucccaggugguccauaa

SEQ ID NO: 2838 - RNA, 19 nt, Homo sapiens
gaugaucauugucccuaca

SEQ ID NO: 2839 - RNA, 19 nt, Homo sapiens
ucaaagagcaacucagucu

SEQ ID NO: 2840 - RNA, 19 nt, Homo sapiens
cauaaggucgugucugaug

SEQ ID NO: 2841 - RNA, 19 nt, Homo sapiens
caucuucuuuaaagccaaa

SEQ ID NO: 2842 - RNA, 19 nt, Homo sapiens
caaugaugguccuggugaa

SEQ ID NO: 2843 - RNA, 19 nt, Homo sapiens
gagacuuacugaggcagaa

SEQ ID NO: 2844 - RNA, 19 nt, Homo sapiens
ucagucugcuggacagguu

SEQ ID NO: 2845 - RNA, 19 nt, Homo sapiens
uaaggucgugucugaugua

SEQ ID NO: 2846 - RNA, 19 nt, Homo sapiens
acuauaaccugaacgacau

SEQ ID NO: 2847 - RNA, 19 nt, Homo sapiens
aagacaagauggaggaagu

SEQ ID NO: 2848 - RNA, 19 nt, Homo sapiens
ggugaauuacaucuucuuu

SEQ ID NO: 2849 - RNA, 19 nt, Homo sapiens
caucaacgacuacgugaag

SEQ ID NO: 2850 - RNA, 19 nt, Homo sapiens
cuacagacacccagaacau

SEQ ID NO: 2851 - RNA, 19 nt, Homo sapiens
uaaccugaacgacauacuu

SEQ ID NO: 2852 - RNA, 19 nt, Homo sapiens
ccuggugaauuacaucuuc

SEQ ID NO: 2853 - RNA, 19 nt, Homo sapiens
ggccuuugccacugacuuu

SEQ ID NO: 2854 - RNA, 19 nt, Homo sapiens
uuacugaggcagaaauuca

SEQ ID NO: 2855 - RNA, 19 nt, Homo sapiens
gcaguggggcucucaguaa

SEQ ID NO: 2856 - RNA, 19 nt, Homo sapiens
ccaucucgagggacuauaa

SEQ ID NO: 2857 - RNA, 19 nt, Homo sapiens
gcucuaccugccaaaguuu

SEQ ID NO: 2858 - RNA, 19 nt, Homo sapiens
caacgacuacgugaagaau

SEQ ID NO: 2859 - RNA, 19 nt, Homo sapiens
acaagcaguuaguccugaa

SEQ ID NO: 2860 - RNA, 19 nt, Homo sapiens
cuccugacagcaauaaaua

SEQ ID NO: 2861 - RNA, 19 nt, Homo sapiens
caagauacucaucagucaa

SEQ ID NO: 2862 - RNA, 19 nt, Homo sapiens
caaaugggagaugcccuuu

SEQ ID NO: 2863 - RNA, 19 nt, Homo sapiens
ggaccauugugcguuucaa

SEQ ID NO: 2864 - RNA, 19 nt, Homo sapiens
guggagacaaggaccauug

SEQ ID NO: 2865 - RNA, 19 nt, Homo sapiens
ucacccuccuuucugcauu

SEQ ID NO: 2866 - RNA, 19 nt, Homo sapiens
ggagggcacagaagcaucu

SEQ ID NO: 2867 - RNA, 19 nt, Homo sapiens
agaagcucaucaacgacua

SEQ ID NO: 2868 - RNA, 19 nt, Homo sapiens
ccgaggccuuugccacuga

SEQ ID NO: 2869 - RNA, 19 nt, Homo sapiens
ccuccuuucugcauuagug

SEQ ID NO: 2870 - RNA, 19 nt, Homo sapiens
cauccucccugaucaagac

SEQ ID NO: 2871 - RNA, 19 nt, Homo sapiens
gagggacuauaaccugaac

SEQ ID NO: 2872 - RNA, 19 nt, Homo sapiens
ucaccugacuauaccuuac

SEQ ID NO: 2873 - RNA, 19 nt, Homo sapiens
gcagcugaguaugggaaau

SEQ ID NO: 2874 - RNA, 19 nt, Homo sapiens
ccugacagcaauaaauaau

SEQ ID NO: 2875 - RNA, 19 nt, Homo sapiens
caaaaucacccuccuuucu

SEQ ID NO: 2876 - RNA, 19 nt, Homo sapiens
gagcucuaccugccaaagu

SEQ ID NO: 2877 - RNA, 19 nt, Homo sapiens
gcaaugccagcgcacucuu

SEQ ID NO: 2878 - RNA, 19 nt, Homo sapiens
gaguuugcaucaccugacu

SEQ ID NO: 2879 - RNA, 19 nt, Homo sapiens
gaguugagaauggagagaa

SEQ ID NO: 2880 - RNA, 19 nt, Homo sapiens
ucacggaggaugccaagag

SEQ ID NO: 2881 - RNA, 19 nt, Homo sapiens
ugucaaagagcaacucagu

SEQ ID NO: 2882 - RNA, 19 nt, Homo sapiens
auaccacccugacagagau

SEQ ID NO: 2883 - RNA, 19 nt, Homo sapiens
ugagcaaagucaccaaucc

SEQ ID NO: 2884 - RNA, 19 nt, Homo sapiens
acgacuacgugaagaaugg

SEQ ID NO: 2885 - RNA, 19 nt, Homo sapiens
ucaacgacuacgugaagaa

SEQ ID NO: 2886 - RNA, 19 nt, Homo sapiens
auacucaucagucaagguu

SEQ ID NO: 2887 - RNA, 19 nt, Homo sapiens
gggaaaaucacagaucuga

SEQ ID NO: 2888 - RNA, 19 nt, Homo sapiens
guauggcuccgaggccuuu

SEQ ID NO: 2889 - RNA, 19 nt, Homo sapiens
ugggaaaugccauguuugu

SEQ ID NO: 2890 - RNA, 19 nt, Homo sapiens
caguaaggaacuuggaaug

SEQ ID NO: 2891 - RNA, 19 nt, Homo sapiens
cacccuaacagcccacuug

SEQ ID NO: 2892 - RNA, 19 nt, Homo sapiens
auaaggucgugucugaugu

SEQ ID NO: 2893 - RNA, 19 nt, Homo sapiens
cagcugaguaugggaaaug

SEQ ID NO: 2894 - RNA, 19 nt, Homo sapiens
caagucaucucuucaaauu

SEQ ID NO: 2895 - RNA, 19 nt, Homo sapiens
gagaaagucugaagcacua

SEQ ID NO: 2896 - RNA, 19 nt, Homo sapiens
gaauaaaugugagcaaaga

SEQ ID NO: 2897 - RNA, 19 nt, Homo sapiens
gagaauaaaugugagcaaa

SEQ ID NO: 2898 - RNA, 19 nt, Homo sapiens
ggaaucaagucaucucuuc

SEQ ID NO: 2899 - RNA, 19 nt, Homo sapiens
gauaaacgcacaucugaaa

SEQ ID NO: 2900 - RNA, 19 nt, Homo sapiens
gaggagccauggagaauga

SEQ ID NO: 2901 - RNA, 19 nt, Homo sapiens
caacaaauuacguggcuua

SEQ ID NO: 2902 - RNA, 19 nt, Homo sapiens
ggagaaugauguggauaaa

SEQ ID NO: 2903 - RNA, 19 nt, Homo sapiens
gggaagugcugcucuaagu

SEQ ID NO: 2904 - RNA, 19 nt, Homo sapiens
gaaaaucgcuguaccuucu

SEQ ID NO: 2905 - RNA, 19 nt, Homo sapiens
ccaccaaccucagaugaaa

SEQ ID NO: 2906 - RNA, 19 nt, Homo sapiens
agaauggucuaguuaaguu

SEQ ID NO: 2907 - RNA, 19 nt, Homo sapiens
ggguucaggugacucauaa

SEQ ID NO: 2908 - RNA, 19 nt, Homo sapiens
ggcauaucauguagguuua

SEQ ID NO: 2909 - RNA, 19 nt, Homo sapiens
uaguuaaguuccacaugua

SEQ ID NO: 2910 - RNA, 19 nt, Homo sapiens
cuaguuaaguuccacaugu

SEQ ID NO: 2911 - RNA, 19 nt, Homo sapiens
gugaguuggcuacuauuua

SEQ ID NO: 2912 - RNA, 19 nt, Homo sapiens
gucacagacuuauaaauca

SEQ ID NO: 2913 - RNA, 19 nt, Homo sapiens
caaauuauggcaguucuga

SEQ ID NO: 2914 - RNA, 19 nt, Homo sapiens
gugcugcucuaagugguua

SEQ ID NO: 2915 - RNA, 19 nt, Homo sapiens
auacgccucucccagauaa

SEQ ID NO: 2916 - RNA, 19 nt, Homo sapiens
ggauccucauagcauauua

SEQ ID NO: 2917 - RNA, 19 nt, Homo sapiens
ugaguuggcuacuauuuac

SEQ ID NO: 2918 - RNA, 19 nt, Homo sapiens
ucauguagguuuacuuucu

SEQ ID NO: 2919 - RNA, 19 nt, Homo sapiens
uacauugucuaucugcuuu

SEQ ID NO: 2920 - RNA, 19 nt, Homo sapiens
ugucaucaccugucaauau

SEQ ID NO: 2921 - RNA, 19 nt, Homo sapiens
gucaucaccugucaauaug

SEQ ID NO: 2922 - RNA, 19 nt, Homo sapiens
ccaagaagcgggacguuca

SEQ ID NO: 2923 - RNA, 19 nt, Homo sapiens
uaaaugugagcaaagauug

SEQ ID NO: 2924 - RNA, 19 nt, Homo sapiens
ggguauaugugccaaagag

SEQ ID NO: 2925 - RNA, 19 nt, Homo sapiens
cugucaauaugaucucuua

SEQ ID NO: 2926 - RNA, 19 nt, Homo sapiens
ucaaccaacuacagauuag

SEQ ID NO: 2927 - RNA, 19 nt, Homo sapiens
gccucuugauguagauuua

SEQ ID NO: 2928 - RNA, 19 nt, Homo sapiens
uauuuacgaugcaagagaa

SEQ ID NO: 2929 - RNA, 19 nt, Homo sapiens
gcaguucugagcuggcuaa

SEQ ID NO: 2930 - RNA, 19 nt, Homo sapiens
acauguaccuguggaauca

SEQ ID NO: 2931 - RNA, 19 nt, Homo sapiens
agaaugauguggauaaacg

SEQ ID NO: 2932 - RNA, 19 nt, Homo sapiens
aggcauaucauguagguuu

SEQ ID NO: 2933 - RNA, 19 nt, Homo sapiens
gauuuaccgucauaucaag

SEQ ID NO: 2934 - RNA, 19 nt, Homo sapiens
uaauuuauccugcccuuca

SEQ ID NO: 2935 - RNA, 19 nt, Homo sapiens
ggauaaacgcacaucugaa

SEQ ID NO: 2936 - RNA, 19 nt, Homo sapiens
ucaggugacucauaaccau

SEQ ID NO: 2937 - RNA, 19 nt, Homo sapiens
gauggacucauguauguca

SEQ ID NO: 2938 - RNA, 19 nt, Homo sapiens
uauccaggguuccuagaug

SEQ ID NO: 2939 - RNA, 19 nt, Homo sapiens
gugaauauuuuaccacuga

SEQ ID NO: 2940 - RNA, 19 nt, Homo sapiens
gcaccuaaguaucauuucc

SEQ ID NO: 2941 - RNA, 19 nt, Homo sapiens
ccaaagagaaagucugaag

SEQ ID NO: 2942 - RNA, 19 nt, Homo sapiens
guauaugugccaaagagaa

SEQ ID NO: 2943 - RNA, 19 nt, Homo sapiens
ugcaagagaauaaauguga

SEQ ID NO: 2944 - RNA, 19 nt, Homo sapiens
gaugcaagagaauaaaugu

SEQ ID NO: 2945 - RNA, 19 nt, Homo sapiens
uuacgaugcaagagaauaa

SEQ ID NO: 2946 - RNA, 19 nt, Homo sapiens
ccugagagaaucgguauuu

SEQ ID NO: 2947 - RNA, 19 nt, Homo sapiens
cuaaguaucauuucccaau

SEQ ID NO: 2948 - RNA, 19 nt, Homo sapiens
aauaggcacuuuucuguuu

SEQ ID NO: 2949 - RNA, 19 nt, Homo sapiens
uggauaaacgcacaucuga

SEQ ID NO: 2950 - RNA, 19 nt, Homo sapiens
uauauugaguggcuaaagg

SEQ ID NO: 2951 - RNA, 19 nt, Homo sapiens
ucauaaccauguugaggau

SEQ ID NO: 2952 - RNA, 19 nt, Homo sapiens
ggacagcagacagacuuga

SEQ ID NO: 2953 - RNA, 19 nt, Homo sapiens
ucaggcauaucauguaggu

SEQ ID NO: 2954 - RNA, 19 nt, Homo sapiens
uaucaaccaacuacagauu

SEQ ID NO: 2955 - RNA, 19 nt, Homo sapiens
uauaugugccaaagagaaa

SEQ ID NO: 2956 - RNA, 19 nt, Homo sapiens
ucacagacuuauaaaucag

SEQ ID NO: 2957 - RNA, 19 nt, Homo sapiens
uagauuuaccgucauauca

SEQ ID NO: 2958 - RNA, 19 nt, Homo sapiens
uggagaaugauguggauaa

SEQ ID NO: 2959 - RNA, 19 nt, Homo sapiens
guacacuauucaggcauau

SEQ ID NO: 2960 - RNA, 19 nt, Homo sapiens
ucggagauuuuccuucuua

SEQ ID NO: 2961 - RNA, 19 nt, Homo sapiens
caacauguaccuguggaau

SEQ ID NO: 2962 - RNA, 19 nt, Homo sapiens
ggaagugcugcucuaagug

SEQ ID NO: 2963 - RNA, 19 nt, Homo sapiens
uagguuuacuuucuguguu

SEQ ID NO: 2964 - RNA, 19 nt, Homo sapiens
aguacacuauucaggcaua

SEQ ID NO: 2965 - RNA, 19 nt, Homo sapiens
aaagagaaagucugaagca

SEQ ID NO: 2966 - RNA, 19 nt, Homo sapiens
gagacaaaauucaacaaca

SEQ ID NO: 2967 - RNA, 19 nt, Homo sapiens
uuugugaguuggcuacuau

SEQ ID NO: 2968 - RNA, 19 nt, Homo sapiens
uggcugaugacaacaaauu

SEQ ID NO: 2969 - RNA, 19 nt, Homo sapiens
ccuucagccucuugaugua

SEQ ID NO: 2970 - RNA, 19 nt, Homo sapiens
ggugugaacccugagagaa

SEQ ID NO: 2971 - RNA, 19 nt, Homo sapiens
uagcaccuaaguaucauuu

SEQ ID NO: 2972 - RNA, 19 nt, Homo sapiens
cgugggaagugcugcucua

SEQ ID NO: 2973 - RNA, 19 nt, Homo sapiens
cauggagaaugauguggau

SEQ ID NO: 2974 - RNA, 19 nt, Homo sapiens
acugugggauuucauuuca

SEQ ID NO: 2975 - RNA, 19 nt, Homo sapiens
ccacauguagcauaauucu

SEQ ID NO: 2976 - RNA, 19 nt, Homo sapiens
cauguagguuuacuuucug

SEQ ID NO: 2977 - RNA, 19 nt, Homo sapiens
gaaucaagucaucucuuca

SEQ ID NO: 2978 - RNA, 19 nt, Homo sapiens
gucaagaucaaacucaaga

SEQ ID NO: 2979 - RNA, 19 nt, Homo sapiens
gaugucaagaucaaacuca

SEQ ID NO: 2980 - RNA, 19 nt, Homo sapiens
agguuuacuuucuguguuu

SEQ ID NO: 2981 - RNA, 19 nt, Homo sapiens
ugugggauuucauuucaau

SEQ ID NO: 2982 - RNA, 19 nt, Homo sapiens
uuccacauguagcauaauu

SEQ ID NO: 2983 - RNA, 19 nt, Homo sapiens
uuucauuucugggacuuaa

SEQ ID NO: 2984 - RNA, 19 nt, Homo sapiens
ccauggagcauuuucauuu

SEQ ID NO: 2985 - RNA, 19 nt, Homo sapiens
ggcugaugacaacaaauua

SEQ ID NO: 2986 - RNA, 19 nt, Homo sapiens
ccugagagguuuauaaaag

SEQ ID NO: 2987 - RNA, 19 nt, Homo sapiens
acccagaugucaagaucaa

SEQ ID NO: 2988 - RNA, 19 nt, Homo sapiens
aaguaucauuucccaauuc

SEQ ID NO: 2989 - RNA, 19 nt, Homo sapiens
gaagcgggacguucaccau

SEQ ID NO: 2990 - RNA, 19 nt, Homo sapiens
ugacucauaaccauguuga

SEQ ID NO: 2991 - RNA, 19 nt, Homo sapiens
guagauuuaccgucauauc

SEQ ID NO: 2992 - RNA, 19 nt, Homo sapiens
gcuccuugaugacccagau

SEQ ID NO: 2993 - RNA, 19 nt, Homo sapiens
cgcuguaccuucugauugu

SEQ ID NO: 2994 - RNA, 19 nt, Homo sapiens
ccacaaagcgaaaguauuu

SEQ ID NO: 2995 - RNA, 19 nt, Homo sapiens
gauggcagcuugauccuaa

SEQ ID NO: 2996 - RNA, 19 nt, Homo sapiens
ggacaugaguggccucuug

SEQ ID NO: 2997 - RNA, 19 nt, Homo sapiens
ccaaaggccugaccguuaa

SEQ ID NO: 2998 - RNA, 19 nt, Homo sapiens
gcacucagcaucuguguuu

SEQ ID NO: 2999 - RNA, 19 nt, Homo sapiens
gaagagggcuggguucuag

SEQ ID NO: 3000 - RNA, 19 nt, Homo sapiens
gauggaagauguggacuuu

SEQ ID NO: 3001 - RNA, 19 nt, Homo sapiens
gggaagcccuauccaugua

SEQ ID NO: 3002 - RNA, 19 nt, Homo sapiens
ugacaaagccuucguaugg

SEQ ID NO: 3003 - RNA, 19 nt, Homo sapiens
gcacugccgugguauauac

SEQ ID NO: 3004 - RNA, 19 nt, Homo sapiens
gaggaagagauacuaguua

SEQ ID NO: 3005 - RNA, 19 nt, Homo sapiens
gaagagauacuaguuaaag

SEQ ID NO: 3006 - RNA, 19 nt, Homo sapiens
uggaagauguggacuuuga

SEQ ID NO: 3007 - RNA, 19 nt, Homo sapiens
aggaagagauacuaguuaa

SEQ ID NO: 3008 - RNA, 19 nt, Homo sapiens
ggaggaagagauacuaguu

SEQ ID NO: 3009 - RNA, 19 nt, Homo sapiens
gaaaguauuuuguguccaa

SEQ ID NO: 3010 - RNA, 19 nt, Homo sapiens
ggaccuuggccaucuauga

SEQ ID NO: 3011 - RNA, 19 nt, Homo sapiens
uaaagacucugugacuugu

SEQ ID NO: 3012 - RNA, 19 nt, Homo sapiens
cauaaagacucugugacuu

SEQ ID NO: 3013 - RNA, 19 nt, Homo sapiens
ggaggaagagggcaacgaa

SEQ ID NO: 3014 - RNA, 19 nt, Homo sapiens
ggaagagauacuaguuaaa

SEQ ID NO: 3015 - RNA, 19 nt, Homo sapiens
ugaguggccucuugaaagu

SEQ ID NO: 3016 - RNA, 19 nt, Homo sapiens
uccaaaggccugaccguua

SEQ ID NO: 3017 - RNA, 19 nt, Homo sapiens
gagcugugguaggcuauga

SEQ ID NO: 3018 - RNA, 19 nt, Homo sapiens
cggcugagauccuggacuu

SEQ ID NO: 3019 - RNA, 19 nt, Homo sapiens
ccauggugaugaagagauu

SEQ ID NO: 3020 - RNA, 19 nt, Homo sapiens
gaaaggaggaagagauacu

SEQ ID NO: 3021 - RNA, 19 nt, Homo sapiens
uguggcagguggacacuaa

SEQ ID NO: 3022 - RNA, 19 nt, Homo sapiens
uggaaaggaggaagagaua

SEQ ID NO: 3023 - RNA, 19 nt, Homo sapiens
cccaggagauggaagaugu

SEQ ID NO: 3024 - RNA, 19 nt, Homo sapiens
cgggagaccuggaguggau

SEQ ID NO: 3025 - RNA, 19 nt, Homo sapiens
ggguggaccuguuucucuu

SEQ ID NO: 3026 - RNA, 19 nt, Homo sapiens
gaccacaaagcgaaaguau

SEQ ID NO: 3027 - RNA, 19 nt, Homo sapiens
gcugagauccuggacuuug

SEQ ID NO: 3028 - RNA, 19 nt, Homo sapiens
aagcuuccauggugaugaa

SEQ ID NO: 3029 - RNA, 19 nt, Homo sapiens
ggaguagguguuugagguu

SEQ ID NO: 3030 - RNA, 19 nt, Homo sapiens
ggaagaagaggaggaagag

SEQ ID NO: 3031 - RNA, 19 nt, Homo sapiens
auaaagacucugugacuug

SEQ ID NO: 3032 - RNA, 19 nt, Homo sapiens
ggaagagggcaacgaagag

SEQ ID NO: 3033 - RNA, 19 nt, Homo sapiens
gaugacaaagccuucguau

SEQ ID NO: 3034 - RNA, 19 nt, Homo sapiens
gggaggagagugaguccaa

SEQ ID NO: 3035 - RNA, 19 nt, Homo sapiens
ggaggucugguccuuugaa

SEQ ID NO: 3036 - RNA, 19 nt, Homo sapiens
gcauugcacucagcaucug

SEQ ID NO: 3037 - RNA, 19 nt, Homo sapiens
ucgggcaccuguccuguug

SEQ ID NO: 3038 - RNA, 19 nt, Homo sapiens
gacaugaguggccucuuga

SEQ ID NO: 3039 - RNA, 19 nt, Homo sapiens
ggccauaaagacucuguga

SEQ ID NO: 3040 - RNA, 19 nt, Homo sapiens
caugaguggccucuugaaa

SEQ ID NO: 3041 - RNA, 19 nt, Homo sapiens
ggacuuugaggaagaagag

SEQ ID NO: 3042 - RNA, 19 nt, Homo sapiens
gugguaggcuaugaagaug

SEQ ID NO: 3043 - RNA, 19 nt, Homo sapiens
ccauaaagacucugugacu

SEQ ID NO: 3044 - RNA, 19 nt, Homo sapiens
gauuaucgaggugguagaa

SEQ ID NO: 3045 - RNA, 19 nt, Homo sapiens
cgaagagggcuggguucua

SEQ ID NO: 3046 - RNA, 19 nt, Homo sapiens
cccuauccauguacugaaa

SEQ ID NO: 3047 - RNA, 19 nt, Homo sapiens
agccaugacuccacucuag

SEQ ID NO: 3048 - RNA, 19 nt, Homo sapiens
gcaaggugguggguguuuu

SEQ ID NO: 3049 - RNA, 19 nt, Homo sapiens
uguggaaagucccgaaugg

SEQ ID NO: 3050 - RNA, 19 nt, Homo sapiens
gaggucugguccuuugaag

SEQ ID NO: 3051 - RNA, 19 nt, Homo sapiens
ugagugugcaggccauaaa

SEQ ID NO: 3052 - RNA, 19 nt, Homo sapiens
aaaggaggaagagauacua

SEQ ID NO: 3053 - RNA, 19 nt, Homo sapiens
guggaccuguuucucuuuc

SEQ ID NO: 3054 - RNA, 19 nt, Homo sapiens
gaagcccuauccauguacu

SEQ ID NO: 3055 - RNA, 19 nt, Homo sapiens
acaccuggauguggaaagu

SEQ ID NO: 3056 - RNA, 19 nt, Homo sapiens
gcaucuguguuuuguguga

SEQ ID NO: 3057 - RNA, 19 nt, Homo sapiens
cagcaucuguguuuugugu

SEQ ID NO: 3058 - RNA, 19 nt, Homo sapiens
guggaaaggaggaagagau

SEQ ID NO: 3059 - RNA, 19 nt, Homo sapiens
aggaagagggcaacgaaga

SEQ ID NO: 3060 - RNA, 19 nt, Homo sapiens
ggauuugggaccugaagca

SEQ ID NO: 3061 - RNA, 19 nt, Homo sapiens
gcaacaccuggauguggaa

SEQ ID NO: 3062 - RNA, 19 nt, Homo sapiens
gguggaccuguuucucuuu

SEQ ID NO: 3063 - RNA, 19 nt, Homo sapiens
gagaaggggaggagaguga

SEQ ID NO: 3064 - RNA, 19 nt, Homo sapiens
ugugguaggcuaugaagau

SEQ ID NO: 3065 - RNA, 19 nt, Homo sapiens
caugggguguguauuugua

SEQ ID NO: 3066 - RNA, 19 nt, Homo sapiens
ggaccuguuucucuuucac

SEQ ID NO: 3067 - RNA, 19 nt, Homo sapiens
gccgccugcuuacugacua

SEQ ID NO: 3068 - RNA, 19 nt, Homo sapiens
cgcagacucuuaggcauca

SEQ ID NO: 3069 - RNA, 19 nt, Homo sapiens
gagcagggcuaaauaaaga

SEQ ID NO: 3070 - RNA, 19 nt, Homo sapiens
ggagagagcagggcuaaau

SEQ ID NO: 3071 - RNA, 19 nt, Homo sapiens
gagagagcagggcuaaaua

SEQ ID NO: 3072 - RNA, 19 nt, Homo sapiens
gggaacaucugcuacuaca

SEQ ID NO: 3073 - RNA, 19 nt, Homo sapiens
gagagcagggcuaaauaaa

SEQ ID NO: 3074 - RNA, 19 nt, Homo sapiens
agacagcaguuuccagaga

SEQ ID NO: 3075 - RNA, 19 nt, Homo sapiens
ccacauagcccaccugcau

SEQ ID NO: 3076 - RNA, 19 nt, Homo sapiens
ggaggacacuuccaaagcu

SEQ ID NO: 3077 - RNA, 19 nt, Homo sapiens
gagcauagagacagcaguu

SEQ ID NO: 3078 - RNA, 19 nt, Homo sapiens
ggacaaggagagacucaug

SEQ ID NO: 3079 - RNA, 19 nt, Homo sapiens
gcauagagacagcaguuuc

SEQ ID NO: 3080 - RNA, 19 nt, Homo sapiens
agagagcagggcuaaauaa

SEQ ID NO: 3081 - RNA, 19 nt, Homo sapiens
gcuaaauaaagaggagaua

SEQ ID NO: 3082 - RNA, 19 nt, Homo sapiens
cugguacccuucuaugaga

SEQ ID NO: 3083 - RNA, 19 nt, Homo sapiens
gcaccaguggccagaaugu

SEQ ID NO: 3084 - RNA, 19 nt, Homo sapiens
ugucagcgccuuugagauc

SEQ ID NO: 3085 - RNA, 19 nt, Homo sapiens
gcugguacccuucuaugag

SEQ ID NO: 3086 - RNA, 19 nt, Homo sapiens
gcacuuccugacccuaugu

SEQ ID NO: 3087 - RNA, 19 nt, Homo sapiens
guggagagagcagggcuaa

SEQ ID NO: 3088 - RNA, 19 nt, Homo sapiens
ggagggaacacuggguauc

SEQ ID NO: 3089 - RNA, 19 nt, Homo sapiens
gcgcugguacccuucuaug

SEQ ID NO: 3090 - RNA, 19 nt, Homo sapiens
gcagagagcuugaagaaau

SEQ ID NO: 3091 - RNA, 19 nt, Homo sapiens
gaucaggucuggcuguuua

SEQ ID NO: 3092 - RNA, 19 nt, Homo sapiens
caagaaggcugaagagauu

SEQ ID NO: 3093 - RNA, 19 nt, Homo sapiens
agaauaagauguccaacua

SEQ ID NO: 3094 - RNA, 19 nt, Homo sapiens
ggagaucgcugaccuugga

SEQ ID NO: 3095 - RNA, 19 nt, Homo sapiens
ggacaagaccuguuucuau

SEQ ID NO: 3096 - RNA, 19 nt, Homo sapiens
gacaagaccuguuucuaug

SEQ ID NO: 3097 - RNA, 19 nt, Homo sapiens
cugaagagauugcuaauga

SEQ ID NO: 3098 - RNA, 19 nt, Homo sapiens
ucauuaugcuggacauuua

SEQ ID NO: 3099 - RNA, 19 nt, Homo sapiens
aaacagaucuggcaaaauu

SEQ ID NO: 3100 - RNA, 19 nt, Homo sapiens
caaagccgauguccagaaa

SEQ ID NO: 3101 - RNA, 19 nt, Homo sapiens
ugacagcagugaagauaaa

SEQ ID NO: 3102 - RNA, 19 nt, Homo sapiens
ggagauuacuuuaaggaau

SEQ ID NO: 3103 - RNA, 19 nt, Homo sapiens
gaacacaauugacccaucu

SEQ ID NO: 3104 - RNA, 19 nt, Homo sapiens
gaagaaggacccagacaug

SEQ ID NO: 3105 - RNA, 19 nt, Homo sapiens
gaaaguuggugcugaggau

SEQ ID NO: 3106 - RNA, 19 nt, Homo sapiens
ggaauuggcauguaagaug

SEQ ID NO: 3107 - RNA, 19 nt, Homo sapiens
cagggaagcugauggcauu

SEQ ID NO: 3108 - RNA, 19 nt, Homo sapiens
cggcagcgauuuauagauu

SEQ ID NO: 3109 - RNA, 19 nt, Homo sapiens
aagauggacucuacucuaa

SEQ ID NO: 3110 - RNA, 19 nt, Homo sapiens
ccacacagcuacgcacauu

SEQ ID NO: 3111 - RNA, 19 nt, Homo sapiens
gaagacccaucaugagcaa

SEQ ID NO: 3112 - RNA, 19 nt, Homo sapiens
agacauggauggcuuugaa

SEQ ID NO: 3113 - RNA, 19 nt, Homo sapiens
caucuacggugaccugaaa

SEQ ID NO: 3114 - RNA, 19 nt, Homo sapiens
gggcuucuuugcuacguua

SEQ ID NO: 3115 - RNA, 19 nt, Homo sapiens
uuaaggaauuggcauguaa

SEQ ID NO: 3116 - RNA, 19 nt, Homo sapiens
cgacgaagacccaucauga

SEQ ID NO: 3117 - RNA, 19 nt, Homo sapiens
gaagagauugcuaaugaga

SEQ ID NO: 3118 - RNA, 19 nt, Homo sapiens
ggaucugacuggacugauu

SEQ ID NO: 3119 - RNA, 19 nt, Homo sapiens
gaugacagcagugaagaua

SEQ ID NO: 3120 - RNA, 19 nt, Homo sapiens
aagcagaucuggaaugcaa

SEQ ID NO: 3121 - RNA, 19 nt, Homo sapiens
cugcuuggcuccucuauga

SEQ ID NO: 3122 - RNA, 19 nt, Homo sapiens
gcaaggaggccagaucuau

SEQ ID NO: 3123 - RNA, 19 nt, Homo sapiens
caaugaggcuggcaagauc

SEQ ID NO: 3124 - RNA, 19 nt, Homo sapiens
ccagaaaggcucauugguu

SEQ ID NO: 3125 - RNA, 19 nt, Homo sapiens
gggaagaccucauuaugcu

SEQ ID NO: 3126 - RNA, 19 nt, Homo sapiens
gaaccaguuuaaacccauu

SEQ ID NO: 3127 - RNA, 19 nt, Homo sapiens
caaccagccucuugucauc

SEQ ID NO: 3128 - RNA, 19 nt, Homo sapiens
ggacuccagugguagcuau

SEQ ID NO: 3129 - RNA, 19 nt, Homo sapiens
gauggacucuacucuaaca

SEQ ID NO: 3130 - RNA, 19 nt, Homo sapiens
caggcaacaugaaggauaa

SEQ ID NO: 3131 - RNA, 19 nt, Homo sapiens
ucaaaucccuaaagaaggu

SEQ ID NO: 3132 - RNA, 19 nt, Homo sapiens
caagauggacucuacucua

SEQ ID NO: 3133 - RNA, 19 nt, Homo sapiens
gaggugcaguuucucaaga

SEQ ID NO: 3134 - RNA, 19 nt, Homo sapiens
caacacagggcguggauau

SEQ ID NO: 3135 - RNA, 19 nt, Homo sapiens
gcaaacagaucuggcaaaa

SEQ ID NO: 3136 - RNA, 19 nt, Homo sapiens
aauaagauguccaacuaug

SEQ ID NO: 3137 - RNA, 19 nt, Homo sapiens
ccagaaggcccucaggaaa

SEQ ID NO: 3138 - RNA, 19 nt, Homo sapiens
guagcuauguauuugagaa

SEQ ID NO: 3139 - RNA, 19 nt, Homo sapiens
ggacauuuacgcuaucgaa

SEQ ID NO: 3140 - RNA, 19 nt, Homo sapiens
gggcaaggaugucuaucau

SEQ ID NO: 3141 - RNA, 19 nt, Homo sapiens
ggagacagcaagaccauuc

SEQ ID NO: 3142 - RNA, 19 nt, Homo sapiens
gcaaagccgauguccagaa

SEQ ID NO: 3143 - RNA, 19 nt, Homo sapiens
gcagcgauuuauagauuuc

SEQ ID NO: 3144 - RNA, 19 nt, Homo sapiens
gaagaggugcaguuucuca

SEQ ID NO: 3145 - RNA, 19 nt, Homo sapiens
uaagauggcucuggaacuc

SEQ ID NO: 3146 - RNA, 19 nt, Homo sapiens
agaaacgaguguuagagaa

SEQ ID NO: 3147 - RNA, 19 nt, Homo sapiens
agagauugcuaaugagaug

SEQ ID NO: 3148 - RNA, 19 nt, Homo sapiens
cuacgcacauucugaacuu

SEQ ID NO: 3149 - RNA, 19 nt, Homo sapiens
cagagagcuugaagaaaug

SEQ ID NO: 3150 - RNA, 19 nt, Homo sapiens
gaaacgaguguuagagaag

SEQ ID NO: 3151 - RNA, 19 nt, Homo sapiens
gaagaagaggugcaguuuc

SEQ ID NO: 3152 - RNA, 19 nt, Homo sapiens
gugaaggacaucauuaaug

SEQ ID NO: 3153 - RNA, 19 nt, Homo sapiens
gaauaagauguccaacuau

SEQ ID NO: 3154 - RNA, 19 nt, Homo sapiens
uaaaggugguggcaaggau

SEQ ID NO: 3155 - RNA, 19 nt, Homo sapiens
cagccaaggcccugaauga

SEQ ID NO: 3156 - RNA, 19 nt, Homo sapiens
aaacgaguguuagagaaga

SEQ ID NO: 3157 - RNA, 19 nt, Homo sapiens
agaaaugucucucugucau

SEQ ID NO: 3158 - RNA, 19 nt, Homo sapiens
cgccucagauuugacuuua

SEQ ID NO: 3159 - RNA, 19 nt, Homo sapiens
ugaagaagaggugcaguuu

SEQ ID NO: 3160 - RNA, 19 nt, Homo sapiens
ggcagcgauuuauagauuu

SEQ ID NO: 3161 - RNA, 19 nt, Homo sapiens
caagaucacgugccugugu

SEQ ID NO: 3162 - RNA, 19 nt, Homo sapiens
uagagaagacgaagcaguu

SEQ ID NO: 3163 - RNA, 19 nt, Homo sapiens
gaaaugucucucugucaug

SEQ ID NO: 3164 - RNA, 19 nt, Homo sapiens
cugcggaacucgagucaug

SEQ ID NO: 3165 - RNA, 19 nt, Homo sapiens
ucaagaaggcugaagagau

SEQ ID NO: 3166 - RNA, 19 nt, Homo sapiens
agaagggccuggugguaga

SEQ ID NO: 3167 - RNA, 19 nt, Homo sapiens
gcaggcaugaaccaguuua

SEQ ID NO: 3168 - RNA, 19 nt, Homo sapiens
gaucugacuggacugauug

SEQ ID NO: 3169 - RNA, 19 nt, Homo sapiens
ccaggcaacaugaaggaua

SEQ ID NO: 3170 - RNA, 19 nt, Homo sapiens
gaguuuggcauucccauug

SEQ ID NO: 3171 - RNA, 19 nt, Homo sapiens
aaaaugaccuggacgaugu

SEQ ID NO: 3172 - RNA, 19 nt, Homo sapiens
ggagcaguccuaugucuca

SEQ ID NO: 3173 - RNA, 19 nt, Homo sapiens
ggaagcugauggcauucug

SEQ ID NO: 3174 - RNA, 19 nt, Homo sapiens
gcacaggccacaggcaaga

SEQ ID NO: 3175 - RNA, 19 nt, Homo sapiens
gcaggugucaggcuugaug

SEQ ID NO: 3176 - RNA, 19 nt, Homo sapiens
gaggaacgagcauacguau

SEQ ID NO: 3177 - RNA, 19 nt, Homo sapiens
cagaaacgaguguuagaga

SEQ ID NO: 3178 - RNA, 19 nt, Homo sapiens
gcuccucuaugacaccuau

SEQ ID NO: 3179 - RNA, 19 nt, Homo sapiens
gcuacaagaacauuugaau

SEQ ID NO: 3180 - RNA, 19 nt, Homo sapiens
cuaaugugcuggagaucug

SEQ ID NO: 3181 - RNA, 19 nt, Homo sapiens
ccgcacaucuugucaacca

SEQ ID NO: 3182 - RNA, 19 nt, Homo sapiens
acucucaaaucccuaaaga

SEQ ID NO: 3183 - RNA, 19 nt, Homo sapiens
ugacuucuguugaguucug

SEQ ID NO: 3184 - RNA, 19 nt, Homo sapiens
cagcaaguaggaaucguuu

SEQ ID NO: 3185 - RNA, 19 nt, Homo sapiens
ucucaaaucccuaaagaag

SEQ ID NO: 3186 - RNA, 19 nt, Homo sapiens
ucagacugcuccaaacaag

SEQ ID NO: 3187 - RNA, 19 nt, Homo sapiens
caaggaggccagaucuaug

SEQ ID NO: 3188 - RNA, 19 nt, Homo sapiens
uggaacgacugguaucugu

SEQ ID NO: 3189 - RNA, 19 nt, Homo sapiens
uguccgaguugcuggauga

SEQ ID NO: 3190 - RNA, 19 nt, Homo sapiens
gggaggaccugcuaaauaa

SEQ ID NO: 3191 - RNA, 19 nt, Homo sapiens
gcaauuaccugguugaugu

SEQ ID NO: 3192 - RNA, 19 nt, Homo sapiens
gaagagagccgaggcaauu

SEQ ID NO: 3193 - RNA, 19 nt, Homo sapiens
caaagucgacguugaauuu

SEQ ID NO: 3194 - RNA, 19 nt, Homo sapiens
gaucuccucuguucccaua

SEQ ID NO: 3195 - RNA, 19 nt, Homo sapiens
gcucaccuguuccucaaua

SEQ ID NO: 3196 - RNA, 19 nt, Homo sapiens
gugaugaccuucagcaaga

SEQ ID NO: 3197 - RNA, 19 nt, Homo sapiens
gaaagagaaccaacaggaa

SEQ ID NO: 3198 - RNA, 19 nt, Homo sapiens
gccuagaucucaggaguua

SEQ ID NO: 3199 - RNA, 19 nt, Homo sapiens
ugaaauacccucuggaaga

SEQ ID NO: 3200 - RNA, 19 nt, Homo sapiens
uggaagaguuugugaaaga

SEQ ID NO: 3201 - RNA, 19 nt, Homo sapiens
cuggagacgugcaugauua

SEQ ID NO: 3202 - RNA, 19 nt, Homo sapiens
ugagagacaucgccaggaa

SEQ ID NO: 3203 - RNA, 19 nt, Homo sapiens
ggugacaaauccauucguu

SEQ ID NO: 3204 - RNA, 19 nt, Homo sapiens
cuaaagccauucacaagau

SEQ ID NO: 3205 - RNA, 19 nt, Homo sapiens
cagcagacgugaugaccuu

SEQ ID NO: 3206 - RNA, 19 nt, Homo sapiens
ucaccacgcucaccuguuc

SEQ ID NO: 3207 - RNA, 19 nt, Homo sapiens
cgggaggaccugcuaaaua

SEQ ID NO: 3208 - RNA, 19 nt, Homo sapiens
gcacugcugcgccuucuug

SEQ ID NO: 3209 - RNA, 19 nt, Homo sapiens
ugacaaauccauucguuuc

SEQ ID NO: 3210 - RNA, 19 nt, Homo sapiens
gaucucaggaguuaaugaa

SEQ ID NO: 3211 - RNA, 19 nt, Homo sapiens
uggaagagguugaggaucu

SEQ ID NO: 3212 - RNA, 19 nt, Homo sapiens
gcugaaauacccucuggaa

SEQ ID NO: 3213 - RNA, 19 nt, Homo sapiens
aaagaagccauuuccacua

SEQ ID NO: 3214 - RNA, 19 nt, Homo sapiens
gagaggacgaggcaccuuu

SEQ ID NO: 3215 - RNA, 19 nt, Homo sapiens
aggaucugauugugaaaua

SEQ ID NO: 3216 - RNA, 19 nt, Homo sapiens
cagccaaagucgacguuga

SEQ ID NO: 3217 - RNA, 19 nt, Homo sapiens
caagguggcagcacgcaaa

SEQ ID NO: 3218 - RNA, 19 nt, Homo sapiens
accgaaugcuggaucuuua

SEQ ID NO: 3219 - RNA, 19 nt, Homo sapiens
uagucaagcugcagccaaa

SEQ ID NO: 3220 - RNA, 19 nt, Homo sapiens
caucuuagcagacuucaag

SEQ ID NO: 3221 - RNA, 19 nt, Homo sapiens
caccuguuccucaauauuu

SEQ ID NO: 3222 - RNA, 19 nt, Homo sapiens
gaggaccugcuaaauaaug

SEQ ID NO: 3223 - RNA, 19 nt, Homo sapiens
uugaggaucugauugugaa

SEQ ID NO: 3224 - RNA, 19 nt, Homo sapiens
ggaagaguuugugaaagag

SEQ ID NO: 3225 - RNA, 19 nt, Homo sapiens
ggaagagguugaggaucug

SEQ ID NO: 3226 - RNA, 19 nt, Homo sapiens
cggagaacuuuguggagaa

SEQ ID NO: 3227 - RNA, 19 nt, Homo sapiens
uggcugaggucaucaacau

SEQ ID NO: 3228 - RNA, 19 nt, Homo sapiens
ggaucugauugugaaauau

SEQ ID NO: 3229 - RNA, 19 nt, Homo sapiens
gaagaguuugugaaagaga

SEQ ID NO: 3230 - RNA, 19 nt, Homo sapiens
ggagaacuuuguggagaag

SEQ ID NO: 3231 - RNA, 19 nt, Homo sapiens
uaaagccauucacaagauc

SEQ ID NO: 3232 - RNA, 19 nt, Homo sapiens
uaugaugggccucugauga

SEQ ID NO: 3233 - RNA, 19 nt, Homo sapiens
gacguugaauuugauuaug

SEQ ID NO: 3234 - RNA, 19 nt, Homo sapiens
gauccagacacauuaguca

SEQ ID NO: 3235 - RNA, 19 nt, Homo sapiens
ggguggcuguggugacaaa

SEQ ID NO: 3236 - RNA, 19 nt, Homo sapiens
gaucugauugugaaauauc

SEQ ID NO: 3237 - RNA, 19 nt, Homo sapiens
cgacguugaauuugauuau

SEQ ID NO: 3238 - RNA, 19 nt, Homo sapiens
ggaggaccauggguugcuu

SEQ ID NO: 3239 - RNA, 19 nt, Homo sapiens
ccucuguucccauagguua

SEQ ID NO: 3240 - RNA, 19 nt, Homo sapiens
gcaaccgaaugcuggaucu

SEQ ID NO: 3241 - RNA, 19 nt, Homo sapiens
gaagccauuuccacuacag

SEQ ID NO: 3242 - RNA, 19 nt, Homo sapiens
gcugaggucaucaacauca

SEQ ID NO: 3243 - RNA, 19 nt, Homo sapiens
gaggaguucaggccuaaug

SEQ ID NO: 3244 - RNA, 19 nt, Homo sapiens
gagcuggagacgugcauga

SEQ ID NO: 3245 - RNA, 19 nt, Homo sapiens
ccgaggcaauuaccugguu

SEQ ID NO: 3246 - RNA, 19 nt, Homo sapiens
aagaagccauuuccacuac

SEQ ID NO: 3247 - RNA, 19 nt, Homo sapiens
caaguaaagaagccauuuc

SEQ ID NO: 3248 - RNA, 19 nt, Homo sapiens
cgauaucccuuccuuugac

SEQ ID NO: 3249 - RNA, 19 nt, Homo sapiens
ccaaagucgacguugaauu

SEQ ID NO: 3250 - RNA, 19 nt, Homo sapiens
gcuggagacgugcaugauu

SEQ ID NO: 3251 - RNA, 19 nt, Homo sapiens
aagaguuugugaaagagaa

SEQ ID NO: 3252 - RNA, 19 nt, Homo sapiens
gaucgauaucccuuccuuu

SEQ ID NO: 3253 - RNA, 19 nt, Homo sapiens
uagcgaccacgcacucuaa

SEQ ID NO: 3254 - RNA, 19 nt, Homo sapiens
agacgugcaugauuaacca

SEQ ID NO: 3255 - RNA, 19 nt, Homo sapiens
ucaaguaaagaagccauuu

SEQ ID NO: 3256 - RNA, 19 nt, Homo sapiens
gccauucacaagaucgaua

SEQ ID NO: 3257 - RNA, 19 nt, Homo sapiens
gaggaccauggguugcuua

SEQ ID NO: 3258 - RNA, 19 nt, Homo sapiens
cgaaugcuggaucuuuauu

SEQ ID NO: 3259 - RNA, 19 nt, Homo sapiens
cuagaucucaggaguuaau

SEQ ID NO: 3260 - RNA, 19 nt, Homo sapiens
cggaauaagcucauuuuaa

SEQ ID NO: 3261 - RNA, 19 nt, Homo sapiens
gcagcuuccagcacacgua

SEQ ID NO: 3262 - RNA, 19 nt, Homo sapiens
ucuaaagccauucacaaga

SEQ ID NO: 3263 - RNA, 19 nt, Homo sapiens
ucgugaaacucauccaaca

SEQ ID NO: 3264 - RNA, 19 nt, Homo sapiens
uaguuugccuaauucaugu

SEQ ID NO: 3265 - RNA, 19 nt, Homo sapiens
aagucgacguugaauuuga

SEQ ID NO: 3266 - RNA, 19 nt, Homo sapiens
gaggucaucaacaucauca

SEQ ID NO: 3267 - RNA, 19 nt, Homo sapiens
ucucaggaguuaaugaaac

SEQ ID NO: 3268 - RNA, 19 nt, Homo sapiens
ucuggaagaguuugugaaa

SEQ ID NO: 3269 - RNA, 19 nt, Homo sapiens
gugacaaauccauucguuu

SEQ ID NO: 3270 - RNA, 19 nt, Homo sapiens
gaagagguugaggaucuga

SEQ ID NO: 3271 - RNA, 19 nt, Homo sapiens
aggaggaguucaggccuaa

SEQ ID NO: 3272 - RNA, 19 nt, Homo sapiens
gauaucccuuccuuugacu

SEQ ID NO: 3273 - RNA, 19 nt, Homo sapiens
ggaggaccugcuaaauaau

SEQ ID NO: 3274 - RNA, 19 nt, Homo sapiens
ggucaucaacaucaucaag

SEQ ID NO: 3275 - RNA, 19 nt, Homo sapiens
ugacccagcagacgugaug

SEQ ID NO: 3276 - RNA, 19 nt, Homo sapiens
gcaaguucugggcccauga

SEQ ID NO: 3277 - RNA, 19 nt, Homo sapiens
guugaggaucugauuguga

SEQ ID NO: 3278 - RNA, 19 nt, Homo sapiens
ggaagucccagggccuaga

SEQ ID NO: 3279 - RNA, 19 nt, Homo sapiens
cuccuggacucaagcgauu

SEQ ID NO: 3280 - RNA, 19 nt, Homo sapiens
cauacggaauaagcucauu

SEQ ID NO: 3281 - RNA, 19 nt, Homo sapiens
gggugucccugucccucaa

SEQ ID NO: 3282 - RNA, 19 nt, Homo sapiens
gaagucccagggccuagau

SEQ ID NO: 3283 - RNA, 19 nt, Homo sapiens
ugacaucuuagcagacuuc

SEQ ID NO: 3284 - RNA, 19 nt, Homo sapiens
ucgauacucccgaugauuc

SEQ ID NO: 3285 - RNA, 19 nt, Homo sapiens
caagcgggaggaccugcua

SEQ ID NO: 3286 - RNA, 19 nt, Homo sapiens
gauuaugaugggccucuga

SEQ ID NO: 3287 - RNA, 19 nt, Homo sapiens
aagagagccgaggcaauua

SEQ ID NO: 3288 - RNA, 19 nt, Homo sapiens
gguugaggaucugauugug

SEQ ID NO: 3289 - RNA, 19 nt, Homo sapiens
gagguugaggaucugauug

SEQ ID NO: 3290 - RNA, 19 nt, Homo sapiens
gugaaaggcuggaaacuua

SEQ ID NO: 3291 - RNA, 19 nt, Homo sapiens
gaaagaaagcuauguauga

SEQ ID NO: 3292 - RNA, 19 nt, Homo sapiens
gaaagaaguuggcaagguu

SEQ ID NO: 3293 - RNA, 19 nt, Homo sapiens
gcaaugauuugaugaagaa

SEQ ID NO: 3294 - RNA, 19 nt, Homo sapiens
ggauuuagguaugcuauua

SEQ ID NO: 3295 - RNA, 19 nt, Homo sapiens
gcaaagcuaucuccucuga

SEQ ID NO: 3296 - RNA, 19 nt, Homo sapiens
aaacuugguuccauuguua

SEQ ID NO: 3297 - RNA, 19 nt, Homo sapiens
gaaccucacuuucagaaga

SEQ ID NO: 3298 - RNA, 19 nt, Homo sapiens
cgacaaggccgcaccauua

SEQ ID NO: 3299 - RNA, 19 nt, Homo sapiens
ucacaagucuaaacaauga

SEQ ID NO: 3300 - RNA, 19 nt, Homo sapiens
gcuauuaucccuucuuaua

SEQ ID NO: 3301 - RNA, 19 nt, Homo sapiens
gaaaacagcuagcuugaaa

SEQ ID NO: 3302 - RNA, 19 nt, Homo sapiens
gaccauaucucgcuucaug

SEQ ID NO: 3303 - RNA, 19 nt, Homo sapiens
gaagaaaacuggugucuau

SEQ ID NO: 3304 - RNA, 19 nt, Homo sapiens
aauaagcccucuauacaua

SEQ ID NO: 3305 - RNA, 19 nt, Homo sapiens
caagugaucuuucaauauc

SEQ ID NO: 3306 - RNA, 19 nt, Homo sapiens
gcucacugguuuacaaaua

SEQ ID NO: 3307 - RNA, 19 nt, Homo sapiens
guauaagacuagagagaua

SEQ ID NO: 3308 - RNA, 19 nt, Homo sapiens
gaacuagacuuuccuuugc

SEQ ID NO: 3309 - RNA, 19 nt, Homo sapiens
gcugagggcugaugucauu

SEQ ID NO: 3310 - RNA, 19 nt, Homo sapiens
gugcuuacaucucauagua

SEQ ID NO: 3311 - RNA, 19 nt, Homo sapiens
gcagaucgauuucucaaca

SEQ ID NO: 3312 - RNA, 19 nt, Homo sapiens
gaauaucaguugacagaau

SEQ ID NO: 3313 - RNA, 19 nt, Homo sapiens
ucaagucucucaacuggua

SEQ ID NO: 3314 - RNA, 19 nt, Homo sapiens
gaagagaugauucaacuug

SEQ ID NO: 3315 - RNA, 19 nt, Homo sapiens
gagagaacccuagccauua

SEQ ID NO: 3316 - RNA, 19 nt, Homo sapiens
ggcaugagcugaccuaugu

SEQ ID NO: 3317 - RNA, 19 nt, Homo sapiens
gaucuaagguugucauucu

SEQ ID NO: 3318 - RNA, 19 nt, Homo sapiens
ugguuuagcugguucauua

SEQ ID NO: 3319 - RNA, 19 nt, Homo sapiens
caacaaauacuuccauaug

SEQ ID NO: 3320 - RNA, 19 nt, Homo sapiens
ggagcccacuguaacaaua

SEQ ID NO: 3321 - RNA, 19 nt, Homo sapiens
gaaacuugguuccauuguu

SEQ ID NO: 3322 - RNA, 19 nt, Homo sapiens
gggagcugcugcugaaaua

SEQ ID NO: 3323 - RNA, 19 nt, Homo sapiens
ggagaugguuauacaauag

SEQ ID NO: 3324 - RNA, 19 nt, Homo sapiens
ggagagaacccuagccauu

SEQ ID NO: 3325 - RNA, 19 nt, Homo sapiens
gugaugaccugguacauug

SEQ ID NO: 3326 - RNA, 19 nt, Homo sapiens
ccauggagcugcuggauga

SEQ ID NO: 3327 - RNA, 19 nt, Homo sapiens
ggagggagccuuuguggaa

SEQ ID NO: 3328 - RNA, 19 nt, Homo sapiens
gcugaaaccuucuaugaca

SEQ ID NO: 3329 - RNA, 19 nt, Homo sapiens
cacaacagauuucuaaguu

SEQ ID NO: 3330 - RNA, 19 nt, Homo sapiens
gcaguuggauggcuuagau

SEQ ID NO: 3331 - RNA, 19 nt, Homo sapiens
ggaagaaccucacuuucag

SEQ ID NO: 3332 - RNA, 19 nt, Homo sapiens
cugcagugcuuccugauua

SEQ ID NO: 3333 - RNA, 19 nt, Homo sapiens
gugaaagacuugaauuuag

SEQ ID NO: 3334 - RNA, 19 nt, Homo sapiens
ucuacuggcucucuaauuu

SEQ ID NO: 3335 - RNA, 19 nt, Homo sapiens
caacgaacaguacacauuu

SEQ ID NO: 3336 - RNA, 19 nt, Homo sapiens
gcacuggaauaucugagaa

SEQ ID NO: 3337 - RNA, 19 nt, Homo sapiens
gauauuaagucucaguaca

SEQ ID NO: 3338 - RNA, 19 nt, Homo sapiens
uaaacgcccucaccaaaga

SEQ ID NO: 3339 - RNA, 19 nt, Homo sapiens
ggaagagacugcuaauugc

SEQ ID NO: 3340 - RNA, 19 nt, Homo sapiens
gacauucgcucugagauga

SEQ ID NO: 3341 - RNA, 19 nt, Homo sapiens
gaauguaccuaugugaguu

SEQ ID NO: 3342 - RNA, 19 nt, Homo sapiens
gauauggcaucguugcauu

SEQ ID NO: 3343 - RNA, 19 nt, Homo sapiens
gguguaagacuucagauuu

SEQ ID NO: 3344 - RNA, 19 nt, Homo sapiens
auaauuggcuuugcagaua

SEQ ID NO: 3345 - RNA, 19 nt, Homo sapiens
gaucauagccaaaagcuua

SEQ ID NO: 3346 - RNA, 19 nt, Homo sapiens
ggaacucuuucaugagauu

SEQ ID NO: 3347 - RNA, 19 nt, Homo sapiens
gaaaagacauucgcucuga

SEQ ID NO: 3348 - RNA, 19 nt, Homo sapiens
gagaagagccacccugguu

SEQ ID NO: 3349 - RNA, 19 nt, Homo sapiens
gaacaagcuagaacccaua

SEQ ID NO: 3350 - RNA, 19 nt, Homo sapiens
ggucacaagucuaaacaau

SEQ ID NO: 3351 - RNA, 19 nt, Homo sapiens
guauggcucucaagugaaa

SEQ ID NO: 3352 - RNA, 19 nt, Homo sapiens
ggagaugcuuuccuuaaca

SEQ ID NO: 3353 - RNA, 19 nt, Homo sapiens
gaacaguacacauuuguca

SEQ ID NO: 3354 - RNA, 19 nt, Homo sapiens
ucaagggcaucguguauga

SEQ ID NO: 3355 - RNA, 19 nt, Homo sapiens
aaauauagguugucuugug

SEQ ID NO: 3356 - RNA, 19 nt, Homo sapiens
gaaaagagccagaaguuga

SEQ ID NO: 3357 - RNA, 19 nt, Homo sapiens
gcacuaggauggcaaucau

SEQ ID NO: 3358 - RNA, 19 nt, Homo sapiens
ggacaguucugcagaucga

SEQ ID NO: 3359 - RNA, 19 nt, Homo sapiens
ggaagccugugcccauuug

SEQ ID NO: 3360 - RNA, 19 nt, Homo sapiens
gugaaacucuauuauggaa

SEQ ID NO: 3361 - RNA, 19 nt, Homo sapiens
agaaagcuauguaugaaga

SEQ ID NO: 3362 - RNA, 19 nt, Homo sapiens
ggagagaacacguggaguu

SEQ ID NO: 3363 - RNA, 19 nt, Homo sapiens
cagcagaaguccuaugugu

SEQ ID NO: 3364 - RNA, 19 nt, Homo sapiens
cagaagagaauaucagaaa

SEQ ID NO: 3365 - RNA, 19 nt, Homo sapiens
aaacauugcugcauagucu

SEQ ID NO: 3366 - RNA, 19 nt, Homo sapiens
gauauuggauaccccauua

SEQ ID NO: 3367 - RNA, 19 nt, Homo sapiens
guagaacccugugguauag

SEQ ID NO: 3368 - RNA, 19 nt, Homo sapiens
guacugauacuauucaaug

SEQ ID NO: 3369 - RNA, 19 nt, Homo sapiens
ggaagaaguaaacuggaua

SEQ ID NO: 3370 - RNA, 19 nt, Homo sapiens
gaugagaaagugaaagaaa

SEQ ID NO: 3371 - RNA, 19 nt, Homo sapiens
gaaagagacgcaaacacaa

SEQ ID NO: 3372 - RNA, 19 nt, Homo sapiens
gugguguucuuccucauua

SEQ ID NO: 3373 - RNA, 19 nt, Homo sapiens
gucaaggugugguucaaua

SEQ ID NO: 3374 - RNA, 19 nt, Homo sapiens
ggacaggauugccaucauc

SEQ ID NO: 3375 - RNA, 19 nt, Homo sapiens
gaagagaauaucagaaauc

SEQ ID NO: 3376 - RNA, 19 nt, Homo sapiens
cagaagagaugauucaacu

SEQ ID NO: 3377 - RNA, 19 nt, Homo sapiens
gaaauccagcucaaacuug

SEQ ID NO: 3378 - RNA, 19 nt, Homo sapiens
gguaagaggcaaagaauca

SEQ ID NO: 3379 - RNA, 19 nt, Homo sapiens
ggccagcgauuauugauca

SEQ ID NO: 3380 - RNA, 19 nt, Homo sapiens
ugacaggacuggacaccaa

SEQ ID NO: 3381 - RNA, 19 nt, Homo sapiens
gcaaugugauggucaggau

SEQ ID NO: 3382 - RNA, 19 nt, Homo sapiens
gcacauccucauucacuaa

SEQ ID NO: 3383 - RNA, 19 nt, Homo sapiens
gagaugcuuuccuuaacaa

SEQ ID NO: 3384 - RNA, 19 nt, Homo sapiens
ucaaugauauccugaaguc

SEQ ID NO: 3385 - RNA, 19 nt, Homo sapiens
cagcugguguggacccuua

SEQ ID NO: 3386 - RNA, 19 nt, Homo sapiens
ggagaacagccaagaaaug

SEQ ID NO: 3387 - RNA, 19 nt, Homo sapiens
uaacaacugugaauaugag

SEQ ID NO: 3388 - RNA, 19 nt, Homo sapiens
gaaagugaaagaaagcuau

SEQ ID NO: 3389 - RNA, 19 nt, Homo sapiens
aaacauccaugaaguacau

SEQ ID NO: 3390 - RNA, 19 nt, Homo sapiens
gcagagagauggacaagau

SEQ ID NO: 3391 - RNA, 19 nt, Homo sapiens
ggagauggcuacaugauca

SEQ ID NO: 3392 - RNA, 19 nt, Homo sapiens
gagaggagguggcgcauga

SEQ ID NO: 3393 - RNA, 19 nt, Homo sapiens
gcacggagauggaugagau

SEQ ID NO: 3394 - RNA, 19 nt, Homo sapiens
gcacagauguuuguuuuaa

SEQ ID NO: 3395 - RNA, 19 nt, Homo sapiens
gcaagaaccugggcaugug

SEQ ID NO: 3396 - RNA, 19 nt, Homo sapiens
ggaagaacgugacgcucaa

SEQ ID NO: 3397 - RNA, 19 nt, Homo sapiens
acaagaagcuggcccugaa

SEQ ID NO: 3398 - RNA, 19 nt, Homo sapiens
ccaagcaucugcaguuugu

SEQ ID NO: 3399 - RNA, 19 nt, Homo sapiens
ggaggaaggcaaccuguuu

SEQ ID NO: 3400 - RNA, 19 nt, Homo sapiens
gaagugggcucuggagaag

SEQ ID NO: 3401 - RNA, 19 nt, Homo sapiens
ggaugaggcugaccugcuu

SEQ ID NO: 3402 - RNA, 19 nt, Homo sapiens
gggagcaccugcagcugua

SEQ ID NO: 3403 - RNA, 19 nt, Homo sapiens
ucaccaaggucuacaagga

SEQ ID NO: 3404 - RNA, 19 nt, Homo sapiens
gcagcuacgugcagauguu

SEQ ID NO: 3405 - RNA, 19 nt, Homo sapiens
gcaacaaccgcaccauuga

SEQ ID NO: 3406 - RNA, 19 nt, Homo sapiens
gaggagauccgcagagaga

SEQ ID NO: 3407 - RNA, 19 nt, Homo sapiens
caacgagacuuuugcuuuu

SEQ ID NO: 3408 - RNA, 19 nt, Homo sapiens
acacaaaggugcaguacca

SEQ ID NO: 3409 - RNA, 19 nt, Homo sapiens
gccacaaugucucugagua

SEQ ID NO: 3410 - RNA, 19 nt, Homo sapiens
gcaugugucuggaguccuu

SEQ ID NO: 3411 - RNA, 19 nt, Homo sapiens
ucaccgccauccugaagua

SEQ ID NO: 3412 - RNA, 19 nt, Homo sapiens
ugucaacaguuaccugaaa

SEQ ID NO: 3413 - RNA, 19 nt, Homo sapiens
ggagagcauugucaacuac

SEQ ID NO: 3414 - RNA, 19 nt, Homo sapiens
gaaacguccugaaguccau

SEQ ID NO: 3415 - RNA, 19 nt, Homo sapiens
ucaaggaggugaugaagac

SEQ ID NO: 3416 - RNA, 19 nt, Homo sapiens
ucauggagauggccuacaa

SEQ ID NO: 3417 - RNA, 19 nt, Homo sapiens
cuaaguacuucgcgcugua

SEQ ID NO: 3418 - RNA, 19 nt, Homo sapiens
gcgaugacuuccuguuugu

SEQ ID NO: 3419 - RNA, 19 nt, Homo sapiens
gcgcacagauguuuguuuu

SEQ ID NO: 3420 - RNA, 19 nt, Homo sapiens
ggucagucccguauuuauu

SEQ ID NO: 3421 - RNA, 19 nt, Homo sapiens
acgaguacaucaacgagua

SEQ ID NO: 3422 - RNA, 19 nt, Homo sapiens
ugaacaagcugagccugaa

SEQ ID NO: 3423 - RNA, 19 nt, Homo sapiens
guacccagccuucaucuuc

SEQ ID NO: 3424 - RNA, 19 nt, Homo sapiens
gaccagcaccuucaagaug

SEQ ID NO: 3425 - RNA, 19 nt, Homo sapiens
ccaagccuguggaggauga

SEQ ID NO: 3426 - RNA, 19 nt, Homo sapiens
ucuacuggcuggcgaacua

SEQ ID NO: 3427 - RNA, 19 nt, Homo sapiens
ggagccaccuggacagauc

SEQ ID NO: 3428 - RNA, 19 nt, Homo sapiens
gggcccagcuguccuucaa

SEQ ID NO: 3429 - RNA, 19 nt, Homo sapiens
agaccacacuggacaaugu

SEQ ID NO: 3430 - RNA, 19 nt, Homo sapiens
ggccaagcaucugcaguuu

SEQ ID NO: 3431 - RNA, 19 nt, Homo sapiens
gcccagguguucagcaaga

SEQ ID NO: 3432 - RNA, 19 nt, Homo sapiens
cgacaucaccggccacaau

SEQ ID NO: 3433 - RNA, 19 nt, Homo sapiens
caucugcccuggauucaca

SEQ ID NO: 3434 - RNA, 19 nt, Homo sapiens
gccagggacucaacaaugg

SEQ ID NO: 3435 - RNA, 19 nt, Homo sapiens
gcacucuucucccagaucu

SEQ ID NO: 3436 - RNA, 19 nt, Homo sapiens
gaggagguggcgcaugaua

SEQ ID NO: 3437 - RNA, 19 nt, Homo sapiens
gaacagugaggccgaugug

SEQ ID NO: 3438 - RNA, 19 nt, Homo sapiens
gccugaaccucuacgagaa

SEQ ID NO: 3439 - RNA, 19 nt, Homo sapiens
ggucugggcucuaaguacu

SEQ ID NO: 3440 - RNA, 19 nt, Homo sapiens
ggcaacaaccgcaccauug

SEQ ID NO: 3441 - RNA, 19 nt, Homo sapiens
gauccacagugucuuccuu

SEQ ID NO: 3442 - RNA, 19 nt, Homo sapiens
guuuggagauggcuacaug

SEQ ID NO: 3443 - RNA, 19 nt, Homo sapiens
ugugggacaugcucaacua

SEQ ID NO: 3444 - RNA, 19 nt, Homo sapiens
cgccagaacuccagcuuca

SEQ ID NO: 3445 - RNA, 19 nt, Homo sapiens
caggacaacgucacuguuu

SEQ ID NO: 3446 - RNA, 19 nt, Homo sapiens
caacaaccgcaccauugaa

SEQ ID NO: 3447 - RNA, 19 nt, Homo sapiens
gaagaaccgguuuggagau

SEQ ID NO: 3448 - RNA, 19 nt, Homo sapiens
ggcugccacuguccaauuu

SEQ ID NO: 3449 - RNA, 19 nt, Homo sapiens
cgcaggagcucuggcguuu

SEQ ID NO: 3450 - RNA, 19 nt, Homo sapiens
gucagucccguauuuauuu

SEQ ID NO: 3451 - RNA, 19 nt, Homo sapiens
cggaagccaugcucaagga

SEQ ID NO: 3452 - RNA, 19 nt, Homo sapiens
gggcgaggccuucgucaau

SEQ ID NO: 3453 - RNA, 19 nt, Homo sapiens
gcgguggcaucaucuacuu

SEQ ID NO: 3454 - RNA, 19 nt, Homo sapiens
gcgccaucaucgacacuuu

SEQ ID NO: 3455 - RNA, 19 nt, Homo sapiens
cgacgucuauggcgacuac

SEQ ID NO: 3456 - RNA, 19 nt, Homo sapiens
gaggaaggcaaccuguuug

SEQ ID NO: 3457 - RNA, 19 nt, Homo sapiens
ggaaccagcuuuucucucu

SEQ ID NO: 3458 - RNA, 19 nt, Homo sapiens
gcauccagcaccugaagaa

SEQ ID NO: 3459 - RNA, 19 nt, Homo sapiens
ggacacgacccuggaggaa

SEQ ID NO: 3460 - RNA, 19 nt, Homo sapiens
ggaccgcauugccaucauc

SEQ ID NO: 3461 - RNA, 19 nt, Homo sapiens
ggagguggcgcaugauaag

SEQ ID NO: 3462 - RNA, 19 nt, Homo sapiens
gcuacgugcccuacaugua

SEQ ID NO: 3463 - RNA, 19 nt, Homo sapiens
ccaagaagcagagugacaa

SEQ ID NO: 3464 - RNA, 19 nt, Homo sapiens
cauccugccugucaugcaa

SEQ ID NO: 3465 - RNA, 19 nt, Homo sapiens
ugucaucaaucucuucauc

SEQ ID NO: 3466 - RNA, 19 nt, Homo sapiens
acacgacccuggaggaagu

SEQ ID NO: 3467 - RNA, 19 nt, Homo sapiens
aggagagcauugucaacua

SEQ ID NO: 3468 - RNA, 19 nt, Homo sapiens
gcccagcuguccuucaaca

SEQ ID NO: 3469 - RNA, 19 nt, Homo sapiens
ugaagugggcucuggagaa

SEQ ID NO: 3470 - RNA, 19 nt, Homo sapiens
cuacaagucccggaagauu

SEQ ID NO: 3471 - RNA, 19 nt, Homo sapiens
acacgucgcccaccaacuu

SEQ ID NO: 3472 - RNA, 19 nt, Homo sapiens
ggauccaguucauguccaa

SEQ ID NO: 3473 - RNA, 19 nt, Homo sapiens
guacacccuugcccugcuu

SEQ ID NO: 3474 - RNA, 19 nt, Homo sapiens
ccaucacgcccaucaugua

SEQ ID NO: 3475 - RNA, 19 nt, Homo sapiens
ccacaggacccagacaaug

SEQ ID NO: 3476 - RNA, 19 nt, Homo sapiens
ggagauccgcagagagaug

SEQ ID NO: 3477 - RNA, 19 nt, Homo sapiens
cgcgaugacuuccuguuug

SEQ ID NO: 3478 - RNA, 19 nt, Homo sapiens
ccagugcucagccuucgua

SEQ ID NO: 3479 - RNA, 19 nt, Homo sapiens
gaagaacgugacgcucaaa

SEQ ID NO: 3480 - RNA, 19 nt, Homo sapiens
gcuggcagguggcaggaau

SEQ ID NO: 3481 - RNA, 19 nt, Homo sapiens
cugggucagucccguauuu

SEQ ID NO: 3482 - RNA, 19 nt, Homo sapiens
ggccagggacucaacaaug

SEQ ID NO: 3483 - RNA, 19 nt, Homo sapiens
cacagugucuuccuucucu

SEQ ID NO: 3484 - RNA, 19 nt, Homo sapiens
cgaguacuacgccaagauu

SEQ ID NO: 3485 - RNA, 19 nt, Homo sapiens
gaacuacgugugggacaug

SEQ ID NO: 3486 - RNA, 19 nt, Homo sapiens
gcucuuuggucccucaucu

SEQ ID NO: 3487 - RNA, 19 nt, Homo sapiens
gggaccucauccugaagua

SEQ ID NO: 3488 - RNA, 19 nt, Homo sapiens
ucugggaccucauccugaa

SEQ ID NO: 3489 - RNA, 19 nt, Homo sapiens
ggcaagaccaccaccaugu

SEQ ID NO: 3490 - RNA, 19 nt, Homo sapiens
gaaauacggugccggcuau

SEQ ID NO: 3491 - RNA, 19 nt, Homo sapiens
gagggaagcugcugacugu

SEQ ID NO: 3492 - RNA, 19 nt, Homo sapiens
aaaggaggcugaaggagua

SEQ ID NO: 3493 - RNA, 19 nt, Homo sapiens
gaagugcccugaagaaguc

SEQ ID NO: 3494 - RNA, 19 nt, Homo sapiens
gagcacguuucuccuauuu

SEQ ID NO: 3495 - RNA, 19 nt, Homo sapiens
gcaagcagggcccaucuua

SEQ ID NO: 3496 - RNA, 19 nt, Homo sapiens
gggagaugcuggucaugua

SEQ ID NO: 3497 - RNA, 19 nt, Homo sapiens
cagagcaccuuuauuucua

SEQ ID NO: 3498 - RNA, 19 nt, Homo sapiens
acagaaggcuggcacacua

SEQ ID NO: 3499 - RNA, 19 nt, Homo sapiens
gcagggcacuugugaucaa

SEQ ID NO: 3500 - RNA, 19 nt, Homo sapiens
gcacaccucgcccucuuua

SEQ ID NO: 3501 - RNA, 19 nt, Homo sapiens
ucgcagagcaccuuuauuu

SEQ ID NO: 3502 - RNA, 19 nt, Homo sapiens
gcuccugccuccugucuaa

SEQ ID NO: 3503 - RNA, 19 nt, Homo sapiens
gggccaaggugcagaguga

SEQ ID NO: 3504 - RNA, 19 nt, Homo sapiens
gaaggucucuuugcuaaac

SEQ ID NO: 3505 - RNA, 19 nt, Homo sapiens
ggacacugacagaauuaua

SEQ ID NO: 3506 - RNA, 19 nt, Homo sapiens
caacugaaccugaaacucu

SEQ ID NO: 3507 - RNA, 19 nt, Homo sapiens
guacaguggugguaacaag

SEQ ID NO: 3508 - RNA, 19 nt, Homo sapiens
gaggaguucuugaucuuca

SEQ ID NO: 3509 - RNA, 19 nt, Homo sapiens
gagaggacccagugacuug

SEQ ID NO: 3510 - RNA, 19 nt, Homo sapiens
gcaucuccaugucugcaua

SEQ ID NO: 3511 - RNA, 19 nt, Homo sapiens
gcagcguccuggaagauga

SEQ ID NO: 3512 - RNA, 19 nt, Homo sapiens
uugcuaaacuggagaagaa

SEQ ID NO: 3513 - RNA, 19 nt, Homo sapiens
cuacaucccuucucacagu

SEQ ID NO: 3514 - RNA, 19 nt, Homo sapiens
cauccucucucuccaaguu

SEQ ID NO: 3515 - RNA, 19 nt, Homo sapiens
gaagaccacgacuuucaaa

SEQ ID NO: 3516 - RNA, 19 nt, Homo sapiens
ccacacaccucugauuauc

SEQ ID NO: 3517 - RNA, 19 nt, Homo sapiens
uugaaggucucuuugcuaa

SEQ ID NO: 3518 - RNA, 19 nt, Homo sapiens
gcagagcaccuuuauuucu

SEQ ID NO: 3519 - RNA, 19 nt, Homo sapiens
gcacugggcgucccuuuca

SEQ ID NO: 3520 - RNA, 19 nt, Homo sapiens
acacgaggcugaccaucuu

SEQ ID NO: 3521 - RNA, 19 nt, Homo sapiens
ccaagcaugugcaguuugu

SEQ ID NO: 3522 - RNA, 19 nt, Homo sapiens
gcucggugcuggagaguca

SEQ ID NO: 3523 - RNA, 19 nt, Homo sapiens
caucagcggguaugaaauu

SEQ ID NO: 3524 - RNA, 19 nt, Homo sapiens
agaaggacuuugaggacua

SEQ ID NO: 3525 - RNA, 19 nt, Homo sapiens
ggacuuugaggacuacauu

SEQ ID NO: 3526 - RNA, 19 nt, Homo sapiens
ggaagcugcugacugugau

SEQ ID NO: 3527 - RNA, 19 nt, Homo sapiens
gggaagaccacgacuuuca

SEQ ID NO: 3528 - RNA, 19 nt, Homo sapiens
ggcggacacugacagaauu

SEQ ID NO: 3529 - RNA, 19 nt, Homo sapiens
ggauggcagucagcaguuu

SEQ ID NO: 3530 - RNA, 19 nt, Homo sapiens
gggccgagcugucuuucau

SEQ ID NO: 3531 - RNA, 19 nt, Homo sapiens
ccagccagguugaacugua

SEQ ID NO: 3532 - RNA, 19 nt, Homo sapiens
gaagggagaccugcugugu

SEQ ID NO: 3533 - RNA, 19 nt, Homo sapiens
ugaaggagccgcacugcaa

SEQ ID NO: 3534 - RNA, 19 nt, Homo sapiens
caacguggacgacgacuuc

SEQ ID NO: 3535 - RNA, 19 nt, Homo sapiens
caucuuacauccucucucu

SEQ ID NO: 3536 - RNA, 19 nt, Homo sapiens
ggccaagcaugugcaguuu

SEQ ID NO: 3537 - RNA, 19 nt, Homo sapiens
agaaagagcugggcauugc

SEQ ID NO: 3538 - RNA, 19 nt, Homo sapiens
gaugaacuucuucuucuug

SEQ ID NO: 3539 - RNA, 19 nt, Homo sapiens
ggacaaccuucuguucaag

SEQ ID NO: 3540 - RNA, 19 nt, Homo sapiens
gcagcguccuucagagaug

SEQ ID NO: 3541 - RNA, 19 nt, Homo sapiens
gcagaaagagcugggcauu

SEQ ID NO: 3542 - RNA, 19 nt, Homo sapiens
gcucgaagcagucucuguu

SEQ ID NO: 3543 - RNA, 19 nt, Homo sapiens
ggacguacaguggugguaa

SEQ ID NO: 3544 - RNA, 19 nt, Homo sapiens
ggaagaccacgacuuucaa

SEQ ID NO: 3545 - RNA, 19 nt, Homo sapiens
cggaagggauucgacauug

SEQ ID NO: 3546 - RNA, 19 nt, Homo sapiens
ggacagcaguauggacauc

SEQ ID NO: 3547 - RNA, 19 nt, Homo sapiens
agaaagcacucagaaacga

SEQ ID NO: 3548 - RNA, 19 nt, Homo sapiens
gggaagcugcugacuguga

SEQ ID NO: 3549 - RNA, 19 nt, Homo sapiens
gguccucgcuguuccucaa

SEQ ID NO: 3550 - RNA, 19 nt, Homo sapiens
ucagaaacgaguacuuuga

SEQ ID NO: 3551 - RNA, 19 nt, Homo sapiens
guacauggaggccgucuuc

SEQ ID NO: 3552 - RNA, 19 nt, Homo sapiens
ggagcugccucuguucuuc

SEQ ID NO: 3553 - RNA, 19 nt, Homo sapiens
gaacuacacccugcagaag

SEQ ID NO: 3554 - RNA, 19 nt, Homo sapiens
gcacguuucuccuauuucc

SEQ ID NO: 3555 - RNA, 19 nt, Homo sapiens
ccaaguuuaucucauccuu

SEQ ID NO: 3556 - RNA, 19 nt, Homo sapiens
ccaaggaccaguuuaacga

SEQ ID NO: 3557 - RNA, 19 nt, Homo sapiens
acaugacgcuggugaagga

SEQ ID NO: 3558 - RNA, 19 nt, Homo sapiens
gcagcacgacauccuguuu

SEQ ID NO: 3559 - RNA, 19 nt, Homo sapiens
ccugggagcuugccuacau

SEQ ID NO: 3560 - RNA, 19 nt, Homo sapiens
cagagcacguuucuccuau

SEQ ID NO: 3561 - RNA, 19 nt, Homo sapiens
ggaagggauucgacauugc

SEQ ID NO: 3562 - RNA, 19 nt, Homo sapiens
gcaccgcugucaagcucaa

SEQ ID NO: 3563 - RNA, 19 nt, Homo sapiens
cgagcugucuuucauccuu

SEQ ID NO: 3564 - RNA, 19 nt, Homo sapiens
cagaaacgaguacuuugaa

SEQ ID NO: 3565 - RNA, 19 nt, Homo sapiens
gaaggaggaagaagacagu

SEQ ID NO: 3566 - RNA, 19 nt, Homo sapiens
gcuggacucugugcucuau

SEQ ID NO: 3567 - RNA, 19 nt, Homo sapiens
caaggugaagccaaaugua

SEQ ID NO: 3568 - RNA, 19 nt, Homo sapiens
gagaccaaccugcuucaga

SEQ ID NO: 3569 - RNA, 19 nt, Homo sapiens
gcaauucugggccauguuc

SEQ ID NO: 3570 - RNA, 19 nt, Homo sapiens
cgagaaagcacucagaaac

SEQ ID NO: 3571 - RNA, 19 nt, Homo sapiens
gaagguggccaggcucgaa

SEQ ID NO: 3572 - RNA, 19 nt, Homo sapiens
gaguccacguggccaguuu

SEQ ID NO: 3573 - RNA, 19 nt, Homo sapiens
gccaagaccgucacugaga

SEQ ID NO: 3574 - RNA, 19 nt, Homo sapiens
gaccacgacuuucaaaaug

SEQ ID NO: 3575 - RNA, 19 nt, Homo sapiens
gcuccaaggugcugauacu

SEQ ID NO: 3576 - RNA, 19 nt, Homo sapiens
uggacaaccuucuguucaa

SEQ ID NO: 3577 - RNA, 19 nt, Homo sapiens
ucggugaccuggaggaguu

SEQ ID NO: 3578 - RNA, 19 nt, Homo sapiens
gggcauccaucaccaccau

SEQ ID NO: 3579 - RNA, 19 nt, Homo sapiens
cugaagaagucaagcagau

SEQ ID NO: 3580 - RNA, 19 nt, Homo sapiens
gacccaaacaggcuccuuu

SEQ ID NO: 3581 - RNA, 19 nt, Homo sapiens
guuacacacggagaaauua

SEQ ID NO: 3582 - RNA, 19 nt, Homo sapiens
gaaggacuuugaggacuac

SEQ ID NO: 3583 - RNA, 19 nt, Homo sapiens
uccaggagcugccucuguu

SEQ ID NO: 3584 - RNA, 19 nt, Homo sapiens
uggcuccgcuugaagauuc

SEQ ID NO: 3585 - RNA, 19 nt, Homo sapiens
ucagagcacguuucuccua

SEQ ID NO: 3586 - RNA, 19 nt, Homo sapiens
gcaaggccaucaucaucac

SEQ ID NO: 3587 - RNA, 19 nt, Homo sapiens
ggagccacaugccaacaag

SEQ ID NO: 3588 - RNA, 19 nt, Homo sapiens
ccgggaagaccacgacuuu

SEQ ID NO: 3589 - RNA, 19 nt, Homo sapiens
gcggacacugacagaauua

SEQ ID NO: 3590 - RNA, 19 nt, Homo sapiens
gaaagaaacuacaagaaga

SEQ ID NO: 3591 - RNA, 19 nt, Homo sapiens
gaaagaaaguggccauugu

SEQ ID NO: 3592 - RNA, 19 nt, Homo sapiens
gaaaguccuuaguggaaua

SEQ ID NO: 3593 - RNA, 19 nt, Homo sapiens
gacaagcacucauagauau

SEQ ID NO: 3594 - RNA, 19 nt, Homo sapiens
gcaaaggccaugaauauug

SEQ ID NO: 3595 - RNA, 19 nt, Homo sapiens
gaaaggcuguggaaacugu

SEQ ID NO: 3596 - RNA, 19 nt, Homo sapiens
gaacgaggacucaagcuuu

SEQ ID NO: 3597 - RNA, 19 nt, Homo sapiens
uagacucacugcugaauua

SEQ ID NO: 3598 - RNA, 19 nt, Homo sapiens
gcuguccucuuccauaaua

SEQ ID NO: 3599 - RNA, 19 nt, Homo sapiens
gcucaguuauguuuacuaa

SEQ ID NO: 3600 - RNA, 19 nt, Homo sapiens
gcacacagauugucaacag

SEQ ID NO: 3601 - RNA, 19 nt, Homo sapiens
gaaaguggccauuguagga

SEQ ID NO: 3602 - RNA, 19 nt, Homo sapiens
gagauaugauggauucuug

SEQ ID NO: 3603 - RNA, 19 nt, Homo sapiens
gaaauugaccaagcagaua

SEQ ID NO: 3604 - RNA, 19 nt, Homo sapiens
gcagguacccuuacuguug

SEQ ID NO: 3605 - RNA, 19 nt, Homo sapiens
caaaugcugugcccaguug

SEQ ID NO: 3606 - RNA, 19 nt, Homo sapiens
gcacagagauaugauggau

SEQ ID NO: 3607 - RNA, 19 nt, Homo sapiens
gcuauuauuucgcuucuau

SEQ ID NO: 3608 - RNA, 19 nt, Homo sapiens
caaaggccaugaauauugu

SEQ ID NO: 3609 - RNA, 19 nt, Homo sapiens
ccaaagaggaggaaagaaa

SEQ ID NO: 3610 - RNA, 19 nt, Homo sapiens
gauaugaagcacagagaua

SEQ ID NO: 3611 - RNA, 19 nt, Homo sapiens
gugguucccuucauguuua

SEQ ID NO: 3612 - RNA, 19 nt, Homo sapiens
gcaaugcuuucuuaugugu

SEQ ID NO: 3613 - RNA, 19 nt, Homo sapiens
caaaggcucuccagguaug

SEQ ID NO: 3614 - RNA, 19 nt, Homo sapiens
caacagcaguucugauugg

SEQ ID NO: 3615 - RNA, 19 nt, Homo sapiens
gugcaaaggccaugaauau

SEQ ID NO: 3616 - RNA, 19 nt, Homo sapiens
ggaaagaaagaaacuacaa

SEQ ID NO: 3617 - RNA, 19 nt, Homo sapiens
caagguagacacccaaauu

SEQ ID NO: 3618 - RNA, 19 nt, Homo sapiens
ugaaggauguggucaaaca

SEQ ID NO: 3619 - RNA, 19 nt, Homo sapiens
gagcuagaguucccauuuc

SEQ ID NO: 3620 - RNA, 19 nt, Homo sapiens
acagagauaugauggauuc

SEQ ID NO: 3621 - RNA, 19 nt, Homo sapiens
gaacuagauuuagauugga

SEQ ID NO: 3622 - RNA, 19 nt, Homo sapiens
guggagaacuagauuuaga

SEQ ID NO: 3623 - RNA, 19 nt, Homo sapiens
caaaugggaagcaaagaaa

SEQ ID NO: 3624 - RNA, 19 nt, Homo sapiens
uagauucgauuacugaaga

SEQ ID NO: 3625 - RNA, 19 nt, Homo sapiens
ggaacuguauauagagaga

SEQ ID NO: 3626 - RNA, 19 nt, Homo sapiens
gguagacacccaaauuaaa

SEQ ID NO: 3627 - RNA, 19 nt, Homo sapiens
ugcaaaggcucuccaggua

SEQ ID NO: 3628 - RNA, 19 nt, Homo sapiens
gacgggagcuuuaucuaag

SEQ ID NO: 3629 - RNA, 19 nt, Homo sapiens
ggaaagaaaguggccauug

SEQ ID NO: 3630 - RNA, 19 nt, Homo sapiens
agacaagcacucauagaua

SEQ ID NO: 3631 - RNA, 19 nt, Homo sapiens
gaacaagggguaucaguuu

SEQ ID NO: 3632 - RNA, 19 nt, Homo sapiens
gcacugaagcagaauuguu

SEQ ID NO: 3633 - RNA, 19 nt, Homo sapiens
ugagugcuuugguauuuaa

SEQ ID NO: 3634 - RNA, 19 nt, Homo sapiens
ccugagugcuuugguauuu

SEQ ID NO: 3635 - RNA, 19 nt, Homo sapiens
guucuuagaugcugcaaag

SEQ ID NO: 3636 - RNA, 19 nt, Homo sapiens
caaauacaguugcaaccau

SEQ ID NO: 3637 - RNA, 19 nt, Homo sapiens
caugaaggauguggucaaa

SEQ ID NO: 3638 - RNA, 19 nt, Homo sapiens
acucacugcugaauuauga

SEQ ID NO: 3639 - RNA, 19 nt, Homo sapiens
agaacuagauuuagauugg

SEQ ID NO: 3640 - RNA, 19 nt, Homo sapiens
caagguagcccagaauuca

SEQ ID NO: 3641 - RNA, 19 nt, Homo sapiens
gauuggcuaugguguauca

SEQ ID NO: 3642 - RNA, 19 nt, Homo sapiens
cuacauauuugcacugaag

SEQ ID NO: 3643 - RNA, 19 nt, Homo sapiens
gaaagaaagaaacuacaag

SEQ ID NO: 3644 - RNA, 19 nt, Homo sapiens
aaagaaaguggccauugua

SEQ ID NO: 3645 - RNA, 19 nt, Homo sapiens
cagaaaguccuuaguggaa

SEQ ID NO: 3646 - RNA, 19 nt, Homo sapiens
ucugggaacuguauauaga

SEQ ID NO: 3647 - RNA, 19 nt, Homo sapiens
ggaaauugaccaagcagau

SEQ ID NO: 3648 - RNA, 19 nt, Homo sapiens
ucagugguguuuuguauua

SEQ ID NO: 3649 - RNA, 19 nt, Homo sapiens
uuaauccucucccuaauca

SEQ ID NO: 3650 - RNA, 19 nt, Homo sapiens
ggagaacuagauuuagauu

SEQ ID NO: 3651 - RNA, 19 nt, Homo sapiens
ggcaacagcaguucugauu

SEQ ID NO: 3652 - RNA, 19 nt, Homo sapiens
ucaaccagaugucgggaaa

SEQ ID NO: 3653 - RNA, 19 nt, Homo sapiens
caccaugguuugcuugcua

SEQ ID NO: 3654 - RNA, 19 nt, Homo sapiens
uacaaccucuuauauggaa

SEQ ID NO: 3655 - RNA, 19 nt, Homo sapiens
gcucgagccuaccagauuc

SEQ ID NO: 3656 - RNA, 19 nt, Homo sapiens
gcagacagacgggagcuuu

SEQ ID NO: 3657 - RNA, 19 nt, Homo sapiens
ugaaaucauugucuuggau

SEQ ID NO: 3658 - RNA, 19 nt, Homo sapiens
ccucuuauauggaaacauc

SEQ ID NO: 3659 - RNA, 19 nt, Homo sapiens
ugaagucccugcaggaaag

SEQ ID NO: 3660 - RNA, 19 nt, Homo sapiens
cagcuaccguggccuuuga

SEQ ID NO: 3661 - RNA, 19 nt, Homo sapiens
gauccggccuuuagucucu

SEQ ID NO: 3662 - RNA, 19 nt, Homo sapiens
gaugcuguccucuuccaua

SEQ ID NO: 3663 - RNA, 19 nt, Homo sapiens
ccaaaugggaagcaaagaa

SEQ ID NO: 3664 - RNA, 19 nt, Homo sapiens
gcaauugcaagagccauuu

SEQ ID NO: 3665 - RNA, 19 nt, Homo sapiens
ccagguauggccacugaua

SEQ ID NO: 3666 - RNA, 19 nt, Homo sapiens
gcaaaggcucuccagguau

SEQ ID NO: 3667 - RNA, 19 nt, Homo sapiens
gggaaaagcacaauaguga

SEQ ID NO: 3668 - RNA, 19 nt, Homo sapiens
guagacacccaaauuaaag

SEQ ID NO: 3669 - RNA, 19 nt, Homo sapiens
aagguagacacccaaauua

SEQ ID NO: 3670 - RNA, 19 nt, Homo sapiens
uguuggagaucuaguaaug

SEQ ID NO: 3671 - RNA, 19 nt, Homo sapiens
ucaggacaguucuuagaug

SEQ ID NO: 3672 - RNA, 19 nt, Homo sapiens
ggccaugaauauugugguu

SEQ ID NO: 3673 - RNA, 19 nt, Homo sapiens
cuaagucacauaagacauu

SEQ ID NO: 3674 - RNA, 19 nt, Homo sapiens
gugaaaggcuguggaaacu

SEQ ID NO: 3675 - RNA, 19 nt, Homo sapiens
caauucaggacaguucuua

SEQ ID NO: 3676 - RNA, 19 nt, Homo sapiens
gcuacuucaucguuagauu

SEQ ID NO: 3677 - RNA, 19 nt, Homo sapiens
gacuagacaagcacucaua

SEQ ID NO: 3678 - RNA, 19 nt, Homo sapiens
uaauggugcucgccaguca

SEQ ID NO: 3679 - RNA, 19 nt, Homo sapiens
gauaugauggauucuugaa

SEQ ID NO: 3680 - RNA, 19 nt, Homo sapiens
ccaagcagauaaugaugca

SEQ ID NO: 3681 - RNA, 19 nt, Homo sapiens
gcaagguagcccagaauuc

SEQ ID NO: 3682 - RNA, 19 nt, Homo sapiens
cgagcuagaguucccauuu

SEQ ID NO: 3683 - RNA, 19 nt, Homo sapiens
gaaucuuacuuaacagcau

SEQ ID NO: 3684 - RNA, 19 nt, Homo sapiens
ggaacgaggacucaagcuu

SEQ ID NO: 3685 - RNA, 19 nt, Homo sapiens
aaaauuagcuggacuucau

SEQ ID NO: 3686 - RNA, 19 nt, Homo sapiens
cagauaaugaugcagguaa

SEQ ID NO: 3687 - RNA, 19 nt, Homo sapiens
gacuacauauuugcacuga

SEQ ID NO: 3688 - RNA, 19 nt, Homo sapiens
agaaagaaacuacaagaag

SEQ ID NO: 3689 - RNA, 19 nt, Homo sapiens
gaacuucuauuuucauugc

SEQ ID NO: 3690 - RNA, 19 nt, Homo sapiens
gaacuugaauuucccuuua

SEQ ID NO: 3691 - RNA, 19 nt, Homo sapiens
gaugaugucugcacugaua

SEQ ID NO: 3692 - RNA, 19 nt, Homo sapiens
ggacagaaaccacucuuua

SEQ ID NO: 3693 - RNA, 19 nt, Homo sapiens
ccaaaucgauggugacuuu

SEQ ID NO: 3694 - RNA, 19 nt, Homo sapiens
gcaaggagcuguucgucaa

SEQ ID NO: 3695 - RNA, 19 nt, Homo sapiens
gagcaucccucccaacauu

SEQ ID NO: 3696 - RNA, 19 nt, Homo sapiens
gcugucaucuggcuuaaua

SEQ ID NO: 3697 - RNA, 19 nt, Homo sapiens
ccaauaaccuggacauaga

SEQ ID NO: 3698 - RNA, 19 nt, Homo sapiens
gcaauuacaugaccuucaa

SEQ ID NO: 3699 - RNA, 19 nt, Homo sapiens
uaacugagcuggccuuauc

SEQ ID NO: 3700 - RNA, 19 nt, Homo sapiens
cgacauggauucaaggauu

SEQ ID NO: 3701 - RNA, 19 nt, Homo sapiens
agaaagaacugcugaaaca

SEQ ID NO: 3702 - RNA, 19 nt, Homo sapiens
gauugaagcugcuggaaga

SEQ ID NO: 3703 - RNA, 19 nt, Homo sapiens
gaaaggaagagaagucaaa

SEQ ID NO: 3704 - RNA, 19 nt, Homo sapiens
gagaagaaucggaucaaua

SEQ ID NO: 3705 - RNA, 19 nt, Homo sapiens
ggaaaggaaugcugcugaa

SEQ ID NO: 3706 - RNA, 19 nt, Homo sapiens
gaagguguaugaggaauug

SEQ ID NO: 3707 - RNA, 19 nt, Homo sapiens
gggaggccaucaaugaaua

SEQ ID NO: 3708 - RNA, 19 nt, Homo sapiens
ggaagaaggauguggauga

SEQ ID NO: 3709 - RNA, 19 nt, Homo sapiens
cagagcagauggaguauga

SEQ ID NO: 3710 - RNA, 19 nt, Homo sapiens
ggaaggagaaggccaagaa

SEQ ID NO: 3711 - RNA, 19 nt, Homo sapiens
agaagaaucggaucaauaa

SEQ ID NO: 3712 - RNA, 19 nt, Homo sapiens
gaagaaggauguggaugau

SEQ ID NO: 3713 - RNA, 19 nt, Homo sapiens
ccaaguggcuucauuaaaa

SEQ ID NO: 3714 - RNA, 19 nt, Homo sapiens
agaaggauguggaugauga

SEQ ID NO: 3715 - RNA, 19 nt, Homo sapiens
gaagccugccucugauuua

SEQ ID NO: 3716 - RNA, 19 nt, Homo sapiens
agaaagugcucaaggagaa

SEQ ID NO: 3717 - RNA, 19 nt, Homo sapiens
gaaugcugcugaacuugaa

SEQ ID NO: 3718 - RNA, 19 nt, Homo sapiens
gacagaaaccacucuuuaa

SEQ ID NO: 3719 - RNA, 19 nt, Homo sapiens
gaaauaaaggaaaggaguu

SEQ ID NO: 3720 - RNA, 19 nt, Homo sapiens
ggaagaaggacaagaagau

SEQ ID NO: 3721 - RNA, 19 nt, Homo sapiens
gacauggauucaaggauuu

SEQ ID NO: 3722 - RNA, 19 nt, Homo sapiens
gcagaaaugccgacggaaa

SEQ ID NO: 3723 - RNA, 19 nt, Homo sapiens
ucaucuggcuuaauaacua

SEQ ID NO: 3724 - RNA, 19 nt, Homo sapiens
ucaauaaggccguaucuga

SEQ ID NO: 3725 - RNA, 19 nt, Homo sapiens
gggaagaaauaaaggaaag

SEQ ID NO: 3726 - RNA, 19 nt, Homo sapiens
cagacaaaguggugaagaa

SEQ ID NO: 3727 - RNA, 19 nt, Homo sapiens
ggagaagaaucggaucaau

SEQ ID NO: 3728 - RNA, 19 nt, Homo sapiens
ggauguggaugaugaugga

SEQ ID NO: 3729 - RNA, 19 nt, Homo sapiens
gaaacaguaugagaagcaa

SEQ ID NO: 3730 - RNA, 19 nt, Homo sapiens
acaucaagcuggagaaguu

SEQ ID NO: 3731 - RNA, 19 nt, Homo sapiens
ggaaugcugcugaacuuga

SEQ ID NO: 3732 - RNA, 19 nt, Homo sapiens
gagcagaguguuagccaaa

SEQ ID NO: 3733 - RNA, 19 nt, Homo sapiens
ucgcugcucuggacaauga

SEQ ID NO: 3734 - RNA, 19 nt, Homo sapiens
ucugaggccuuugccauua

SEQ ID NO: 3735 - RNA, 19 nt, Homo sapiens
cugaaagacuuguuuguuc

SEQ ID NO: 3736 - RNA, 19 nt, Homo sapiens
acaugaagguggaguguga

SEQ ID NO: 3737 - RNA, 19 nt, Homo sapiens
uugaagagcuggcaguaga

SEQ ID NO: 3738 - RNA, 19 nt, Homo sapiens
ucaggacucucaucacuca

SEQ ID NO: 3739 - RNA, 19 nt, Homo sapiens
ggacucucaucacucagaa

SEQ ID NO: 3740 - RNA, 19 nt, Homo sapiens
gaaagaaccaccggcugaa

SEQ ID NO: 3741 - RNA, 19 nt, Homo sapiens
gagcugacaccaagcgauu

SEQ ID NO: 3742 - RNA, 19 nt, Homo sapiens
ugaaagacuuguuuguucu

SEQ ID NO: 3743 - RNA, 19 nt, Homo sapiens
gcagaguguuagccaaauc

SEQ ID NO: 3744 - RNA, 19 nt, Homo sapiens
gaaaaugcaucugacauca

SEQ ID NO: 3745 - RNA, 19 nt, Homo sapiens
gaagaaauaaaggaaagga

SEQ ID NO: 3746 - RNA, 19 nt, Homo sapiens
caagggugcugugaucguu

SEQ ID NO: 3747 - RNA, 19 nt, Homo sapiens
ccagggcacuguucaugga

SEQ ID NO: 3748 - RNA, 19 nt, Homo sapiens
agaggaggauaaagaagaa

SEQ ID NO: 3749 - RNA, 19 nt, Homo sapiens
aagagaaagugcucaagga

SEQ ID NO: 3750 - RNA, 19 nt, Homo sapiens
acaaugaagaggaggauaa

SEQ ID NO: 3751 - RNA, 19 nt, Homo sapiens
aaguuuauguggccuauug

SEQ ID NO: 3752 - RNA, 19 nt, Homo sapiens
cagcugaccuggcaaccau

SEQ ID NO: 3753 - RNA, 19 nt, Homo sapiens
ggccaucaaugaauacaag

SEQ ID NO: 3754 - RNA, 19 nt, Homo sapiens
ugaagaggaggauaaagaa

SEQ ID NO: 3755 - RNA, 19 nt, Homo sapiens
ucauggagcgucuuaagaa

SEQ ID NO: 3756 - RNA, 19 nt, Homo sapiens
caacagcaacagcagcaaa

SEQ ID NO: 3757 - RNA, 19 nt, Homo sapiens
aaggaaugcugcugaacuu

SEQ ID NO: 3758 - RNA, 19 nt, Homo sapiens
gaaggcgcgaguuguguuu

SEQ ID NO: 3759 - RNA, 19 nt, Homo sapiens
gcaucgacauggauucaag

SEQ ID NO: 3760 - RNA, 19 nt, Homo sapiens
aggcagagcagauggagua

SEQ ID NO: 3761 - RNA, 19 nt, Homo sapiens
ggaagaggaggaggaagaa

SEQ ID NO: 3762 - RNA, 19 nt, Homo sapiens
auacaagggugcugugauc

SEQ ID NO: 3763 - RNA, 19 nt, Homo sapiens
uggacgagccaaccaauaa

SEQ ID NO: 3764 - RNA, 19 nt, Homo sapiens
ggucagaaggcgcgaguug

SEQ ID NO: 3765 - RNA, 19 nt, Homo sapiens
cagaaucgacccacacaga

SEQ ID NO: 3766 - RNA, 19 nt, Homo sapiens
augcagaccuguacauugu

SEQ ID NO: 3767 - RNA, 19 nt, Homo sapiens
gaagaaggacaagaagauc

SEQ ID NO: 3768 - RNA, 19 nt, Homo sapiens
gcacgagcccaucagacaa

SEQ ID NO: 3769 - RNA, 19 nt, Homo sapiens
acaaaguggugaagaaagg

SEQ ID NO: 3770 - RNA, 19 nt, Homo sapiens
aaaugcaucugacaucaag

SEQ ID NO: 3771 - RNA, 19 nt, Homo sapiens
ggaugaugauggagaagag

SEQ ID NO: 3772 - RNA, 19 nt, Homo sapiens
gauuuacccuacagcuuca

SEQ ID NO: 3773 - RNA, 19 nt, Homo sapiens
ugaagcgcccuaaggagua

SEQ ID NO: 3774 - RNA, 19 nt, Homo sapiens
cccagcggcuccacuacua

SEQ ID NO: 3775 - RNA, 19 nt, Homo sapiens
caagaaggcagagcagaug

SEQ ID NO: 3776 - RNA, 19 nt, Homo sapiens
ugucugcacugauaucauc

SEQ ID NO: 3777 - RNA, 19 nt, Homo sapiens
ccaaccaccuggaccucaa

SEQ ID NO: 3778 - RNA, 19 nt, Homo sapiens
gagaagguguaugaggaau

SEQ ID NO: 3779 - RNA, 19 nt, Homo sapiens
ggcuagagaagguguauga

SEQ ID NO: 3780 - RNA, 19 nt, Homo sapiens
ccaaacaagggaaggagaa

SEQ ID NO: 3781 - RNA, 19 nt, Homo sapiens
gagcuggcaguagaagaua

SEQ ID NO: 3782 - RNA, 19 nt, Homo sapiens
cagagcagcugcgcaugga

SEQ ID NO: 3783 - RNA, 19 nt, Homo sapiens
gauucaaggauuugcauug

SEQ ID NO: 3784 - RNA, 19 nt, Homo sapiens
acacugugcgcuucacuuu

SEQ ID NO: 3785 - RNA, 19 nt, Homo sapiens
aaucgauggugacuuugaa

SEQ ID NO: 3786 - RNA, 19 nt, Homo sapiens
gaauacaagggugcuguga

SEQ ID NO: 3787 - RNA, 19 nt, Homo sapiens
ugaagaaagggaagaagga

SEQ ID NO: 3788 - RNA, 19 nt, Homo sapiens
ggugguagcagaugagaca

SEQ ID NO: 3789 - RNA, 19 nt, Homo sapiens
gaggauaaagaagaagaaa

SEQ ID NO: 3790 - RNA, 19 nt, Homo sapiens
gagaacaucuuuaccuuua

SEQ ID NO: 3791 - RNA, 19 nt, Homo sapiens
gaacuuaucuuccuucuuc

SEQ ID NO: 3792 - RNA, 19 nt, Homo sapiens
gaagaaggcugugagcuua

SEQ ID NO: 3793 - RNA, 19 nt, Homo sapiens
ggacagagcuacacaucuu

SEQ ID NO: 3794 - RNA, 19 nt, Homo sapiens
uaaaugagcugauggaugu

SEQ ID NO: 3795 - RNA, 19 nt, Homo sapiens
ggaauugugucaaacuaua

SEQ ID NO: 3796 - RNA, 19 nt, Homo sapiens
caaaugcacucaucacaaa

SEQ ID NO: 3797 - RNA, 19 nt, Homo sapiens
gaacaucuccgacuucuug

SEQ ID NO: 3798 - RNA, 19 nt, Homo sapiens
gcacggaaauucuacaaga

SEQ ID NO: 3799 - RNA, 19 nt, Homo sapiens
gaacagagguauggaggaa

SEQ ID NO: 3800 - RNA, 19 nt, Homo sapiens
ggaaggauccuaucuauuc

SEQ ID NO: 3801 - RNA, 19 nt, Homo sapiens
guugcaaacuggaguauua

SEQ ID NO: 3802 - RNA, 19 nt, Homo sapiens
gcacacagaugaacaugau

SEQ ID NO: 3803 - RNA, 19 nt, Homo sapiens
gaagaaacacugacacuau

SEQ ID NO: 3804 - RNA, 19 nt, Homo sapiens
ggaagaggaauacgaauaa

SEQ ID NO: 3805 - RNA, 19 nt, Homo sapiens
guaguggugucaucuauuu

SEQ ID NO: 3806 - RNA, 19 nt, Homo sapiens
gaacaucuuuaccuuuaug

SEQ ID NO: 3807 - RNA, 19 nt, Homo sapiens
gagaaggaguugcgacuga

SEQ ID NO: 3808 - RNA, 19 nt, Homo sapiens
ggagagaauugcaggaaga

SEQ ID NO: 3809 - RNA, 19 nt, Homo sapiens
gaagaaagagcccuggaaa

SEQ ID NO: 3810 - RNA, 19 nt, Homo sapiens
gaacucguguggccuuuau

SEQ ID NO: 3811 - RNA, 19 nt, Homo sapiens
ggaagaauccuacauuaca

SEQ ID NO: 3812 - RNA, 19 nt, Homo sapiens
gguauucccugacauguau

SEQ ID NO: 3813 - RNA, 19 nt, Homo sapiens
gauccuaucuauucuuaug

SEQ ID NO: 3814 - RNA, 19 nt, Homo sapiens
gcaaggguauaucgagauu

SEQ ID NO: 3815 - RNA, 19 nt, Homo sapiens
ucugggacaucaugaauua

SEQ ID NO: 3816 - RNA, 19 nt, Homo sapiens
ccaagcaccuccaguuuau

SEQ ID NO: 3817 - RNA, 19 nt, Homo sapiens
ggaagcacuuguuggguuu

SEQ ID NO: 3818 - RNA, 19 nt, Homo sapiens
ggaauacgaauaagggaua

SEQ ID NO: 3819 - RNA, 19 nt, Homo sapiens
gcagacguccuccugaaua

SEQ ID NO: 3820 - RNA, 19 nt, Homo sapiens
ggacgauucuuucaugauc

SEQ ID NO: 3821 - RNA, 19 nt, Homo sapiens
caacugguaugaagacaau

SEQ ID NO: 3822 - RNA, 19 nt, Homo sapiens
gaaacugaagacaacauua

SEQ ID NO: 3823 - RNA, 19 nt, Homo sapiens
gggaucugcuccugaagua

SEQ ID NO: 3824 - RNA, 19 nt, Homo sapiens
gaccagguguuuguaaauu

SEQ ID NO: 3825 - RNA, 19 nt, Homo sapiens
gaacuaaccaagauuuauc

SEQ ID NO: 3826 - RNA, 19 nt, Homo sapiens
ugaccuaacuccagaacaa

SEQ ID NO: 3827 - RNA, 19 nt, Homo sapiens
caagagucguauuggcuua

SEQ ID NO: 3828 - RNA, 19 nt, Homo sapiens
gaagaacuggaacacguua

SEQ ID NO: 3829 - RNA, 19 nt, Homo sapiens
gaaggauacugaagaaugc

SEQ ID NO: 3830 - RNA, 19 nt, Homo sapiens
gcacgaaggauacugaaga

SEQ ID NO: 3831 - RNA, 19 nt, Homo sapiens
ggucaaagccugggaagaa

SEQ ID NO: 3832 - RNA, 19 nt, Homo sapiens
gggauugacuccacaagga

SEQ ID NO: 3833 - RNA, 19 nt, Homo sapiens
ugauguggcugaagaaaga

SEQ ID NO: 3834 - RNA, 19 nt, Homo sapiens
ggagugcauuggucaagaa

SEQ ID NO: 3835 - RNA, 19 nt, Homo sapiens
cguguggccuuuaucuuua

SEQ ID NO: 3836 - RNA, 19 nt, Homo sapiens
gcucugaugcuuucuauug

SEQ ID NO: 3837 - RNA, 19 nt, Homo sapiens
ggcacaggcuuguacuuaa

SEQ ID NO: 3838 - RNA, 19 nt, Homo sapiens
ggacauauuuaacaucacu

SEQ ID NO: 3839 - RNA, 19 nt, Homo sapiens
gauagaagacacucuguau

SEQ ID NO: 3840 - RNA, 19 nt, Homo sapiens
aagaaacacugacacuauu

SEQ ID NO: 3841 - RNA, 19 nt, Homo sapiens
gacaacagcacacagauga

SEQ ID NO: 3842 - RNA, 19 nt, Homo sapiens
gaauaagggauaucuugaa

SEQ ID NO: 3843 - RNA, 19 nt, Homo sapiens
caagaacuccucaugaaug

SEQ ID NO: 3844 - RNA, 19 nt, Homo sapiens
ccauauugcucucauuuca

SEQ ID NO: 3845 - RNA, 19 nt, Homo sapiens
caucucaaguccaaauuug

SEQ ID NO: 3846 - RNA, 19 nt, Homo sapiens
gagcugaucccguggaaga

SEQ ID NO: 3847 - RNA, 19 nt, Homo sapiens
ggagggacauauuuaacau

SEQ ID NO: 3848 - RNA, 19 nt, Homo sapiens
gcaaaugcacucaucacaa

SEQ ID NO: 3849 - RNA, 19 nt, Homo sapiens
gcccaggacugaucuuuca

SEQ ID NO: 3850 - RNA, 19 nt, Homo sapiens
cuaaggagcccauuguuga

SEQ ID NO: 3851 - RNA, 19 nt, Homo sapiens
ucacccagcuguuccagaa

SEQ ID NO: 3852 - RNA, 19 nt, Homo sapiens
gaagaauccuacauuacag

SEQ ID NO: 3853 - RNA, 19 nt, Homo sapiens
cuacacaucuugucccaau

SEQ ID NO: 3854 - RNA, 19 nt, Homo sapiens
caaauaagaacuucaagca

SEQ ID NO: 3855 - RNA, 19 nt, Homo sapiens
ugaagaggcucaggaccua

SEQ ID NO: 3856 - RNA, 19 nt, Homo sapiens
aaagacagguauugggauu

SEQ ID NO: 3857 - RNA, 19 nt, Homo sapiens
gcaggaagaggaauacgaa

SEQ ID NO: 3858 - RNA, 19 nt, Homo sapiens
ggaagcugcucauugucuu

SEQ ID NO: 3859 - RNA, 19 nt, Homo sapiens
aaacguauccugcucuuau

SEQ ID NO: 3860 - RNA, 19 nt, Homo sapiens
cagacguccuccugaauaa

SEQ ID NO: 3861 - RNA, 19 nt, Homo sapiens
ggauauaugggcagcagua

SEQ ID NO: 3862 - RNA, 19 nt, Homo sapiens
ggaccgcauugccaucauu

SEQ ID NO: 3863 - RNA, 19 nt, Homo sapiens
gaggagcacucugcaaauc

SEQ ID NO: 3864 - RNA, 19 nt, Homo sapiens
gaccuuggccggaucauga

SEQ ID NO: 3865 - RNA, 19 nt, Homo sapiens
gucaagagauuccaacaca

SEQ ID NO: 3866 - RNA, 19 nt, Homo sapiens
uggauaaguuugaaagcua

SEQ ID NO: 3867 - RNA, 19 nt, Homo sapiens
gguaugaagacaauaacua

SEQ ID NO: 3868 - RNA, 19 nt, Homo sapiens
ucugauaugucaccaagaa

SEQ ID NO: 3869 - RNA, 19 nt, Homo sapiens
gcagagccuuggcaugugu

SEQ ID NO: 3870 - RNA, 19 nt, Homo sapiens
gaaggauccuaucuauucu

SEQ ID NO: 3871 - RNA, 19 nt, Homo sapiens
cuugaaagaugaagaaaca

SEQ ID NO: 3872 - RNA, 19 nt, Homo sapiens
ggacucacccggagagaau

SEQ ID NO: 3873 - RNA, 19 nt, Homo sapiens
cagcauccuuccuguuuga

SEQ ID NO: 3874 - RNA, 19 nt, Homo sapiens
acagagguauggaggaauu

SEQ ID NO: 3875 - RNA, 19 nt, Homo sapiens
agagaaggcuggacagaca

SEQ ID NO: 3876 - RNA, 19 nt, Homo sapiens
ggauguaaaugagcugaug

SEQ ID NO: 3877 - RNA, 19 nt, Homo sapiens
gcacaggcuuguacuuaac

SEQ ID NO: 3878 - RNA, 19 nt, Homo sapiens
gaacuggacccugcggaaa

SEQ ID NO: 3879 - RNA, 19 nt, Homo sapiens
gcauggaucuacucugucu

SEQ ID NO: 3880 - RNA, 19 nt, Homo sapiens
gaaccgcuguuucccuauc

SEQ ID NO: 3881 - RNA, 19 nt, Homo sapiens
ggagugguauucccugaca

SEQ ID NO: 3882 - RNA, 19 nt, Homo sapiens
gcaaacuggaguauuaaga

SEQ ID NO: 3883 - RNA, 19 nt, Homo sapiens
ccagcuuuguccuuuauuu

SEQ ID NO: 3884 - RNA, 19 nt, Homo sapiens
gggagaagcucaccaugcu

SEQ ID NO: 3885 - RNA, 19 nt, Homo sapiens
cugaugcuuucuauuguua

SEQ ID NO: 3886 - RNA, 19 nt, Homo sapiens
gcacugcuccugcuguaug

SEQ ID NO: 3887 - RNA, 19 nt, Homo sapiens
aaggguggcuuccggagua

SEQ ID NO: 3888 - RNA, 19 nt, Homo sapiens
acacaggccuccaccacaa

SEQ ID NO: 3889 - RNA, 19 nt, Homo sapiens
guaccugguucgcuuugaa

SEQ ID NO: 3890 - RNA, 19 nt, Homo sapiens
gaaagaagcugcagucaug

SEQ ID NO: 3891 - RNA, 19 nt, Homo sapiens
ucaacaaacuggagaauaa

SEQ ID NO: 3892 - RNA, 19 nt, Homo sapiens
gaacugggcgaaugucuua

SEQ ID NO: 3893 - RNA, 19 nt, Homo sapiens
gaacagcuggugccaaaua

SEQ ID NO: 3894 - RNA, 19 nt, Homo sapiens
gggcgaaugucuuauuuaa

SEQ ID NO: 3895 - RNA, 19 nt, Homo sapiens
caaaguagauucuuacaag

SEQ ID NO: 3896 - RNA, 19 nt, Homo sapiens
ggaaaucagugacauagug

SEQ ID NO: 3897 - RNA, 19 nt, Homo sapiens
gcacggacaucaccaugaa

SEQ ID NO: 3898 - RNA, 19 nt, Homo sapiens
gagaaggacuaccgcauga

SEQ ID NO: 3899 - RNA, 19 nt, Homo sapiens
gaacugaggccuugugugu

SEQ ID NO: 3900 - RNA, 19 nt, Homo sapiens
caggacagcucuugauuug

SEQ ID NO: 3901 - RNA, 19 nt, Homo sapiens
cugaaagccucacguauuu

SEQ ID NO: 3902 - RNA, 19 nt, Homo sapiens
gugaacagcuggugccaaa

SEQ ID NO: 3903 - RNA, 19 nt, Homo sapiens
gcacacggcuggucacucu

SEQ ID NO: 3904 - RNA, 19 nt, Homo sapiens
gaagacauguuucaagaac

SEQ ID NO: 3905 - RNA, 19 nt, Homo sapiens
ccagaaggcugcccagaga

SEQ ID NO: 3906 - RNA, 19 nt, Homo sapiens
gaucaaacacccuaaccua

SEQ ID NO: 3907 - RNA, 19 nt, Homo sapiens
gaaggaaaucagugacaua

SEQ ID NO: 3908 - RNA, 19 nt, Homo sapiens
ucacugaguucaugaccua

SEQ ID NO: 3909 - RNA, 19 nt, Homo sapiens
gcaacaagcccacugucua

SEQ ID NO: 3910 - RNA, 19 nt, Homo sapiens
uguaugagcugcuagagaa

SEQ ID NO: 3911 - RNA, 19 nt, Homo sapiens
gauaacacucuaagcauaa

SEQ ID NO: 3912 - RNA, 19 nt, Homo sapiens
agauaacacucuaagcaua

SEQ ID NO: 3913 - RNA, 19 nt, Homo sapiens
ccaaaucuguccucuguag

SEQ ID NO: 3914 - RNA, 19 nt, Homo sapiens
gagcacgccugccaucuuc

SEQ ID NO: 3915 - RNA, 19 nt, Homo sapiens
gguccuggcugcacucuug

SEQ ID NO: 3916 - RNA, 19 nt, Homo sapiens
gcaaaugaggaacaaguuu

SEQ ID NO: 3917 - RNA, 19 nt, Homo sapiens
acacguaucucuugguaug

SEQ ID NO: 3918 - RNA, 19 nt, Homo sapiens
gaaauuguccaagcucaaa

SEQ ID NO: 3919 - RNA, 19 nt, Homo sapiens
gaagggaggguguaccauu

SEQ ID NO: 3920 - RNA, 19 nt, Homo sapiens
gcuuuacgcucaucaccua

SEQ ID NO: 3921 - RNA, 19 nt, Homo sapiens
gaagagggccgagacauca

SEQ ID NO: 3922 - RNA, 19 nt, Homo sapiens
ggagauaacacucuaagca

SEQ ID NO: 3923 - RNA, 19 nt, Homo sapiens
gaaaaugaccccaaccuuu

SEQ ID NO: 3924 - RNA, 19 nt, Homo sapiens
ucagcaagcuccucaguuc

SEQ ID NO: 3925 - RNA, 19 nt, Homo sapiens
gagaaggucuaugaacuca

SEQ ID NO: 3926 - RNA, 19 nt, Homo sapiens
aagggaggguguaccauua

SEQ ID NO: 3927 - RNA, 19 nt, Homo sapiens
gccaguagcaucugacuuu

SEQ ID NO: 3928 - RNA, 19 nt, Homo sapiens
gcaggacagcucuugauuu

SEQ ID NO: 3929 - RNA, 19 nt, Homo sapiens
caacaagcccacugucuau

SEQ ID NO: 3930 - RNA, 19 nt, Homo sapiens
gcgauccucuggaccauga

SEQ ID NO: 3931 - RNA, 19 nt, Homo sapiens
ccaccaagccuuugaaaca

SEQ ID NO: 3932 - RNA, 19 nt, Homo sapiens
caaacacccuaaccuagug

SEQ ID NO: 3933 - RNA, 19 nt, Homo sapiens
aagcauaacuaaaggugaa

SEQ ID NO: 3934 - RNA, 19 nt, Homo sapiens
cuucaucccucucauauca

SEQ ID NO: 3935 - RNA, 19 nt, Homo sapiens
ccauggagguggaagaguu

SEQ ID NO: 3936 - RNA, 19 nt, Homo sapiens
uuacacguaucucuuggua

SEQ ID NO: 3937 - RNA, 19 nt, Homo sapiens
gcccagagaaggucuauga

SEQ ID NO: 3938 - RNA, 19 nt, Homo sapiens
uggaguaccuagagaagaa

SEQ ID NO: 3939 - RNA, 19 nt, Homo sapiens
gaacaagacagccuucacu

SEQ ID NO: 3940 - RNA, 19 nt, Homo sapiens
gaaccguccuuucacacau

SEQ ID NO: 3941 - RNA, 19 nt, Homo sapiens
ugaggaagcugcugaugag

SEQ ID NO: 3942 - RNA, 19 nt, Homo sapiens
ucaacagucuggagaaaca

SEQ ID NO: 3943 - RNA, 19 nt, Homo sapiens
ccacugacgugccugagau

SEQ ID NO: 3944 - RNA, 19 nt, Homo sapiens
uaucaucacugaguucaug

SEQ ID NO: 3945 - RNA, 19 nt, Homo sapiens
ucuguccucuguaguauuu

SEQ ID NO: 3946 - RNA, 19 nt, Homo sapiens
ucaguucggugaaggaaau

SEQ ID NO: 3947 - RNA, 19 nt, Homo sapiens
cagagaaggucuaugaacu

SEQ ID NO: 3948 - RNA, 19 nt, Homo sapiens
guacauggccacucagauc

SEQ ID NO: 3949 - RNA, 19 nt, Homo sapiens
ccugaaagccucacguauu

SEQ ID NO: 3950 - RNA, 19 nt, Homo sapiens
gagaggccaucaacaaacu

SEQ ID NO: 3951 - RNA, 19 nt, Homo sapiens
caaggaagaagccuggaaa

SEQ ID NO: 3952 - RNA, 19 nt, Homo sapiens
ugaaauccaccaagccuuu

SEQ ID NO: 3953 - RNA, 19 nt, Homo sapiens
gcauuuggaguauugcuuu

SEQ ID NO: 3954 - RNA, 19 nt, Homo sapiens
gaguauugcuuugggaaau

SEQ ID NO: 3955 - RNA, 19 nt, Homo sapiens
gugaugugccacuauauuu

SEQ ID NO: 3956 - RNA, 19 nt, Homo sapiens
gcucaucaccuaaacuugu

SEQ ID NO: 3957 - RNA, 19 nt, Homo sapiens
gaauggaagccugaacuga

SEQ ID NO: 3958 - RNA, 19 nt, Homo sapiens
uacagcacaucaccucuuu

SEQ ID NO: 3959 - RNA, 19 nt, Homo sapiens
ggaagagggccgagacauc

SEQ ID NO: 3960 - RNA, 19 nt, Homo sapiens
caagacagccuucacuuuu

SEQ ID NO: 3961 - RNA, 19 nt, Homo sapiens
caccaagccuuugaaacaa

SEQ ID NO: 3962 - RNA, 19 nt, Homo sapiens
ucaacacccuggccgaguu

SEQ ID NO: 3963 - RNA, 19 nt, Homo sapiens
gaucaauggcagcuucuug

SEQ ID NO: 3964 - RNA, 19 nt, Homo sapiens
gguuuccucuggaucguuu

SEQ ID NO: 3965 - RNA, 19 nt, Homo sapiens
ucguugcacuguaugauuu

SEQ ID NO: 3966 - RNA, 19 nt, Homo sapiens
aagcugcagucaugaaaga

SEQ ID NO: 3967 - RNA, 19 nt, Homo sapiens
gcccagcucuugcucucuu

SEQ ID NO: 3968 - RNA, 19 nt, Homo sapiens
gccgaggaguccagaguga

SEQ ID NO: 3969 - RNA, 19 nt, Homo sapiens
acaacaaguucuccaucaa

SEQ ID NO: 3970 - RNA, 19 nt, Homo sapiens
uacaacaaguucuccauca

SEQ ID NO: 3971 - RNA, 19 nt, Homo sapiens
ggaucaacacugcuucuga

SEQ ID NO: 3972 - RNA, 19 nt, Homo sapiens
gcauguccuuuccaucugu

SEQ ID NO: 3973 - RNA, 19 nt, Homo sapiens
gcugagaagggacuaguga

SEQ ID NO: 3974 - RNA, 19 nt, Homo sapiens
gagauaacacucuaagcau

SEQ ID NO: 3975 - RNA, 19 nt, Homo sapiens
gcacaggcccuagcuuuac

SEQ ID NO: 3976 - RNA, 19 nt, Homo sapiens
acaagacagccuucacuuu

SEQ ID NO: 3977 - RNA, 19 nt, Homo sapiens
ugugaauccuggcaagaaa

SEQ ID NO: 3978 - RNA, 19 nt, Homo sapiens
ccaagccuuugaaacaaug

SEQ ID NO: 3979 - RNA, 19 nt, Homo sapiens
ccgagagccuggccuacaa

SEQ ID NO: 3980 - RNA, 19 nt, Homo sapiens
ccaggaauccaguaucuca

SEQ ID NO: 3981 - RNA, 19 nt, Homo sapiens
gaaggacuaccgcaugaag

SEQ ID NO: 3982 - RNA, 19 nt, Homo sapiens
aaaucuguccucuguagua

SEQ ID NO: 3983 - RNA, 19 nt, Homo sapiens
aacgugaugugccacuaua

SEQ ID NO: 3984 - RNA, 19 nt, Homo sapiens
ucaccuaaacuuguacuuu

SEQ ID NO: 3985 - RNA, 19 nt, Homo sapiens
gggcauguccuuuccaucu

SEQ ID NO: 3986 - RNA, 19 nt, Homo sapiens
ggaaauuguccaagcucaa

SEQ ID NO: 3987 - RNA, 19 nt, Homo sapiens
guauugcuuugggaaauug

SEQ ID NO: 3988 - RNA, 19 nt, Homo sapiens
cgucugggcauuuggagua

SEQ ID NO: 3989 - RNA, 19 nt, Homo sapiens
uggugaagguagcugauuu

SEQ ID NO: 3990 - RNA, 19 nt, Homo sapiens
gaaagaagcugcagucaug

SEQ ID NO: 3991 - RNA, 19 nt, Homo sapiens
ucaacaaacuggagaauaa

SEQ ID NO: 3992 - RNA, 19 nt, Homo sapiens
gaacugggcgaaugucuua

SEQ ID NO: 3993 - RNA, 19 nt, Homo sapiens
gaacagcuggugccaaaua

SEQ ID NO: 3994 - RNA, 19 nt, Homo sapiens
gggcgaaugucuuauuuaa

SEQ ID NO: 3995 - RNA, 19 nt, Homo sapiens
caaaguagauucuuacaag

SEQ ID NO: 3996 - RNA, 19 nt, Homo sapiens
ggaaaucagugacauagug

SEQ ID NO: 3997 - RNA, 19 nt, Homo sapiens
gcacggacaucaccaugaa

SEQ ID NO: 3998 - RNA, 19 nt, Homo sapiens
gagaaggacuaccgcauga

SEQ ID NO: 3999 - RNA, 19 nt, Homo sapiens
gaacugaggccuugugugu

SEQ ID NO: 4000 - RNA, 19 nt, Homo sapiens
caggacagcucuugauuug

SEQ ID NO: 4001 - RNA, 19 nt, Homo sapiens
cugaaagccucacguauuu

SEQ ID NO: 4002 - RNA, 19 nt, Homo sapiens
gugaacagcuggugccaaa

SEQ ID NO: 4003 - RNA, 19 nt, Homo sapiens
gcacacggcuggucacucu

SEQ ID NO: 4004 - RNA, 19 nt, Homo sapiens
gaagacauguuucaagaac

SEQ ID NO: 4005 - RNA, 19 nt, Homo sapiens
ccagaaggcugcccagaga

SEQ ID NO: 4006 - RNA, 19 nt, Homo sapiens
gaucaaacacccuaaccua

SEQ ID NO: 4007 - RNA, 19 nt, Homo sapiens
gguccacacugcaauguuu

SEQ ID NO: 4008 - RNA, 19 nt, Homo sapiens
gaaggaaaucagugacaua

SEQ ID NO: 4009 - RNA, 19 nt, Homo sapiens
ucacugaguucaugaccua

SEQ ID NO: 4010 - RNA, 19 nt, Homo sapiens
gcaacaagcccacugucua

SEQ ID NO: 4011 - RNA, 19 nt, Homo sapiens
uguaugagcugcuagagaa

SEQ ID NO: 4012 - RNA, 19 nt, Homo sapiens
gauaacacucuaagcauaa

SEQ ID NO: 4013 - RNA, 19 nt, Homo sapiens
agauaacacucuaagcaua

SEQ ID NO: 4014 - RNA, 19 nt, Homo sapiens
ccaaaucuguccucuguag

SEQ ID NO: 4015 - RNA, 19 nt, Homo sapiens
gagcacgccugccaucuuc

SEQ ID NO: 4016 - RNA, 19 nt, Homo sapiens
gguccuggcugcacucuug

SEQ ID NO: 4017 - RNA, 19 nt, Homo sapiens
gcaaaugaggaacaaguuu

SEQ ID NO: 4018 - RNA, 19 nt, Homo sapiens
acacguaucucuugguaug

SEQ ID NO: 4019 - RNA, 19 nt, Homo sapiens
gaaauuguccaagcucaaa

SEQ ID NO: 4020 - RNA, 19 nt, Homo sapiens
gaagggaggguguaccauu

SEQ ID NO: 4021 - RNA, 19 nt, Homo sapiens
gcuuuacgcucaucaccua

SEQ ID NO: 4022 - RNA, 19 nt, Homo sapiens
gaagagggccgagacauca

SEQ ID NO: 4023 - RNA, 19 nt, Homo sapiens
ggagauaacacucuaagca

SEQ ID NO: 4024 - RNA, 19 nt, Homo sapiens
gaaaaugaccccaaccuuu

SEQ ID NO: 4025 - RNA, 19 nt, Homo sapiens
ucagcaagcuccucaguuc

SEQ ID NO: 4026 - RNA, 19 nt, Homo sapiens
gagaaggucuaugaacuca

SEQ ID NO: 4027 - RNA, 19 nt, Homo sapiens
aagggaggguguaccauua

SEQ ID NO: 4028 - RNA, 19 nt, Homo sapiens
gccaguagcaucugacuuu

SEQ ID NO: 4029 - RNA, 19 nt, Homo sapiens
gcaggacagcucuugauuu

SEQ ID NO: 4030 - RNA, 19 nt, Homo sapiens
caacaagcccacugucuau

SEQ ID NO: 4031 - RNA, 19 nt, Homo sapiens
gcgauccucuggaccauga

SEQ ID NO: 4032 - RNA, 19 nt, Homo sapiens
ccaccaagccuuugaaaca

SEQ ID NO: 4033 - RNA, 19 nt, Homo sapiens
caaacacccuaaccuagug

SEQ ID NO: 4034 - RNA, 19 nt, Homo sapiens
aagcauaacuaaaggugaa

SEQ ID NO: 4035 - RNA, 19 nt, Homo sapiens
cuucaucccucucauauca

SEQ ID NO: 4036 - RNA, 19 nt, Homo sapiens
ccauggagguggaagaguu

SEQ ID NO: 4037 - RNA, 19 nt, Homo sapiens
uuacacguaucucuuggua

SEQ ID NO: 4038 - RNA, 19 nt, Homo sapiens
gcccagagaaggucuauga

SEQ ID NO: 4039 - RNA, 19 nt, Homo sapiens
uggaguaccuagagaagaa

SEQ ID NO: 4040 - RNA, 19 nt, Homo sapiens
gaacaagacagccuucacu

SEQ ID NO: 4041 - RNA, 19 nt, Homo sapiens
gaaccguccuuucacacau

SEQ ID NO: 4042 - RNA, 19 nt, Homo sapiens
ugaggaagcugcugaugag

SEQ ID NO: 4043 - RNA, 19 nt, Homo sapiens
ucaacagucuggagaaaca

SEQ ID NO: 4044 - RNA, 19 nt, Homo sapiens
ccacugacgugccugagau

SEQ ID NO: 4045 - RNA, 19 nt, Homo sapiens
uaucaucacugaguucaug

SEQ ID NO: 4046 - RNA, 19 nt, Homo sapiens
ucuguccucuguaguauuu

SEQ ID NO: 4047 - RNA, 19 nt, Homo sapiens
ucaguucggugaaggaaau

SEQ ID NO: 4048 - RNA, 19 nt, Homo sapiens
cagagaaggucuaugaacu

SEQ ID NO: 4049 - RNA, 19 nt, Homo sapiens
guacauggccacucagauc

SEQ ID NO: 4050 - RNA, 19 nt, Homo sapiens
ccugaaagccucacguauu

SEQ ID NO: 4051 - RNA, 19 nt, Homo sapiens
gcagcagccuggaaaagua

SEQ ID NO: 4052 - RNA, 19 nt, Homo sapiens
gagaggccaucaacaaacu

SEQ ID NO: 4053 - RNA, 19 nt, Homo sapiens
caaggaagaagccuggaaa

SEQ ID NO: 4054 - RNA, 19 nt, Homo sapiens
ugaaauccaccaagccuuu

SEQ ID NO: 4055 - RNA, 19 nt, Homo sapiens
gcauuuggaguauugcuuu

SEQ ID NO: 4056 - RNA, 19 nt, Homo sapiens
gaguauugcuuugggaaau

SEQ ID NO: 4057 - RNA, 19 nt, Homo sapiens
gugaugugccacuauauuu

SEQ ID NO: 4058 - RNA, 19 nt, Homo sapiens
gcucaucaccuaaacuugu

SEQ ID NO: 4059 - RNA, 19 nt, Homo sapiens
gaauggaagccugaacuga

SEQ ID NO: 4060 - RNA, 19 nt, Homo sapiens
uacagcacaucaccucuuu

SEQ ID NO: 4061 - RNA, 19 nt, Homo sapiens
ggaagagggccgagacauc

SEQ ID NO: 4062 - RNA, 19 nt, Homo sapiens
caagacagccuucacuuuu

SEQ ID NO: 4063 - RNA, 19 nt, Homo sapiens
caccaagccuuugaaacaa

SEQ ID NO: 4064 - RNA, 19 nt, Homo sapiens
ucaacacccuggccgaguu

SEQ ID NO: 4065 - RNA, 19 nt, Homo sapiens
gaucaauggcagcuucuug

SEQ ID NO: 4066 - RNA, 19 nt, Homo sapiens
gguuuccucuggaucguuu

SEQ ID NO: 4067 - RNA, 19 nt, Homo sapiens
ucguugcacuguaugauuu

SEQ ID NO: 4068 - RNA, 19 nt, Homo sapiens
aagcugcagucaugaaaga

SEQ ID NO: 4069 - RNA, 19 nt, Homo sapiens
gcccagcucuugcucucuu

SEQ ID NO: 4070 - RNA, 19 nt, Homo sapiens
gccgaggaguccagaguga

SEQ ID NO: 4071 - RNA, 19 nt, Homo sapiens
acaacaaguucuccaucaa

SEQ ID NO: 4072 - RNA, 19 nt, Homo sapiens
uacaacaaguucuccauca

SEQ ID NO: 4073 - RNA, 19 nt, Homo sapiens
ggaucaacacugcuucuga

SEQ ID NO: 4074 - RNA, 19 nt, Homo sapiens
gcauguccuuuccaucugu

SEQ ID NO: 4075 - RNA, 19 nt, Homo sapiens
gcugagaagggacuaguga

SEQ ID NO: 4076 - RNA, 19 nt, Homo sapiens
gagauaacacucuaagcau

SEQ ID NO: 4077 - RNA, 19 nt, Homo sapiens
gcacaggcccuagcuuuac

SEQ ID NO: 4078 - RNA, 19 nt, Homo sapiens
acaagacagccuucacuuu

SEQ ID NO: 4079 - RNA, 19 nt, Homo sapiens
ugugaauccuggcaagaaa

SEQ ID NO: 4080 - RNA, 19 nt, Homo sapiens
gagcagggaagaaggaauc

SEQ ID NO: 4081 - RNA, 19 nt, Homo sapiens
ccaagccuuugaaacaaug

SEQ ID NO: 4082 - RNA, 19 nt, Homo sapiens
ccgagagccuggccuacaa

SEQ ID NO: 4083 - RNA, 19 nt, Homo sapiens
caaaggagcagggaagaag

SEQ ID NO: 4084 - RNA, 19 nt, Homo sapiens
ccaggaauccaguaucuca

SEQ ID NO: 4085 - RNA, 19 nt, Homo sapiens
gaaggacuaccgcaugaag

SEQ ID NO: 4086 - RNA, 19 nt, Homo sapiens
aaaucuguccucuguagua

SEQ ID NO: 4087 - RNA, 19 nt, Homo sapiens
aacgugaugugccacuaua

SEQ ID NO: 4088 - RNA, 19 nt, Homo sapiens
ucaccuaaacuuguacuuu

SEQ ID NO: 4089 - RNA, 19 nt, Homo sapiens
gggcauguccuuuccaucu

SEQ ID NO: 4090 - RNA, 19 nt, Homo sapiens
aaaggaagcugcccaagua

SEQ ID NO: 4091 - RNA, 19 nt, Homo sapiens
gcacuuuaauuccaacuuu

SEQ ID NO: 4092 - RNA, 19 nt, Homo sapiens
gcaguuggcuuaucauaca

SEQ ID NO: 4093 - RNA, 19 nt, Homo sapiens
caucaguucuuccucaaua

SEQ ID NO: 4094 - RNA, 19 nt, Homo sapiens
cuucaacugucuacaauua

SEQ ID NO: 4095 - RNA, 19 nt, Homo sapiens
gugcugagguuucuggaua

SEQ ID NO: 4096 - RNA, 19 nt, Homo sapiens
ggaacuggcucggaaguau

SEQ ID NO: 4097 - RNA, 19 nt, Homo sapiens
ccaaguaccugcucuuuac

SEQ ID NO: 4098 - RNA, 19 nt, Homo sapiens
caacauacacacucacuug

SEQ ID NO: 4099 - RNA, 19 nt, Homo sapiens
gagagcgcauugccuauga

SEQ ID NO: 4100 - RNA, 19 nt, Homo sapiens
ccaccuuccuggacacuuu

SEQ ID NO: 4101 - RNA, 19 nt, Homo sapiens
ccaccugauuggcaacaua

SEQ ID NO: 4102 - RNA, 19 nt, Homo sapiens
gauuacauuugggacuuua

SEQ ID NO: 4103 - RNA, 19 nt, Homo sapiens
caacuucaacugucuacaa

SEQ ID NO: 4104 - RNA, 19 nt, Homo sapiens
caacaacgagaacauugaa

SEQ ID NO: 4105 - RNA, 19 nt, Homo sapiens
ucaacugucuacaauuaug

SEQ ID NO: 4106 - RNA, 19 nt, Homo sapiens
gggcaacgcugugcucuac

SEQ ID NO: 4107 - RNA, 19 nt, Homo sapiens
aaagguggcuucaacuucu

SEQ ID NO: 4108 - RNA, 19 nt, Homo sapiens
gaucaugggagcacagaug

SEQ ID NO: 4109 - RNA, 19 nt, Homo sapiens
ccaccaccauggccaagaa

SEQ ID NO: 4110 - RNA, 19 nt, Homo sapiens
gaacuggcucggaaguaug

SEQ ID NO: 4111 - RNA, 19 nt, Homo sapiens
gcugagguuucuggauaaa

SEQ ID NO: 4112 - RNA, 19 nt, Homo sapiens
ugaaggcagugcacagcuu

SEQ ID NO: 4113 - RNA, 19 nt, Homo sapiens
acacucacuuggugcacua

SEQ ID NO: 4114 - RNA, 19 nt, Homo sapiens
caacugucuacaauuauga

SEQ ID NO: 4115 - RNA, 19 nt, Homo sapiens
uaaagguggcuucaacuuc

SEQ ID NO: 4116 - RNA, 19 nt, Homo sapiens
caagaacagcuuccagaca

SEQ ID NO: 4117 - RNA, 19 nt, Homo sapiens
gagaugcugcugcccaaga

SEQ ID NO: 4118 - RNA, 19 nt, Homo sapiens
ucacaacaacgagaacauu

SEQ ID NO: 4119 - RNA, 19 nt, Homo sapiens
ggagagcgcauugccuaug

SEQ ID NO: 4120 - RNA, 19 nt, Homo sapiens
gcucggaaguaugcagaug

SEQ ID NO: 4121 - RNA, 19 nt, Homo sapiens
ggcagacaauaaacucuca

SEQ ID NO: 4122 - RNA, 19 nt, Homo sapiens
ggacacuuuccacuacuau

SEQ ID NO: 4123 - RNA, 19 nt, Homo sapiens
ccaagacugccaugacaga

SEQ ID NO: 4124 - RNA, 19 nt, Homo sapiens
acacuuuccacuacuauga

SEQ ID NO: 4125 - RNA, 19 nt, Homo sapiens
cccaaguaccugcucuuua

SEQ ID NO: 4126 - RNA, 19 nt, Homo sapiens
ugagguuucuggauaaagg

SEQ ID NO: 4127 - RNA, 19 nt, Homo sapiens
uccagacacugcagaugaa

SEQ ID NO: 4128 - RNA, 19 nt, Homo sapiens
guacaacgggaaguucuau

SEQ ID NO: 4129 - RNA, 19 nt, Homo sapiens
aagaggcaguggcgcugua

SEQ ID NO: 4130 - RNA, 19 nt, Homo sapiens
ugauuacauuugggacuuu

SEQ ID NO: 4131 - RNA, 19 nt, Homo sapiens
cgagcccucugccucuuug

SEQ ID NO: 4132 - RNA, 19 nt, Homo sapiens
ccacaggcuucucauucca

SEQ ID NO: 4133 - RNA, 19 nt, Homo sapiens
gcuacaaugggaccuauag

SEQ ID NO: 4134 - RNA, 19 nt, Homo sapiens
cagaggacauucccaacac

SEQ ID NO: 4135 - RNA, 19 nt, Homo sapiens
ggugauggaggccaagaug

SEQ ID NO: 4136 - RNA, 19 nt, Homo sapiens
gguacaacgggaaguucua

SEQ ID NO: 4137 - RNA, 19 nt, Homo sapiens
acaacaacgagaacauuga

SEQ ID NO: 4138 - RNA, 19 nt, Homo sapiens
cacaacaacgagaacauug

SEQ ID NO: 4139 - RNA, 19 nt, Homo sapiens
gcaguuucuucacaacaac

SEQ ID NO: 4140 - RNA, 19 nt, Homo sapiens
gcccaaguaccugcucuuu

SEQ ID NO: 4141 - RNA, 19 nt, Homo sapiens
gcaacauacacacucacuu

SEQ ID NO: 4142 - RNA, 19 nt, Homo sapiens
ccaggagcaucccaauguc

SEQ ID NO: 4143 - RNA, 19 nt, Homo sapiens
gcaucuaccaccagaacga

SEQ ID NO: 4144 - RNA, 19 nt, Homo sapiens
agaugcugcugcccaagaa

SEQ ID NO: 4145 - RNA, 19 nt, Homo sapiens
cgccgcaguuggcuuauca

SEQ ID NO: 4146 - RNA, 19 nt, Homo sapiens
uaccacaggcuucucauuc

SEQ ID NO: 4147 - RNA, 19 nt, Homo sapiens
gcccucugccucuuugaaa

SEQ ID NO: 4148 - RNA, 19 nt, Homo sapiens
caauaccacaggcuucuca

SEQ ID NO: 4149 - RNA, 19 nt, Homo sapiens
uagcuacaaugggaccuau

SEQ ID NO: 4150 - RNA, 19 nt, Homo sapiens
uuugggacuuuaucuucua

SEQ ID NO: 4151 - RNA, 19 nt, Homo sapiens
ucggaaguaugcagaugga

SEQ ID NO: 4152 - RNA, 19 nt, Homo sapiens
ucagaggacauucccaaca

SEQ ID NO: 4153 - RNA, 19 nt, Homo sapiens
gagcaguuucuucacaaca

SEQ ID NO: 4154 - RNA, 19 nt, Homo sapiens
cauuugggacuuuaucuuc

SEQ ID NO: 4155 - RNA, 19 nt, Homo sapiens
uuaaagguggcuucaacuu

SEQ ID NO: 4156 - RNA, 19 nt, Homo sapiens
ccguggagcagguguggua

SEQ ID NO: 4157 - RNA, 19 nt, Homo sapiens
ccgcaguuggcuuaucaua

SEQ ID NO: 4158 - RNA, 19 nt, Homo sapiens
gaccaggagcaucccaaug

SEQ ID NO: 4159 - RNA, 19 nt, Homo sapiens
gaccaaguaccucgauguc

SEQ ID NO: 4160 - RNA, 19 nt, Homo sapiens
uggagcaggugugguacaa

SEQ ID NO: 4161 - RNA, 19 nt, Homo sapiens
aagguggcuucaacuucua

SEQ ID NO: 4162 - RNA, 19 nt, Homo sapiens
cuuuaaagguggcuucaac

SEQ ID NO: 4163 - RNA, 19 nt, Homo sapiens
caggcaugcagaccaagua

SEQ ID NO: 4164 - RNA, 19 nt, Homo sapiens
cugcagcccuccaguacca

SEQ ID NO: 4165 - RNA, 19 nt, Homo sapiens
caucuccacagcagaguau

SEQ ID NO: 4166 - RNA, 19 nt, Homo sapiens
cccuggcagugaccaagua

SEQ ID NO: 4167 - RNA, 19 nt, Homo sapiens
cacugcagaugaagcuaga

SEQ ID NO: 4168 - RNA, 19 nt, Homo sapiens
gauguggcaggcaccaaga

SEQ ID NO: 4169 - RNA, 19 nt, Homo sapiens
aacuucaacugucuacaau

SEQ ID NO: 4170 - RNA, 19 nt, Homo sapiens
gcagaccaaguaccucgau

SEQ ID NO: 4171 - RNA, 19 nt, Homo sapiens
uuccaagacugccaugaca

SEQ ID NO: 4172 - RNA, 19 nt, Homo sapiens
ccaagccccugcaucaguu

SEQ ID NO: 4173 - RNA, 19 nt, Homo sapiens
ccagagacacugugaucgu

SEQ ID NO: 4174 - RNA, 19 nt, Homo sapiens
gcauccagagacacuguga

SEQ ID NO: 4175 - RNA, 19 nt, Homo sapiens
gcuccggccauucaacuuc

SEQ ID NO: 4176 - RNA, 19 nt, Homo sapiens
agcaguuucuucacaacaa

SEQ ID NO: 4177 - RNA, 19 nt, Homo sapiens
uugagcaguuucuucacaa

SEQ ID NO: 4178 - RNA, 19 nt, Homo sapiens
cguggucuuugagcaguuu

SEQ ID NO: 4179 - RNA, 19 nt, Homo sapiens
ggcggcacuuuaauuccaa

SEQ ID NO: 4180 - RNA, 19 nt, Homo sapiens
ugcugagguuucuggauaa

SEQ ID NO: 4181 - RNA, 19 nt, Homo sapiens
gaaagaagcugcaguaaug

SEQ ID NO: 4182 - RNA, 19 nt, Homo sapiens
gaacagauauuaccaugaa

SEQ ID NO: 4183 - RNA, 19 nt, Homo sapiens
gaaguucgcucuaagaaug

SEQ ID NO: 4184 - RNA, 19 nt, Homo sapiens
ggagccaaauuuccuauua

SEQ ID NO: 4185 - RNA, 19 nt, Homo sapiens
gaaauggagcgaacagaua

SEQ ID NO: 4186 - RNA, 19 nt, Homo sapiens
gaagagaaaugcuccuaca

SEQ ID NO: 4187 - RNA, 19 nt, Homo sapiens
gcacaggccucuaguggau

SEQ ID NO: 4188 - RNA, 19 nt, Homo sapiens
ggaaauugcuaccuaugga

SEQ ID NO: 4189 - RNA, 19 nt, Homo sapiens
gagccaaauuuccuauuaa

SEQ ID NO: 4190 - RNA, 19 nt, Homo sapiens
guaauaagccuacagucua

SEQ ID NO: 4191 - RNA, 19 nt, Homo sapiens
ggagugaaguucgcucuaa

SEQ ID NO: 4192 - RNA, 19 nt, Homo sapiens
gaagaagaauuucauccau

SEQ ID NO: 4193 - RNA, 19 nt, Homo sapiens
caaacccuguccuuaauaa

SEQ ID NO: 4194 - RNA, 19 nt, Homo sapiens
ccaaugacaugcuuccaaa

SEQ ID NO: 4195 - RNA, 19 nt, Homo sapiens
ggaaugugcugaccuacug

SEQ ID NO: 4196 - RNA, 19 nt, Homo sapiens
gaucaggacacuucacuuu

SEQ ID NO: 4197 - RNA, 19 nt, Homo sapiens
cagcauuucugaagaggua

SEQ ID NO: 4198 - RNA, 19 nt, Homo sapiens
gaaauacagccuuacaguu

SEQ ID NO: 4199 - RNA, 19 nt, Homo sapiens
gcagagguagccacuguua

SEQ ID NO: 4200 - RNA, 19 nt, Homo sapiens
gaacaaggagaacauugaa

SEQ ID NO: 4201 - RNA, 19 nt, Homo sapiens
gcaauggaguacuuagaga

SEQ ID NO: 4202 - RNA, 19 nt, Homo sapiens
ggacagggccaaugacaug

SEQ ID NO: 4203 - RNA, 19 nt, Homo sapiens
uagaagaauuccugaaaga

SEQ ID NO: 4204 - RNA, 19 nt, Homo sapiens
agaaacagguggagaacaa

SEQ ID NO: 4205 - RNA, 19 nt, Homo sapiens
uggaagaaauacagccuua

SEQ ID NO: 4206 - RNA, 19 nt, Homo sapiens
gacaccagcugcuugacua

SEQ ID NO: 4207 - RNA, 19 nt, Homo sapiens
gcucagacccuacagaaga

SEQ ID NO: 4208 - RNA, 19 nt, Homo sapiens
gcagagaucaggacacuuc

SEQ ID NO: 4209 - RNA, 19 nt, Homo sapiens
gcugauggguucucuuuca

SEQ ID NO: 4210 - RNA, 19 nt, Homo sapiens
gguaacuucucaucuguug

SEQ ID NO: 4211 - RNA, 19 nt, Homo sapiens
cgucaucuguuguuccaua

SEQ ID NO: 4212 - RNA, 19 nt, Homo sapiens
uaauaagccuacagucuau

SEQ ID NO: 4213 - RNA, 19 nt, Homo sapiens
gcucagcagucuaaucaau

SEQ ID NO: 4214 - RNA, 19 nt, Homo sapiens
caaacaggccgcugagaaa

SEQ ID NO: 4215 - RNA, 19 nt, Homo sapiens
aaauucugcuuccaguuua

SEQ ID NO: 4216 - RNA, 19 nt, Homo sapiens
cagagagucuugccuacaa

SEQ ID NO: 4217 - RNA, 19 nt, Homo sapiens
gguagaagaauuccugaaa

SEQ ID NO: 4218 - RNA, 19 nt, Homo sapiens
gaagaaauacagccuuaca

SEQ ID NO: 4219 - RNA, 19 nt, Homo sapiens
gcuggaaugugcugaccua

SEQ ID NO: 4220 - RNA, 19 nt, Homo sapiens
ggaauuugcuggauuaccu

SEQ ID NO: 4221 - RNA, 19 nt, Homo sapiens
guagaagaauuccugaaag

SEQ ID NO: 4222 - RNA, 19 nt, Homo sapiens
ccauggagguagaagaauu

SEQ ID NO: 4223 - RNA, 19 nt, Homo sapiens
aauacgaacucacggguaa

SEQ ID NO: 4224 - RNA, 19 nt, Homo sapiens
gaaaucaagcauccuaauc

SEQ ID NO: 4225 - RNA, 19 nt, Homo sapiens
gaagaauuccugaaagaag

SEQ ID NO: 4226 - RNA, 19 nt, Homo sapiens
aaauacagccuuacaguug

SEQ ID NO: 4227 - RNA, 19 nt, Homo sapiens
gaaaaucucagcagacaaa

SEQ ID NO: 4228 - RNA, 19 nt, Homo sapiens
ccaaauuuccuauuaagug

SEQ ID NO: 4229 - RNA, 19 nt, Homo sapiens
aauucaagcucuuaucuga

SEQ ID NO: 4230 - RNA, 19 nt, Homo sapiens
cgacuuaacagaagcuuug

SEQ ID NO: 4231 - RNA, 19 nt, Homo sapiens
gauaacacacucagcauca

SEQ ID NO: 4232 - RNA, 19 nt, Homo sapiens
ggaaauggagcgaacagau

SEQ ID NO: 4233 - RNA, 19 nt, Homo sapiens
gugcagagguagccacugu

SEQ ID NO: 4234 - RNA, 19 nt, Homo sapiens
gcacaagaugccacagaaa

SEQ ID NO: 4235 - RNA, 19 nt, Homo sapiens
agaagaauuucauccauag

SEQ ID NO: 4236 - RNA, 19 nt, Homo sapiens
cuacauggccacucagauu

SEQ ID NO: 4237 - RNA, 19 nt, Homo sapiens
ccaaacaggccgcugagaa

SEQ ID NO: 4238 - RNA, 19 nt, Homo sapiens
gaaauugcuaccuauggaa

SEQ ID NO: 4239 - RNA, 19 nt, Homo sapiens
caagcauccuaaucuggua

SEQ ID NO: 4240 - RNA, 19 nt, Homo sapiens
gcacagcagguacuaaagu

SEQ ID NO: 4241 - RNA, 19 nt, Homo sapiens
gaucuagccauuacagaga

SEQ ID NO: 4242 - RNA, 19 nt, Homo sapiens
cauaagaaauacgaacuca

SEQ ID NO: 4243 - RNA, 19 nt, Homo sapiens
cuacaauaccuucucaauu

SEQ ID NO: 4244 - RNA, 19 nt, Homo sapiens
gugauguggugcagaggua

SEQ ID NO: 4245 - RNA, 19 nt, Homo sapiens
ggaaaucaagcauccuaau

SEQ ID NO: 4246 - RNA, 19 nt, Homo sapiens
caaagaggcccugcuggaa

SEQ ID NO: 4247 - RNA, 19 nt, Homo sapiens
uaaaguggcucugagaaaa

SEQ ID NO: 4248 - RNA, 19 nt, Homo sapiens
ggucaaacucuacaucuuc

SEQ ID NO: 4249 - RNA, 19 nt, Homo sapiens
ugaagaaacagguggagaa

SEQ ID NO: 4250 - RNA, 19 nt, Homo sapiens
ucguugcacuuuaugauuu

SEQ ID NO: 4251 - RNA, 19 nt, Homo sapiens
uuccaugacuccagcauuu

SEQ ID NO: 4252 - RNA, 19 nt, Homo sapiens
gagagucuugccuacaaua

SEQ ID NO: 4253 - RNA, 19 nt, Homo sapiens
acgggaauuugcuggauua

SEQ ID NO: 4254 - RNA, 19 nt, Homo sapiens
cauugugacugaauacaug

SEQ ID NO: 4255 - RNA, 19 nt, Homo sapiens
gcacccaaguguaauaagc

SEQ ID NO: 4256 - RNA, 19 nt, Homo sapiens
gagugacccuaaucucuuc

SEQ ID NO: 4257 - RNA, 19 nt, Homo sapiens
ggacagcaccagagagucu

SEQ ID NO: 4258 - RNA, 19 nt, Homo sapiens
ugaaagaagcugcaguaau

SEQ ID NO: 4259 - RNA, 19 nt, Homo sapiens
gaagagccaacugcccuaa

SEQ ID NO: 4260 - RNA, 19 nt, Homo sapiens
ggaagaugccaaagagaca

SEQ ID NO: 4261 - RNA, 19 nt, Homo sapiens
gagaacaaggagaacauug

SEQ ID NO: 4262 - RNA, 19 nt, Homo sapiens
cuaaaguggcucugagaaa

SEQ ID NO: 4263 - RNA, 19 nt, Homo sapiens
cagcagcuccuuccgagaa

SEQ ID NO: 4264 - RNA, 19 nt, Homo sapiens
gcacugccucgaaagcaaa

SEQ ID NO: 4265 - RNA, 19 nt, Homo sapiens
aaaaggauaucgaauggaa

SEQ ID NO: 4266 - RNA, 19 nt, Homo sapiens
agaauuucauccauagaga

SEQ ID NO: 4267 - RNA, 19 nt, Homo sapiens
gaagaggugacugcaguug

SEQ ID NO: 4268 - RNA, 19 nt, Homo sapiens
guacgagggacguguguau

SEQ ID NO: 4269 - RNA, 19 nt, Homo sapiens
ugugggaaauugcuaccua

SEQ ID NO: 4270 - RNA, 19 nt, Homo sapiens
ccugaaagaagcugcagua

SEQ ID NO: 4271 - RNA, 19 nt, Homo sapiens
ccgagaggcugugagcaaa

SEQ ID NO: 4272 - RNA, 19 nt, Homo sapiens
caaagugccaguccuuauc

SEQ ID NO: 4273 - RNA, 19 nt, Homo sapiens
uccgagaaauggagaauca

SEQ ID NO: 4274 - RNA, 19 nt, Homo sapiens
ucucuucguugcacuuuau

SEQ ID NO: 4275 - RNA, 19 nt, Homo sapiens
ggagaacaaggagaacauu

SEQ ID NO: 4276 - RNA, 19 nt, Homo sapiens
ugacugaauacaugccaua

SEQ ID NO: 4277 - RNA, 19 nt, Homo sapiens
aagaggcccugcuggaaug

SEQ ID NO: 4278 - RNA, 19 nt, Homo sapiens
caucacaggcuucuuuaca

SEQ ID NO: 4279 - RNA, 19 nt, Homo sapiens
gaaagcaaagagacaaguc

SEQ ID NO: 4280 - RNA, 19 nt, Homo sapiens
gaagaauuucauccauaga

SEQ ID NO: 4281 - RNA, 19 nt, Homo sapiens
gaaagaagcugcaguaaug

SEQ ID NO: 4282 - RNA, 19 nt, Homo sapiens
gaacagauauuaccaugaa

SEQ ID NO: 4283 - RNA, 19 nt, Homo sapiens
gaaguucgcucuaagaaug

SEQ ID NO: 4284 - RNA, 19 nt, Homo sapiens
ggagccaaauuuccuauua

SEQ ID NO: 4285 - RNA, 19 nt, Homo sapiens
gaaauggagcgaacagaua

SEQ ID NO: 4286 - RNA, 19 nt, Homo sapiens
gaagagaaaugcuccuaca

SEQ ID NO: 4287 - RNA, 19 nt, Homo sapiens
gcacaggccucuaguggau

SEQ ID NO: 4288 - RNA, 19 nt, Homo sapiens
ggaaauugcuaccuaugga

SEQ ID NO: 4289 - RNA, 19 nt, Homo sapiens
gagccaaauuuccuauuaa

SEQ ID NO: 4290 - RNA, 19 nt, Homo sapiens
guaauaagccuacagucua

SEQ ID NO: 4291 - RNA, 19 nt, Homo sapiens
ggagugaaguucgcucuaa

SEQ ID NO: 4292 - RNA, 19 nt, Homo sapiens
gaagaagaauuucauccau

SEQ ID NO: 4293 - RNA, 19 nt, Homo sapiens
caaacccuguccuuaauaa

SEQ ID NO: 4294 - RNA, 19 nt, Homo sapiens
ccaaugacaugcuuccaaa

SEQ ID NO: 4295 - RNA, 19 nt, Homo sapiens
ggaaugugcugaccuacug

SEQ ID NO: 4296 - RNA, 19 nt, Homo sapiens
cagcauuucugaagaggua

SEQ ID NO: 4297 - RNA, 19 nt, Homo sapiens
gaaauacagccuuacaguu

SEQ ID NO: 4298 - RNA, 19 nt, Homo sapiens
gcagagguagccacuguua

SEQ ID NO: 4299 - RNA, 19 nt, Homo sapiens
gaacaaggagaacauugaa

SEQ ID NO: 4300 - RNA, 19 nt, Homo sapiens
gcaauggaguacuuagaga

SEQ ID NO: 4301 - RNA, 19 nt, Homo sapiens
ggacagggccaaugacaug

SEQ ID NO: 4302 - RNA, 19 nt, Homo sapiens
uagaagaauuccugaaaga

SEQ ID NO: 4303 - RNA, 19 nt, Homo sapiens
agaaacagguggagaacaa

SEQ ID NO: 4304 - RNA, 19 nt, Homo sapiens
uggaagaaauacagccuua

SEQ ID NO: 4305 - RNA, 19 nt, Homo sapiens
gacaccagcugcuugacua

SEQ ID NO: 4306 - RNA, 19 nt, Homo sapiens
gcucagacccuacagaaga

SEQ ID NO: 4307 - RNA, 19 nt, Homo sapiens
gcugauggguucucuuuca

SEQ ID NO: 4308 - RNA, 19 nt, Homo sapiens
gguaacuucucaucuguug

SEQ ID NO: 4309 - RNA, 19 nt, Homo sapiens
cgucaucuguuguuccaua

SEQ ID NO: 4310 - RNA, 19 nt, Homo sapiens
uaauaagccuacagucuau

SEQ ID NO: 4311 - RNA, 19 nt, Homo sapiens
gcucagcagucuaaucaau

SEQ ID NO: 4312 - RNA, 19 nt, Homo sapiens
caaacaggccgcugagaaa

SEQ ID NO: 4313 - RNA, 19 nt, Homo sapiens
aaauucugcuuccaguuua

SEQ ID NO: 4314 - RNA, 19 nt, Homo sapiens
cagagagucuugccuacaa

SEQ ID NO: 4315 - RNA, 19 nt, Homo sapiens
gguagaagaauuccugaaa

SEQ ID NO: 4316 - RNA, 19 nt, Homo sapiens
gaagaaauacagccuuaca

SEQ ID NO: 4317 - RNA, 19 nt, Homo sapiens
gcuggaaugugcugaccua

SEQ ID NO: 4318 - RNA, 19 nt, Homo sapiens
ggaauuugcuggauuaccu

SEQ ID NO: 4319 - RNA, 19 nt, Homo sapiens
guagaagaauuccugaaag

SEQ ID NO: 4320 - RNA, 19 nt, Homo sapiens
ccauggagguagaagaauu

SEQ ID NO: 4321 - RNA, 19 nt, Homo sapiens
aauacgaacucacggguaa

SEQ ID NO: 4322 - RNA, 19 nt, Homo sapiens
gaaaucaagcauccuaauc

SEQ ID NO: 4323 - RNA, 19 nt, Homo sapiens
gaagaauuccugaaagaag

SEQ ID NO: 4324 - RNA, 19 nt, Homo sapiens
aaauacagccuuacaguug

SEQ ID NO: 4325 - RNA, 19 nt, Homo sapiens
gagaccggcuucaauaucu

SEQ ID NO: 4326 - RNA, 19 nt, Homo sapiens
acagagaccggcuucaaua

SEQ ID NO: 4327 - RNA, 19 nt, Homo sapiens
gaaaaucucagcagacaaa

SEQ ID NO: 4328 - RNA, 19 nt, Homo sapiens
ccaaauuuccuauuaagug

SEQ ID NO: 4329 - RNA, 19 nt, Homo sapiens
aauucaagcucuuaucuga

SEQ ID NO: 4330 - RNA, 19 nt, Homo sapiens
gcaguaguccagaagcuuu

SEQ ID NO: 4331 - RNA, 19 nt, Homo sapiens
gauaacacacucagcauca

SEQ ID NO: 4332 - RNA, 19 nt, Homo sapiens
ggaaauggagcgaacagau

SEQ ID NO: 4333 - RNA, 19 nt, Homo sapiens
gugcagagguagccacugu

SEQ ID NO: 4334 - RNA, 19 nt, Homo sapiens
gcacaagaugccacagaaa

SEQ ID NO: 4335 - RNA, 19 nt, Homo sapiens
agaagaauuucauccauag

SEQ ID NO: 4336 - RNA, 19 nt, Homo sapiens
cuacauggccacucagauu

SEQ ID NO: 4337 - RNA, 19 nt, Homo sapiens
ccaaacaggccgcugagaa

SEQ ID NO: 4338 - RNA, 19 nt, Homo sapiens
gaaauugcuaccuauggaa

SEQ ID NO: 4339 - RNA, 19 nt, Homo sapiens
caagcauccuaaucuggua

SEQ ID NO: 4340 - RNA, 19 nt, Homo sapiens
gcacagcagguacuaaagu

SEQ ID NO: 4341 - RNA, 19 nt, Homo sapiens
gaucuagccauuacagaga

SEQ ID NO: 4342 - RNA, 19 nt, Homo sapiens
cauaagaaauacgaacuca

SEQ ID NO: 4343 - RNA, 19 nt, Homo sapiens
cuacaauaccuucucaauu

SEQ ID NO: 4344 - RNA, 19 nt, Homo sapiens
gugauguggugcagaggua

SEQ ID NO: 4345 - RNA, 19 nt, Homo sapiens
ggaaaucaagcauccuaau

SEQ ID NO: 4346 - RNA, 19 nt, Homo sapiens
caaagaggcccugcuggaa

SEQ ID NO: 4347 - RNA, 19 nt, Homo sapiens
uaaaguggcucugagaaaa

SEQ ID NO: 4348 - RNA, 19 nt, Homo sapiens
ggucaaacucuacaucuuc

SEQ ID NO: 4349 - RNA, 19 nt, Homo sapiens
ugaagaaacagguggagaa

SEQ ID NO: 4350 - RNA, 19 nt, Homo sapiens
ucguugcacuuuaugauuu

SEQ ID NO: 4351 - RNA, 19 nt, Homo sapiens
uuccaugacuccagcauuu

SEQ ID NO: 4352 - RNA, 19 nt, Homo sapiens
gagagucuugccuacaaua

SEQ ID NO: 4353 - RNA, 19 nt, Homo sapiens
acgggaauuugcuggauua

SEQ ID NO: 4354 - RNA, 19 nt, Homo sapiens
cauugugacugaauacaug

SEQ ID NO: 4355 - RNA, 19 nt, Homo sapiens
gcacccaaguguaauaagc

SEQ ID NO: 4356 - RNA, 19 nt, Homo sapiens
gagccgaggaggaauguga

SEQ ID NO: 4357 - RNA, 19 nt, Homo sapiens
gagugacccuaaucucuuc

SEQ ID NO: 4358 - RNA, 19 nt, Homo sapiens
ggacagcaccagagagucu

SEQ ID NO: 4359 - RNA, 19 nt, Homo sapiens
ugaaagaagcugcaguaau

SEQ ID NO: 4360 - RNA, 19 nt, Homo sapiens
gaagagccaacugcccuaa

SEQ ID NO: 4361 - RNA, 19 nt, Homo sapiens
ggaagaugccaaagagaca

SEQ ID NO: 4362 - RNA, 19 nt, Homo sapiens
gagaacaaggagaacauug

SEQ ID NO: 4363 - RNA, 19 nt, Homo sapiens
cuaaaguggcucugagaaa

SEQ ID NO: 4364 - RNA, 19 nt, Homo sapiens
cagcagcuccuuccgagaa

SEQ ID NO: 4365 - RNA, 19 nt, Homo sapiens
gcacugccucgaaagcaaa

SEQ ID NO: 4366 - RNA, 19 nt, Homo sapiens
aaaaggauaucgaauggaa

SEQ ID NO: 4367 - RNA, 19 nt, Homo sapiens
agaauuucauccauagaga

SEQ ID NO: 4368 - RNA, 19 nt, Homo sapiens
gaagaggugacugcaguug

SEQ ID NO: 4369 - RNA, 19 nt, Homo sapiens
guacgagggacguguguau

SEQ ID NO: 4370 - RNA, 19 nt, Homo sapiens
ugugggaaauugcuaccua

SEQ ID NO: 4371 - RNA, 19 nt, Homo sapiens
ccugaaagaagcugcagua

SEQ ID NO: 4372 - RNA, 19 nt, Homo sapiens
ccgagaggcugugagcaaa

SEQ ID NO: 4373 - RNA, 19 nt, Homo sapiens
caaagugccaguccuuauc

SEQ ID NO: 4374 - RNA, 19 nt, Homo sapiens
uccgagaaauggagaauca

SEQ ID NO: 4375 - RNA, 19 nt, Homo sapiens
ggagaacaaggagaacauu

SEQ ID NO: 4376 - RNA, 19 nt, Homo sapiens
cacccagcaugaucacuuu

SEQ ID NO: 4377 - RNA, 19 nt, Homo sapiens
ucucuucguugcacuuuau

SEQ ID NO: 4378 - RNA, 19 nt, Homo sapiens
ugacugaauacaugccaua

SEQ ID NO: 4379 - RNA, 19 nt, Homo sapiens
aagaggcccugcuggaaug

SEQ ID NO: 4380 - RNA, 19 nt, Homo sapiens
caucacaggcuucuuuaca

SEQ ID NO: 4381 - RNA, 19 nt, Homo sapiens
gcauggagaugaucaguga

SEQ ID NO: 4382 - RNA, 19 nt, Homo sapiens
gaacaccaccauuggguua

SEQ ID NO: 4383 - RNA, 19 nt, Homo sapiens
ucacugcggugcccaagaa

SEQ ID NO: 4384 - RNA, 19 nt, Homo sapiens
agagccaccugaacaagua

SEQ ID NO: 4385 - RNA, 19 nt, Homo sapiens
uaauaaugcuugucuuggu

SEQ ID NO: 4386 - RNA, 19 nt, Homo sapiens
ggacgagggcgauuucuac

SEQ ID NO: 4387 - RNA, 19 nt, Homo sapiens
uguuugccaucaagaaaua

SEQ ID NO: 4388 - RNA, 19 nt, Homo sapiens
cgagggcgauuucuacuac

SEQ ID NO: 4389 - RNA, 19 nt, Homo sapiens
uaacuguguuugccaucaa

SEQ ID NO: 4390 - RNA, 19 nt, Homo sapiens
gauccugacuccgcuguuc

SEQ ID NO: 4391 - RNA, 19 nt, Homo sapiens
auacguggcuuuccugaag

SEQ ID NO: 4392 - RNA, 19 nt, Homo sapiens
gacgagagccaccugaaca

SEQ ID NO: 4393 - RNA, 19 nt, Homo sapiens
ggagggcacauucaacauc

SEQ ID NO: 4394 - RNA, 19 nt, Homo sapiens
ucaagaaauacguggcuuu

SEQ ID NO: 4395 - RNA, 19 nt, Homo sapiens
caacaucgacauccucaac

SEQ ID NO: 4396 - RNA, 19 nt, Homo sapiens
uagggaaccugaccaucug

SEQ ID NO: 4397 - RNA, 19 nt, Homo sapiens
ccacgcacuucgaccuaug

SEQ ID NO: 4398 - RNA, 19 nt, Homo sapiens
ggagaugaucagugacuuc

SEQ ID NO: 4399 - RNA, 19 nt, Homo sapiens
ccuaauaaugcuugucuug

SEQ ID NO: 4400 - RNA, 19 nt, Homo sapiens
caaggacgagggcgauuuc

SEQ ID NO: 4401 - RNA, 19 nt, Homo sapiens
ccaaggacgagggcgauuu

SEQ ID NO: 4402 - RNA, 19 nt, Homo sapiens
ggacguggacauggaguuc

SEQ ID NO: 4403 - RNA, 19 nt, Homo sapiens
gagagccaccugaacaagu

SEQ ID NO: 4404 - RNA, 19 nt, Homo sapiens
gcguggacguggacaugga

SEQ ID NO: 4405 - RNA, 19 nt, Homo sapiens
gggaggccuucaccuacga

SEQ ID NO: 4406 - RNA, 19 nt, Homo sapiens
gucuuggucuuguuugguu

SEQ ID NO: 4407 - RNA, 19 nt, Homo sapiens
gccaccguguccacuacua

SEQ ID NO: 4408 - RNA, 19 nt, Homo sapiens
gcacauucaacaucgacau

SEQ ID NO: 4409 - RNA, 19 nt, Homo sapiens
ccuaugauccuuuuccuaa

SEQ ID NO: 4410 - RNA, 19 nt, Homo sapiens
gagaugaucagugacuucu

SEQ ID NO: 4411 - RNA, 19 nt, Homo sapiens
ccauuggguuaacuguguu

SEQ ID NO: 4412 - RNA, 19 nt, Homo sapiens
accauuggguuaacugugu

SEQ ID NO: 4413 - RNA, 19 nt, Homo sapiens
ugaggaagcugagguucac

SEQ ID NO: 4414 - RNA, 19 nt, Homo sapiens
cuccagaacaccaccauug

SEQ ID NO: 4415 - RNA, 19 nt, Homo sapiens
gccacgcacuucgaccuau

SEQ ID NO: 4416 - RNA, 19 nt, Homo sapiens
uuagggaaccugaccaucu

SEQ ID NO: 4417 - RNA, 19 nt, Homo sapiens
gcgaagagaucuacauuaa

SEQ ID NO: 4418 - RNA, 19 nt, Homo sapiens
gaacuugagucuaaagaug

SEQ ID NO: 4419 - RNA, 19 nt, Homo sapiens
gcggugaacuugagucuaa

SEQ ID NO: 4420 - RNA, 19 nt, Homo sapiens
gaagaucucugcccucaag

SEQ ID NO: 4421 - RNA, 19 nt, Homo sapiens
ggaaagacaugcccaagag

SEQ ID NO: 4422 - RNA, 19 nt, Homo sapiens
caaccuggcuaccguguuu

SEQ ID NO: 4423 - RNA, 19 nt, Homo sapiens
agaagaagauguuugagaa

SEQ ID NO: 4424 - RNA, 19 nt, Homo sapiens
gaagagaucuacauuaacc

SEQ ID NO: 4425 - RNA, 19 nt, Homo sapiens
gaaaggcggugaacuugag

SEQ ID NO: 4426 - RNA, 19 nt, Homo sapiens
ggaaaggccuggagaugag

SEQ ID NO: 4427 - RNA, 19 nt, Homo sapiens
gcaaaggcucauauuuaua

SEQ ID NO: 4428 - RNA, 19 nt, Homo sapiens
gagagaagcaauucagaaa

SEQ ID NO: 4429 - RNA, 19 nt, Homo sapiens
ggaagcaccagcaguauga

SEQ ID NO: 4430 - RNA, 19 nt, Homo sapiens
caagugggaugaggaguuu

SEQ ID NO: 4431 - RNA, 19 nt, Homo sapiens
gcaauaaagacgacgauga

SEQ ID NO: 4432 - RNA, 19 nt, Homo sapiens
cagaggaacucaaagugaa

SEQ ID NO: 4433 - RNA, 19 nt, Homo sapiens
ccaaagugauggacaggaa

SEQ ID NO: 4434 - RNA, 19 nt, Homo sapiens
gagaagcaauucagaaacu

SEQ ID NO: 4435 - RNA, 19 nt, Homo sapiens
cggcacgucuuccucuuua

SEQ ID NO: 4436 - RNA, 19 nt, Homo sapiens
ugcaaaggcucauauuuau

SEQ ID NO: 4437 - RNA, 19 nt, Homo sapiens
gaaaugcaaaggcucauau

SEQ ID NO: 4438 - RNA, 19 nt, Homo sapiens
gaaggagcccaucaacaaa

SEQ ID NO: 4439 - RNA, 19 nt, Homo sapiens
acaaugagaucguggacaa

SEQ ID NO: 4440 - RNA, 19 nt, Homo sapiens
gcuguucuauuuccuuuga

SEQ ID NO: 4441 - RNA, 19 nt, Homo sapiens
ggaggacgaagauguguuu

SEQ ID NO: 4442 - RNA, 19 nt, Homo sapiens
gagaagugcuaugacaaga

SEQ ID NO: 4443 - RNA, 19 nt, Homo sapiens
ggagagaagcaauucagaa

SEQ ID NO: 4444 - RNA, 19 nt, Homo sapiens
ugaagaagaagauguuuga

SEQ ID NO: 4445 - RNA, 19 nt, Homo sapiens
ggacgaagauguguuucuc

SEQ ID NO: 4446 - RNA, 19 nt, Homo sapiens
uugaaagacugcaauagaa

SEQ ID NO: 4447 - RNA, 19 nt, Homo sapiens
uaaagucgcucuggagaca

SEQ ID NO: 4448 - RNA, 19 nt, Homo sapiens
augcaaaggcucauauuua

SEQ ID NO: 4449 - RNA, 19 nt, Homo sapiens
ggaaggaaguacugaccau

SEQ ID NO: 4450 - RNA, 19 nt, Homo sapiens
agaaggagcccaucaacaa

SEQ ID NO: 4451 - RNA, 19 nt, Homo sapiens
agaagauguuugagaauga

SEQ ID NO: 4452 - RNA, 19 nt, Homo sapiens
ucuaugagauccacaagga

SEQ ID NO: 4453 - RNA, 19 nt, Homo sapiens
cggcagcaguggucuguuu

SEQ ID NO: 4454 - RNA, 19 nt, Homo sapiens
gccaagggauuuaagcaau

SEQ ID NO: 4455 - RNA, 19 nt, Homo sapiens
guacacaacauuccuguca

SEQ ID NO: 4456 - RNA, 19 nt, Homo sapiens
gaaggagaaagccaacaaa

SEQ ID NO: 4457 - RNA, 19 nt, Homo sapiens
gaucucagaggaacucaaa

SEQ ID NO: 4458 - RNA, 19 nt, Homo sapiens
acaaggaguucuaugacaa

SEQ ID NO: 4459 - RNA, 19 nt, Homo sapiens
gaugggacccuucaugaau

SEQ ID NO: 4460 - RNA, 19 nt, Homo sapiens
ggaacacacuguacuucuc

SEQ ID NO: 4461 - RNA, 19 nt, Homo sapiens
gaaauucaccagccgagau

SEQ ID NO: 4462 - RNA, 19 nt, Homo sapiens
gcaggagucaggcuaagaa

SEQ ID NO: 4463 - RNA, 19 nt, Homo sapiens
ggaaaggcggugaacuuga

SEQ ID NO: 4464 - RNA, 19 nt, Homo sapiens
gggaaaggccuggagauga

SEQ ID NO: 4465 - RNA, 19 nt, Homo sapiens
ucaacaaggacaacaauga

SEQ ID NO: 4466 - RNA, 19 nt, Homo sapiens
gaagguggaagcagggaaa

SEQ ID NO: 4467 - RNA, 19 nt, Homo sapiens
uggaagcucugcucuacaa

SEQ ID NO: 4468 - RNA, 19 nt, Homo sapiens
gcacagaaggcuccugcuu

SEQ ID NO: 4469 - RNA, 19 nt, Homo sapiens
gcaaucagccaaccuguac

SEQ ID NO: 4470 - RNA, 19 nt, Homo sapiens
agagugaaauccagaagga

SEQ ID NO: 4471 - RNA, 19 nt, Homo sapiens
gaccaucggcugccuguga

SEQ ID NO: 4472 - RNA, 19 nt, Homo sapiens
gaagaagauguuugagaau

SEQ ID NO: 4473 - RNA, 19 nt, Homo sapiens
ugaaagacugcaauagaaa

SEQ ID NO: 4474 - RNA, 19 nt, Homo sapiens
ccucagaaguggagagcaa

SEQ ID NO: 4475 - RNA, 19 nt, Homo sapiens
ugagugacauggacaucaa

SEQ ID NO: 4476 - RNA, 19 nt, Homo sapiens
uaugagaagugcuaugaca

SEQ ID NO: 4477 - RNA, 19 nt, Homo sapiens
gcuaugagaagugcuauga

SEQ ID NO: 4478 - RNA, 19 nt, Homo sapiens
gugagcagcuuagcaagga

SEQ ID NO: 4479 - RNA, 19 nt, Homo sapiens
gcucaaggccgucuucgau

SEQ ID NO: 4480 - RNA, 19 nt, Homo sapiens
aagaagauguuugagaaug

SEQ ID NO: 4481 - RNA, 19 nt, Homo sapiens
ggaggaagaggaggcgaua

SEQ ID NO: 4482 - RNA, 19 nt, Homo sapiens
gugguacucuugccuuaga

SEQ ID NO: 4483 - RNA, 19 nt, Homo sapiens
ccgcuuuguucuuucauuu

SEQ ID NO: 4484 - RNA, 19 nt, Homo sapiens
ccgggacgcucaagcugua

SEQ ID NO: 4485 - RNA, 19 nt, Homo sapiens
gagaugaacgggaucaaag

SEQ ID NO: 4486 - RNA, 19 nt, Homo sapiens
gaagauguuugagaaugag

SEQ ID NO: 4487 - RNA, 19 nt, Homo sapiens
cagggaagcaccagcagua

SEQ ID NO: 4488 - RNA, 19 nt, Homo sapiens
gaaaaggguugccgagaag

SEQ ID NO: 4489 - RNA, 19 nt, Homo sapiens
uggaggacaugaagaugaa

SEQ ID NO: 4490 - RNA, 19 nt, Homo sapiens
guaaaccacgugagaggaa

SEQ ID NO: 4491 - RNA, 19 nt, Homo sapiens
gauacagccuuuuggguaa

SEQ ID NO: 4492 - RNA, 19 nt, Homo sapiens
ggaugggacccuucaugaa

SEQ ID NO: 4493 - RNA, 19 nt, Homo sapiens
gaacgggaucaaaguggaa

SEQ ID NO: 4494 - RNA, 19 nt, Homo sapiens
ggauccuguuucaagcuua

SEQ ID NO: 4495 - RNA, 19 nt, Homo sapiens
uggaaagaguuaccuguuc

SEQ ID NO: 4496 - RNA, 19 nt, Homo sapiens
gugccaagcugaagaagac

SEQ ID NO: 4497 - RNA, 19 nt, Homo sapiens
cugcaaaggcugagaaaug

SEQ ID NO: 4498 - RNA, 19 nt, Homo sapiens
gggaaaggcggugaacuug

SEQ ID NO: 4499 - RNA, 19 nt, Homo sapiens
cuauuuccuuugaguguaa

SEQ ID NO: 4500 - RNA, 19 nt, Homo sapiens
guuggcaucuacaggauau

SEQ ID NO: 4501 - RNA, 19 nt, Homo sapiens
cauggaagcucugcucuac

SEQ ID NO: 4502 - RNA, 19 nt, Homo sapiens
ucagaggaacucaaaguga

SEQ ID NO: 4503 - RNA, 19 nt, Homo sapiens
gaaggagugagguguguuc

SEQ ID NO: 4504 - RNA, 19 nt, Homo sapiens
acagacagcccgcuuuguu

SEQ ID NO: 4505 - RNA, 19 nt, Homo sapiens
ugaggauccugugcuauga

SEQ ID NO: 4506 - RNA, 19 nt, Homo sapiens
caauaaagacgacgaugag

SEQ ID NO: 4507 - RNA, 19 nt, Homo sapiens
gcaauucagaaacuacaga

SEQ ID NO: 4508 - RNA, 19 nt, Homo sapiens
cgcgacagcuggugaagga

SEQ ID NO: 4509 - RNA, 19 nt, Homo sapiens
ccaacaaccaguuccagaa

SEQ ID NO: 4510 - RNA, 19 nt, Homo sapiens
ggaaacaccacaggcugaa

SEQ ID NO: 4511 - RNA, 19 nt, Homo sapiens
gcgcccauuucuggaauuu

SEQ ID NO: 4512 - RNA, 19 nt, Homo sapiens
cuccauaccucuaguugug

SEQ ID NO: 4513 - RNA, 19 nt, Homo sapiens
gagaaggagcccaucaaca

SEQ ID NO: 4514 - RNA, 19 nt, Homo sapiens
cgagauaugagccugaaga

SEQ ID NO: 4515 - RNA, 19 nt, Homo sapiens
ccagccagcucggugugua

SEQ ID NO: 4516 - RNA, 19 nt, Homo sapiens
agaagcaauucagaaacua

SEQ ID NO: 4517 - RNA, 19 nt, Homo sapiens
gcgaagagaucuacauuaa

SEQ ID NO: 4518 - RNA, 19 nt, Homo sapiens
gaacuugagucuaaagaug

SEQ ID NO: 4519 - RNA, 19 nt, Homo sapiens
gcggugaacuugagucuaa

SEQ ID NO: 4520 - RNA, 19 nt, Homo sapiens
gaagaucucugcccucaag

SEQ ID NO: 4521 - RNA, 19 nt, Homo sapiens
ggaaagacaugcccaagag

SEQ ID NO: 4522 - RNA, 19 nt, Homo sapiens
caaccuggcuaccguguuu

SEQ ID NO: 4523 - RNA, 19 nt, Homo sapiens
agaagaagauguuugagaa

SEQ ID NO: 4524 - RNA, 19 nt, Homo sapiens
gaagagaucuacauuaacc

SEQ ID NO: 4525 - RNA, 19 nt, Homo sapiens
gaaaggcggugaacuugag

SEQ ID NO: 4526 - RNA, 19 nt, Homo sapiens
ggaaaggccuggagaugag

SEQ ID NO: 4527 - RNA, 19 nt, Homo sapiens
gcaaaggcucauauuuaua

SEQ ID NO: 4528 - RNA, 19 nt, Homo sapiens
gagagaagcaauucagaaa

SEQ ID NO: 4529 - RNA, 19 nt, Homo sapiens
ggaagcaccagcaguauga

SEQ ID NO: 4530 - RNA, 19 nt, Homo sapiens
caagugggaugaggaguuu

SEQ ID NO: 4531 - RNA, 19 nt, Homo sapiens
gcaauaaagacgacgauga

SEQ ID NO: 4532 - RNA, 19 nt, Homo sapiens
cagaggaacucaaagugaa

SEQ ID NO: 4533 - RNA, 19 nt, Homo sapiens
ccaaagugauggacaggaa

SEQ ID NO: 4534 - RNA, 19 nt, Homo sapiens
gagaagcaauucagaaacu

SEQ ID NO: 4535 - RNA, 19 nt, Homo sapiens
cggcacgucuuccucuuua

SEQ ID NO: 4536 - RNA, 19 nt, Homo sapiens
ugcaaaggcucauauuuau

SEQ ID NO: 4537 - RNA, 19 nt, Homo sapiens
gaaaugcaaaggcucauau

SEQ ID NO: 4538 - RNA, 19 nt, Homo sapiens
gaaggagcccaucaacaaa

SEQ ID NO: 4539 - RNA, 19 nt, Homo sapiens
acaaugagaucguggacaa

SEQ ID NO: 4540 - RNA, 19 nt, Homo sapiens
gcuguucuauuuccuuuga

SEQ ID NO: 4541 - RNA, 19 nt, Homo sapiens
gagaagugcuaugacaaga

SEQ ID NO: 4542 - RNA, 19 nt, Homo sapiens
ggagagaagcaauucagaa

SEQ ID NO: 4543 - RNA, 19 nt, Homo sapiens
ugaagaagaagauguuuga

SEQ ID NO: 4544 - RNA, 19 nt, Homo sapiens
uugaaagacugcaauagaa

SEQ ID NO: 4545 - RNA, 19 nt, Homo sapiens
uaaagucgcucuggagaca

SEQ ID NO: 4546 - RNA, 19 nt, Homo sapiens
augcaaaggcucauauuua

SEQ ID NO: 4547 - RNA, 19 nt, Homo sapiens
ggaaggaaguacugaccau

SEQ ID NO: 4548 - RNA, 19 nt, Homo sapiens
agaaggagcccaucaacaa

SEQ ID NO: 4549 - RNA, 19 nt, Homo sapiens
agaagauguuugagaauga

SEQ ID NO: 4550 - RNA, 19 nt, Homo sapiens
ucuaugagauccacaagga

SEQ ID NO: 4551 - RNA, 19 nt, Homo sapiens
cggcagcaguggucuguuu

SEQ ID NO: 4552 - RNA, 19 nt, Homo sapiens
gccaagggauuuaagcaau

SEQ ID NO: 4553 - RNA, 19 nt, Homo sapiens
guacacaacauuccuguca

SEQ ID NO: 4554 - RNA, 19 nt, Homo sapiens
gaaggagaaagccaacaaa

SEQ ID NO: 4555 - RNA, 19 nt, Homo sapiens
gaucucagaggaacucaaa

SEQ ID NO: 4556 - RNA, 19 nt, Homo sapiens
acaaggaguucuaugacaa

SEQ ID NO: 4557 - RNA, 19 nt, Homo sapiens
gaugggacccuucaugaau

SEQ ID NO: 4558 - RNA, 19 nt, Homo sapiens
ggaacacacuguacuucuc

SEQ ID NO: 4559 - RNA, 19 nt, Homo sapiens
gaaauucaccagccgagau

SEQ ID NO: 4560 - RNA, 19 nt, Homo sapiens
gcaggagucaggcuaagaa

SEQ ID NO: 4561 - RNA, 19 nt, Homo sapiens
ggaaaggcggugaacuuga

SEQ ID NO: 4562 - RNA, 19 nt, Homo sapiens
ucaacaaggacaacaauga

SEQ ID NO: 4563 - RNA, 19 nt, Homo sapiens
uggaagcucugcucuacaa

SEQ ID NO: 4564 - RNA, 19 nt, Homo sapiens
gggaaaggccuggagauga

SEQ ID NO: 4565 - RNA, 19 nt, Homo sapiens
gcacagaaggcuccugcuu

SEQ ID NO: 4566 - RNA, 19 nt, Homo sapiens
gcaaucagccaaccuguac

SEQ ID NO: 4567 - RNA, 19 nt, Homo sapiens
agagugaaauccagaagga

SEQ ID NO: 4568 - RNA, 19 nt, Homo sapiens
gaccaucggcugccuguga

SEQ ID NO: 4569 - RNA, 19 nt, Homo sapiens
gaagaagauguuugagaau

SEQ ID NO: 4570 - RNA, 19 nt, Homo sapiens
ugaaagacugcaauagaaa

SEQ ID NO: 4571 - RNA, 19 nt, Homo sapiens
ccucagaaguggagagcaa

SEQ ID NO: 4572 - RNA, 19 nt, Homo sapiens
ugagugacauggacaucaa

SEQ ID NO: 4573 - RNA, 19 nt, Homo sapiens
uaugagaagugcuaugaca

SEQ ID NO: 4574 - RNA, 19 nt, Homo sapiens
gcuaugagaagugcuauga

SEQ ID NO: 4575 - RNA, 19 nt, Homo sapiens
gugagcagcuuagcaagga

SEQ ID NO: 4576 - RNA, 19 nt, Homo sapiens
gcucaaggccgucuucgau

SEQ ID NO: 4577 - RNA, 19 nt, Homo sapiens
aagaagauguuugagaaug

SEQ ID NO: 4578 - RNA, 19 nt, Homo sapiens
gugguacucuugccuuaga

SEQ ID NO: 4579 - RNA, 19 nt, Homo sapiens
ccgcuuuguucuuucauuu

SEQ ID NO: 4580 - RNA, 19 nt, Homo sapiens
ccgggacgcucaagcugua

SEQ ID NO: 4581 - RNA, 19 nt, Homo sapiens
gcuccaaggugcccuacau

SEQ ID NO: 4582 - RNA, 19 nt, Homo sapiens
gagaugaacgggaucaaag

SEQ ID NO: 4583 - RNA, 19 nt, Homo sapiens
gaagauguuugagaaugag

SEQ ID NO: 4584 - RNA, 19 nt, Homo sapiens
cagggaagcaccagcagua

SEQ ID NO: 4585 - RNA, 19 nt, Homo sapiens
gaaaaggguugccgagaag

SEQ ID NO: 4586 - RNA, 19 nt, Homo sapiens
uggaggacaugaagaugaa

SEQ ID NO: 4587 - RNA, 19 nt, Homo sapiens
guaaaccacgugagaggaa

SEQ ID NO: 4588 - RNA, 19 nt, Homo sapiens
gauacagccuuuuggguaa

SEQ ID NO: 4589 - RNA, 19 nt, Homo sapiens
ggaugggacccuucaugaa

SEQ ID NO: 4590 - RNA, 19 nt, Homo sapiens
gaacgggaucaaaguggaa

SEQ ID NO: 4591 - RNA, 19 nt, Homo sapiens
ggauccuguuucaagcuua

SEQ ID NO: 4592 - RNA, 19 nt, Homo sapiens
uggaaagaguuaccuguuc

SEQ ID NO: 4593 - RNA, 19 nt, Homo sapiens
gugccaagcugaagaagac

SEQ ID NO: 4594 - RNA, 19 nt, Homo sapiens
cugcaaaggcugagaaaug

SEQ ID NO: 4595 - RNA, 19 nt, Homo sapiens
gggaaaggcggugaacuug

SEQ ID NO: 4596 - RNA, 19 nt, Homo sapiens
cuauuuccuuugaguguaa

SEQ ID NO: 4597 - RNA, 19 nt, Homo sapiens
guuggcaucuacaggauau

SEQ ID NO: 4598 - RNA, 19 nt, Homo sapiens
cauggaagcucugcucuac

SEQ ID NO: 4599 - RNA, 19 nt, Homo sapiens
ucagaggaacucaaaguga

SEQ ID NO: 4600 - RNA, 19 nt, Homo sapiens
gaaggagugagguguguuc

SEQ ID NO: 4601 - RNA, 19 nt, Homo sapiens
acagacagcccgcuuuguu

SEQ ID NO: 4602 - RNA, 19 nt, Homo sapiens
ugaggauccugugcuauga

SEQ ID NO: 4603 - RNA, 19 nt, Homo sapiens
caauaaagacgacgaugag

SEQ ID NO: 4604 - RNA, 19 nt, Homo sapiens
gcaauucagaaacuacaga

SEQ ID NO: 4605 - RNA, 19 nt, Homo sapiens
cgcgacagcuggugaagga

SEQ ID NO: 4606 - RNA, 19 nt, Homo sapiens
ccaacaaccaguuccagaa

SEQ ID NO: 4607 - RNA, 19 nt, Homo sapiens
ggaaacaccacaggcugaa

SEQ ID NO: 4608 - RNA, 19 nt, Homo sapiens
gcgcccauuucuggaauuu

SEQ ID NO: 4609 - RNA, 19 nt, Homo sapiens
cuccauaccucuaguugug

SEQ ID NO: 4610 - RNA, 19 nt, Homo sapiens
gagaaggagcccaucaaca

SEQ ID NO: 4611 - RNA, 19 nt, Homo sapiens
cgagauaugagccugaaga

SEQ ID NO: 4612 - RNA, 19 nt, Homo sapiens
agaagcaauucagaaacua

SEQ ID NO: 4613 - RNA, 19 nt, Homo sapiens
ccagccagcucggugugua

SEQ ID NO: 4614 - RNA, 19 nt, Homo sapiens
cacaaggaguucuaugaca

SEQ ID NO: 4615 - RNA, 19 nt, Homo sapiens
guacucuugccuuagauuu

SEQ ID NO: 4616 - RNA, 19 nt, Homo sapiens
gagcgcccauuucuggaau

SEQ ID NO: 4617 - RNA, 19 nt, Homo sapiens
gaacacugaugacauggua

SEQ ID NO: 4618 - RNA, 19 nt, Homo sapiens
ggccagagauugccugauu

SEQ ID NO: 4619 - RNA, 19 nt, Homo sapiens
gagauugccugauuccuau

SEQ ID NO: 4620 - RNA, 19 nt, Homo sapiens
gaauguggcugagcgguuu

SEQ ID NO: 4621 - RNA, 19 nt, Homo sapiens
gcggacggcugucuguuaa

SEQ ID NO: 4622 - RNA, 19 nt, Homo sapiens
gggauaaccucugagaaug

SEQ ID NO: 4623 - RNA, 19 nt, Homo sapiens
gcugagcgguuuggcauuu

SEQ ID NO: 4624 - RNA, 19 nt, Homo sapiens
agaaaugggucuuaugaca

SEQ ID NO: 4625 - RNA, 19 nt, Homo sapiens
gcagguggcaucagaaaug

SEQ ID NO: 4626 - RNA, 19 nt, Homo sapiens
ccaccacgguccaugauga

SEQ ID NO: 4627 - RNA, 19 nt, Homo sapiens
caaggcacuucaacucauu

SEQ ID NO: 4628 - RNA, 19 nt, Homo sapiens
ugaauacccugggaacuga

SEQ ID NO: 4629 - RNA, 19 nt, Homo sapiens
cauagcagguggcaucaga

SEQ ID NO: 4630 - RNA, 19 nt, Homo sapiens
acaaggccaugguuaauuc

SEQ ID NO: 4631 - RNA, 19 nt, Homo sapiens
ccgcugccgucuuugaaua

SEQ ID NO: 4632 - RNA, 19 nt, Homo sapiens
gauaaccucugagaaugug

SEQ ID NO: 4633 - RNA, 19 nt, Homo sapiens
ucagaaaugggucuuauga

SEQ ID NO: 4634 - RNA, 19 nt, Homo sapiens
caucagaaaugggucuuau

SEQ ID NO: 4635 - RNA, 19 nt, Homo sapiens
gagcuucucucggcaguca

SEQ ID NO: 4636 - RNA, 19 nt, Homo sapiens
ggagaagcaggauaccuuu

SEQ ID NO: 4637 - RNA, 19 nt, Homo sapiens
gagcaagggcuguuuccaa

SEQ ID NO: 4638 - RNA, 19 nt, Homo sapiens
gcacuucaacucauuugga

SEQ ID NO: 4639 - RNA, 19 nt, Homo sapiens
cgagaucaaugaggccuuu

SEQ ID NO: 4640 - RNA, 19 nt, Homo sapiens
gaaaugggucuuaugacau

SEQ ID NO: 4641 - RNA, 19 nt, Homo sapiens
ggucccaccugacaucaug

SEQ ID NO: 4642 - RNA, 19 nt, Homo sapiens
gggaacccuggaaauauua

SEQ ID NO: 4643 - RNA, 19 nt, Homo sapiens
gaucaaggcacuucaacuc

SEQ ID NO: 4644 - RNA, 19 nt, Homo sapiens
gaagugcaaugggcauagu

SEQ ID NO: 4645 - RNA, 19 nt, Homo sapiens
ugugaacacugaugacaug

SEQ ID NO: 4646 - RNA, 19 nt, Homo sapiens
ggacagaucaaggcacuuc

SEQ ID NO: 4647 - RNA, 19 nt, Homo sapiens
uaccacagcuggaaacucu

SEQ ID NO: 4648 - RNA, 19 nt, Homo sapiens
gggagaagcaggauaccuu

SEQ ID NO: 4649 - RNA, 19 nt, Homo sapiens
agacaguccugcugcucua

SEQ ID NO: 4650 - RNA, 19 nt, Homo sapiens
ugagugacguggacaucuu

SEQ ID NO: 4651 - RNA, 19 nt, Homo sapiens
ugaccgcgguucucaagga

SEQ ID NO: 4652 - RNA, 19 nt, Homo sapiens
aggccaugguuaauucuua

SEQ ID NO: 4653 - RNA, 19 nt, Homo sapiens
cugaugacaugguauagga

SEQ ID NO: 4654 - RNA, 19 nt, Homo sapiens
acacugaugacaugguaua

SEQ ID NO: 4655 - RNA, 19 nt, Homo sapiens
ggacggcugucuguuaacu

SEQ ID NO: 4656 - RNA, 19 nt, Homo sapiens
aauauuacuucgcgcuuga

SEQ ID NO: 4657 - RNA, 19 nt, Homo sapiens
ucaaggcacuucaacucau

SEQ ID NO: 4658 - RNA, 19 nt, Homo sapiens
ggauaaccucugagaaugu

SEQ ID NO: 4659 - RNA, 19 nt, Homo sapiens
agagauugccugauuccua

SEQ ID NO: 4660 - RNA, 19 nt, Homo sapiens
ggagaaggccagagauugc

SEQ ID NO: 4661 - RNA, 19 nt, Homo sapiens
gccacaaggccaugguuaa

SEQ ID NO: 4662 - RNA, 19 nt, Homo sapiens
cuuuagcugugcaagauaa

SEQ ID NO: 4663 - RNA, 19 nt, Homo sapiens
caucagacccucuuuagcu

SEQ ID NO: 4664 - RNA, 19 nt, Homo sapiens
gagaagugcaaugggcaua

SEQ ID NO: 4665 - RNA, 19 nt, Homo sapiens
ccacaaggccaugguuaau

SEQ ID NO: 4666 - RNA, 19 nt, Homo sapiens
cacuucaacucauuuggaa

SEQ ID NO: 4667 - RNA, 19 nt, Homo sapiens
guccaaggcagaagaguug

SEQ ID NO: 4668 - RNA, 19 nt, Homo sapiens
caagggcuguuuccaagcu

SEQ ID NO: 4669 - RNA, 19 nt, Homo sapiens
uggaaaaugugaacacuga

SEQ ID NO: 4670 - RNA, 19 nt, Homo sapiens
cgaaucgcccaguuucuga

SEQ ID NO: 4671 - RNA, 19 nt, Homo sapiens
ccaagaggagcaucacugu

SEQ ID NO: 4672 - RNA, 19 nt, Homo sapiens
gaugacaagggcaccaaga

SEQ ID NO: 4673 - RNA, 19 nt, Homo sapiens
gcugagauugugccuguga

SEQ ID NO: 4674 - RNA, 19 nt, Homo sapiens
gagaagcaggauaccuuug

SEQ ID NO: 4675 - RNA, 19 nt, Homo sapiens
agaaggagaaggccagaga

SEQ ID NO: 4676 - RNA, 19 nt, Homo sapiens
gaggucuuaugcagugguu

SEQ ID NO: 4677 - RNA, 19 nt, Homo sapiens
gccagagauugccugauuc

SEQ ID NO: 4678 - RNA, 19 nt, Homo sapiens
gaaggagaaggccagagau

SEQ ID NO: 4679 - RNA, 19 nt, Homo sapiens
gagccgcugccgucuuuga

SEQ ID NO: 4680 - RNA, 19 nt, Homo sapiens
gguccaaggcagaagaguu

SEQ ID NO: 4681 - RNA, 19 nt, Homo sapiens
ggagguccaaggcagaaga

SEQ ID NO: 4682 - RNA, 19 nt, Homo sapiens
cacaaggccaugguuaauu

SEQ ID NO: 4683 - RNA, 19 nt, Homo sapiens
aaagcagggcugacaguga

SEQ ID NO: 4684 - RNA, 19 nt, Homo sapiens
gcaucagaaaugggucuua

SEQ ID NO: 4685 - RNA, 19 nt, Homo sapiens
uagcagguggcaucagaaa

SEQ ID NO: 4686 - RNA, 19 nt, Homo sapiens
gcauuucacgggagaagca

SEQ ID NO: 4687 - RNA, 19 nt, Homo sapiens
ucgcccaguuucugaguga

SEQ ID NO: 4688 - RNA, 19 nt, Homo sapiens
gcaaucauggcccgaaucg

SEQ ID NO: 4689 - RNA, 19 nt, Homo sapiens
gaaaaugugaacacugaug

SEQ ID NO: 4690 - RNA, 19 nt, Homo sapiens
uuacuucgcgcuugaugga

SEQ ID NO: 4691 - RNA, 19 nt, Homo sapiens
ggucaucacgcugcucaau

SEQ ID NO: 4692 - RNA, 19 nt, Homo sapiens
gaucaaugaggccuuugca

SEQ ID NO: 4693 - RNA, 19 nt, Homo sapiens
aagccugccuucaagaaag

SEQ ID NO: 4694 - RNA, 19 nt, Homo sapiens
gugcaaugggcauaguaaa

SEQ ID NO: 4695 - RNA, 19 nt, Homo sapiens
ggguugaccugcgcaaugc

SEQ ID NO: 4696 - RNA, 19 nt, Homo sapiens
cagcaagagcccagagcaa

SEQ ID NO: 4697 - RNA, 19 nt, Homo sapiens
ucccggagacugugccuuu

SEQ ID NO: 4698 - RNA, 19 nt, Homo sapiens
uuuccaagcugagauugug

SEQ ID NO: 4699 - RNA, 19 nt, Homo sapiens
aaggagaaggccagagauu

SEQ ID NO: 4700 - RNA, 19 nt, Homo sapiens
gcccgaaucgcccaguuuc

SEQ ID NO: 4701 - RNA, 19 nt, Homo sapiens
ccacagcuggaaacucuag

SEQ ID NO: 4702 - RNA, 19 nt, Homo sapiens
ggggauaaccucugagaau

SEQ ID NO: 4703 - RNA, 19 nt, Homo sapiens
ugcggacggcugucuguua

SEQ ID NO: 4704 - RNA, 19 nt, Homo sapiens
ugagcgguuuggcauuuca

SEQ ID NO: 4705 - RNA, 19 nt, Homo sapiens
gaaagcaggucaacuauga

SEQ ID NO: 4706 - RNA, 19 nt, Homo sapiens
gcacagaagugacagacua

SEQ ID NO: 4707 - RNA, 19 nt, Homo sapiens
gaugugagccugcgaaaua

SEQ ID NO: 4708 - RNA, 19 nt, Homo sapiens
gaaaucaaauuccgcagaa

SEQ ID NO: 4709 - RNA, 19 nt, Homo sapiens
gaaauagcgucucuaacuu

SEQ ID NO: 4710 - RNA, 19 nt, Homo sapiens
cagcaaaccuggauucuga

SEQ ID NO: 4711 - RNA, 19 nt, Homo sapiens
gcagaugacuucccuaauc

SEQ ID NO: 4712 - RNA, 19 nt, Homo sapiens
gcaauuagauucguuguca

SEQ ID NO: 4713 - RNA, 19 nt, Homo sapiens
gaaguuuggugcuuacauu

SEQ ID NO: 4714 - RNA, 19 nt, Homo sapiens
gggcuuauauugccuauga

SEQ ID NO: 4715 - RNA, 19 nt, Homo sapiens
gaaaauagauucucaacga

SEQ ID NO: 4716 - RNA, 19 nt, Homo sapiens
cauaauagguucuguguca

SEQ ID NO: 4717 - RNA, 19 nt, Homo sapiens
gcaaugcuaucucuuuguu

SEQ ID NO: 4718 - RNA, 19 nt, Homo sapiens
gaucuuagcggaccaauau

SEQ ID NO: 4719 - RNA, 19 nt, Homo sapiens
ccaaagaccugcugcaauc

SEQ ID NO: 4720 - RNA, 19 nt, Homo sapiens
guacaacaccgccagcuua

SEQ ID NO: 4721 - RNA, 19 nt, Homo sapiens
gcucauacacuucugaaua

SEQ ID NO: 4722 - RNA, 19 nt, Homo sapiens
gaaaugaacgugcaauuag

SEQ ID NO: 4723 - RNA, 19 nt, Homo sapiens
gagaagagaauaagaguga

SEQ ID NO: 4724 - RNA, 19 nt, Homo sapiens
gaucggagauuucauagag

SEQ ID NO: 4725 - RNA, 19 nt, Homo sapiens
gaucuuugaugaaguaaug

SEQ ID NO: 4726 - RNA, 19 nt, Homo sapiens
ggaaggaguuggagagcaa

SEQ ID NO: 4727 - RNA, 19 nt, Homo sapiens
uaacuuccuucacuccuua

SEQ ID NO: 4728 - RNA, 19 nt, Homo sapiens
ggaaauaaagugauugaga

SEQ ID NO: 4729 - RNA, 19 nt, Homo sapiens
ggacaacguacauauauga

SEQ ID NO: 4730 - RNA, 19 nt, Homo sapiens
caacaacuaugcaaaugug

SEQ ID NO: 4731 - RNA, 19 nt, Homo sapiens
gaauccagguacaagauaa

SEQ ID NO: 4732 - RNA, 19 nt, Homo sapiens
gaagaaauucgccauaugu

SEQ ID NO: 4733 - RNA, 19 nt, Homo sapiens
gacauuacauaccgaauug

SEQ ID NO: 4734 - RNA, 19 nt, Homo sapiens
gaaaugagauuggcauggu

SEQ ID NO: 4735 - RNA, 19 nt, Homo sapiens
gaagucgccuguggaaauu

SEQ ID NO: 4736 - RNA, 19 nt, Homo sapiens
gaugguggcugaugucaau

SEQ ID NO: 4737 - RNA, 19 nt, Homo sapiens
gaacucaaaggauccuaua

SEQ ID NO: 4738 - RNA, 19 nt, Homo sapiens
gaaagaagagggaauugga

SEQ ID NO: 4739 - RNA, 19 nt, Homo sapiens
ucucagagcuuccgaacuu

SEQ ID NO: 4740 - RNA, 19 nt, Homo sapiens
gaucguaucuaucgucauc

SEQ ID NO: 4741 - RNA, 19 nt, Homo sapiens
acacgucucuuuaugauga

SEQ ID NO: 4742 - RNA, 19 nt, Homo sapiens
agaaggaaauggcucagua

SEQ ID NO: 4743 - RNA, 19 nt, Homo sapiens
gagcaaacaacaacaacua

SEQ ID NO: 4744 - RNA, 19 nt, Homo sapiens
cgaaaugaacgugcaauua

SEQ ID NO: 4745 - RNA, 19 nt, Homo sapiens
ccagcacucucgauucaua

SEQ ID NO: 4746 - RNA, 19 nt, Homo sapiens
uugaauaucugcaaaguga

SEQ ID NO: 4747 - RNA, 19 nt, Homo sapiens
uaucagcuauugacaugua

SEQ ID NO: 4748 - RNA, 19 nt, Homo sapiens
gaccaccaaugccaaagua

SEQ ID NO: 4749 - RNA, 19 nt, Homo sapiens
gcaguuacaccacguauau

SEQ ID NO: 4750 - RNA, 19 nt, Homo sapiens
guuagagacugaaagcuuu

SEQ ID NO: 4751 - RNA, 19 nt, Homo sapiens
gagaagaagcaauuucaaa

SEQ ID NO: 4752 - RNA, 19 nt, Homo sapiens
gauggcagcuucuacuuuc

SEQ ID NO: 4753 - RNA, 19 nt, Homo sapiens
gggaauaccugugggaguu

SEQ ID NO: 4754 - RNA, 19 nt, Homo sapiens
ggaagucgccuguggaaau

SEQ ID NO: 4755 - RNA, 19 nt, Homo sapiens
ggagaagucuaucaagaag

SEQ ID NO: 4756 - RNA, 19 nt, Homo sapiens
gauaaucuggucaauguaa

SEQ ID NO: 4757 - RNA, 19 nt, Homo sapiens
aaacagagaagaagcaauu

SEQ ID NO: 4758 - RNA, 19 nt, Homo sapiens
gguacaagauaacagauau

SEQ ID NO: 4759 - RNA, 19 nt, Homo sapiens
ccagaaggccgagauguua

SEQ ID NO: 4760 - RNA, 19 nt, Homo sapiens
cuucugacaugcugacuua

SEQ ID NO: 4761 - RNA, 19 nt, Homo sapiens
uaugucaacucaagcauuu

SEQ ID NO: 4762 - RNA, 19 nt, Homo sapiens
cagcacagaucauguuuca

SEQ ID NO: 4763 - RNA, 19 nt, Homo sapiens
caaacgagucuggcuauua

SEQ ID NO: 4764 - RNA, 19 nt, Homo sapiens
ucagaaagcaggucaacua

SEQ ID NO: 4765 - RNA, 19 nt, Homo sapiens
caaacaaucucgucaucug

SEQ ID NO: 4766 - RNA, 19 nt, Homo sapiens
ccacuuggcugagcgauug

SEQ ID NO: 4767 - RNA, 19 nt, Homo sapiens
gaacaucccuacgcuaaac

SEQ ID NO: 4768 - RNA, 19 nt, Homo sapiens
gaacagugaaggcuuaugu

SEQ ID NO: 4769 - RNA, 19 nt, Homo sapiens
gaaaggaucuggugaaaac

SEQ ID NO: 4770 - RNA, 19 nt, Homo sapiens
gauguaugcugaccgagaa

SEQ ID NO: 4771 - RNA, 19 nt, Homo sapiens
gaaguguacaccuccaaua

SEQ ID NO: 4772 - RNA, 19 nt, Homo sapiens
caaggaagcuucuuuugaa

SEQ ID NO: 4773 - RNA, 19 nt, Homo sapiens
gcagcuauguucagagaau

SEQ ID NO: 4774 - RNA, 19 nt, Homo sapiens
gcagguaucccaacucuuc

SEQ ID NO: 4775 - RNA, 19 nt, Homo sapiens
gggcagaagucauaaggau

SEQ ID NO: 4776 - RNA, 19 nt, Homo sapiens
ggacagcacagaucauguu

SEQ ID NO: 4777 - RNA, 19 nt, Homo sapiens
gagcugaaccggaugagaa

SEQ ID NO: 4778 - RNA, 19 nt, Homo sapiens
ucacagagcuaacucaacu

SEQ ID NO: 4779 - RNA, 19 nt, Homo sapiens
uggauaaucuggucaaugu

SEQ ID NO: 4780 - RNA, 19 nt, Homo sapiens
guagacagauaucgcauca

SEQ ID NO: 4781 - RNA, 19 nt, Homo sapiens
gaaucggacuggcagaaga

SEQ ID NO: 4782 - RNA, 19 nt, Homo sapiens
gagcaagggauaaguuuga

SEQ ID NO: 4783 - RNA, 19 nt, Homo sapiens
ggucacacgucucuuuaug

SEQ ID NO: 4784 - RNA, 19 nt, Homo sapiens
caggaucuuugaugaagua

SEQ ID NO: 4785 - RNA, 19 nt, Homo sapiens
cugaugagcugcugaguau

SEQ ID NO: 4786 - RNA, 19 nt, Homo sapiens
agauggaggucauguguuu

SEQ ID NO: 4787 - RNA, 19 nt, Homo sapiens
ugaaggagcugucuauucg

SEQ ID NO: 4788 - RNA, 19 nt, Homo sapiens
cagaagaaauucgccauau

SEQ ID NO: 4789 - RNA, 19 nt, Homo sapiens
aaacucauccuaucagaaa

SEQ ID NO: 4790 - RNA, 19 nt, Homo sapiens
ggaaauggcucaguaugcu

SEQ ID NO: 4791 - RNA, 19 nt, Homo sapiens
gaagauuauugaagaagca

SEQ ID NO: 4792 - RNA, 19 nt, Homo sapiens
gugaacacguggaagauga

SEQ ID NO: 4793 - RNA, 19 nt, Homo sapiens
gacuuacacugaacuggua

SEQ ID NO: 4794 - RNA, 19 nt, Homo sapiens
gcacaauccuuagggacaa

SEQ ID NO: 4795 - RNA, 19 nt, Homo sapiens
gcaauucccauccgccuuu

SEQ ID NO: 4796 - RNA, 19 nt, Homo sapiens
guacugaacuacaucuucu

SEQ ID NO: 4797 - RNA, 19 nt, Homo sapiens
gaauaagagugacaugaac

SEQ ID NO: 4798 - RNA, 19 nt, Homo sapiens
gaagcuccaucgaguguuc

SEQ ID NO: 4799 - RNA, 19 nt, Homo sapiens
ugaagaugguaaugacuuu

SEQ ID NO: 4800 - RNA, 19 nt, Homo sapiens
gaagauggaggucaugugu

SEQ ID NO: 4801 - RNA, 19 nt, Homo sapiens
gaagaagcaauuucaaaca

SEQ ID NO: 4802 - RNA, 19 nt, Homo sapiens
guacaacgcaggcaucaga

SEQ ID NO: 4803 - RNA, 19 nt, Homo sapiens
caacaacaacuaugcaaau

SEQ ID NO: 4804 - RNA, 19 nt, Homo sapiens
uaagauggcagaucacuau

SEQ ID NO: 4805 - RNA, 19 nt, Homo sapiens
gaacaucccugcacagaaa

SEQ ID NO: 4806 - RNA, 19 nt, Homo sapiens
gaauggaguugcuuucuua

SEQ ID NO: 4807 - RNA, 19 nt, Homo sapiens
gaagagaucgucaccauua

SEQ ID NO: 4808 - RNA, 19 nt, Homo sapiens
gaacgugcaugacagauuu

SEQ ID NO: 4809 - RNA, 19 nt, Homo sapiens
ccaaagacauccugacaua

SEQ ID NO: 4810 - RNA, 19 nt, Homo sapiens
gaagagaggucuacacauc

SEQ ID NO: 4811 - RNA, 19 nt, Homo sapiens
cgacagagcucuucaugga

SEQ ID NO: 4812 - RNA, 19 nt, Homo sapiens
aggaagagguugacaguua

SEQ ID NO: 4813 - RNA, 19 nt, Homo sapiens
gcacgcaccuuccuguauu

SEQ ID NO: 4814 - RNA, 19 nt, Homo sapiens
gaaggaagguaugaaguga

SEQ ID NO: 4815 - RNA, 19 nt, Homo sapiens
gaaaggaagaucugauaaa

SEQ ID NO: 4816 - RNA, 19 nt, Homo sapiens
ccucguagauguggaauua

SEQ ID NO: 4817 - RNA, 19 nt, Homo sapiens
gagaugaguuugcagaaga

SEQ ID NO: 4818 - RNA, 19 nt, Homo sapiens
gcaaggugauggcccagua

SEQ ID NO: 4819 - RNA, 19 nt, Homo sapiens
ugacaaggguugcgugaaa

SEQ ID NO: 4820 - RNA, 19 nt, Homo sapiens
gcguucagaucaugcauua

SEQ ID NO: 4821 - RNA, 19 nt, Homo sapiens
ccgagaaccuccagaaauu

SEQ ID NO: 4822 - RNA, 19 nt, Homo sapiens
gauccucgcugaccaguau

SEQ ID NO: 4823 - RNA, 19 nt, Homo sapiens
gaagauacuugcguguuga

SEQ ID NO: 4824 - RNA, 19 nt, Homo sapiens
gacaucaccuuucgcauug

SEQ ID NO: 4825 - RNA, 19 nt, Homo sapiens
acaagaagcucauggaaca

SEQ ID NO: 4826 - RNA, 19 nt, Homo sapiens
agaaauguaugcagacaaa

SEQ ID NO: 4827 - RNA, 19 nt, Homo sapiens
ggacaucagccucuacaaa

SEQ ID NO: 4828 - RNA, 19 nt, Homo sapiens
gugaggagccugagcuuua

SEQ ID NO: 4829 - RNA, 19 nt, Homo sapiens
cagaagauguuuaugacaa

SEQ ID NO: 4830 - RNA, 19 nt, Homo sapiens
gcacgacucuguccucaag

SEQ ID NO: 4831 - RNA, 19 nt, Homo sapiens
gcaagagccucagagaaga

SEQ ID NO: 4832 - RNA, 19 nt, Homo sapiens
cgagaggucuucuucauca

SEQ ID NO: 4833 - RNA, 19 nt, Homo sapiens
ggaauccgcggucauauga

SEQ ID NO: 4834 - RNA, 19 nt, Homo sapiens
uggaauaccucuauaguca

SEQ ID NO: 4835 - RNA, 19 nt, Homo sapiens
gagauuaaguuccgaaagg

SEQ ID NO: 4836 - RNA, 19 nt, Homo sapiens
gaaaugaggugggcauggu

SEQ ID NO: 4837 - RNA, 19 nt, Homo sapiens
gcaccugcgugguagaauu

SEQ ID NO: 4838 - RNA, 19 nt, Homo sapiens
gaaccuccagaaauuaaua

SEQ ID NO: 4839 - RNA, 19 nt, Homo sapiens
gaugguagcuuccacuucu

SEQ ID NO: 4840 - RNA, 19 nt, Homo sapiens
ggaaugcugugucucuguu

SEQ ID NO: 4841 - RNA, 19 nt, Homo sapiens
gugcaugacagauuucuua

SEQ ID NO: 4842 - RNA, 19 nt, Homo sapiens
gaaaugauugcugacguua

SEQ ID NO: 4843 - RNA, 19 nt, Homo sapiens
gcaaugacaucaccuuucg

SEQ ID NO: 4844 - RNA, 19 nt, Homo sapiens
gaacaucacguaccugaag

SEQ ID NO: 4845 - RNA, 19 nt, Homo sapiens
ggaggcagcagaaagaauu

SEQ ID NO: 4846 - RNA, 19 nt, Homo sapiens
uggaguggcuguccuauau

SEQ ID NO: 4847 - RNA, 19 nt, Homo sapiens
ccacaaaggauuuaaauac

SEQ ID NO: 4848 - RNA, 19 nt, Homo sapiens
gagaagagcccauccacau

SEQ ID NO: 4849 - RNA, 19 nt, Homo sapiens
gagaaccuccagaaauuaa

SEQ ID NO: 4850 - RNA, 19 nt, Homo sapiens
gaagagcccauccacauuc

SEQ ID NO: 4851 - RNA, 19 nt, Homo sapiens
gagcugcugugcaagaaug

SEQ ID NO: 4852 - RNA, 19 nt, Homo sapiens
ggacaguggagauuaaguu

SEQ ID NO: 4853 - RNA, 19 nt, Homo sapiens
caagugcucucaacaaggu

SEQ ID NO: 4854 - RNA, 19 nt, Homo sapiens
gauacaugaucacggauau

SEQ ID NO: 4855 - RNA, 19 nt, Homo sapiens
ccaccuacaugaaggaaga

SEQ ID NO: 4856 - RNA, 19 nt, Homo sapiens
gaagaucguugaggaagca

SEQ ID NO: 4857 - RNA, 19 nt, Homo sapiens
acucugaccugaucacaaa

SEQ ID NO: 4858 - RNA, 19 nt, Homo sapiens
ggaaccaccuacaucuaug

SEQ ID NO: 4859 - RNA, 19 nt, Homo sapiens
ccacggcaguuucaaggaa

SEQ ID NO: 4860 - RNA, 19 nt, Homo sapiens
caggcaggcucucuuuaaa

SEQ ID NO: 4861 - RNA, 19 nt, Homo sapiens
ucgaauaccugcagaacga

SEQ ID NO: 4862 - RNA, 19 nt, Homo sapiens
ggaaggaagguaugaagug

SEQ ID NO: 4863 - RNA, 19 nt, Homo sapiens
ggaagagguugacaguuac

SEQ ID NO: 4864 - RNA, 19 nt, Homo sapiens
ucaagauggcggaucauua

SEQ ID NO: 4865 - RNA, 19 nt, Homo sapiens
ccacaaaggcccaaagauc

SEQ ID NO: 4866 - RNA, 19 nt, Homo sapiens
aggaagaucugauaaaguc

SEQ ID NO: 4867 - RNA, 19 nt, Homo sapiens
aaaggaagaucugauaaag

SEQ ID NO: 4868 - RNA, 19 nt, Homo sapiens
ugaacuccguccacuguaa

SEQ ID NO: 4869 - RNA, 19 nt, Homo sapiens
gagaggaccuucuguaccu

SEQ ID NO: 4870 - RNA, 19 nt, Homo sapiens
gaaggaagagguugacagu

SEQ ID NO: 4871 - RNA, 19 nt, Homo sapiens
aaagauauccggcuucugu

SEQ ID NO: 4872 - RNA, 19 nt, Homo sapiens
ggagaagggcgucauaucu

SEQ ID NO: 4873 - RNA, 19 nt, Homo sapiens
ugacaucaccuuucgcauu

SEQ ID NO: 4874 - RNA, 19 nt, Homo sapiens
ccaccuacaucuaugacuu

SEQ ID NO: 4875 - RNA, 19 nt, Homo sapiens
ccuacgagcugcggcauaa

SEQ ID NO: 4876 - RNA, 19 nt, Homo sapiens
agaagauacuugcguguug

SEQ ID NO: 4877 - RNA, 19 nt, Homo sapiens
gcaagaacgucugggguua

SEQ ID NO: 4878 - RNA, 19 nt, Homo sapiens
gaaucagugucccagaaga

SEQ ID NO: 4879 - RNA, 19 nt, Homo sapiens
agaagggcgucauaucuga

SEQ ID NO: 4880 - RNA, 19 nt, Homo sapiens
gaacguggcagagcggauu

SEQ ID NO: 4881 - RNA, 19 nt, Homo sapiens
ggaggagaguccagauaca

SEQ ID NO: 4882 - RNA, 19 nt, Homo sapiens
cagaggagaucaaacacau

SEQ ID NO: 4883 - RNA, 19 nt, Homo sapiens
gagguggcguucaauaaca

SEQ ID NO: 4884 - RNA, 19 nt, Homo sapiens
ggagaguccagauacauga

SEQ ID NO: 4885 - RNA, 19 nt, Homo sapiens
gaacuccguccacuguaaa

SEQ ID NO: 4886 - RNA, 19 nt, Homo sapiens
gagcccagccucccacaaa

SEQ ID NO: 4887 - RNA, 19 nt, Homo sapiens
caaacaaagucgugugcau

SEQ ID NO: 4888 - RNA, 19 nt, Homo sapiens
ggcagucucugaccauguu

SEQ ID NO: 4889 - RNA, 19 nt, Homo sapiens
cgaggcgacuuuaggacua

SEQ ID NO: 4890 - RNA, 19 nt, Homo sapiens
ucagacaaguacagaguga

SEQ ID NO: 4891 - RNA, 19 nt, Homo sapiens
gaaccaccuacaucuauga

SEQ ID NO: 4892 - RNA, 19 nt, Homo sapiens
ccugaauacuuucuucuau

SEQ ID NO: 4893 - RNA, 19 nt, Homo sapiens
gcacaggugaccaagaaga

SEQ ID NO: 4894 - RNA, 19 nt, Homo sapiens
ggcaauaagacguguguuu

SEQ ID NO: 4895 - RNA, 19 nt, Homo sapiens
ggugguggcuuugaaggaa

SEQ ID NO: 4896 - RNA, 19 nt, Homo sapiens
caacgggacugggacacaa

SEQ ID NO: 4897 - RNA, 19 nt, Homo sapiens
gccacacucugcacaaaga

SEQ ID NO: 4898 - RNA, 19 nt, Homo sapiens
gcaaccacaucuuccucaa

SEQ ID NO: 4899 - RNA, 19 nt, Homo sapiens
gaaaccgaauaucaugcuu

SEQ ID NO: 4900 - RNA, 19 nt, Homo sapiens
agaaaugauugcugacguu

SEQ ID NO: 4901 - RNA, 19 nt, Homo sapiens
gaucugauaaaguccauga

SEQ ID NO: 4902 - RNA, 19 nt, Homo sapiens
cgaaaggaagaucugauaa

SEQ ID NO: 4903 - RNA, 19 nt, Homo sapiens
ccgaaaggaagaucugaua

SEQ ID NO: 4904 - RNA, 19 nt, Homo sapiens
cgagaaccuccagaaauua

SEQ ID NO: 4905 - RNA, 19 nt, Homo sapiens
ggagaaagcuggagaagua

SEQ ID NO: 4906 - RNA, 19 nt, Homo sapiens
ggagcaagcuuauucaaau

SEQ ID NO: 4907 - RNA, 19 nt, Homo sapiens
ggaagugacuggauucuca

SEQ ID NO: 4908 - RNA, 19 nt, Homo sapiens
ggacucagcuaaguauuug

SEQ ID NO: 4909 - RNA, 19 nt, Homo sapiens
gcaagguguucaucaguaa

SEQ ID NO: 4910 - RNA, 19 nt, Homo sapiens
gaacagauuaagcacuuua

SEQ ID NO: 4911 - RNA, 19 nt, Homo sapiens
gugaaacgcugcugaguga

SEQ ID NO: 4912 - RNA, 19 nt, Homo sapiens
gauauacgguugccagcua

SEQ ID NO: 4913 - RNA, 19 nt, Homo sapiens
gagcaagcuuauucaaauu

SEQ ID NO: 4914 - RNA, 19 nt, Homo sapiens
ggaagaacgucuagaaacu

SEQ ID NO: 4915 - RNA, 19 nt, Homo sapiens
gaaaccaggaacuauguua

SEQ ID NO: 4916 - RNA, 19 nt, Homo sapiens
gaagaaaccaggaacuaug

SEQ ID NO: 4917 - RNA, 19 nt, Homo sapiens
ggaaugaaaggauuuauca

SEQ ID NO: 4918 - RNA, 19 nt, Homo sapiens
caauggaacucuuucuuca

SEQ ID NO: 4919 - RNA, 19 nt, Homo sapiens
ggaaagcgaggaaacacua

SEQ ID NO: 4920 - RNA, 19 nt, Homo sapiens
ccagaugacugcaggcaaa

SEQ ID NO: 4921 - RNA, 19 nt, Homo sapiens
ggaguccuauuacagcuaa

SEQ ID NO: 4922 - RNA, 19 nt, Homo sapiens
uaagugauguugugauugu

SEQ ID NO: 4923 - RNA, 19 nt, Homo sapiens
gauagcacauugacuuuua

SEQ ID NO: 4924 - RNA, 19 nt, Homo sapiens
ggauggaagugacuggauu

SEQ ID NO: 4925 - RNA, 19 nt, Homo sapiens
gacagugcaacauaaauua

SEQ ID NO: 4926 - RNA, 19 nt, Homo sapiens
caggaaaggcuguuaauug

SEQ ID NO: 4927 - RNA, 19 nt, Homo sapiens
uaagauagcacauugacuu

SEQ ID NO: 4928 - RNA, 19 nt, Homo sapiens
guagacaucugcccacauc

SEQ ID NO: 4929 - RNA, 19 nt, Homo sapiens
uggaagccaucauaccuua

SEQ ID NO: 4930 - RNA, 19 nt, Homo sapiens
gaagcuggaagccaucaua

SEQ ID NO: 4931 - RNA, 19 nt, Homo sapiens
gcuagugaauucauguuug

SEQ ID NO: 4932 - RNA, 19 nt, Homo sapiens
aaaccaggcuguuaauaca

SEQ ID NO: 4933 - RNA, 19 nt, Homo sapiens
agugagaacugcuuucauu

SEQ ID NO: 4934 - RNA, 19 nt, Homo sapiens
gauauaggaauucgaagaa

SEQ ID NO: 4935 - RNA, 19 nt, Homo sapiens
ggaacucuuucuucaaaca

SEQ ID NO: 4936 - RNA, 19 nt, Homo sapiens
cuacagacagugcaacaua

SEQ ID NO: 4937 - RNA, 19 nt, Homo sapiens
gaagcaagguguucaucag

SEQ ID NO: 4938 - RNA, 19 nt, Homo sapiens
gcaauggaacucuuucuuc

SEQ ID NO: 4939 - RNA, 19 nt, Homo sapiens
gaggaaacacuaaacaugu

SEQ ID NO: 4940 - RNA, 19 nt, Homo sapiens
uaacuuagcauguaaacuc

SEQ ID NO: 4941 - RNA, 19 nt, Homo sapiens
cuagugaauucauguuuga

SEQ ID NO: 4942 - RNA, 19 nt, Homo sapiens
gcaagcuuauucaaauugu

SEQ ID NO: 4943 - RNA, 19 nt, Homo sapiens
gggaaugccuugguucugu

SEQ ID NO: 4944 - RNA, 19 nt, Homo sapiens
cagcuaaucucguuuuaaa

SEQ ID NO: 4945 - RNA, 19 nt, Homo sapiens
gacgaaagcuacauaaaau

SEQ ID NO: 4946 - RNA, 19 nt, Homo sapiens
aagaacagauuaagcacuu

SEQ ID NO: 4947 - RNA, 19 nt, Homo sapiens
gcucagaagaacagauuaa

SEQ ID NO: 4948 - RNA, 19 nt, Homo sapiens
gguauugucauguccuaua

SEQ ID NO: 4949 - RNA, 19 nt, Homo sapiens
uaguguagcuuacgacugu

SEQ ID NO: 4950 - RNA, 19 nt, Homo sapiens
ggacgaaagcuacauaaaa

SEQ ID NO: 4951 - RNA, 19 nt, Homo sapiens
cugcuugcauggcgaaaua

SEQ ID NO: 4952 - RNA, 19 nt, Homo sapiens
aaacaaaacuggcaagauc

SEQ ID NO: 4953 - RNA, 19 nt, Homo sapiens
ucaaaccaaggcagaaaua

SEQ ID NO: 4954 - RNA, 19 nt, Homo sapiens
gaaagcgaggaaacacuaa

SEQ ID NO: 4955 - RNA, 19 nt, Homo sapiens
cgaaauauugggcaucuga

SEQ ID NO: 4956 - RNA, 19 nt, Homo sapiens
uacagacagugcaacauaa

SEQ ID NO: 4957 - RNA, 19 nt, Homo sapiens
caaaacaguugcucaccua

SEQ ID NO: 4958 - RNA, 19 nt, Homo sapiens
ggauaccgcagaacuauuc

SEQ ID NO: 4959 - RNA, 19 nt, Homo sapiens
gaaguaaguagggagguuu

SEQ ID NO: 4960 - RNA, 19 nt, Homo sapiens
gaaacgcugcugagugaga

SEQ ID NO: 4961 - RNA, 19 nt, Homo sapiens
uugccuagguguuucauuu

SEQ ID NO: 4962 - RNA, 19 nt, Homo sapiens
guauugucauguccuauau

SEQ ID NO: 4963 - RNA, 19 nt, Homo sapiens
gggaggagcaagcuuauuc

SEQ ID NO: 4964 - RNA, 19 nt, Homo sapiens
gaagaagugauuccucauc

SEQ ID NO: 4965 - RNA, 19 nt, Homo sapiens
gaucuguacuccgcagcua

SEQ ID NO: 4966 - RNA, 19 nt, Homo sapiens
gggaguacccaauugcaaa

SEQ ID NO: 4967 - RNA, 19 nt, Homo sapiens
gcaugaagcgaaacguuug

SEQ ID NO: 4968 - RNA, 19 nt, Homo sapiens
gcaucugaguuacaaaaua

SEQ ID NO: 4969 - RNA, 19 nt, Homo sapiens
ggucacaaaucaugaagcu

SEQ ID NO: 4970 - RNA, 19 nt, Homo sapiens
cagaagaacagauuaagca

SEQ ID NO: 4971 - RNA, 19 nt, Homo sapiens
aaccaaggcagaaauaauu

SEQ ID NO: 4972 - RNA, 19 nt, Homo sapiens
cgaggaaacacuaaacaug

SEQ ID NO: 4973 - RNA, 19 nt, Homo sapiens
cagccaaucuaugguggua

SEQ ID NO: 4974 - RNA, 19 nt, Homo sapiens
aaacuggcaagaucacuaa

SEQ ID NO: 4975 - RNA, 19 nt, Homo sapiens
ugagaacugcuuucauuga

SEQ ID NO: 4976 - RNA, 19 nt, Homo sapiens
uaccugcucucucuauaga

SEQ ID NO: 4977 - RNA, 19 nt, Homo sapiens
ggaagcaagguguucauca

SEQ ID NO: 4978 - RNA, 19 nt, Homo sapiens
gcugacaucugagaacaca

SEQ ID NO: 4979 - RNA, 19 nt, Homo sapiens
cagcuaaguauuugccuaa

SEQ ID NO: 4980 - RNA, 19 nt, Homo sapiens
gaaucuugccuagguguuu

SEQ ID NO: 4981 - RNA, 19 nt, Homo sapiens
agacagugcaacauaaauu

SEQ ID NO: 4982 - RNA, 19 nt, Homo sapiens
gcuguuaauugcugaugug

SEQ ID NO: 4983 - RNA, 19 nt, Homo sapiens
cagauuaagcacuuuauuc

SEQ ID NO: 4984 - RNA, 19 nt, Homo sapiens
cuauaaaccaggcuguuaa

SEQ ID NO: 4985 - RNA, 19 nt, Homo sapiens
aacaaaagcuuaugcagaa

SEQ ID NO: 4986 - RNA, 19 nt, Homo sapiens
auggaacucuuucuucaaa

SEQ ID NO: 4987 - RNA, 19 nt, Homo sapiens
gccuagguguuucauuuau

SEQ ID NO: 4988 - RNA, 19 nt, Homo sapiens
uaacagauauaggaauucg

SEQ ID NO: 4989 - RNA, 19 nt, Homo sapiens
gucauuaagugauguugug

SEQ ID NO: 4990 - RNA, 19 nt, Homo sapiens
uacaaaccauggcucagaa

SEQ ID NO: 4991 - RNA, 19 nt, Homo sapiens
uaaaccaggcuguuaauac

SEQ ID NO: 4992 - RNA, 19 nt, Homo sapiens
ucuauaaaccaggcuguua

SEQ ID NO: 4993 - RNA, 19 nt, Homo sapiens
caaaccaaggcagaaauaa

SEQ ID NO: 4994 - RNA, 19 nt, Homo sapiens
gguguuucauuuaucucua

SEQ ID NO: 4995 - RNA, 19 nt, Homo sapiens
aggaaaggcuguuaauugc

SEQ ID NO: 4996 - RNA, 19 nt, Homo sapiens
gaacucuuucuucaaacaa

SEQ ID NO: 4997 - RNA, 19 nt, Homo sapiens
ggacugcuuggugucaaua

SEQ ID NO: 4998 - RNA, 19 nt, Homo sapiens
aaaccaggaacuauguuaa

SEQ ID NO: 4999 - RNA, 19 nt, Homo sapiens
gaacgucuagaaacuccuu

SEQ ID NO: 5000 - RNA, 19 nt, Homo sapiens
gggaagaacgucuagaaac

SEQ ID NO: 5001 - RNA, 19 nt, Homo sapiens
gguggaaaauggaaugaaa

SEQ ID NO: 5002 - RNA, 19 nt, Homo sapiens
uaguugcggucacaaauca

SEQ ID NO: 5003 - RNA, 19 nt, Homo sapiens
gugacuggauucucaaugg

SEQ ID NO: 5004 - RNA, 19 nt, Homo sapiens
ggaaaaguguaaggaaguu

SEQ ID NO: 5005 - RNA, 19 nt, Homo sapiens
caauaaagcuugccuuaaa

SEQ ID NO: 5006 - RNA, 19 nt, Homo sapiens
gaaaggagaugaguauauu

SEQ ID NO: 5007 - RNA, 19 nt, Homo sapiens
gaaccaggauuaggauuua

SEQ ID NO: 5008 - RNA, 19 nt, Homo sapiens
ugacggagcugguuucaaa

SEQ ID NO: 5009 - RNA, 19 nt, Homo sapiens
gaacuugguuuaaugaaca

SEQ ID NO: 5010 - RNA, 19 nt, Homo sapiens
ggaugaagcuaccaaguau

SEQ ID NO: 5011 - RNA, 19 nt, Homo sapiens
ggccagcgauguucagaua

SEQ ID NO: 5012 - RNA, 19 nt, Homo sapiens
gugaacacauugacaagua

SEQ ID NO: 5013 - RNA, 19 nt, Homo sapiens
aaagugggcuuagaaagua

SEQ ID NO: 5014 - RNA, 19 nt, Homo sapiens
gcaauggauuuaauacaga

SEQ ID NO: 5015 - RNA, 19 nt, Homo sapiens
gcaccaagcaauaucauuu

SEQ ID NO: 5016 - RNA, 19 nt, Homo sapiens
cuaaagcuccugcuaauaa

SEQ ID NO: 5017 - RNA, 19 nt, Homo sapiens
gaugugugcuuauugugua

SEQ ID NO: 5018 - RNA, 19 nt, Homo sapiens
gaauucagauugggagaaa

SEQ ID NO: 5019 - RNA, 19 nt, Homo sapiens
gcaacugcuuauuauagua

SEQ ID NO: 5020 - RNA, 19 nt, Homo sapiens
agaauuggcuuauggaugu

SEQ ID NO: 5021 - RNA, 19 nt, Homo sapiens
gaaagcauuugugaaacuu

SEQ ID NO: 5022 - RNA, 19 nt, Homo sapiens
gaaauggcaaugaaaguug

SEQ ID NO: 5023 - RNA, 19 nt, Homo sapiens
ggagaucacagcauacaaa

SEQ ID NO: 5024 - RNA, 19 nt, Homo sapiens
ggaaagcauuugugaaacu

SEQ ID NO: 5025 - RNA, 19 nt, Homo sapiens
ugauguagcugguauaaag

SEQ ID NO: 5026 - RNA, 19 nt, Homo sapiens
gcagauacuuggaggcaau

SEQ ID NO: 5027 - RNA, 19 nt, Homo sapiens
gagagcagcuugggagguu

SEQ ID NO: 5028 - RNA, 19 nt, Homo sapiens
gaaagugccuaaagaaaau

SEQ ID NO: 5029 - RNA, 19 nt, Homo sapiens
uaaagcuccugcuaauaaa

SEQ ID NO: 5030 - RNA, 19 nt, Homo sapiens
cauuggagaucacagcaua

SEQ ID NO: 5031 - RNA, 19 nt, Homo sapiens
caguaacuuuguagacuua

SEQ ID NO: 5032 - RNA, 19 nt, Homo sapiens
ggagcugguuucaaaguug

SEQ ID NO: 5033 - RNA, 19 nt, Homo sapiens
ggucagaagauguggauaa

SEQ ID NO: 5034 - RNA, 19 nt, Homo sapiens
ggccgugacccguguauua

SEQ ID NO: 5035 - RNA, 19 nt, Homo sapiens
ggcauuugcuggagauauu

SEQ ID NO: 5036 - RNA, 19 nt, Homo sapiens
gagaaaggaauuaaacaug

SEQ ID NO: 5037 - RNA, 19 nt, Homo sapiens
ggaggcaauggauuuaaua

SEQ ID NO: 5038 - RNA, 19 nt, Homo sapiens
ccacuuuacuugaauuaca

SEQ ID NO: 5039 - RNA, 19 nt, Homo sapiens
ugaacuagcuagaaugagu

SEQ ID NO: 5040 - RNA, 19 nt, Homo sapiens
caagcaauaucauuuaugc

SEQ ID NO: 5041 - RNA, 19 nt, Homo sapiens
acacacacauuccagagaa

SEQ ID NO: 5042 - RNA, 19 nt, Homo sapiens
uagaaugaguuaccagaga

SEQ ID NO: 5043 - RNA, 19 nt, Homo sapiens
aaagaaaggagaugaguau

SEQ ID NO: 5044 - RNA, 19 nt, Homo sapiens
cccaguggcugcagaauau

SEQ ID NO: 5045 - RNA, 19 nt, Homo sapiens
caacuugacaguaacuuug

SEQ ID NO: 5046 - RNA, 19 nt, Homo sapiens
cagaagauguggauaacca

SEQ ID NO: 5047 - RNA, 19 nt, Homo sapiens
gugaagaauuggcuuaugg

SEQ ID NO: 5048 - RNA, 19 nt, Homo sapiens
gcuguuggauuagcacaaa

SEQ ID NO: 5049 - RNA, 19 nt, Homo sapiens
ggagaaaggaauuaaacau

SEQ ID NO: 5050 - RNA, 19 nt, Homo sapiens
gcucugauguagcugguau

SEQ ID NO: 5051 - RNA, 19 nt, Homo sapiens
agacugcuauugaaggaaa

SEQ ID NO: 5052 - RNA, 19 nt, Homo sapiens
guucagugcuuauuaucau

SEQ ID NO: 5053 - RNA, 19 nt, Homo sapiens
ggcaauggauuuaauacag

SEQ ID NO: 5054 - RNA, 19 nt, Homo sapiens
ugacauucauauucuccua

SEQ ID NO: 5055 - RNA, 19 nt, Homo sapiens
cuggagauauugcaaauca

SEQ ID NO: 5056 - RNA, 19 nt, Homo sapiens
caccaagcaauaucauuua

SEQ ID NO: 5057 - RNA, 19 nt, Homo sapiens
gguagccuuuggucuauug

SEQ ID NO: 5058 - RNA, 19 nt, Homo sapiens
uagaggaauugucuucgaa

SEQ ID NO: 5059 - RNA, 19 nt, Homo sapiens
ggaacuugguuuaaugaac

SEQ ID NO: 5060 - RNA, 19 nt, Homo sapiens
ccgaacagcagaaagaauu

SEQ ID NO: 5061 - RNA, 19 nt, Homo sapiens
ggauuaggauuuaguuuug

SEQ ID NO: 5062 - RNA, 19 nt, Homo sapiens
guaccacuuuacuugaauu

SEQ ID NO: 5063 - RNA, 19 nt, Homo sapiens
cuagguagccuuuggucua

SEQ ID NO: 5064 - RNA, 19 nt, Homo sapiens
gacaguaacuuuguagacu

SEQ ID NO: 5065 - RNA, 19 nt, Homo sapiens
ccauugaugugugcuuauu

SEQ ID NO: 5066 - RNA, 19 nt, Homo sapiens
ccauauuucacuuaccuua

SEQ ID NO: 5067 - RNA, 19 nt, Homo sapiens
uggcugaaauggcaaugaa

SEQ ID NO: 5068 - RNA, 19 nt, Homo sapiens
gugaaagugccuaaagaaa

SEQ ID NO: 5069 - RNA, 19 nt, Homo sapiens
gaccaaagcagaaaagaaa

SEQ ID NO: 5070 - RNA, 19 nt, Homo sapiens
gaauuggcuuauggaugua

SEQ ID NO: 5071 - RNA, 19 nt, Homo sapiens
agaagagccugggaacuug

SEQ ID NO: 5072 - RNA, 19 nt, Homo sapiens
aaauggcaaugaaaguuga

SEQ ID NO: 5073 - RNA, 19 nt, Homo sapiens
gcaaugggagcuuuugaua

SEQ ID NO: 5074 - RNA, 19 nt, Homo sapiens
uagaagagccugggaacuu

SEQ ID NO: 5075 - RNA, 19 nt, Homo sapiens
uaaauuugccagagaggaa

SEQ ID NO: 5076 - RNA, 19 nt, Homo sapiens
ucaauaaagcuugccuuaa

SEQ ID NO: 5077 - RNA, 19 nt, Homo sapiens
cagaauauccuguagaaaa

SEQ ID NO: 5078 - RNA, 19 nt, Homo sapiens
uggaugaagcuaccaagua

SEQ ID NO: 5079 - RNA, 19 nt, Homo sapiens
gacuguuggucucuaggua

SEQ ID NO: 5080 - RNA, 19 nt, Homo sapiens
ucaagcuacugcucguaaa

SEQ ID NO: 5081 - RNA, 19 nt, Homo sapiens
ggagauauugcaaaucagu

SEQ ID NO: 5082 - RNA, 19 nt, Homo sapiens
cgugacccguguauuauug

SEQ ID NO: 5083 - RNA, 19 nt, Homo sapiens
agaaaggagaugaguauau

SEQ ID NO: 5084 - RNA, 19 nt, Homo sapiens
ucagacugcuauugaagga

SEQ ID NO: 5085 - RNA, 19 nt, Homo sapiens
gauucuggucgucgaaaua

SEQ ID NO: 5086 - RNA, 19 nt, Homo sapiens
ugaaauggcaaugaaaguu

SEQ ID NO: 5087 - RNA, 19 nt, Homo sapiens
guagagcaccaagcaauau

SEQ ID NO: 5088 - RNA, 19 nt, Homo sapiens
aaugggagcuuuugauaaa

SEQ ID NO: 5089 - RNA, 19 nt, Homo sapiens
gaugcuuguuuaauuagug

SEQ ID NO: 5090 - RNA, 19 nt, Homo sapiens
ugaaccaggauuaggauuu

SEQ ID NO: 5091 - RNA, 19 nt, Homo sapiens
gaggaaaagcuaauuggua

SEQ ID NO: 5092 - RNA, 19 nt, Homo sapiens
ucaccgaacagcagaaaga

SEQ ID NO: 5093 - RNA, 19 nt, Homo sapiens
uauaaagaccaaagcagaa

SEQ ID NO: 5094 - RNA, 19 nt, Homo sapiens
gaacuguggaggucuugga

SEQ ID NO: 5095 - RNA, 19 nt, Homo sapiens
gcacagaaacagucaaaau

SEQ ID NO: 5096 - RNA, 19 nt, Homo sapiens
uuggaaagcauuugugaaa

SEQ ID NO: 5097 - RNA, 19 nt, Homo sapiens
acaguaacuuuguagacuu

SEQ ID NO: 5098 - RNA, 19 nt, Homo sapiens
uaccaaguaugcccuggaa

SEQ ID NO: 5099 - RNA, 19 nt, Homo sapiens
gauccuaaagcuccugcua

SEQ ID NO: 5100 - RNA, 19 nt, Homo sapiens
gagcccauauuucacuuac

SEQ ID NO: 5101 - RNA, 19 nt, Homo sapiens
aguaugcccuggaaaggaa

SEQ ID NO: 5102 - RNA, 19 nt, Homo sapiens
gauacuagaggaauugucu

SEQ ID NO: 5103 - RNA, 19 nt, Homo sapiens
gcuuagaaaguauucaaga

SEQ ID NO: 5104 - RNA, 19 nt, Homo sapiens
gaagaauuggcuuauggau

SEQ ID NO: 5105 - RNA, 19 nt, Homo sapiens
caagaagccuuucaucaag

SEQ ID NO: 5106 - RNA, 19 nt, Homo sapiens
gggaugggcuucaagauag

SEQ ID NO: 5107 - RNA, 19 nt, Homo sapiens
acaagaagccuuucaucaa

SEQ ID NO: 5108 - RNA, 19 nt, Homo sapiens
cggccaaccucaucuuuga

SEQ ID NO: 5109 - RNA, 19 nt, Homo sapiens
gggcccaucuugaaguuug

SEQ ID NO: 5110 - RNA, 19 nt, Homo sapiens
ucaaguuccucaucuaagu

SEQ ID NO: 5111 - RNA, 19 nt, Homo sapiens
ggugauucaugcuguguga

SEQ ID NO: 5112 - RNA, 19 nt, Homo sapiens
gcugaaggauaacaagaag

SEQ ID NO: 5113 - RNA, 19 nt, Homo sapiens
gcgcugccaugcugaagga

SEQ ID NO: 5114 - RNA, 19 nt, Homo sapiens
ggauaaggaacaucucuuc

SEQ ID NO: 5115 - RNA, 19 nt, Homo sapiens
gacugacuguggguaauaa

SEQ ID NO: 5116 - RNA, 19 nt, Homo sapiens
ucaccaagcuccaggucau

SEQ ID NO: 5117 - RNA, 19 nt, Homo sapiens
ggucauccaguucaaguug

SEQ ID NO: 5118 - RNA, 19 nt, Homo sapiens
ugacaaaauuggcugcuuu

SEQ ID NO: 5119 - RNA, 19 nt, Homo sapiens
gcugugaacuacgcugaga

SEQ ID NO: 5120 - RNA, 19 nt, Homo sapiens
caucaugagugucaacaac

SEQ ID NO: 5121 - RNA, 19 nt, Homo sapiens
cggcucaggugaagaagau

SEQ ID NO: 5122 - RNA, 19 nt, Homo sapiens
cagcccagguggauaagga

SEQ ID NO: 5123 - RNA, 19 nt, Homo sapiens
cugccaugcugaaggauaa

SEQ ID NO: 5124 - RNA, 19 nt, Homo sapiens
acucauggguucugaaugg

SEQ ID NO: 5125 - RNA, 19 nt, Homo sapiens
ggaguuguuucccauugca

SEQ ID NO: 5126 - RNA, 19 nt, Homo sapiens
gaaggaguuguuucccauu

SEQ ID NO: 5127 - RNA, 19 nt, Homo sapiens
uaacaagaagccuuucauc

SEQ ID NO: 5128 - RNA, 19 nt, Homo sapiens
ugacugacuguggguaaua

SEQ ID NO: 5129 - RNA, 19 nt, Homo sapiens
ccucaaguuccucaucuaa

SEQ ID NO: 5130 - RNA, 19 nt, Homo sapiens
ucagaucacaugggaauga

SEQ ID NO: 5131 - RNA, 19 nt, Homo sapiens
gauaacaagaagccuuuca

SEQ ID NO: 5132 - RNA, 19 nt, Homo sapiens
gcaguuacacaccaucuac

SEQ ID NO: 5133 - RNA, 19 nt, Homo sapiens
ccagaccgcccucgauugu

SEQ ID NO: 5134 - RNA, 19 nt, Homo sapiens
ccagggaacggcagugaug

SEQ ID NO: 5135 - RNA, 19 nt, Homo sapiens
gcggugcuggccucgauua

SEQ ID NO: 5136 - RNA, 19 nt, Homo sapiens
agggaugggcuucaagaua

SEQ ID NO: 5137 - RNA, 19 nt, Homo sapiens
aaggaguuguuucccauug

SEQ ID NO: 5138 - RNA, 19 nt, Homo sapiens
ccagacaugccgggacuuu

SEQ ID NO: 5139 - RNA, 19 nt, Homo sapiens
ccgcaucacugagaucuac

SEQ ID NO: 5140 - RNA, 19 nt, Homo sapiens
ggaaccaaagccuggauca

SEQ ID NO: 5141 - RNA, 19 nt, Homo sapiens
cagcggcucaggugaagaa

SEQ ID NO: 5142 - RNA, 19 nt, Homo sapiens
ggacagagcccugcaaaac

SEQ ID NO: 5143 - RNA, 19 nt, Homo sapiens
gccucaaguuccucaucua

SEQ ID NO: 5144 - RNA, 19 nt, Homo sapiens
gccgggacuuugccgagaa

SEQ ID NO: 5145 - RNA, 19 nt, Homo sapiens
aacaagaagccuuucauca

SEQ ID NO: 5146 - RNA, 19 nt, Homo sapiens
cgagacacaccagauguug

SEQ ID NO: 5147 - RNA, 19 nt, Homo sapiens
ggaagaaagaagacaagcu

SEQ ID NO: 5148 - RNA, 19 nt, Homo sapiens
ucaccacugugccucaagu

SEQ ID NO: 5149 - RNA, 19 nt, Homo sapiens
ccagggaugggcuucaaga

SEQ ID NO: 5150 - RNA, 19 nt, Homo sapiens
ucgauugugcugugaacua

SEQ ID NO: 5151 - RNA, 19 nt, Homo sapiens
caagauagccaugcaaacc

SEQ ID NO: 5152 - RNA, 19 nt, Homo sapiens
cgacucauggguucugaau

SEQ ID NO: 5153 - RNA, 19 nt, Homo sapiens
gcugccaugcugaaggaua

SEQ ID NO: 5154 - RNA, 19 nt, Homo sapiens
acagagcccugcaaaacaa

SEQ ID NO: 5155 - RNA, 19 nt, Homo sapiens
ugacuguggguaauaaaca

SEQ ID NO: 5156 - RNA, 19 nt, Homo sapiens
uugcagcccagguggauaa

SEQ ID NO: 5157 - RNA, 19 nt, Homo sapiens
cgauugugcugugaacuac

SEQ ID NO: 5158 - RNA, 19 nt, Homo sapiens
ccagguggauaaggaacau

SEQ ID NO: 5159 - RNA, 19 nt, Homo sapiens
caaguuccucaucuaagug

SEQ ID NO: 5160 - RNA, 19 nt, Homo sapiens
ccaccaggccauccagauc

SEQ ID NO: 5161 - RNA, 19 nt, Homo sapiens
ggccugggacugugucugu

SEQ ID NO: 5162 - RNA, 19 nt, Homo sapiens
gugcuggccucgauuaccu

SEQ ID NO: 5163 - RNA, 19 nt, Homo sapiens
cgagggcaccagcgaaauc

SEQ ID NO: 5164 - RNA, 19 nt, Homo sapiens
aggauaacaagaagccuuu

SEQ ID NO: 5165 - RNA, 19 nt, Homo sapiens
caucuaccagucuguggaa

SEQ ID NO: 5166 - RNA, 19 nt, Homo sapiens
gaaauuuccugacuuguuu

SEQ ID NO: 5167 - RNA, 19 nt, Homo sapiens
gcuggaagcugcaagauua

SEQ ID NO: 5168 - RNA, 19 nt, Homo sapiens
gaagaaauuuccugacuug

SEQ ID NO: 5169 - RNA, 19 nt, Homo sapiens
ggacauggcuauaaguaug

SEQ ID NO: 5170 - RNA, 19 nt, Homo sapiens
ggaauuaccuccuucuuag

SEQ ID NO: 5171 - RNA, 19 nt, Homo sapiens
ccacagcauucgaauauuu

SEQ ID NO: 5172 - RNA, 19 nt, Homo sapiens
gaccagagcugauaaagag

SEQ ID NO: 5173 - RNA, 19 nt, Homo sapiens
gcagaauacugacgucuau

SEQ ID NO: 5174 - RNA, 19 nt, Homo sapiens
ggagaaaucaguaauacaa

SEQ ID NO: 5175 - RNA, 19 nt, Homo sapiens
guaggaaguuucugccuuu

SEQ ID NO: 5176 - RNA, 19 nt, Homo sapiens
gaaguuucaucccaucauu

SEQ ID NO: 5177 - RNA, 19 nt, Homo sapiens
gagaaauacuuccgagaug

SEQ ID NO: 5178 - RNA, 19 nt, Homo sapiens
gaagcucuacucaauauaa

SEQ ID NO: 5179 - RNA, 19 nt, Homo sapiens
cagaagcucuacucaauau

SEQ ID NO: 5180 - RNA, 19 nt, Homo sapiens
ggacaaacaacgaguaaau

SEQ ID NO: 5181 - RNA, 19 nt, Homo sapiens
ggauaucugucaugcacua

SEQ ID NO: 5182 - RNA, 19 nt, Homo sapiens
gagaaucaguggaaaauaa

SEQ ID NO: 5183 - RNA, 19 nt, Homo sapiens
gggaauuaccuccuucuua

SEQ ID NO: 5184 - RNA, 19 nt, Homo sapiens
gaagguagaauaggaauug

SEQ ID NO: 5185 - RNA, 19 nt, Homo sapiens
ggaauuagccaaaguugau

SEQ ID NO: 5186 - RNA, 19 nt, Homo sapiens
guaaauguaucgaguggau

SEQ ID NO: 5187 - RNA, 19 nt, Homo sapiens
gaagauuccuccucauguc

SEQ ID NO: 5188 - RNA, 19 nt, Homo sapiens
gcaaagauugguacgauau

SEQ ID NO: 5189 - RNA, 19 nt, Homo sapiens
ugacuacacuauuccauau

SEQ ID NO: 5190 - RNA, 19 nt, Homo sapiens
caaugaagguagaauagga

SEQ ID NO: 5191 - RNA, 19 nt, Homo sapiens
ucaauacaguguuggauau

SEQ ID NO: 5192 - RNA, 19 nt, Homo sapiens
ccacugugcucgugauaga

SEQ ID NO: 5193 - RNA, 19 nt, Homo sapiens
gucagaagcucuacucaau

SEQ ID NO: 5194 - RNA, 19 nt, Homo sapiens
aaaggcaucugaaguacaa

SEQ ID NO: 5195 - RNA, 19 nt, Homo sapiens
gguagugacucauuugcuu

SEQ ID NO: 5196 - RNA, 19 nt, Homo sapiens
aauaaaggcaucugaagua

SEQ ID NO: 5197 - RNA, 19 nt, Homo sapiens
gaauaaacuuccacagcau

SEQ ID NO: 5198 - RNA, 19 nt, Homo sapiens
aagcgucaauggccaaaua

SEQ ID NO: 5199 - RNA, 19 nt, Homo sapiens
gaggaaaugaugauaaaga

SEQ ID NO: 5200 - RNA, 19 nt, Homo sapiens
gaaauuggguuuugguuca

SEQ ID NO: 5201 - RNA, 19 nt, Homo sapiens
uuaaagcuguauacgcaua

SEQ ID NO: 5202 - RNA, 19 nt, Homo sapiens
gaugaggaaaugaugauaa

SEQ ID NO: 5203 - RNA, 19 nt, Homo sapiens
uaucugucaugcacuauuu

SEQ ID NO: 5204 - RNA, 19 nt, Homo sapiens
ggagaaauacuuccgagau

SEQ ID NO: 5205 - RNA, 19 nt, Homo sapiens
caaacaacgaguaaaugua

SEQ ID NO: 5206 - RNA, 19 nt, Homo sapiens
gaacaccauugcaaagcau

SEQ ID NO: 5207 - RNA, 19 nt, Homo sapiens
ugacuuguuugucuucuug

SEQ ID NO: 5208 - RNA, 19 nt, Homo sapiens
gcuggaaagccauucauaa

SEQ ID NO: 5209 - RNA, 19 nt, Homo sapiens
gaagcugcaagauuacuaa

SEQ ID NO: 5210 - RNA, 19 nt, Homo sapiens
guugauggguauugaaguu

SEQ ID NO: 5211 - RNA, 19 nt, Homo sapiens
cacaggagauccacuuuua

SEQ ID NO: 5212 - RNA, 19 nt, Homo sapiens
ggaaagccauucauaaaag

SEQ ID NO: 5213 - RNA, 19 nt, Homo sapiens
gaaguugacccagaauaug

SEQ ID NO: 5214 - RNA, 19 nt, Homo sapiens
gaaaucaguaauacaagga

SEQ ID NO: 5215 - RNA, 19 nt, Homo sapiens
cugcaaacauuuacagaug

SEQ ID NO: 5216 - RNA, 19 nt, Homo sapiens
uuuaaacgguugugucuug

SEQ ID NO: 5217 - RNA, 19 nt, Homo sapiens
caaagauugguacgauaua

SEQ ID NO: 5218 - RNA, 19 nt, Homo sapiens
gaagaccagagcugauaaa

SEQ ID NO: 5219 - RNA, 19 nt, Homo sapiens
ccaaagugcugggauuaca

SEQ ID NO: 5220 - RNA, 19 nt, Homo sapiens
aaacgguugugucuuguug

SEQ ID NO: 5221 - RNA, 19 nt, Homo sapiens
gcugcaagauuacuaacau

SEQ ID NO: 5222 - RNA, 19 nt, Homo sapiens
cauagggagucucaaugaa

SEQ ID NO: 5223 - RNA, 19 nt, Homo sapiens
gauagaggaauuagccaaa

SEQ ID NO: 5224 - RNA, 19 nt, Homo sapiens
gaaaauggagaaaucagua

SEQ ID NO: 5225 - RNA, 19 nt, Homo sapiens
gcaaacauuuacagaugag

SEQ ID NO: 5226 - RNA, 19 nt, Homo sapiens
gagcagguagugacucauu

SEQ ID NO: 5227 - RNA, 19 nt, Homo sapiens
agaagaaauuuccugacuu

SEQ ID NO: 5228 - RNA, 19 nt, Homo sapiens
gcaggacaaacaacgagua

SEQ ID NO: 5229 - RNA, 19 nt, Homo sapiens
gaaagccauucauaaaaga

SEQ ID NO: 5230 - RNA, 19 nt, Homo sapiens
caaauuggacauggcuaua

SEQ ID NO: 5231 - RNA, 19 nt, Homo sapiens
agagggagauuauuauguc

SEQ ID NO: 5232 - RNA, 19 nt, Homo sapiens
ggaaguuucugccuuucag

SEQ ID NO: 5233 - RNA, 19 nt, Homo sapiens
aggaacaaauugcaccuuu

SEQ ID NO: 5234 - RNA, 19 nt, Homo sapiens
ggucauaugauugaagaaa

SEQ ID NO: 5235 - RNA, 19 nt, Homo sapiens
cuuccgagaugcaaagauu

SEQ ID NO: 5236 - RNA, 19 nt, Homo sapiens
ccaaauacuaugcaucaga

SEQ ID NO: 5237 - RNA, 19 nt, Homo sapiens
ggccaaauacuaugcauca

SEQ ID NO: 5238 - RNA, 19 nt, Homo sapiens
ggaagcugcaagauuacua

SEQ ID NO: 5239 - RNA, 19 nt, Homo sapiens
gcaaggauguuuugacuac

SEQ ID NO: 5240 - RNA, 19 nt, Homo sapiens
ucagaagcucuacucaaua

SEQ ID NO: 5241 - RNA, 19 nt, Homo sapiens
gauccagaacacauuaauu

SEQ ID NO: 5242 - RNA, 19 nt, Homo sapiens
caaggauuauuucaacaag

SEQ ID NO: 5243 - RNA, 19 nt, Homo sapiens
gaugauaaagaguucaguu

SEQ ID NO: 5244 - RNA, 19 nt, Homo sapiens
uggcuggguauuuauauua

SEQ ID NO: 5245 - RNA, 19 nt, Homo sapiens
uaggcuacaccaaagauua

SEQ ID NO: 5246 - RNA, 19 nt, Homo sapiens
cugcaagauuacuaacaua

SEQ ID NO: 5247 - RNA, 19 nt, Homo sapiens
ccauagggagucucaauga

SEQ ID NO: 5248 - RNA, 19 nt, Homo sapiens
gcagguagugacucauuug

SEQ ID NO: 5249 - RNA, 19 nt, Homo sapiens
gaacaaaaggccaccuauu

SEQ ID NO: 5250 - RNA, 19 nt, Homo sapiens
ugagauccagaacacauua

SEQ ID NO: 5251 - RNA, 19 nt, Homo sapiens
ugaaguugacccagaauau

SEQ ID NO: 5252 - RNA, 19 nt, Homo sapiens
uaggucauaugauugaaga

SEQ ID NO: 5253 - RNA, 19 nt, Homo sapiens
aggaauugcugcacagaug

SEQ ID NO: 5254 - RNA, 19 nt, Homo sapiens
ccaccugcccguuaacauu

SEQ ID NO: 5255 - RNA, 19 nt, Homo sapiens
aagaagaaauuuccugacu

SEQ ID NO: 5256 - RNA, 19 nt, Homo sapiens
cauucuaguuucagaguau

SEQ ID NO: 5257 - RNA, 19 nt, Homo sapiens
gagauccacuuuuaaacuu

SEQ ID NO: 5258 - RNA, 19 nt, Homo sapiens
uaacuuaggcacaggagau

SEQ ID NO: 5259 - RNA, 19 nt, Homo sapiens
gucaauggccaaauacuau

SEQ ID NO: 5260 - RNA, 19 nt, Homo sapiens
cuggaaagccauucauaaa

SEQ ID NO: 5261 - RNA, 19 nt, Homo sapiens
gcaagauuacuaacauaca

SEQ ID NO: 5262 - RNA, 19 nt, Homo sapiens
agaaauuuccugacuuguu

SEQ ID NO: 5263 - RNA, 19 nt, Homo sapiens
gaaauacuuccgagaugca

SEQ ID NO: 5264 - RNA, 19 nt, Homo sapiens
aagauuacccuguggagaa

SEQ ID NO: 5265 - RNA, 19 nt, Homo sapiens
aagaaaggauacaauuugg

SEQ ID NO: 5266 - RNA, 19 nt, Homo sapiens
gcacaaaggcccagaaaga

SEQ ID NO: 5267 - RNA, 19 nt, Homo sapiens
cagcagagguguucuuuga

SEQ ID NO: 5268 - RNA, 19 nt, Homo sapiens
gaaggaaccuggaguagag

SEQ ID NO: 5269 - RNA, 19 nt, Homo sapiens
gagcagacacaguuucuua

SEQ ID NO: 5270 - RNA, 19 nt, Homo sapiens
ccacuuggcuucugaauac

SEQ ID NO: 5271 - RNA, 19 nt, Homo sapiens
gcagagguguucuuugaug

SEQ ID NO: 5272 - RNA, 19 nt, Homo sapiens
uaacugaguccauggcuua

SEQ ID NO: 5273 - RNA, 19 nt, Homo sapiens
caucaaggcuucaaacaca

SEQ ID NO: 5274 - RNA, 19 nt, Homo sapiens
gaucaugccacuaaucgua

SEQ ID NO: 5275 - RNA, 19 nt, Homo sapiens
cagaucagguguucccaua

SEQ ID NO: 5276 - RNA, 19 nt, Homo sapiens
ggagaaaauucacaacuuu

SEQ ID NO: 5277 - RNA, 19 nt, Homo sapiens
gaaugacgcucuggagaug

SEQ ID NO: 5278 - RNA, 19 nt, Homo sapiens
ugagaggcaucauugcuaa

SEQ ID NO: 5279 - RNA, 19 nt, Homo sapiens
ccucaacaauggaagguuu

SEQ ID NO: 5280 - RNA, 19 nt, Homo sapiens
gcagacacaguuucuuaaa

SEQ ID NO: 5281 - RNA, 19 nt, Homo sapiens
ccuggaaggugacagauga

SEQ ID NO: 5282 - RNA, 19 nt, Homo sapiens
ccacggacuuccagauaga

SEQ ID NO: 5283 - RNA, 19 nt, Homo sapiens
aggagaagaucacagcuuu

SEQ ID NO: 5284 - RNA, 19 nt, Homo sapiens
ggaugguuaugcugcagua

SEQ ID NO: 5285 - RNA, 19 nt, Homo sapiens
gaacgaucccgccaagaau

SEQ ID NO: 5286 - RNA, 19 nt, Homo sapiens
cuuacugccucgcaaauaa

SEQ ID NO: 5287 - RNA, 19 nt, Homo sapiens
gggagacuguggccgcuuu

SEQ ID NO: 5288 - RNA, 19 nt, Homo sapiens
caacccacuuggcuucuga

SEQ ID NO: 5289 - RNA, 19 nt, Homo sapiens
ccacuaaucguacccaguu

SEQ ID NO: 5290 - RNA, 19 nt, Homo sapiens
gguguucuuugauggagua

SEQ ID NO: 5291 - RNA, 19 nt, Homo sapiens
gaccuuggcgugggcauua

SEQ ID NO: 5292 - RNA, 19 nt, Homo sapiens
uggcagugcucuaaagaau

SEQ ID NO: 5293 - RNA, 19 nt, Homo sapiens
gcagugcucuaaagaaucc

SEQ ID NO: 5294 - RNA, 19 nt, Homo sapiens
ugaacgaucccgccaagaa

SEQ ID NO: 5295 - RNA, 19 nt, Homo sapiens
gaaggugacagaugaaugc

SEQ ID NO: 5296 - RNA, 19 nt, Homo sapiens
gaagagcagacacaguuuc

SEQ ID NO: 5297 - RNA, 19 nt, Homo sapiens
gcacuuacugccucgcaaa

SEQ ID NO: 5298 - RNA, 19 nt, Homo sapiens
caagagcucuaccgcaacu

SEQ ID NO: 5299 - RNA, 19 nt, Homo sapiens
gcagggcuguauggacaaa

SEQ ID NO: 5300 - RNA, 19 nt, Homo sapiens
acaaaggcccagaaagaaa

SEQ ID NO: 5301 - RNA, 19 nt, Homo sapiens
ucaaaggcauccugcucuu

SEQ ID NO: 5302 - RNA, 19 nt, Homo sapiens
caggagccgugaaggagaa

SEQ ID NO: 5303 - RNA, 19 nt, Homo sapiens
gcuaggagaggcaggcaaa

SEQ ID NO: 5304 - RNA, 19 nt, Homo sapiens
caagacaccaguuacagau

SEQ ID NO: 5305 - RNA, 19 nt, Homo sapiens
caucagagcaucgguuuca

SEQ ID NO: 5306 - RNA, 19 nt, Homo sapiens
gggcuuggcagugcucuaa

SEQ ID NO: 5307 - RNA, 19 nt, Homo sapiens
ggaaggugacagaugaaug

SEQ ID NO: 5308 - RNA, 19 nt, Homo sapiens
ccaagacaccaguuacaga

SEQ ID NO: 5309 - RNA, 19 nt, Homo sapiens
gggccuagcagacaucuuc

SEQ ID NO: 5310 - RNA, 19 nt, Homo sapiens
ggcggaaucuaaguccuuu

SEQ ID NO: 5311 - RNA, 19 nt, Homo sapiens
ugacauucuucggcuguuu

SEQ ID NO: 5312 - RNA, 19 nt, Homo sapiens
caugaaggaaccuggagua

SEQ ID NO: 5313 - RNA, 19 nt, Homo sapiens
gggagaaaauucacaacuu

SEQ ID NO: 5314 - RNA, 19 nt, Homo sapiens
ccaugcacauccucaacaa

SEQ ID NO: 5315 - RNA, 19 nt, Homo sapiens
cacaaaggcccagaaagaa

SEQ ID NO: 5316 - RNA, 19 nt, Homo sapiens
cagacacaguuucuuaaag

SEQ ID NO: 5317 - RNA, 19 nt, Homo sapiens
gaacgugcugggugagguu

SEQ ID NO: 5318 - RNA, 19 nt, Homo sapiens
ccggagagauucggagaug

SEQ ID NO: 5319 - RNA, 19 nt, Homo sapiens
ccacaggagccgugaagga

SEQ ID NO: 5320 - RNA, 19 nt, Homo sapiens
cggccaaggcggaaucuaa

SEQ ID NO: 5321 - RNA, 19 nt, Homo sapiens
ggagagauucggagaugca

SEQ ID NO: 5322 - RNA, 19 nt, Homo sapiens
gccacggacuuccagauag

SEQ ID NO: 5323 - RNA, 19 nt, Homo sapiens
cgguagaucaugccacuaa

SEQ ID NO: 5324 - RNA, 19 nt, Homo sapiens
gcacauccucaacaaugga

SEQ ID NO: 5325 - RNA, 19 nt, Homo sapiens
acgaagagcagacacaguu

SEQ ID NO: 5326 - RNA, 19 nt, Homo sapiens
gguggaggccaagcugaua

SEQ ID NO: 5327 - RNA, 19 nt, Homo sapiens
guuaugcugcaguauguaa

SEQ ID NO: 5328 - RNA, 19 nt, Homo sapiens
gaagcuggcacggaugguu

SEQ ID NO: 5329 - RNA, 19 nt, Homo sapiens
gguagaucaugccacuaau

SEQ ID NO: 5330 - RNA, 19 nt, Homo sapiens
gaucagguguucccauacc

SEQ ID NO: 5331 - RNA, 19 nt, Homo sapiens
gagccugugucccguuucu

SEQ ID NO: 5332 - RNA, 19 nt, Homo sapiens
cgaagagcagacacaguuu

SEQ ID NO: 5333 - RNA, 19 nt, Homo sapiens
ggugugggccuuugcaaca

SEQ ID NO: 5334 - RNA, 19 nt, Homo sapiens
gcucuaccgcaacuucaaa

SEQ ID NO: 5335 - RNA, 19 nt, Homo sapiens
ccacggcccagcaugagaa

SEQ ID NO: 5336 - RNA, 19 nt, Homo sapiens
ugaaggaaccuggaguaga

SEQ ID NO: 5337 - RNA, 19 nt, Homo sapiens
cguccgugcucaacgaaga

SEQ ID NO: 5338 - RNA, 19 nt, Homo sapiens
ucagagcaucgguuucaaa

SEQ ID NO: 5339 - RNA, 19 nt, Homo sapiens
ugccuucccucaagccaaa

SEQ ID NO: 5340 - RNA, 19 nt, Homo sapiens
gcaagcuuuggaucaguaa

SEQ ID NO: 5341 - RNA, 19 nt, Homo sapiens
aaggccagcucaccacaga

SEQ ID NO: 5342 - RNA, 19 nt, Homo sapiens
aagcuggcacggaugguua

SEQ ID NO: 5343 - RNA, 19 nt, Homo sapiens
gcaacccacuuggcuucug

SEQ ID NO: 5344 - RNA, 19 nt, Homo sapiens
gcuuggcagugcucuaaag

SEQ ID NO: 5345 - RNA, 19 nt, Homo sapiens
agcaagcuuuggaucagua

SEQ ID NO: 5346 - RNA, 19 nt, Homo sapiens
uacuauacccucaauggaa

SEQ ID NO: 5347 - RNA, 19 nt, Homo sapiens
gaaugcuggccuccugcua

SEQ ID NO: 5348 - RNA, 19 nt, Homo sapiens
ugaaugcauccaaaucaug

SEQ ID NO: 5349 - RNA, 19 nt, Homo sapiens
ugguuaugcugcaguaugu

SEQ ID NO: 5350 - RNA, 19 nt, Homo sapiens
ucacaacuuugggcugauc

SEQ ID NO: 5351 - RNA, 19 nt, Homo sapiens
gagaagaucacagcuuuug

SEQ ID NO: 5352 - RNA, 19 nt, Homo sapiens
uguggccgcuuucugucua

SEQ ID NO: 5353 - RNA, 19 nt, Homo sapiens
caaaggcccagaaagaaaa

SEQ ID NO: 5354 - RNA, 19 nt, Homo sapiens
guggaggccaagcugauaa

SEQ ID NO: 5355 - RNA, 19 nt, Homo sapiens
guagaucaugccacuaauc

SEQ ID NO: 5356 - RNA, 19 nt, Homo sapiens
gcuucaagguugccaugca

SEQ ID NO: 5357 - RNA, 19 nt, Homo sapiens
gaaaauacuauacccucaa

SEQ ID NO: 5358 - RNA, 19 nt, Homo sapiens
gagaaaaugcucugugaca

SEQ ID NO: 5359 - RNA, 19 nt, Homo sapiens
gacuguggccgcuuucugu

SEQ ID NO: 5360 - RNA, 19 nt, Homo sapiens
agaaugacgcucuggagau

SEQ ID NO: 5361 - RNA, 19 nt, Homo sapiens
guccuuugcugugggaaug

SEQ ID NO: 5362 - RNA, 19 nt, Homo sapiens
cugacgcucugaccaggaa

SEQ ID NO: 5363 - RNA, 19 nt, Homo sapiens
gacauucuucggcuguuug

SEQ ID NO: 5364 - RNA, 19 nt, Homo sapiens
cuucgcaucuuccggaucu

SEQ ID NO: 5365 - RNA, 19 nt, Homo sapiens
gcaucuuccggaucuuuga

SEQ ID NO: 5366 - RNA, 19 nt, Homo sapiens
cagauaagcuguuucauuu

SEQ ID NO: 5367 - RNA, 19 nt, Homo sapiens
ggaaguaaaugaagccuuu

SEQ ID NO: 5368 - RNA, 19 nt, Homo sapiens
gaaaugaacaggacgcuua

SEQ ID NO: 5369 - RNA, 19 nt, Homo sapiens
ggguaaagcuugaagauuu

SEQ ID NO: 5370 - RNA, 19 nt, Homo sapiens
gcaaagaagcugaauauug

SEQ ID NO: 5371 - RNA, 19 nt, Homo sapiens
gcgaagaggcucaauguua

SEQ ID NO: 5372 - RNA, 19 nt, Homo sapiens
caaagaagcugaauauugc

SEQ ID NO: 5373 - RNA, 19 nt, Homo sapiens
gacaaccucugcuauuuaa

SEQ ID NO: 5374 - RNA, 19 nt, Homo sapiens
gaacacccauuggaucuuu

SEQ ID NO: 5375 - RNA, 19 nt, Homo sapiens
gaaagaaaauggcacagua

SEQ ID NO: 5376 - RNA, 19 nt, Homo sapiens
gaacaggacgcuuaugcua

SEQ ID NO: 5377 - RNA, 19 nt, Homo sapiens
ggugcaggcuuaccuauuu

SEQ ID NO: 5378 - RNA, 19 nt, Homo sapiens
gaaggaaguggucauagua

SEQ ID NO: 5379 - RNA, 19 nt, Homo sapiens
ggaaauaagauauguggaa

SEQ ID NO: 5380 - RNA, 19 nt, Homo sapiens
ggaacggaguuauguauca

SEQ ID NO: 5381 - RNA, 19 nt, Homo sapiens
gguaaagcuugaagauuug

SEQ ID NO: 5382 - RNA, 19 nt, Homo sapiens
gaacggaguuauguaucaa

SEQ ID NO: 5383 - RNA, 19 nt, Homo sapiens
cauaguaagugcuacaaga

SEQ ID NO: 5384 - RNA, 19 nt, Homo sapiens
cagaaggccugcuguaauc

SEQ ID NO: 5385 - RNA, 19 nt, Homo sapiens
uagacaaccucugcuauuu

SEQ ID NO: 5386 - RNA, 19 nt, Homo sapiens
gagagcauguccaauguuc

SEQ ID NO: 5387 - RNA, 19 nt, Homo sapiens
cgaagaggcucaauguuac

SEQ ID NO: 5388 - RNA, 19 nt, Homo sapiens
gcuugaagauuugauugua

SEQ ID NO: 5389 - RNA, 19 nt, Homo sapiens
gaauauugcacgaaaugaa

SEQ ID NO: 5390 - RNA, 19 nt, Homo sapiens
ggugaaagaagaugaagaa

SEQ ID NO: 5391 - RNA, 19 nt, Homo sapiens
acaggacgcuuaugcuauu

SEQ ID NO: 5392 - RNA, 19 nt, Homo sapiens
acaaggaggugaaggacaa

SEQ ID NO: 5393 - RNA, 19 nt, Homo sapiens
ucagauaagcuguuucauu

SEQ ID NO: 5394 - RNA, 19 nt, Homo sapiens
ccacuaagcuugguuccau

SEQ ID NO: 5395 - RNA, 19 nt, Homo sapiens
guagacaaccucugcuauu

SEQ ID NO: 5396 - RNA, 19 nt, Homo sapiens
aagaagauauugcaaugug

SEQ ID NO: 5397 - RNA, 19 nt, Homo sapiens
ggaggaggccgcuagucua

SEQ ID NO: 5398 - RNA, 19 nt, Homo sapiens
agacaaccucugcuauuua

SEQ ID NO: 5399 - RNA, 19 nt, Homo sapiens
uccaauugcuccuguauau

SEQ ID NO: 5400 - RNA, 19 nt, Homo sapiens
gcaagaauaguagcauuug

SEQ ID NO: 5401 - RNA, 19 nt, Homo sapiens
aguauugggugcaggcuua

SEQ ID NO: 5402 - RNA, 19 nt, Homo sapiens
uuaaagaugugggauugaa

SEQ ID NO: 5403 - RNA, 19 nt, Homo sapiens
ugaaggaaguggucauagu

SEQ ID NO: 5404 - RNA, 19 nt, Homo sapiens
ggacgcuuaugcuauuaau

SEQ ID NO: 5405 - RNA, 19 nt, Homo sapiens
gcuaacugaugucuacaau

SEQ ID NO: 5406 - RNA, 19 nt, Homo sapiens
gcaaggagaauacggucuu

SEQ ID NO: 5407 - RNA, 19 nt, Homo sapiens
cugcaucuaugguucuuaa

SEQ ID NO: 5408 - RNA, 19 nt, Homo sapiens
uuacaccacuggcaagaau

SEQ ID NO: 5409 - RNA, 19 nt, Homo sapiens
gcaaaguuccaaagcugaa

SEQ ID NO: 5410 - RNA, 19 nt, Homo sapiens
cagauguaguggugaaaga

SEQ ID NO: 5411 - RNA, 19 nt, Homo sapiens
augggaagcugggaaauuu

SEQ ID NO: 5412 - RNA, 19 nt, Homo sapiens
guccaauguuccauaugua

SEQ ID NO: 5413 - RNA, 19 nt, Homo sapiens
cuacaaggcaggcaguauu

SEQ ID NO: 5414 - RNA, 19 nt, Homo sapiens
ccagaaggccugcuguaau

SEQ ID NO: 5415 - RNA, 19 nt, Homo sapiens
caggauuguuggucauuug

SEQ ID NO: 5416 - RNA, 19 nt, Homo sapiens
ggcaagaauaguagcauuu

SEQ ID NO: 5417 - RNA, 19 nt, Homo sapiens
gaaguggucauaguaagug

SEQ ID NO: 5418 - RNA, 19 nt, Homo sapiens
caugauggccucucaaagu

SEQ ID NO: 5419 - RNA, 19 nt, Homo sapiens
ccaaagcugaagacaguuu

SEQ ID NO: 5420 - RNA, 19 nt, Homo sapiens
guaccaccauaaacaaagu

SEQ ID NO: 5421 - RNA, 19 nt, Homo sapiens
cuguagaaccuauugauuu

SEQ ID NO: 5422 - RNA, 19 nt, Homo sapiens
uuccaaagcugaagacagu

SEQ ID NO: 5423 - RNA, 19 nt, Homo sapiens
ggaaguggucauaguaagu

SEQ ID NO: 5424 - RNA, 19 nt, Homo sapiens
gcuacaagaacacccauug

SEQ ID NO: 5425 - RNA, 19 nt, Homo sapiens
gaccagaaggccugcugua

SEQ ID NO: 5426 - RNA, 19 nt, Homo sapiens
guuguacuagcaaacauua

SEQ ID NO: 5427 - RNA, 19 nt, Homo sapiens
ggaggcuggugcaggaaau

SEQ ID NO: 5428 - RNA, 19 nt, Homo sapiens
uguccaauguuccauaugu

SEQ ID NO: 5429 - RNA, 19 nt, Homo sapiens
gauggccucucaaagucuu

SEQ ID NO: 5430 - RNA, 19 nt, Homo sapiens
gcauguccaauguuccaua

SEQ ID NO: 5431 - RNA, 19 nt, Homo sapiens
ccaggauuguuggucauuu

SEQ ID NO: 5432 - RNA, 19 nt, Homo sapiens
gcuguagaaccuauugauu

SEQ ID NO: 5433 - RNA, 19 nt, Homo sapiens
cagcgaagaggcucaaugu

SEQ ID NO: 5434 - RNA, 19 nt, Homo sapiens
guaaugaacagaggaucaa

SEQ ID NO: 5435 - RNA, 19 nt, Homo sapiens
gaauacggucuugccagua

SEQ ID NO: 5436 - RNA, 19 nt, Homo sapiens
caaugugggaaguaaauga

SEQ ID NO: 5437 - RNA, 19 nt, Homo sapiens
cauguccaauguuccauau

SEQ ID NO: 5438 - RNA, 19 nt, Homo sapiens
gaagaauauaaacguguug

SEQ ID NO: 5439 - RNA, 19 nt, Homo sapiens
gaagcugggaaauuuggaa

SEQ ID NO: 5440 - RNA, 19 nt, Homo sapiens
caggacgcuuaugcuauua

SEQ ID NO: 5441 - RNA, 19 nt, Homo sapiens
uggcaagaauaguagcauu

SEQ ID NO: 5442 - RNA, 19 nt, Homo sapiens
gaagaggcucaauguuaca

SEQ ID NO: 5443 - RNA, 19 nt, Homo sapiens
cagaggaucaacaccauau

SEQ ID NO: 5444 - RNA, 19 nt, Homo sapiens
ggguaauguucuacaagga

SEQ ID NO: 5445 - RNA, 19 nt, Homo sapiens
uaaagaugugggauugaaa

SEQ ID NO: 5446 - RNA, 19 nt, Homo sapiens
gcugaauauugcacgaaau

SEQ ID NO: 5447 - RNA, 19 nt, Homo sapiens
ggagagcauguccaauguu

SEQ ID NO: 5448 - RNA, 19 nt, Homo sapiens
gauauguggaacggaguua

SEQ ID NO: 5449 - RNA, 19 nt, Homo sapiens
caauguuccauauguaaug

SEQ ID NO: 5450 - RNA, 19 nt, Homo sapiens
ccauguaccaccauaaaca

SEQ ID NO: 5451 - RNA, 19 nt, Homo sapiens
cauggguaauguucuacaa

SEQ ID NO: 5452 - RNA, 19 nt, Homo sapiens
gcuguaaucagugugacua

SEQ ID NO: 5453 - RNA, 19 nt, Homo sapiens
caauugcuccuguauaugc

SEQ ID NO: 5454 - RNA, 19 nt, Homo sapiens
caagaauaguagcauuugc

SEQ ID NO: 5455 - RNA, 19 nt, Homo sapiens
acgcuuaugcuauuaauuc

SEQ ID NO: 5456 - RNA, 19 nt, Homo sapiens
aaagacgggcuaacugaug

SEQ ID NO: 5457 - RNA, 19 nt, Homo sapiens
cagcugcucugguucucau

SEQ ID NO: 5458 - RNA, 19 nt, Homo sapiens
aagcuugguuccauugcaa

SEQ ID NO: 5459 - RNA, 19 nt, Homo sapiens
aagacgggcuaacugaugu

SEQ ID NO: 5460 - RNA, 19 nt, Homo sapiens
gugcaggcuuaccuauuuc

SEQ ID NO: 5461 - RNA, 19 nt, Homo sapiens
caaaagaagaagugaaaga

SEQ ID NO: 5462 - RNA, 19 nt, Homo sapiens
guggaacggaguuauguau

SEQ ID NO: 5463 - RNA, 19 nt, Homo sapiens
gcagcgaagaggcucaaug

SEQ ID NO: 5464 - RNA, 19 nt, Homo sapiens
uaaaagacgggcuaacuga

SEQ ID NO: 5465 - RNA, 19 nt, Homo sapiens
gaggaucaacaccauaugg

SEQ ID NO: 5466 - RNA, 19 nt, Homo sapiens
gcauggagcugccagauga

SEQ ID NO: 5467 - RNA, 19 nt, Homo sapiens
caucauagguuccuucaau

SEQ ID NO: 5468 - RNA, 19 nt, Homo sapiens
gaacaucagaucaaucauu

SEQ ID NO: 5469 - RNA, 19 nt, Homo sapiens
ugaaaucaaugaagccuuu

SEQ ID NO: 5470 - RNA, 19 nt, Homo sapiens
gagaacaggaguaaagaua

SEQ ID NO: 5471 - RNA, 19 nt, Homo sapiens
ucacuuggcuuacuugaga

SEQ ID NO: 5472 - RNA, 19 nt, Homo sapiens
ggaauucccuacucuguuc

SEQ ID NO: 5473 - RNA, 19 nt, Homo sapiens
gaacaaccucaauuucuuu

SEQ ID NO: 5474 - RNA, 19 nt, Homo sapiens
ggacagagaaugcacagaa

SEQ ID NO: 5475 - RNA, 19 nt, Homo sapiens
guacuagguugcaauaugu

SEQ ID NO: 5476 - RNA, 19 nt, Homo sapiens
gaagccauguccaagcuaa

SEQ ID NO: 5477 - RNA, 19 nt, Homo sapiens
gagaaugaauugcuuaaac

SEQ ID NO: 5478 - RNA, 19 nt, Homo sapiens
gaaaaggucuuauugaagu

SEQ ID NO: 5479 - RNA, 19 nt, Homo sapiens
gcagaauccuguuagacaa

SEQ ID NO: 5480 - RNA, 19 nt, Homo sapiens
gcaucuggcugucgaauuc

SEQ ID NO: 5481 - RNA, 19 nt, Homo sapiens
guacaagacaauugcauuu

SEQ ID NO: 5482 - RNA, 19 nt, Homo sapiens
gacaauguguguucagaga

SEQ ID NO: 5483 - RNA, 19 nt, Homo sapiens
gaacaggaguaaagauagg

SEQ ID NO: 5484 - RNA, 19 nt, Homo sapiens
uguccaagcuaaagccuua

SEQ ID NO: 5485 - RNA, 19 nt, Homo sapiens
ggacaagguugcaguucug

SEQ ID NO: 5486 - RNA, 19 nt, Homo sapiens
ugaacaaccucaauuucuu

SEQ ID NO: 5487 - RNA, 19 nt, Homo sapiens
caaagagauuguaccaguu

SEQ ID NO: 5488 - RNA, 19 nt, Homo sapiens
gacagagaaugcacagaaa

SEQ ID NO: 5489 - RNA, 19 nt, Homo sapiens
gaccugggcuccacuguca

SEQ ID NO: 5490 - RNA, 19 nt, Homo sapiens
gaaaucagaggaccaaagu

SEQ ID NO: 5491 - RNA, 19 nt, Homo sapiens
gcaagugaguagagaagau

SEQ ID NO: 5492 - RNA, 19 nt, Homo sapiens
gggcagaagucgugguguu

SEQ ID NO: 5493 - RNA, 19 nt, Homo sapiens
acagaaagcuggccauuuu

SEQ ID NO: 5494 - RNA, 19 nt, Homo sapiens
gggcuccacugucaucaaa

SEQ ID NO: 5495 - RNA, 19 nt, Homo sapiens
ggaccaaaguacagaugga

SEQ ID NO: 5496 - RNA, 19 nt, Homo sapiens
ccagagaaggucaauauug

SEQ ID NO: 5497 - RNA, 19 nt, Homo sapiens
uaaagcaagcuguuacaaa

SEQ ID NO: 5498 - RNA, 19 nt, Homo sapiens
cagcuuguacuuuacuuua

SEQ ID NO: 5499 - RNA, 19 nt, Homo sapiens
gaauagcaauguguguuca

SEQ ID NO: 5500 - RNA, 19 nt, Homo sapiens
gagaagaucaggacaaggu

SEQ ID NO: 5501 - RNA, 19 nt, Homo sapiens
gccaaugcuucaggaauaa

SEQ ID NO: 5502 - RNA, 19 nt, Homo sapiens
agccaaugcuucaggaaua

SEQ ID NO: 5503 - RNA, 19 nt, Homo sapiens
caauguguguucagagaga

SEQ ID NO: 5504 - RNA, 19 nt, Homo sapiens
caauguguguucagagaga

SEQ ID NO: 5505 - RNA, 19 nt, Homo sapiens
gaggucaucuuuggacaug

SEQ ID NO: 5506 - RNA, 19 nt, Homo sapiens
gcuccacugucaucaaaga

SEQ ID NO: 5507 - RNA, 19 nt, Homo sapiens
ugcaauaugugaaaucaga

SEQ ID NO: 5508 - RNA, 19 nt, Homo sapiens
gagagaaugaauugcuuaa

SEQ ID NO: 5509 - RNA, 19 nt, Homo sapiens
ucagagagaaugacaaugu

SEQ ID NO: 5510 - RNA, 19 nt, Homo sapiens
aaagcaagcuguuacaaaa

SEQ ID NO: 5511 - RNA, 19 nt, Homo sapiens
gcauuucacaacugucaua

SEQ ID NO: 5512 - RNA, 19 nt, Homo sapiens
gcugauaaacgugggcuua

SEQ ID NO: 5513 - RNA, 19 nt, Homo sapiens
aaagagauuguaccaguuu

SEQ ID NO: 5514 - RNA, 19 nt, Homo sapiens
caagacaauugcauuuaac

SEQ ID NO: 5515 - RNA, 19 nt, Homo sapiens
ggaauagcaauguguguuc

SEQ ID NO: 5516 - RNA, 19 nt, Homo sapiens
cagagagaaugaauugcuu

SEQ ID NO: 5517 - RNA, 19 nt, Homo sapiens
gaaugacaauguguguuca

SEQ ID NO: 5518 - RNA, 19 nt, Homo sapiens
gcacagaaagcuggccauu

SEQ ID NO: 5519 - RNA, 19 nt, Homo sapiens
aaaggaacaucagaucaau

SEQ ID NO: 5520 - RNA, 19 nt, Homo sapiens
ggaccaauuccagccauaa

SEQ ID NO: 5521 - RNA, 19 nt, Homo sapiens
aaaguacuagguugcaaua

SEQ ID NO: 5522 - RNA, 19 nt, Homo sapiens
cagagagaaugacaaugug

SEQ ID NO: 5523 - RNA, 19 nt, Homo sapiens
guuggucacuggaagaugu

SEQ ID NO: 5524 - RNA, 19 nt, Homo sapiens
aacgugggcuuacaccuuu

SEQ ID NO: 5525 - RNA, 19 nt, Homo sapiens
uuucacaacugucauaugg

SEQ ID NO: 5526 - RNA, 19 nt, Homo sapiens
gaguaaagauaggugagau

SEQ ID NO: 5527 - RNA, 19 nt, Homo sapiens
gaacaggacagagaaugca

SEQ ID NO: 5528 - RNA, 19 nt, Homo sapiens
gaaaauguagccacaaaau

SEQ ID NO: 5529 - RNA, 19 nt, Homo sapiens
gcgcggaccaucauagguu

SEQ ID NO: 5530 - RNA, 19 nt, Homo sapiens
ugucugaggucaucuuugg

SEQ ID NO: 5531 - RNA, 19 nt, Homo sapiens
cagugugggugcaggaauu

SEQ ID NO: 5532 - RNA, 19 nt, Homo sapiens
gguacaagacaauugcauu

SEQ ID NO: 5533 - RNA, 19 nt, Homo sapiens
aguacuagguugcaauaug

SEQ ID NO: 5534 - RNA, 19 nt, Homo sapiens
ggcaggagaagcaagauga

SEQ ID NO: 5535 - RNA, 19 nt, Homo sapiens
guagagaagaucaggacaa

SEQ ID NO: 5536 - RNA, 19 nt, Homo sapiens
ugucucugcugcaauaguu

SEQ ID NO: 5537 - RNA, 19 nt, Homo sapiens
gaccaauuccagccauaaa

SEQ ID NO: 5538 - RNA, 19 nt, Homo sapiens
ggucaucuuuggacauguc

SEQ ID NO: 5539 - RNA, 19 nt, Homo sapiens
ccacugucaucaaagaagu

SEQ ID NO: 5540 - RNA, 19 nt, Homo sapiens
gccauaaagcaagcuguua

SEQ ID NO: 5541 - RNA, 19 nt, Homo sapiens
uagagaagaucaggacaag

SEQ ID NO: 5542 - RNA, 19 nt, Homo sapiens
ggcagaauccuguuagaca

SEQ ID NO: 5543 - RNA, 19 nt, Homo sapiens
ggaugggaauagcaaugug

SEQ ID NO: 5544 - RNA, 19 nt, Homo sapiens
gauuaaacccagagaaggu

SEQ ID NO: 5545 - RNA, 19 nt, Homo sapiens
gcucagauccuguggucau

SEQ ID NO: 5546 - RNA, 19 nt, Homo sapiens
gcaggagaagcaagaugaa

SEQ ID NO: 5547 - RNA, 19 nt, Homo sapiens
gggaauagcaauguguguu

SEQ ID NO: 5548 - RNA, 19 nt, Homo sapiens
gaauucuugugacccuguu

SEQ ID NO: 5549 - RNA, 19 nt, Homo sapiens
ggaguaaagauaggugaga

SEQ ID NO: 5550 - RNA, 19 nt, Homo sapiens
guugcaauaugugaaauca

SEQ ID NO: 5551 - RNA, 19 nt, Homo sapiens
agagagaaugaauugcuua

SEQ ID NO: 5552 - RNA, 19 nt, Homo sapiens
guucagagagaaugacaau

SEQ ID NO: 5553 - RNA, 19 nt, Homo sapiens
gagagaaugggcagaaguc

SEQ ID NO: 5554 - RNA, 19 nt, Homo sapiens
aaacgugggcuuacaccuu

SEQ ID NO: 5555 - RNA, 19 nt, Homo sapiens
gcaggaggcauggaaaaua

SEQ ID NO: 5556 - RNA, 19 nt, Homo sapiens
ggagaagcaagaugaaugc

SEQ ID NO: 5557 - RNA, 19 nt, Homo sapiens
gugcaggaauucccuacuc

SEQ ID NO: 5558 - RNA, 19 nt, Homo sapiens
caacugucauauggguauu

SEQ ID NO: 5559 - RNA, 19 nt, Homo sapiens
cagaugcauuucacaacug

SEQ ID NO: 5560 - RNA, 19 nt, Homo sapiens
ggagagaaugggcagaagu

SEQ ID NO: 5561 - RNA, 19 nt, Homo sapiens
gauggaacgggaacaguca

SEQ ID NO: 5562 - RNA, 19 nt, Homo sapiens
auacucaacucacgguaca

SEQ ID NO: 5563 - RNA, 19 nt, Homo sapiens
gaccaaaguacagauggaa

SEQ ID NO: 5564 - RNA, 19 nt, Homo sapiens
agaaugacaauguguguuc

SEQ ID NO: 5565 - RNA, 19 nt, Homo sapiens
gcagcuguugcucuuauga

SEQ ID NO: 5566 - RNA, 19 nt, Homo sapiens
gaacgaaccugccaucaca

SEQ ID NO: 5567 - RNA, 19 nt, Homo sapiens
gaaauucgaucaaccugaa

SEQ ID NO: 5568 - RNA, 19 nt, Homo sapiens
uacuagagcucuuugauua

SEQ ID NO: 5569 - RNA, 19 nt, Homo sapiens
gaagaaggcguaugaaguu

SEQ ID NO: 5570 - RNA, 19 nt, Homo sapiens
gaucaaagagaagcuauua

SEQ ID NO: 5571 - RNA, 19 nt, Homo sapiens
aaucagaacugcacaauca

SEQ ID NO: 5572 - RNA, 19 nt, Homo sapiens
guaugaaguugcugccuua

SEQ ID NO: 5573 - RNA, 19 nt, Homo sapiens
cuagagcucuuugauuaua

SEQ ID NO: 5574 - RNA, 19 nt, Homo sapiens
gccaugaccugaaggauau

SEQ ID NO: 5575 - RNA, 19 nt, Homo sapiens
uuuaugagcugaucaaaga

SEQ ID NO: 5576 - RNA, 19 nt, Homo sapiens
cagaugggauuguucauug

SEQ ID NO: 5577 - RNA, 19 nt, Homo sapiens
acaaagagcucuccauggu

SEQ ID NO: 5578 - RNA, 19 nt, Homo sapiens
gggaaguguuacauguuua

SEQ ID NO: 5579 - RNA, 19 nt, Homo sapiens
ugaaggauaugaugcucua

SEQ ID NO: 5580 - RNA, 19 nt, Homo sapiens
cggcugggcucucaggaua

SEQ ID NO: 5581 - RNA, 19 nt, Homo sapiens
caaaauaugggaaguguua

SEQ ID NO: 5582 - RNA, 19 nt, Homo sapiens
ucacuaagguggacgaagu

SEQ ID NO: 5583 - RNA, 19 nt, Homo sapiens
ucaaagagaagcuauuaga

SEQ ID NO: 5584 - RNA, 19 nt, Homo sapiens
gcaacgggcuggagaucau

SEQ ID NO: 5585 - RNA, 19 nt, Homo sapiens
cuuggugucucccuaaaua

SEQ ID NO: 5586 - RNA, 19 nt, Homo sapiens
ggaaguguuacauguuuaa

SEQ ID NO: 5587 - RNA, 19 nt, Homo sapiens
ccacaguguuuacaaaaua

SEQ ID NO: 5588 - RNA, 19 nt, Homo sapiens
gcucuucucugaaauucga

SEQ ID NO: 5589 - RNA, 19 nt, Homo sapiens
guucuugugucguuuguga

SEQ ID NO: 5590 - RNA, 19 nt, Homo sapiens
gaagggagccacgaugaga

SEQ ID NO: 5591 - RNA, 19 nt, Homo sapiens
ucaccacaguguuuacaaa

SEQ ID NO: 5592 - RNA, 19 nt, Homo sapiens
acugggagcucuucucuga

SEQ ID NO: 5593 - RNA, 19 nt, Homo sapiens
gggacucucugcuacauuc

SEQ ID NO: 5594 - RNA, 19 nt, Homo sapiens
ggccaugaccugaaggaua

SEQ ID NO: 5595 - RNA, 19 nt, Homo sapiens
gcaagacaucagccaagua

SEQ ID NO: 5596 - RNA, 19 nt, Homo sapiens
ugggaaguguuacauguuu

SEQ ID NO: 5597 - RNA, 19 nt, Homo sapiens
caacuucaagcacuacaaa

SEQ ID NO: 5598 - RNA, 19 nt, Homo sapiens
ugggagcucuucucugaaa

SEQ ID NO: 5599 - RNA, 19 nt, Homo sapiens
ccuguaggauugacuguga

SEQ ID NO: 5600 - RNA, 19 nt, Homo sapiens
ggaaacgacauuugaagca

SEQ ID NO: 5601 - RNA, 19 nt, Homo sapiens
cagaggaaacgacauuuga

SEQ ID NO: 5602 - RNA, 19 nt, Homo sapiens
gaacgucaagguuuaagca

SEQ ID NO: 5603 - RNA, 19 nt, Homo sapiens
cgauggaccucaaggaaag

SEQ ID NO: 5604 - RNA, 19 nt, Homo sapiens
ccacgucugucuuguacau

SEQ ID NO: 5605 - RNA, 19 nt, Homo sapiens
gcugggcucucaggauaaa

SEQ ID NO: 5606 - RNA, 19 nt, Homo sapiens
gagcucuucucugaaauuc

SEQ ID NO: 5607 - RNA, 19 nt, Homo sapiens
ggagauuuguuuuguuuug

SEQ ID NO: 5608 - RNA, 19 nt, Homo sapiens
gugcuaguauccuuacaau

SEQ ID NO: 5609 - RNA, 19 nt, Homo sapiens
uaugggaaguguuacaugu

SEQ ID NO: 5610 - RNA, 19 nt, Homo sapiens
agagaugggccucgacuuu

SEQ ID NO: 5611 - RNA, 19 nt, Homo sapiens
gaagcaggagugaaaguuc

SEQ ID NO: 5612 - RNA, 19 nt, Homo sapiens
cugagaggguguccuacua

SEQ ID NO: 5613 - RNA, 19 nt, Homo sapiens
caucaccgccuguaggauu

SEQ ID NO: 5614 - RNA, 19 nt, Homo sapiens
gaggguguccuacuacuuc

SEQ ID NO: 5615 - RNA, 19 nt, Homo sapiens
gauuccagguccaaaguca

SEQ ID NO: 5616 - RNA, 19 nt, Homo sapiens
agacagaggaaacgacauu

SEQ ID NO: 5617 - RNA, 19 nt, Homo sapiens
agacuucaccacaguguuu

SEQ ID NO: 5618 - RNA, 19 nt, Homo sapiens
gaugagaaugugaguacuu

SEQ ID NO: 5619 - RNA, 19 nt, Homo sapiens
ggagcucuucucugaaauu

SEQ ID NO: 5620 - RNA, 19 nt, Homo sapiens
ugauauugguggucagaug

SEQ ID NO: 5621 - RNA, 19 nt, Homo sapiens
gaacagaagaaggcguaug

SEQ ID NO: 5622 - RNA, 19 nt, Homo sapiens
guucugagguuugcuuugg

SEQ ID NO: 5623 - RNA, 19 nt, Homo sapiens
ggaaucagaacugcacaau

SEQ ID NO: 5624 - RNA, 19 nt, Homo sapiens
gagaaugugaguacuugug

SEQ ID NO: 5625 - RNA, 19 nt, Homo sapiens
caagacaucagccaaguac

SEQ ID NO: 5626 - RNA, 19 nt, Homo sapiens
ugugagacccgcuacauug

SEQ ID NO: 5627 - RNA, 19 nt, Homo sapiens
gagugccgauccucagaga

SEQ ID NO: 5628 - RNA, 19 nt, Homo sapiens
aaaucaagagcuagaguuu

SEQ ID NO: 5629 - RNA, 19 nt, Homo sapiens
cccugaacgucaagguuua

SEQ ID NO: 5630 - RNA, 19 nt, Homo sapiens
gcaccugcaugcucagacu

SEQ ID NO: 5631 - RNA, 19 nt, Homo sapiens
ccaaaccacucugaaacca

SEQ ID NO: 5632 - RNA, 19 nt, Homo sapiens
gagccacgaugagaaugug

SEQ ID NO: 5633 - RNA, 19 nt, Homo sapiens
guucauuggugcuaguauc

SEQ ID NO: 5634 - RNA, 19 nt, Homo sapiens
ggucagaugggauuguuca

SEQ ID NO: 5635 - RNA, 19 nt, Homo sapiens
agaagaaggcguaugaagu

SEQ ID NO: 5636 - RNA, 19 nt, Homo sapiens
ugagacaauugaacagaag

SEQ ID NO: 5637 - RNA, 19 nt, Homo sapiens
caaccuaacccgcuacaac

SEQ ID NO: 5638 - RNA, 19 nt, Homo sapiens
ugagccaccuuucauccaa

SEQ ID NO: 5639 - RNA, 19 nt, Homo sapiens
gaggaaacgacauuugaag

SEQ ID NO: 5640 - RNA, 19 nt, Homo sapiens
ggacugggagcucuucucu

SEQ ID NO: 5641 - RNA, 19 nt, Homo sapiens
gaaggcguaugaaguugcu

SEQ ID NO: 5642 - RNA, 19 nt, Homo sapiens
cagcugugacccucuguaa

SEQ ID NO: 5643 - RNA, 19 nt, Homo sapiens
ccaagacccaggacaagga

SEQ ID NO: 5644 - RNA, 19 nt, Homo sapiens
ggacgaagggagccacgau

SEQ ID NO: 5645 - RNA, 19 nt, Homo sapiens
ccuaccagcaugucacuaa

SEQ ID NO: 5646 - RNA, 19 nt, Homo sapiens
gguccaaagucaccaugag

SEQ ID NO: 5647 - RNA, 19 nt, Homo sapiens
ugccuuacuuggugauauu

SEQ ID NO: 5648 - RNA, 19 nt, Homo sapiens
cugaauggcuuccgguucu

SEQ ID NO: 5649 - RNA, 19 nt, Homo sapiens
guucagauccacagucagu

SEQ ID NO: 5650 - RNA, 19 nt, Homo sapiens
gagaggguguccuacuacu

SEQ ID NO: 5651 - RNA, 19 nt, Homo sapiens
aacagaagaaggcguauga

SEQ ID NO: 5652 - RNA, 19 nt, Homo sapiens
aggacacccugcaaccuaa

SEQ ID NO: 5653 - RNA, 19 nt, Homo sapiens
gcaacugccgcaugguuca

SEQ ID NO: 5654 - RNA, 19 nt, Homo sapiens
acauucagcaggaugagua

SEQ ID NO: 5655 - RNA, 19 nt, Homo sapiens
cuacaaacccaagcaguuc

SEQ ID NO: 5656 - RNA, 19 nt, Homo sapiens
ggaacuguccaagaacgaa

SEQ ID NO: 5657 - RNA, 19 nt, Homo sapiens
uuacaauacuagagcucuu

SEQ ID NO: 5658 - RNA, 19 nt, Homo sapiens
acccagcacucccuccaaa

SEQ ID NO: 5659 - RNA, 19 nt, Homo sapiens
caagagcuagaguuugaau

SEQ ID NO: 5660 - RNA, 19 nt, Homo sapiens
ucuccaggcucaccaccaa

SEQ ID NO: 5661 - RNA, 19 nt, Homo sapiens
cagaacugcacaaucaaga

SEQ ID NO: 5662 - RNA, 19 nt, Homo sapiens
gaaucagaacugcacaauc

SEQ ID NO: 5663 - RNA, 19 nt, Homo sapiens
gaaccugccaucacaucuc

SEQ ID NO: 5664 - RNA, 19 nt, Homo sapiens
auacuagagcucuuugauu

SEQ ID NO: 5665 - RNA, 19 nt, Homo sapiens
ucagaugggauuguucauu

SEQ ID NO: 5666 - RNA, 19 nt, Homo sapiens
gaagaaggccuaugagauu

SEQ ID NO: 5667 - RNA, 19 nt, Homo sapiens
gcaaagagcuguccauggu

SEQ ID NO: 5668 - RNA, 19 nt, Homo sapiens
uuaaagaccuggcugguua

SEQ ID NO: 5669 - RNA, 19 nt, Homo sapiens
gggcagaucuuuccucuug

SEQ ID NO: 5670 - RNA, 19 nt, Homo sapiens
gaagggcgcuagugccuaa

SEQ ID NO: 5671 - RNA, 19 nt, Homo sapiens
caacaaaucugagcaauac

SEQ ID NO: 5672 - RNA, 19 nt, Homo sapiens
ccaaguaccuggccaagaa

SEQ ID NO: 5673 - RNA, 19 nt, Homo sapiens
gaaggagucuugaccauag

SEQ ID NO: 5674 - RNA, 19 nt, Homo sapiens
caacaaggauggaacugaa

SEQ ID NO: 5675 - RNA, 19 nt, Homo sapiens
gcaugccucuggucuaaua

SEQ ID NO: 5676 - RNA, 19 nt, Homo sapiens
ggucuacccuggacacuaa

SEQ ID NO: 5677 - RNA, 19 nt, Homo sapiens
gcaaagcuguuaccaugga

SEQ ID NO: 5678 - RNA, 19 nt, Homo sapiens
gcaaugggcuggaaaucau

SEQ ID NO: 5679 - RNA, 19 nt, Homo sapiens
ccaagaaguucaacaaauc

SEQ ID NO: 5680 - RNA, 19 nt, Homo sapiens
ggaaagugcuacacguuca

SEQ ID NO: 5681 - RNA, 19 nt, Homo sapiens
acacacagauggcagauga

SEQ ID NO: 5682 - RNA, 19 nt, Homo sapiens
caacaacagguaugagaua

SEQ ID NO: 5683 - RNA, 19 nt, Homo sapiens
guugaaagcucugcuguug

SEQ ID NO: 5684 - RNA, 19 nt, Homo sapiens
gccuggagcuggagaguaa

SEQ ID NO: 5685 - RNA, 19 nt, Homo sapiens
caaaggaagcugugaauca

SEQ ID NO: 5686 - RNA, 19 nt, Homo sapiens
gccaagaaguucaacaaau

SEQ ID NO: 5687 - RNA, 19 nt, Homo sapiens
gacauacgcugccaacauc

SEQ ID NO: 5688 - RNA, 19 nt, Homo sapiens
gaucuuuccucuugucugu

SEQ ID NO: 5689 - RNA, 19 nt, Homo sapiens
gaguaaggcuguaggaucu

SEQ ID NO: 5690 - RNA, 19 nt, Homo sapiens
ggaaggagucuugaccaua

SEQ ID NO: 5691 - RNA, 19 nt, Homo sapiens
gcacgacauucgagacaug

SEQ ID NO: 5692 - RNA, 19 nt, Homo sapiens
gcaaagccucagccaagua

SEQ ID NO: 5693 - RNA, 19 nt, Homo sapiens
ggacucggauuuggauuuc

SEQ ID NO: 5694 - RNA, 19 nt, Homo sapiens
ugaaagcucugcuguuguc

SEQ ID NO: 5695 - RNA, 19 nt, Homo sapiens
gcaggccgcugaaccaaag

SEQ ID NO: 5696 - RNA, 19 nt, Homo sapiens
guaaggcuguaggaucuuu

SEQ ID NO: 5697 - RNA, 19 nt, Homo sapiens
gauacagacucuauauugc

SEQ ID NO: 5698 - RNA, 19 nt, Homo sapiens
ugauacagacucuauauug

SEQ ID NO: 5699 - RNA, 19 nt, Homo sapiens
caaaucugagcaauacaua

SEQ ID NO: 5700 - RNA, 19 nt, Homo sapiens
caacuucauuugcuucucu

SEQ ID NO: 5701 - RNA, 19 nt, Homo sapiens
gcagaucuuuccucuuguc

SEQ ID NO: 5702 - RNA, 19 nt, Homo sapiens
caacaugcgugaguucuac

SEQ ID NO: 5703 - RNA, 19 nt, Homo sapiens
gcuguaggaucuuuggaau

SEQ ID NO: 5704 - RNA, 19 nt, Homo sapiens
ccugauaccuauaaguuca

SEQ ID NO: 5705 - RNA, 19 nt, Homo sapiens
ucaacaaaucugagcaaua

SEQ ID NO: 5706 - RNA, 19 nt, Homo sapiens
ucaacaaccucaucugcau

SEQ ID NO: 5707 - RNA, 19 nt, Homo sapiens
aaccagagaauguaccuua

SEQ ID NO: 5708 - RNA, 19 nt, Homo sapiens
ccugaauucugucuaucua

SEQ ID NO: 5709 - RNA, 19 nt, Homo sapiens
ccaagaaugaccuguauca

SEQ ID NO: 5710 - RNA, 19 nt, Homo sapiens
ggucuucaaucccagaaca

SEQ ID NO: 5711 - RNA, 19 nt, Homo sapiens
cacaagcucugccucuuuc

SEQ ID NO: 5712 - RNA, 19 nt, Homo sapiens
acacacaucccucugagaa

SEQ ID NO: 5713 - RNA, 19 nt, Homo sapiens
gacgacacgcgcauuguaa

SEQ ID NO: 5714 - RNA, 19 nt, Homo sapiens
ugaaugccuucgccuguau

SEQ ID NO: 5715 - RNA, 19 nt, Homo sapiens
caaguuccaccuucuaugu

SEQ ID NO: 5716 - RNA, 19 nt, Homo sapiens
uacagacucuauauugcua

SEQ ID NO: 5717 - RNA, 19 nt, Homo sapiens
gggccacguccauaaauuu

SEQ ID NO: 5718 - RNA, 19 nt, Homo sapiens
cuagcugucugccaucuga

SEQ ID NO: 5719 - RNA, 19 nt, Homo sapiens
ucaguggccuuuccuccuu

SEQ ID NO: 5720 - RNA, 19 nt, Homo sapiens
ucacaagcucugccucuuu

SEQ ID NO: 5721 - RNA, 19 nt, Homo sapiens
ggagacgacacgcgcauug

SEQ ID NO: 5722 - RNA, 19 nt, Homo sapiens
guagagggccacguccaua

SEQ ID NO: 5723 - RNA, 19 nt, Homo sapiens
gcuacauccugauaccuau

SEQ ID NO: 5724 - RNA, 19 nt, Homo sapiens
cagccugaauucugucuau

SEQ ID NO: 5725 - RNA, 19 nt, Homo sapiens
caacuuccgcagcuucaaa

SEQ ID NO: 5726 - RNA, 19 nt, Homo sapiens
acgcaugccucuggucuaa

SEQ ID NO: 5727 - RNA, 19 nt, Homo sapiens
cuaagaguuuccucagaga

SEQ ID NO: 5728 - RNA, 19 nt, Homo sapiens
uacccaagcccaccacuuu

SEQ ID NO: 5729 - RNA, 19 nt, Homo sapiens
guacaaggagugugcagau

SEQ ID NO: 5730 - RNA, 19 nt, Homo sapiens
gcuguugucucacccuauc

SEQ ID NO: 5731 - RNA, 19 nt, Homo sapiens
gacaaaggaagcugugaau

SEQ ID NO: 5732 - RNA, 19 nt, Homo sapiens
cgacaaaggaagcugugaa

SEQ ID NO: 5733 - RNA, 19 nt, Homo sapiens
cagagaauguaccuuaagg

SEQ ID NO: 5734 - RNA, 19 nt, Homo sapiens
ccuacgaggucauuaagca

SEQ ID NO: 5735 - RNA, 19 nt, Homo sapiens
guacugcgugugugaaaug

SEQ ID NO: 5736 - RNA, 19 nt, Homo sapiens
uguaggaucuuuggaaucu

SEQ ID NO: 5737 - RNA, 19 nt, Homo sapiens
gaagggagcuggggauugg

SEQ ID NO: 5738 - RNA, 19 nt, Homo sapiens
aagaaggccuaugagauug

SEQ ID NO: 5739 - RNA, 19 nt, Homo sapiens
cagaagaaggccuaugaga

SEQ ID NO: 5740 - RNA, 19 nt, Homo sapiens
gaacagaagaaggccuaug

SEQ ID NO: 5741 - RNA, 19 nt, Homo sapiens
gaaagugcuacacguucaa

SEQ ID NO: 5742 - RNA, 19 nt, Homo sapiens
ggagauacugcaggacaaa

SEQ ID NO: 5743 - RNA, 19 nt, Homo sapiens
caacaaccucaucugcauu

SEQ ID NO: 5744 - RNA, 19 nt, Homo sapiens
ugacauacgcugccaacau

SEQ ID NO: 5745 - RNA, 19 nt, Homo sapiens
ugcuggagcucuuugacua

SEQ ID NO: 5746 - RNA, 19 nt, Homo sapiens
ucacggugcuggagcucuu

SEQ ID NO: 5747 - RNA, 19 nt, Homo sapiens
ucaaagugcagauccauag

SEQ ID NO: 5748 - RNA, 19 nt, Homo sapiens
agaagaaggccuaugagau

SEQ ID NO: 5749 - RNA, 19 nt, Homo sapiens
cuucgaagcaggcaucaaa

SEQ ID NO: 5750 - RNA, 19 nt, Homo sapiens
ccucuggucuaauaaacug

SEQ ID NO: 5751 - RNA, 19 nt, Homo sapiens
ccuggugucuguacugugu

SEQ ID NO: 5752 - RNA, 19 nt, Homo sapiens
gagguggguuugggaggaa

SEQ ID NO: 5753 - RNA, 19 nt, Homo sapiens
ugugcaaccucaacgaguu

SEQ ID NO: 5754 - RNA, 19 nt, Homo sapiens
agacgacacgcgcauugua

SEQ ID NO: 5755 - RNA, 19 nt, Homo sapiens
agccaagucuccaagaaug

SEQ ID NO: 5756 - RNA, 19 nt, Homo sapiens
ggccaagaaguucaacaaa

SEQ ID NO: 5757 - RNA, 19 nt, Homo sapiens
ccugugagcagcugcauug

SEQ ID NO: 5758 - RNA, 19 nt, Homo sapiens
gccuucgccuguauaaaga

SEQ ID NO: 5759 - RNA, 19 nt, Homo sapiens
gaaugccuucgccuguaua

SEQ ID NO: 5760 - RNA, 19 nt, Homo sapiens
cugaaugccuucgccugua

SEQ ID NO: 5761 - RNA, 19 nt, Homo sapiens
uagagggccacguccauaa

SEQ ID NO: 5762 - RNA, 19 nt, Homo sapiens
gaguguccaucuacauucu

SEQ ID NO: 5763 - RNA, 19 nt, Homo sapiens
ccagcugccuccucacauc

SEQ ID NO: 5764 - RNA, 19 nt, Homo sapiens
cgaagcaggcaucaaagug

SEQ ID NO: 5765 - RNA, 19 nt, Homo sapiens
cggagcgugugcaguacua

SEQ ID NO: 5766 - RNA, 19 nt, Homo sapiens
gaagaaggccuaugagauu

SEQ ID NO: 5767 - RNA, 19 nt, Homo sapiens
gcaaagagcuguccauggu

SEQ ID NO: 5768 - RNA, 19 nt, Homo sapiens
uuaaagaccuggcugguua

SEQ ID NO: 5769 - RNA, 19 nt, Homo sapiens
gggcagaucuuuccucuug

SEQ ID NO: 5770 - RNA, 19 nt, Homo sapiens
gaagggcgcuagugccuaa

SEQ ID NO: 5771 - RNA, 19 nt, Homo sapiens
caacaaaucugagcaauac

SEQ ID NO: 5772 - RNA, 19 nt, Homo sapiens
ccaaguaccuggccaagaa

SEQ ID NO: 5773 - RNA, 19 nt, Homo sapiens
gaaggagucuugaccauag

SEQ ID NO: 5774 - RNA, 19 nt, Homo sapiens
caacaaggauggaacugaa

SEQ ID NO: 5775 - RNA, 19 nt, Homo sapiens
gcaugccucuggucuaaua

SEQ ID NO: 5776 - RNA, 19 nt, Homo sapiens
ggucuacccuggacacuaa

SEQ ID NO: 5777 - RNA, 19 nt, Homo sapiens
gcaaagcuguuaccaugga

SEQ ID NO: 5778 - RNA, 19 nt, Homo sapiens
gcaaugggcuggaaaucau

SEQ ID NO: 5779 - RNA, 19 nt, Homo sapiens
ccaagaaguucaacaaauc

SEQ ID NO: 5780 - RNA, 19 nt, Homo sapiens
ggaaagugcuacacguuca

SEQ ID NO: 5781 - RNA, 19 nt, Homo sapiens
acacacagauggcagauga

SEQ ID NO: 5782 - RNA, 19 nt, Homo sapiens
caacaacagguaugagaua

SEQ ID NO: 5783 - RNA, 19 nt, Homo sapiens
guugaaagcucugcuguug

SEQ ID NO: 5784 - RNA, 19 nt, Homo sapiens
gccuggagcuggagaguaa

SEQ ID NO: 5785 - RNA, 19 nt, Homo sapiens
caaaggaagcugugaauca

SEQ ID NO: 5786 - RNA, 19 nt, Homo sapiens
gccaagaaguucaacaaau

SEQ ID NO: 5787 - RNA, 19 nt, Homo sapiens
gcagggugcucacuucugu

SEQ ID NO: 5788 - RNA, 19 nt, Homo sapiens
gacauacgcugccaacauc

SEQ ID NO: 5789 - RNA, 19 nt, Homo sapiens
gaucuuuccucuugucugu

SEQ ID NO: 5790 - RNA, 19 nt, Homo sapiens
gaguaaggcuguaggaucu

SEQ ID NO: 5791 - RNA, 19 nt, Homo sapiens
ggaaggagucuugaccaua

SEQ ID NO: 5792 - RNA, 19 nt, Homo sapiens
gcacgacauucgagacaug

SEQ ID NO: 5793 - RNA, 19 nt, Homo sapiens
gcucacuucugucccauga

SEQ ID NO: 5794 - RNA, 19 nt, Homo sapiens
gcaaagccucagccaagua

SEQ ID NO: 5795 - RNA, 19 nt, Homo sapiens
ggacucggauuuggauuuc

SEQ ID NO: 5796 - RNA, 19 nt, Homo sapiens
ugaaagcucugcuguuguc

SEQ ID NO: 5797 - RNA, 19 nt, Homo sapiens
gcaggccgcugaaccaaag

SEQ ID NO: 5798 - RNA, 19 nt, Homo sapiens
guaaggcuguaggaucuuu

SEQ ID NO: 5799 - RNA, 19 nt, Homo sapiens
gauacagacucuauauugc

SEQ ID NO: 5800 - RNA, 19 nt, Homo sapiens
ugauacagacucuauauug

SEQ ID NO: 5801 - RNA, 19 nt, Homo sapiens
cccaaacccuguugucuug

SEQ ID NO: 5802 - RNA, 19 nt, Homo sapiens
caaaucugagcaauacaua

SEQ ID NO: 5803 - RNA, 19 nt, Homo sapiens
caacuucauuugcuucucu

SEQ ID NO: 5804 - RNA, 19 nt, Homo sapiens
gcagaucuuuccucuuguc

SEQ ID NO: 5805 - RNA, 19 nt, Homo sapiens
caacaugcgugaguucuac

SEQ ID NO: 5806 - RNA, 19 nt, Homo sapiens
gcuguaggaucuuuggaau

SEQ ID NO: 5807 - RNA, 19 nt, Homo sapiens
ccugauaccuauaaguuca

SEQ ID NO: 5808 - RNA, 19 nt, Homo sapiens
ucaacaaaucugagcaaua

SEQ ID NO: 5809 - RNA, 19 nt, Homo sapiens
ucaacaaccucaucugcau

SEQ ID NO: 5810 - RNA, 19 nt, Homo sapiens
aaccagagaauguaccuua

SEQ ID NO: 5811 - RNA, 19 nt, Homo sapiens
ccugaauucugucuaucua

SEQ ID NO: 5812 - RNA, 19 nt, Homo sapiens
ccaagaaugaccuguauca

SEQ ID NO: 5813 - RNA, 19 nt, Homo sapiens
ggucuucaaucccagaaca

SEQ ID NO: 5814 - RNA, 19 nt, Homo sapiens
cacaagcucugccucuuuc

SEQ ID NO: 5815 - RNA, 19 nt, Homo sapiens
acacacaucccucugagaa

SEQ ID NO: 5816 - RNA, 19 nt, Homo sapiens
gacgacacgcgcauuguaa

SEQ ID NO: 5817 - RNA, 19 nt, Homo sapiens
ugaaugccuucgccuguau

SEQ ID NO: 5818 - RNA, 19 nt, Homo sapiens
caaguuccaccuucuaugu

SEQ ID NO: 5819 - RNA, 19 nt, Homo sapiens
uacagacucuauauugcua

SEQ ID NO: 5820 - RNA, 19 nt, Homo sapiens
gggccacguccauaaauuu

SEQ ID NO: 5821 - RNA, 19 nt, Homo sapiens
cuagcugucugccaucuga

SEQ ID NO: 5822 - RNA, 19 nt, Homo sapiens
ucaguggccuuuccuccuu

SEQ ID NO: 5823 - RNA, 19 nt, Homo sapiens
ucacaagcucugccucuuu

SEQ ID NO: 5824 - RNA, 19 nt, Homo sapiens
ggagacgacacgcgcauug

SEQ ID NO: 5825 - RNA, 19 nt, Homo sapiens
guagagggccacguccaua

SEQ ID NO: 5826 - RNA, 19 nt, Homo sapiens
gcuacauccugauaccuau

SEQ ID NO: 5827 - RNA, 19 nt, Homo sapiens
cagccugaauucugucuau

SEQ ID NO: 5828 - RNA, 19 nt, Homo sapiens
caacuuccgcagcuucaaa

SEQ ID NO: 5829 - RNA, 19 nt, Homo sapiens
acgcaugccucuggucuaa

SEQ ID NO: 5830 - RNA, 19 nt, Homo sapiens
cuaagaguuuccucagaga

SEQ ID NO: 5831 - RNA, 19 nt, Homo sapiens
uacccaagcccaccacuuu

SEQ ID NO: 5832 - RNA, 19 nt, Homo sapiens
guacaaggagugugcagau

SEQ ID NO: 5833 - RNA, 19 nt, Homo sapiens
gcuguugucucacccuauc

SEQ ID NO: 5834 - RNA, 19 nt, Homo sapiens
gacaaaggaagcugugaau

SEQ ID NO: 5835 - RNA, 19 nt, Homo sapiens
cgacaaaggaagcugugaa

SEQ ID NO: 5836 - RNA, 19 nt, Homo sapiens
cagagaauguaccuuaagg

SEQ ID NO: 5837 - RNA, 19 nt, Homo sapiens
ccuacgaggucauuaagca

SEQ ID NO: 5838 - RNA, 19 nt, Homo sapiens
guacugcgugugugaaaug

SEQ ID NO: 5839 - RNA, 19 nt, Homo sapiens
uguaggaucuuuggaaucu

SEQ ID NO: 5840 - RNA, 19 nt, Homo sapiens
gaagggagcuggggauugg

SEQ ID NO: 5841 - RNA, 19 nt, Homo sapiens
aagaaggccuaugagauug

SEQ ID NO: 5842 - RNA, 19 nt, Homo sapiens
cagaagaaggccuaugaga

SEQ ID NO: 5843 - RNA, 19 nt, Homo sapiens
gaacagaagaaggccuaug

SEQ ID NO: 5844 - RNA, 19 nt, Homo sapiens
gaaagugcuacacguucaa

SEQ ID NO: 5845 - RNA, 19 nt, Homo sapiens
ggagauacugcaggacaaa

SEQ ID NO: 5846 - RNA, 19 nt, Homo sapiens
caacaaccucaucugcauu

SEQ ID NO: 5847 - RNA, 19 nt, Homo sapiens
ugacauacgcugccaacau

SEQ ID NO: 5848 - RNA, 19 nt, Homo sapiens
ugcuggagcucuuugacua

SEQ ID NO: 5849 - RNA, 19 nt, Homo sapiens
ucacggugcuggagcucuu

SEQ ID NO: 5850 - RNA, 19 nt, Homo sapiens
ucaaagugcagauccauag

SEQ ID NO: 5851 - RNA, 19 nt, Homo sapiens
agaagaaggccuaugagau

SEQ ID NO: 5852 - RNA, 19 nt, Homo sapiens
cuucgaagcaggcaucaaa

SEQ ID NO: 5853 - RNA, 19 nt, Homo sapiens
ccucuggucuaauaaacug

SEQ ID NO: 5854 - RNA, 19 nt, Homo sapiens
ccuggugucuguacugugu

SEQ ID NO: 5855 - RNA, 19 nt, Homo sapiens
gagguggguuugggaggaa

SEQ ID NO: 5856 - RNA, 19 nt, Homo sapiens
agacgacacgcgcauugua

SEQ ID NO: 5857 - RNA, 19 nt, Homo sapiens
agccaagucuccaagaaug

SEQ ID NO: 5858 - RNA, 19 nt, Homo sapiens
ugugcaaccucaacgaguu

SEQ ID NO: 5859 - RNA, 19 nt, Homo sapiens
ggccaagaaguucaacaaa

SEQ ID NO: 5860 - RNA, 19 nt, Homo sapiens
ccugugagcagcugcauug

SEQ ID NO: 5861 - RNA, 19 nt, Homo sapiens
gccuucgccuguauaaaga

SEQ ID NO: 5862 - RNA, 19 nt, Homo sapiens
gaaugccuucgccuguaua

SEQ ID NO: 5863 - RNA, 19 nt, Homo sapiens
cugaaugccuucgccugua

SEQ ID NO: 5864 - RNA, 19 nt, Homo sapiens
uagagggccacguccauaa

SEQ ID NO: 5865 - RNA, 19 nt, Homo sapiens
gaguguccaucuacauucu

SEQ ID NO: 5866 - RNA, 19 nt, Homo sapiens
ggucuacgccuacgucuuu

SEQ ID NO: 5867 - RNA, 19 nt, Homo sapiens
gaaagcgucuuccgguucu

SEQ ID NO: 5868 - RNA, 19 nt, Homo sapiens
uuucagggcugggcuauaa

SEQ ID NO: 5869 - RNA, 19 nt, Homo sapiens
cgacaucagugacgcuguu

SEQ ID NO: 5870 - RNA, 19 nt, Homo sapiens
gaugagggcucguauuuuc

SEQ ID NO: 5871 - RNA, 19 nt, Homo sapiens
gacaacgagucucucauca

SEQ ID NO: 5872 - RNA, 19 nt, Homo sapiens
gcucguauuuucugguuua

SEQ ID NO: 5873 - RNA, 19 nt, Homo sapiens
ggcugcaaauaaacuguua

SEQ ID NO: 5874 - RNA, 19 nt, Homo sapiens
gcuacgagaucgaguucau

SEQ ID NO: 5875 - RNA, 19 nt, Homo sapiens
aggcugugguccugcauua

SEQ ID NO: 5876 - RNA, 19 nt, Homo sapiens
ugugguagauggagacuuc

SEQ ID NO: 5877 - RNA, 19 nt, Homo sapiens
caaugugggucuccuggau

SEQ ID NO: 5878 - RNA, 19 nt, Homo sapiens
caucaacgcgggagacuuc

SEQ ID NO: 5879 - RNA, 19 nt, Homo sapiens
gaaugacacagagcuggua

SEQ ID NO: 5880 - RNA, 19 nt, Homo sapiens
cuacaaccuuccagagugu

SEQ ID NO: 5881 - RNA, 19 nt, Homo sapiens
guacgauggccgcuucuug

SEQ ID NO: 5882 - RNA, 19 nt, Homo sapiens
gcacaggggaucccaauga

SEQ ID NO: 5883 - RNA, 19 nt, Homo sapiens
gcgauacugggccaacuuu

SEQ ID NO: 5884 - RNA, 19 nt, Homo sapiens
aggaugagggcucguauuu

SEQ ID NO: 5885 - RNA, 19 nt, Homo sapiens
gcacgugcugccucaagaa

SEQ ID NO: 5886 - RNA, 19 nt, Homo sapiens
gagugucugcuaccaauau

SEQ ID NO: 5887 - RNA, 19 nt, Homo sapiens
gaaggaugagggcucguau

SEQ ID NO: 5888 - RNA, 19 nt, Homo sapiens
cccagcgacugaugcgaua

SEQ ID NO: 5889 - RNA, 19 nt, Homo sapiens
gagcgaggacugccuguac

SEQ ID NO: 5890 - RNA, 19 nt, Homo sapiens
ggagacuuccucagugaca

SEQ ID NO: 5891 - RNA, 19 nt, Homo sapiens
gggcucagcaguacguuag

SEQ ID NO: 5892 - RNA, 19 nt, Homo sapiens
gcccucuggcugcaaauaa

SEQ ID NO: 5893 - RNA, 19 nt, Homo sapiens
gcucagcaguacguuaguc

SEQ ID NO: 5894 - RNA, 19 nt, Homo sapiens
cccucuggcugcaaauaaa

SEQ ID NO: 5895 - RNA, 19 nt, Homo sapiens
cuacacggcagaggagaaa

SEQ ID NO: 5896 - RNA, 19 nt, Homo sapiens
gcugugguccugcauuaca

SEQ ID NO: 5897 - RNA, 19 nt, Homo sapiens
ugaaggaugagggcucgua

SEQ ID NO: 5898 - RNA, 19 nt, Homo sapiens
uggguguggugaaggauga

SEQ ID NO: 5899 - RNA, 19 nt, Homo sapiens
cgauggccgcuucuuggua

SEQ ID NO: 5900 - RNA, 19 nt, Homo sapiens
ccuacauggugcacuggaa

SEQ ID NO: 5901 - RNA, 19 nt, Homo sapiens
auggagacuuccucaguga

SEQ ID NO: 5902 - RNA, 19 nt, Homo sapiens
guccucgucuggaucuaug

SEQ ID NO: 5903 - RNA, 19 nt, Homo sapiens
gauacugggccaacuuugc

SEQ ID NO: 5904 - RNA, 19 nt, Homo sapiens
gcugguggguguggugaag

SEQ ID NO: 5905 - RNA, 19 nt, Homo sapiens
gugcugguguccaugaacu

SEQ ID NO: 5906 - RNA, 19 nt, Homo sapiens
ggucuacgccuacgucuuu

SEQ ID NO: 5907 - RNA, 19 nt, Homo sapiens
cuauaacggucaaccauuu

SEQ ID NO: 5908 - RNA, 19 nt, Homo sapiens
gaaagcgucuuccgguucu

SEQ ID NO: 5909 - RNA, 19 nt, Homo sapiens
cauccucccucucgucuuu

SEQ ID NO: 5910 - RNA, 19 nt, Homo sapiens
ccauuucugucucuucuuu

SEQ ID NO: 5911 - RNA, 19 nt, Homo sapiens
uuucagggcugggcuauaa

SEQ ID NO: 5912 - RNA, 19 nt, Homo sapiens
cgacaucagugacgcuguu

SEQ ID NO: 5913 - RNA, 19 nt, Homo sapiens
gaugagggcucguauuuuc

SEQ ID NO: 5914 - RNA, 19 nt, Homo sapiens
gacaacgagucucucauca

SEQ ID NO: 5915 - RNA, 19 nt, Homo sapiens
gcucguauuuucugguuua

SEQ ID NO: 5916 - RNA, 19 nt, Homo sapiens
ggcugcaaauaaacuguua

SEQ ID NO: 5917 - RNA, 19 nt, Homo sapiens
ccacgccuuuguuguuuga

SEQ ID NO: 5918 - RNA, 19 nt, Homo sapiens
gcuacgagaucgaguucau

SEQ ID NO: 5919 - RNA, 19 nt, Homo sapiens
aggcugugguccugcauua

SEQ ID NO: 5920 - RNA, 19 nt, Homo sapiens
ugugguagauggagacuuc

SEQ ID NO: 5921 - RNA, 19 nt, Homo sapiens
caaugugggucuccuggau

SEQ ID NO: 5922 - RNA, 19 nt, Homo sapiens
caucaacgcgggagacuuc

SEQ ID NO: 5923 - RNA, 19 nt, Homo sapiens
gaaugacacagagcuggua

SEQ ID NO: 5924 - RNA, 19 nt, Homo sapiens
cuacaaccuuccagagugu

SEQ ID NO: 5925 - RNA, 19 nt, Homo sapiens
cguccucccugcacugaaa

SEQ ID NO: 5926 - RNA, 19 nt, Homo sapiens
gaaccugagccugacauug

SEQ ID NO: 5927 - RNA, 19 nt, Homo sapiens
gcuauaacggucaaccauu

SEQ ID NO: 5928 - RNA, 19 nt, Homo sapiens
guacgauggccgcuucuug

SEQ ID NO: 5929 - RNA, 19 nt, Homo sapiens
gcacaggggaucccaauga

SEQ ID NO: 5930 - RNA, 19 nt, Homo sapiens
gcgauacugggccaacuuu

SEQ ID NO: 5931 - RNA, 19 nt, Homo sapiens
aggaugagggcucguauuu

SEQ ID NO: 5932 - RNA, 19 nt, Homo sapiens
gcacgugcugccucaagaa

SEQ ID NO: 5933 - RNA, 19 nt, Homo sapiens
gagugucugcuaccaauau

SEQ ID NO: 5934 - RNA, 19 nt, Homo sapiens
gaaggaugagggcucguau

SEQ ID NO: 5935 - RNA, 19 nt, Homo sapiens
cccagcgacugaugcgaua

SEQ ID NO: 5936 - RNA, 19 nt, Homo sapiens
gagcgaggacugccuguac

SEQ ID NO: 5937 - RNA, 19 nt, Homo sapiens
ggagacuuccucagugaca

SEQ ID NO: 5938 - RNA, 19 nt, Homo sapiens
gggcucagcaguacguuag

SEQ ID NO: 5939 - RNA, 19 nt, Homo sapiens
gcccucuggcugcaaauaa

SEQ ID NO: 5940 - RNA, 19 nt, Homo sapiens
ccacguggucgccugcauu

SEQ ID NO: 5941 - RNA, 19 nt, Homo sapiens
gcucagcaguacguuaguc

SEQ ID NO: 5942 - RNA, 19 nt, Homo sapiens
cccucuggcugcaaauaaa

SEQ ID NO: 5943 - RNA, 19 nt, Homo sapiens
ccucaaaccgagagacuca

SEQ ID NO: 5944 - RNA, 19 nt, Homo sapiens
cuacacggcagaggagaaa

SEQ ID NO: 5945 - RNA, 19 nt, Homo sapiens
gcugugguccugcauuaca

SEQ ID NO: 5946 - RNA, 19 nt, Homo sapiens
ugaaggaugagggcucgua

SEQ ID NO: 5947 - RNA, 19 nt, Homo sapiens
uggguguggugaaggauga

SEQ ID NO: 5948 - RNA, 19 nt, Homo sapiens
cgucuuccggucauucuuu

SEQ ID NO: 5949 - RNA, 19 nt, Homo sapiens
ggaaccugagccugacauu

SEQ ID NO: 5950 - RNA, 19 nt, Homo sapiens
cgauggccgcuucuuggua

SEQ ID NO: 5951 - RNA, 19 nt, Homo sapiens
ccuacauggugcacuggaa

SEQ ID NO: 5952 - RNA, 19 nt, Homo sapiens
auggagacuuccucaguga

SEQ ID NO: 5953 - RNA, 19 nt, Homo sapiens
guccucgucuggaucuaug

SEQ ID NO: 5954 - RNA, 19 nt, Homo sapiens
ucucgucuuucgcacauuc

SEQ ID NO: 5955 - RNA, 19 nt, Homo sapiens
aaccugagccugacauugg

SEQ ID NO: 5956 - RNA, 19 nt, Homo sapiens
gauacugggccaacuuugc

SEQ ID NO: 5957 - RNA, 19 nt, Homo sapiens
gcugguggguguggugaag

SEQ ID NO: 5958 - RNA, 19 nt, Homo sapiens
gaaauggaaaagccaguau

SEQ ID NO: 5959 - RNA, 19 nt, Homo sapiens
ggaaauggaaaagccagua

SEQ ID NO: 5960 - RNA, 19 nt, Homo sapiens
gugcugguguccaugaacu

SEQ ID NO: 5961 - RNA, 19 nt, Homo sapiens
ggaggaagcugaugaauau

SEQ ID NO: 5962 - RNA, 19 nt, Homo sapiens
ugaaaugucuugugucuua

SEQ ID NO: 5963 - RNA, 19 nt, Homo sapiens
cgagaaagcugaucaagaa

SEQ ID NO: 5964 - RNA, 19 nt, Homo sapiens
gcagaaagcugugaaaugu

SEQ ID NO: 5965 - RNA, 19 nt, Homo sapiens
ccaacgagcucaacaauau

SEQ ID NO: 5966 - RNA, 19 nt, Homo sapiens
gaaggaagcaggaguguuu

SEQ ID NO: 5967 - RNA, 19 nt, Homo sapiens
guuaagggcuuguuuggua

SEQ ID NO: 5968 - RNA, 19 nt, Homo sapiens
gaccaaagauggagucuau

SEQ ID NO: 5969 - RNA, 19 nt, Homo sapiens
ucaacgagcuggcaaacua

SEQ ID NO: 5970 - RNA, 19 nt, Homo sapiens
caaaauauguggaguagua

SEQ ID NO: 5971 - RNA, 19 nt, Homo sapiens
ccacuccucugcucgauua

SEQ ID NO: 5972 - RNA, 19 nt, Homo sapiens
gaaccaggcuuugaaggaa

SEQ ID NO: 5973 - RNA, 19 nt, Homo sapiens
caagaucccugcaaggaaa

SEQ ID NO: 5974 - RNA, 19 nt, Homo sapiens
ggaagcugaugaauauauu

SEQ ID NO: 5975 - RNA, 19 nt, Homo sapiens
cagccaagauguucaguaa

SEQ ID NO: 5976 - RNA, 19 nt, Homo sapiens
gacacuaucuugaucagaa

SEQ ID NO: 5977 - RNA, 19 nt, Homo sapiens
ucacugaggucuucaagga

SEQ ID NO: 5978 - RNA, 19 nt, Homo sapiens
gcacgaagucacaaucuuu

SEQ ID NO: 5979 - RNA, 19 nt, Homo sapiens
ccacugaaauguucugugu

SEQ ID NO: 5980 - RNA, 19 nt, Homo sapiens
ugaacaagaugaagaagga

SEQ ID NO: 5981 - RNA, 19 nt, Homo sapiens
ugagagcaauucgagauua

SEQ ID NO: 5982 - RNA, 19 nt, Homo sapiens
uaaguacucuugccaguuc

SEQ ID NO: 5983 - RNA, 19 nt, Homo sapiens
gacuacaucugcaaaguga

SEQ ID NO: 5984 - RNA, 19 nt, Homo sapiens
uaacuacuuugcaucugua

SEQ ID NO: 5985 - RNA, 19 nt, Homo sapiens
gggaggaagcugaugaaua

SEQ ID NO: 5986 - RNA, 19 nt, Homo sapiens
gugcagauccucaaagauu

SEQ ID NO: 5987 - RNA, 19 nt, Homo sapiens
caaccaggcuucugaaacu

SEQ ID NO: 5988 - RNA, 19 nt, Homo sapiens
gccaagauguucaguaaag

SEQ ID NO: 5989 - RNA, 19 nt, Homo sapiens
aaaccugccucguucauga

SEQ ID NO: 5990 - RNA, 19 nt, Homo sapiens
gcaagauccucaucauugg

SEQ ID NO: 5991 - RNA, 19 nt, Homo sapiens
ggcaagauccucaucauug

SEQ ID NO: 5992 - RNA, 19 nt, Homo sapiens
gagugcagauccucaaaga

SEQ ID NO: 5993 - RNA, 19 nt, Homo sapiens
cgagugaagucgauaaaca

SEQ ID NO: 5994 - RNA, 19 nt, Homo sapiens
ccacaggcuuccucaagaa

SEQ ID NO: 5995 - RNA, 19 nt, Homo sapiens
gaucaaacgucguggaaaa

SEQ ID NO: 5996 - RNA, 19 nt, Homo sapiens
cagaaucgguucaaguaug

SEQ ID NO: 5997 - RNA, 19 nt, Homo sapiens
ggaagcaucuaaguacugu

SEQ ID NO: 5998 - RNA, 19 nt, Homo sapiens
gaucauguguuacgcuauc

SEQ ID NO: 5999 - RNA, 19 nt, Homo sapiens
gcacccagauggcaagauc

SEQ ID NO: 6000 - RNA, 19 nt, Homo sapiens
ucucuucucuguauuauca

SEQ ID NO: 6001 - RNA, 19 nt, Homo sapiens
ucugcuaccugcuguauuu

SEQ ID NO: 6002 - RNA, 19 nt, Homo sapiens
gcugugaaaugucuugugu

SEQ ID NO: 6003 - RNA, 19 nt, Homo sapiens
gaccacggauggcgucuau

SEQ ID NO: 6004 - RNA, 19 nt, Homo sapiens
uauguggaguaguaacuua

SEQ ID NO: 6005 - RNA, 19 nt, Homo sapiens
acacaaagaagcuucauau

SEQ ID NO: 6006 - RNA, 19 nt, Homo sapiens
caaaucuuauccugaaugu

SEQ ID NO: 6007 - RNA, 19 nt, Homo sapiens
gcacugaggaauauaagau

SEQ ID NO: 6008 - RNA, 19 nt, Homo sapiens
caucggaccugccacuguu

SEQ ID NO: 6009 - RNA, 19 nt, Homo sapiens
ggcccacacugcaaacuuu

SEQ ID NO: 6010 - RNA, 19 nt, Homo sapiens
ugucuuauguucucuguau

SEQ ID NO: 6011 - RNA, 19 nt, Homo sapiens
gauaaacaacccagacaug

SEQ ID NO: 6012 - RNA, 19 nt, Homo sapiens
gcgagcagcagaccuauga

SEQ ID NO: 6013 - RNA, 19 nt, Homo sapiens
ucaccuaccucgagaucaa

SEQ ID NO: 6014 - RNA, 19 nt, Homo sapiens
ggacaggaagccacaguug

SEQ ID NO: 6015 - RNA, 19 nt, Homo sapiens
guggaguaguaacuuaaua

SEQ ID NO: 6016 - RNA, 19 nt, Homo sapiens
uuacuucccuugcuucuuc

SEQ ID NO: 6017 - RNA, 19 nt, Homo sapiens
gcuaccugcuguauuuauu

SEQ ID NO: 6018 - RNA, 19 nt, Homo sapiens
gcacagagacucacaugac

SEQ ID NO: 6019 - RNA, 19 nt, Homo sapiens
cauccagucuguauacgaa

SEQ ID NO: 6020 - RNA, 19 nt, Homo sapiens
aaacugcaguagccaagaa

SEQ ID NO: 6021 - RNA, 19 nt, Homo sapiens
ucuccggccucuucaauuu

SEQ ID NO: 6022 - RNA, 19 nt, Homo sapiens
gaaauucuggccaguuuua

SEQ ID NO: 6023 - RNA, 19 nt, Homo sapiens
guuaggauguugcuuucuu

SEQ ID NO: 6024 - RNA, 19 nt, Homo sapiens
aguggagccugcuuuauuu

SEQ ID NO: 6025 - RNA, 19 nt, Homo sapiens
ugcagauccucaaagauua

SEQ ID NO: 6026 - RNA, 19 nt, Homo sapiens
ccagggagcuugguuugau

SEQ ID NO: 6027 - RNA, 19 nt, Homo sapiens
gaaaugucuugugucuuau

SEQ ID NO: 6028 - RNA, 19 nt, Homo sapiens
gagaucauccagucuguau

SEQ ID NO: 6029 - RNA, 19 nt, Homo sapiens
ccaagaaccaggcuuugaa

SEQ ID NO: 6030 - RNA, 19 nt, Homo sapiens
acugaaauguucuguguug

SEQ ID NO: 6031 - RNA, 19 nt, Homo sapiens
ggaagcacccggagguaga

SEQ ID NO: 6032 - RNA, 19 nt, Homo sapiens
gcagcagaccuaugacuau

SEQ ID NO: 6033 - RNA, 19 nt, Homo sapiens
gauaccaucugugaucuag

SEQ ID NO: 6034 - RNA, 19 nt, Homo sapiens
gccacaggcuuccucaaga

SEQ ID NO: 6035 - RNA, 19 nt, Homo sapiens
caucuguaauccacaaaga

SEQ ID NO: 6036 - RNA, 19 nt, Homo sapiens
aaaccaagccaauauuugu

SEQ ID NO: 6037 - RNA, 19 nt, Homo sapiens
caucggagucgcauuugua

SEQ ID NO: 6038 - RNA, 19 nt, Homo sapiens
gcccacaacaccaucauuu

SEQ ID NO: 6039 - RNA, 19 nt, Homo sapiens
ccacggauggcgucuauga

SEQ ID NO: 6040 - RNA, 19 nt, Homo sapiens
ucaagaaggcggaccagaa

SEQ ID NO: 6041 - RNA, 19 nt, Homo sapiens
gaagaucucguggccaaug

SEQ ID NO: 6042 - RNA, 19 nt, Homo sapiens
gagagaucauccagucugu

SEQ ID NO: 6043 - RNA, 19 nt, Homo sapiens
guauuuaugcagcugauuu

SEQ ID NO: 6044 - RNA, 19 nt, Homo sapiens
agaaagcugugaaaugucu

SEQ ID NO: 6045 - RNA, 19 nt, Homo sapiens
ggacgugugccaccauguu

SEQ ID NO: 6046 - RNA, 19 nt, Homo sapiens
gcucaacaauaucaucucu

SEQ ID NO: 6047 - RNA, 19 nt, Homo sapiens
ccugggugcuuuaagauug

SEQ ID NO: 6048 - RNA, 19 nt, Homo sapiens
gccaauauuugugacuuug

SEQ ID NO: 6049 - RNA, 19 nt, Homo sapiens
caguggagccugcuuuauu

SEQ ID NO: 6050 - RNA, 19 nt, Homo sapiens
gcugaugaauauauugaca

SEQ ID NO: 6051 - RNA, 19 nt, Homo sapiens
agccaaaucuuauccugaa

SEQ ID NO: 6052 - RNA, 19 nt, Homo sapiens
agaaaagguugccuaagua

SEQ ID NO: 6053 - RNA, 19 nt, Homo sapiens
gagagcaauucgagauuac

SEQ ID NO: 6054 - RNA, 19 nt, Homo sapiens
cagcagaccuaugacuaug

SEQ ID NO: 6055 - RNA, 19 nt, Homo sapiens
ggaguaguaacuuaauaug

SEQ ID NO: 6056 - RNA, 19 nt, Homo sapiens
aaacauuuauggccucaag

SEQ ID NO: 6057 - RNA, 19 nt, Homo sapiens
ggaggaagggaaugaaaca

SEQ ID NO: 6058 - RNA, 19 nt, Homo sapiens
uagaaacuguggguccuuu

SEQ ID NO: 6059 - RNA, 19 nt, Homo sapiens
gguggcauauccagaggaa

SEQ ID NO: 6060 - RNA, 19 nt, Homo sapiens
ccaaagauggagucuaugu

SEQ ID NO: 6061 - RNA, 19 nt, Homo sapiens
gaaccaagcuugucuuuaa

SEQ ID NO: 6062 - RNA, 19 nt, Homo sapiens
ggaaauccuugauguguuu

SEQ ID NO: 6063 - RNA, 19 nt, Homo sapiens
gcaaacaggucgugaugaa

SEQ ID NO: 6064 - RNA, 19 nt, Homo sapiens
gaacauagaagugccauuu

SEQ ID NO: 6065 - RNA, 19 nt, Homo sapiens
aaagauaucuggccgacua

SEQ ID NO: 6066 - RNA, 19 nt, Homo sapiens
gcagacaguuuacagaaga

SEQ ID NO: 6067 - RNA, 19 nt, Homo sapiens
guaggaauguuucgagauu

SEQ ID NO: 6068 - RNA, 19 nt, Homo sapiens
gagauucgguaacaacuga

SEQ ID NO: 6069 - RNA, 19 nt, Homo sapiens
ccuaugugcugcuaaauuu

SEQ ID NO: 6070 - RNA, 19 nt, Homo sapiens
gaagaaacaggauauugaa

SEQ ID NO: 6071 - RNA, 19 nt, Homo sapiens
gcaaggauuuaaaggauuc

SEQ ID NO: 6072 - RNA, 19 nt, Homo sapiens
gagcagugauucucucuuc

SEQ ID NO: 6073 - RNA, 19 nt, Homo sapiens
caaaucaccaccauucuuu

SEQ ID NO: 6074 - RNA, 19 nt, Homo sapiens
gguaacaacugaccacauc

SEQ ID NO: 6075 - RNA, 19 nt, Homo sapiens
gcaaauuugucgaguucuu

SEQ ID NO: 6076 - RNA, 19 nt, Homo sapiens
acauagaagugccauuuaa

SEQ ID NO: 6077 - RNA, 19 nt, Homo sapiens
aaauagagacugugaauga

SEQ ID NO: 6078 - RNA, 19 nt, Homo sapiens
gauaagaacuuugcacacu

SEQ ID NO: 6079 - RNA, 19 nt, Homo sapiens
cagaagggcagacaguuua

SEQ ID NO: 6080 - RNA, 19 nt, Homo sapiens
gagcuacgauugcuaacau

SEQ ID NO: 6081 - RNA, 19 nt, Homo sapiens
gggcaaauuugucgaguuc

SEQ ID NO: 6082 - RNA, 19 nt, Homo sapiens
gaaucaagaccuggaauuu

SEQ ID NO: 6083 - RNA, 19 nt, Homo sapiens
aaugaaaccuuccucuuga

SEQ ID NO: 6084 - RNA, 19 nt, Homo sapiens
gggaacauuugccaacauu

SEQ ID NO: 6085 - RNA, 19 nt, Homo sapiens
ccuuguagcuguuggagua

SEQ ID NO: 6086 - RNA, 19 nt, Homo sapiens
ggaaauauugcaagaaaca

SEQ ID NO: 6087 - RNA, 19 nt, Homo sapiens
ggacagcagguauuucuga

SEQ ID NO: 6088 - RNA, 19 nt, Homo sapiens
ggaagucuaucagaaaaua

SEQ ID NO: 6089 - RNA, 19 nt, Homo sapiens
gaaagagccauugggagua

SEQ ID NO: 6090 - RNA, 19 nt, Homo sapiens
caaugaaaccuuccucuug

SEQ ID NO: 6091 - RNA, 19 nt, Homo sapiens
uuaaggaagucuaucagaa

SEQ ID NO: 6092 - RNA, 19 nt, Homo sapiens
guaauagcauaugcaauug

SEQ ID NO: 6093 - RNA, 19 nt, Homo sapiens
ggaguggcguggucaccua

SEQ ID NO: 6094 - RNA, 19 nt, Homo sapiens
gaacacguggccaucagua

SEQ ID NO: 6095 - RNA, 19 nt, Homo sapiens
uaacauguguccagaguac

SEQ ID NO: 6096 - RNA, 19 nt, Homo sapiens
ugaagaaacaggauauuga

SEQ ID NO: 6097 - RNA, 19 nt, Homo sapiens
gaucacaggacguugcuuu

SEQ ID NO: 6098 - RNA, 19 nt, Homo sapiens
cagaaucgacuuugagaaa

SEQ ID NO: 6099 - RNA, 19 nt, Homo sapiens
gggaaauccuugauguguu

SEQ ID NO: 6100 - RNA, 19 nt, Homo sapiens
uaaggaagucuaucagaaa

SEQ ID NO: 6101 - RNA, 19 nt, Homo sapiens
caagagugguauuugauca

SEQ ID NO: 6102 - RNA, 19 nt, Homo sapiens
gcugcucgcuacuuaacua

SEQ ID NO: 6103 - RNA, 19 nt, Homo sapiens
ucaaugacccuucucaaga

SEQ ID NO: 6104 - RNA, 19 nt, Homo sapiens
uaagaacuuugcacacuuc

SEQ ID NO: 6105 - RNA, 19 nt, Homo sapiens
aaagagccauugggaguaa

SEQ ID NO: 6106 - RNA, 19 nt, Homo sapiens
ucacccagguuguggaauu

SEQ ID NO: 6107 - RNA, 19 nt, Homo sapiens
cugcugaucuuguaauaga

SEQ ID NO: 6108 - RNA, 19 nt, Homo sapiens
cuggaaauauugcaagaaa

SEQ ID NO: 6109 - RNA, 19 nt, Homo sapiens
gcaaagggacagcagguau

SEQ ID NO: 6110 - RNA, 19 nt, Homo sapiens
gggcaggauuguuagcaaa

SEQ ID NO: 6111 - RNA, 19 nt, Homo sapiens
ccaaguugcuccugaacau

SEQ ID NO: 6112 - RNA, 19 nt, Homo sapiens
uuuaaaggauuccaaguug

SEQ ID NO: 6113 - RNA, 19 nt, Homo sapiens
gcacaagaacauagaagug

SEQ ID NO: 6114 - RNA, 19 nt, Homo sapiens
ccucaaaccacaaaugaaa

SEQ ID NO: 6115 - RNA, 19 nt, Homo sapiens
ucaccaccauucuuugaaa

SEQ ID NO: 6116 - RNA, 19 nt, Homo sapiens
gccauuggauccuguacaa

SEQ ID NO: 6117 - RNA, 19 nt, Homo sapiens
ggauaggucggguguuaaa

SEQ ID NO: 6118 - RNA, 19 nt, Homo sapiens
auguggagcucacuuauuu

SEQ ID NO: 6119 - RNA, 19 nt, Homo sapiens
aaagcggagucaugccuua

SEQ ID NO: 6120 - RNA, 19 nt, Homo sapiens
gcuaacauguguccagagu

SEQ ID NO: 6121 - RNA, 19 nt, Homo sapiens
aggaggagauccagagaaa

SEQ ID NO: 6122 - RNA, 19 nt, Homo sapiens
ucacagggcaagaacgaua

SEQ ID NO: 6123 - RNA, 19 nt, Homo sapiens
ggaauuccaaaucuacgua

SEQ ID NO: 6124 - RNA, 19 nt, Homo sapiens
ggaguacuaucuggaaaca

SEQ ID NO: 6125 - RNA, 19 nt, Homo sapiens
gccugaacgugaugccuua

SEQ ID NO: 6126 - RNA, 19 nt, Homo sapiens
ucacguaccuggugcaaac

SEQ ID NO: 6127 - RNA, 19 nt, Homo sapiens
gaccuggaauuugaaagaa

SEQ ID NO: 6128 - RNA, 19 nt, Homo sapiens
uaaauuggaggauucaaga

SEQ ID NO: 6129 - RNA, 19 nt, Homo sapiens
ggucauugcugccauuacu

SEQ ID NO: 6130 - RNA, 19 nt, Homo sapiens
aagcaaggauuuaaaggau

SEQ ID NO: 6131 - RNA, 19 nt, Homo sapiens
uggcaagagugguauuuga

SEQ ID NO: 6132 - RNA, 19 nt, Homo sapiens
ccaggugaauuuggaauau

SEQ ID NO: 6133 - RNA, 19 nt, Homo sapiens
gagaaccaagcuugucuuu

SEQ ID NO: 6134 - RNA, 19 nt, Homo sapiens
gaauuuggaagcuagaaug

SEQ ID NO: 6135 - RNA, 19 nt, Homo sapiens
gaaugucacucagcacaag

SEQ ID NO: 6136 - RNA, 19 nt, Homo sapiens
gcaagauggccaaguagga

SEQ ID NO: 6137 - RNA, 19 nt, Homo sapiens
ccaaaucuacguauaucaa

SEQ ID NO: 6138 - RNA, 19 nt, Homo sapiens
gacagcagguauuucugaa

SEQ ID NO: 6139 - RNA, 19 nt, Homo sapiens
gcaggauuguuagcaaaga

SEQ ID NO: 6140 - RNA, 19 nt, Homo sapiens
aaacaggucgugaugaaga

SEQ ID NO: 6141 - RNA, 19 nt, Homo sapiens
gaucaggauggauauuauu

SEQ ID NO: 6142 - RNA, 19 nt, Homo sapiens
gggcaagaacgauacacua

SEQ ID NO: 6143 - RNA, 19 nt, Homo sapiens
uaucaaaucaccaccauuc

SEQ ID NO: 6144 - RNA, 19 nt, Homo sapiens
caaagggacagcagguauu

SEQ ID NO: 6145 - RNA, 19 nt, Homo sapiens
uaauccgucugugauguua

SEQ ID NO: 6146 - RNA, 19 nt, Homo sapiens
caaaaggccucaggacaaa

SEQ ID NO: 6147 - RNA, 19 nt, Homo sapiens
gacaucgugcucaccauua

SEQ ID NO: 6148 - RNA, 19 nt, Homo sapiens
ggugucuccuacccucuua

SEQ ID NO: 6149 - RNA, 19 nt, Homo sapiens
gagccaagcaaggauuuaa

SEQ ID NO: 6150 - RNA, 19 nt, Homo sapiens
gcacagacucgcacacuac

SEQ ID NO: 6151 - RNA, 19 nt, Homo sapiens
gggcagacaguuuacagaa

SEQ ID NO: 6152 - RNA, 19 nt, Homo sapiens
cacgagaauucaacuccua

SEQ ID NO: 6153 - RNA, 19 nt, Homo sapiens
gaaaauagagacugugaau

SEQ ID NO: 6154 - RNA, 19 nt, Homo sapiens
ugucucagcuuggguuuga

SEQ ID NO: 6155 - RNA, 19 nt, Homo sapiens
aaagaaagcuguggaugcu

SEQ ID NO: 6156 - RNA, 19 nt, Homo sapiens
caagcaaggauuuaaagga

SEQ ID NO: 6157 - RNA, 19 nt, Homo sapiens
ggucggguguuaaaguugu

SEQ ID NO: 6158 - RNA, 19 nt, Homo sapiens
auggauaggucggguguua

SEQ ID NO: 6159 - RNA, 19 nt, Homo sapiens
ggugugaucccacuugaau

SEQ ID NO: 6160 - RNA, 19 nt, Homo sapiens
gcucgcuacuuaacuaaca

SEQ ID NO: 6161 - RNA, 19 nt, Homo sapiens
caaaggaaauuacauaugg

SEQ ID NO: 6162 - RNA, 19 nt, Homo sapiens
gagcaaaggaaauuacaua

SEQ ID NO: 6163 - RNA, 19 nt, Homo sapiens
gaucugaccugguucucaa

SEQ ID NO: 6164 - RNA, 19 nt, Homo sapiens
ccacagagcucccagaacu

SEQ ID NO: 6165 - RNA, 19 nt, Homo sapiens
ggaaagaaccauuaugaca

SEQ ID NO: 6166 - RNA, 19 nt, Homo sapiens
gaaauuacauaugggaaca

SEQ ID NO: 6167 - RNA, 19 nt, Homo sapiens
gaaagaaccauuaugacau

SEQ ID NO: 6168 - RNA, 19 nt, Homo sapiens
aaagaaccauuaugacaug

SEQ ID NO: 6169 - RNA, 19 nt, Homo sapiens
gcaaaggaaauuacauaug

SEQ ID NO: 6170 - RNA, 19 nt, Homo sapiens
gcccuucacuccugagaaa

SEQ ID NO: 6171 - RNA, 19 nt, Homo sapiens
uaaaggcgccugugcaaga

SEQ ID NO: 6172 - RNA, 19 nt, Homo sapiens
ggccuuaucugaacuggau

SEQ ID NO: 6173 - RNA, 19 nt, Homo sapiens
gcaaggaaagcgccuaugu

SEQ ID NO: 6174 - RNA, 19 nt, Homo sapiens
gcaggaguaugguugagau

SEQ ID NO: 6175 - RNA, 19 nt, Homo sapiens
gcaaagacagcaaggaaag

SEQ ID NO: 6176 - RNA, 19 nt, Homo sapiens
agagagauauguggagaaa

SEQ ID NO: 6177 - RNA, 19 nt, Homo sapiens
gaacaauaaaccaguaaag

SEQ ID NO: 6178 - RNA, 19 nt, Homo sapiens
gaccuggacuuguguaacu

SEQ ID NO: 6179 - RNA, 19 nt, Homo sapiens
guaacucgacccaguggua

SEQ ID NO: 6180 - RNA, 19 nt, Homo sapiens
cugcucaccuuccuuggua

SEQ ID NO: 6181 - RNA, 19 nt, Homo sapiens
gaguaugguugagaugcua

SEQ ID NO: 6182 - RNA, 19 nt, Homo sapiens
gcucauagaggucuugaag

SEQ ID NO: 6183 - RNA, 19 nt, Homo sapiens
ggaacaauaaaccaguaaa

SEQ ID NO: 6184 - RNA, 19 nt, Homo sapiens
ggguuacgguucaggcaaa

SEQ ID NO: 6185 - RNA, 19 nt, Homo sapiens
gugcaaagacagcaaggaa

SEQ ID NO: 6186 - RNA, 19 nt, Homo sapiens
gagaaaaucaucauucaug

SEQ ID NO: 6187 - RNA, 19 nt, Homo sapiens
ugaccugguucucaacaga

SEQ ID NO: 6188 - RNA, 19 nt, Homo sapiens
ccacagguaccacacaugu

SEQ ID NO: 6189 - RNA, 19 nt, Homo sapiens
gauaacgccacgugugaug

SEQ ID NO: 6190 - RNA, 19 nt, Homo sapiens
ccaccuggccuuaucugaa

SEQ ID NO: 6191 - RNA, 19 nt, Homo sapiens
ugggaacaauaaaccagua

SEQ ID NO: 6192 - RNA, 19 nt, Homo sapiens
ccaccuacacccucaucua

SEQ ID NO: 6193 - RNA, 19 nt, Homo sapiens
caaggaaagcgccuaugug

SEQ ID NO: 6194 - RNA, 19 nt, Homo sapiens
gcuaccaacugccauucug

SEQ ID NO: 6195 - RNA, 19 nt, Homo sapiens
gaccacagagcucccagaa

SEQ ID NO: 6196 - RNA, 19 nt, Homo sapiens
acggaaagaaccauuauga

SEQ ID NO: 6197 - RNA, 19 nt, Homo sapiens
cuccugaucugaccugguu

SEQ ID NO: 6198 - RNA, 19 nt, Homo sapiens
gauugguucuaacgcuuug

SEQ ID NO: 6199 - RNA, 19 nt, Homo sapiens
ggaguaugguugagaugcu

SEQ ID NO: 6200 - RNA, 19 nt, Homo sapiens
cgacggaaagaaccauuau

SEQ ID NO: 6201 - RNA, 19 nt, Homo sapiens
agagauauguggagaaaau

SEQ ID NO: 6202 - RNA, 19 nt, Homo sapiens
gggaacaauaaaccaguaa

SEQ ID NO: 6203 - RNA, 19 nt, Homo sapiens
caguguccgugguugcuaa

SEQ ID NO: 6204 - RNA, 19 nt, Homo sapiens
gagaucaccccucccauuu

SEQ ID NO: 6205 - RNA, 19 nt, Homo sapiens
ucaucgaccuggacuugug

SEQ ID NO: 6206 - RNA, 19 nt, Homo sapiens
aagauaacgccacguguga

SEQ ID NO: 6207 - RNA, 19 nt, Homo sapiens
gccuccagaucuucacgua

SEQ ID NO: 6208 - RNA, 19 nt, Homo sapiens
cuccagaucuucacguaca

SEQ ID NO: 6209 - RNA, 19 nt, Homo sapiens
ccucucaugugcaaagaca

SEQ ID NO: 6210 - RNA, 19 nt, Homo sapiens
ggggauauauagaagagaa

SEQ ID NO: 6211 - RNA, 19 nt, Homo sapiens
gauggaggcacguguggau

SEQ ID NO: 6212 - RNA, 19 nt, Homo sapiens
cgacagagggaaaugacau

SEQ ID NO: 6213 - RNA, 19 nt, Homo sapiens
guccgugguugcuaaagau

SEQ ID NO: 6214 - RNA, 19 nt, Homo sapiens
caccuggccuuaucugaac

SEQ ID NO: 6215 - RNA, 19 nt, Homo sapiens
gaugcuaccaacugccauu

SEQ ID NO: 6216 - RNA, 19 nt, Homo sapiens
acagagcucccagaacuga

SEQ ID NO: 6217 - RNA, 19 nt, Homo sapiens
ucaccuuccuugguauuuc

SEQ ID NO: 6218 - RNA, 19 nt, Homo sapiens
gcguucagccaaccaaugu

SEQ ID NO: 6219 - RNA, 19 nt, Homo sapiens
uguccgugguugcuaaaga

SEQ ID NO: 6220 - RNA, 19 nt, Homo sapiens
ccgacggaaagaaccauua

SEQ ID NO: 6221 - RNA, 19 nt, Homo sapiens
gcgccuacagcagcucaua

SEQ ID NO: 6222 - RNA, 19 nt, Homo sapiens
acauugcccucguggagau

SEQ ID NO: 6223 - RNA, 19 nt, Homo sapiens
gcagugcaggaguaugguu

SEQ ID NO: 6224 - RNA, 19 nt, Homo sapiens
gccuacagcagcucauaga

SEQ ID NO: 6225 - RNA, 19 nt, Homo sapiens
ccuccagccucaccuuuac

SEQ ID NO: 6226 - RNA, 19 nt, Homo sapiens
gcucaccuuccuugguauu

SEQ ID NO: 6227 - RNA, 19 nt, Homo sapiens
ccuauguggucgugggaau

SEQ ID NO: 6228 - RNA, 19 nt, Homo sapiens
ccuacacccucaucuacca

SEQ ID NO: 6229 - RNA, 19 nt, Homo sapiens
cccaggccaucaucuauac

SEQ ID NO: 6230 - RNA, 19 nt, Homo sapiens
gauggucagccuccagauc

SEQ ID NO: 6231 - RNA, 19 nt, Homo sapiens
ggagcaaaggaaauuacau

SEQ ID NO: 6232 - RNA, 19 nt, Homo sapiens
ucacugcugcucacugcuu

SEQ ID NO: 6233 - RNA, 19 nt, Homo sapiens
gggauauauagaagagaaa

SEQ ID NO: 6234 - RNA, 19 nt, Homo sapiens
caacaugggugcagaaauu

SEQ ID NO: 6235 - RNA, 19 nt, Homo sapiens
caaucuagcugaugaauuc

SEQ ID NO: 6236 - RNA, 19 nt, Homo sapiens
gagaagaacauuaacauug

SEQ ID NO: 6237 - RNA, 19 nt, Homo sapiens
ccacuuccguguucccuua

SEQ ID NO: 6238 - RNA, 19 nt, Homo sapiens
ccaaagaugugauccugaa

SEQ ID NO: 6239 - RNA, 19 nt, Homo sapiens
gcagugcccucaacagaau

SEQ ID NO: 6240 - RNA, 19 nt, Homo sapiens
ccaggaaguuuauaauuuc

SEQ ID NO: 6241 - RNA, 19 nt, Homo sapiens
cagaugagcuucccaaagg

SEQ ID NO: 6242 - RNA, 19 nt, Homo sapiens
gcacuggcauggcgacaau

SEQ ID NO: 6243 - RNA, 19 nt, Homo sapiens
caacugcaggugccaaaua

SEQ ID NO: 6244 - RNA, 19 nt, Homo sapiens
ggacggcuaugcacagauc

SEQ ID NO: 6245 - RNA, 19 nt, Homo sapiens
gcacggauggcaagaaguu

SEQ ID NO: 6246 - RNA, 19 nt, Homo sapiens
agaccaaccugaagaaaca

SEQ ID NO: 6247 - RNA, 19 nt, Homo sapiens
caggugcaaucguggaaua

SEQ ID NO: 6248 - RNA, 19 nt, Homo sapiens
acgaguacauccauuauga

SEQ ID NO: 6249 - RNA, 19 nt, Homo sapiens
ccaacgaguacauccauua

SEQ ID NO: 6250 - RNA, 19 nt, Homo sapiens
cggagaagauuguguaugg

SEQ ID NO: 6251 - RNA, 19 nt, Homo sapiens
agacgcagauugagugguu

SEQ ID NO: 6252 - RNA, 19 nt, Homo sapiens
gccuggaucuggaaucauu

SEQ ID NO: 6253 - RNA, 19 nt, Homo sapiens
ggacaucaaccaggaaguu

SEQ ID NO: 6254 - RNA, 19 nt, Homo sapiens
uggacaagcugaccauuca

SEQ ID NO: 6255 - RNA, 19 nt, Homo sapiens
gagcugaagccacacauca

SEQ ID NO: 6256 - RNA, 19 nt, Homo sapiens
ggagaagauuguguaugga

SEQ ID NO: 6257 - RNA, 19 nt, Homo sapiens
ugaagugcaucaucaagca

SEQ ID NO: 6258 - RNA, 19 nt, Homo sapiens
acacaaucgucaccuccua

SEQ ID NO: 6259 - RNA, 19 nt, Homo sapiens
ggccaccacuuccguguuc

SEQ ID NO: 6260 - RNA, 19 nt, Homo sapiens
caacgaguacauccauuau

SEQ ID NO: 6261 - RNA, 19 nt, Homo sapiens
ucacagcccuggccauugc

SEQ ID NO: 6262 - RNA, 19 nt, Homo sapiens
auuaugaccugcuagagaa

SEQ ID NO: 6263 - RNA, 19 nt, Homo sapiens
gggcacggauggcaagaag

SEQ ID NO: 6264 - RNA, 19 nt, Homo sapiens
cauccaccauccacuguga

SEQ ID NO: 6265 - RNA, 19 nt, Homo sapiens
cgagugggucuaauuggua

SEQ ID NO: 6266 - RNA, 19 nt, Homo sapiens
ccacugugaccaucugauu

SEQ ID NO: 6267 - RNA, 19 nt, Homo sapiens
gcagaugagcuucccaaag

SEQ ID NO: 6268 - RNA, 19 nt, Homo sapiens
ggacaggaaggacaucaag

SEQ ID NO: 6269 - RNA, 19 nt, Homo sapiens
caaccaggaaguuuauaau

SEQ ID NO: 6270 - RNA, 19 nt, Homo sapiens
ucaaccaggaaguuuauaa

SEQ ID NO: 6271 - RNA, 19 nt, Homo sapiens
gcucauuggugccaucaac

SEQ ID NO: 6272 - RNA, 19 nt, Homo sapiens
gaaugaaggaacugcaaca

SEQ ID NO: 6273 - RNA, 19 nt, Homo sapiens
acaggaaggacaucaagaa

SEQ ID NO: 6274 - RNA, 19 nt, Homo sapiens
gcaccaauucaagcuauga

SEQ ID NO: 6275 - RNA, 19 nt, Homo sapiens
ugacucggcugcagaaagc

SEQ ID NO: 6276 - RNA, 19 nt, Homo sapiens
gaaauugagcgaggcaagu

SEQ ID NO: 6277 - RNA, 19 nt, Homo sapiens
caucaaccaggaaguuuau

SEQ ID NO: 6278 - RNA, 19 nt, Homo sapiens
gacaucaaccaggaaguuu

SEQ ID NO: 6279 - RNA, 19 nt, Homo sapiens
ccaagagcuuugccaggau

SEQ ID NO: 6280 - RNA, 19 nt, Homo sapiens
gaucggagacgagaacuac

SEQ ID NO: 6281 - RNA, 19 nt, Homo sapiens
gcaagucccaguucaccau

SEQ ID NO: 6282 - RNA, 19 nt, Homo sapiens
gcaagguggcagagaagga

SEQ ID NO: 6283 - RNA, 19 nt, Homo sapiens
accacaggaugaagaagua

SEQ ID NO: 6284 - RNA, 19 nt, Homo sapiens
caaggugauuggcgugaag

SEQ ID NO: 6285 - RNA, 19 nt, Homo sapiens
agaaguaccugagcaagac

SEQ ID NO: 6286 - RNA, 19 nt, Homo sapiens
caucaucaccaagagcuuu

SEQ ID NO: 6287 - RNA, 19 nt, Homo sapiens
ggaucuggguggcauuguc

SEQ ID NO: 6288 - RNA, 19 nt, Homo sapiens
caagguggcagagaaggaa

SEQ ID NO: 6289 - RNA, 19 nt, Homo sapiens
gcugaagccacacaucaau

SEQ ID NO: 6290 - RNA, 19 nt, Homo sapiens
uugccaaucuagcugauga

SEQ ID NO: 6291 - RNA, 19 nt, Homo sapiens
cauuaugaccugcuagaga

SEQ ID NO: 6292 - RNA, 19 nt, Homo sapiens
cauccauuaugaccugcua

SEQ ID NO: 6293 - RNA, 19 nt, Homo sapiens
cauccgagugggucuaauu

SEQ ID NO: 6294 - RNA, 19 nt, Homo sapiens
acaucaaccaggaaguuua

SEQ ID NO: 6295 - RNA, 19 nt, Homo sapiens
ccuauuccaaguaguguaa

SEQ ID NO: 6296 - RNA, 19 nt, Homo sapiens
gguccucacccaaagaugu

SEQ ID NO: 6297 - RNA, 19 nt, Homo sapiens
acuuugagcccaacgagua

SEQ ID NO: 6298 - RNA, 19 nt, Homo sapiens
gggcaucugcauuggaguu

SEQ ID NO: 6299 - RNA, 19 nt, Homo sapiens
ucgcugacccggcugacua

SEQ ID NO: 6300 - RNA, 19 nt, Homo sapiens
uccaacaaccugcucauug

SEQ ID NO: 6301 - RNA, 19 nt, Homo sapiens
ggacauccgagugggucua

SEQ ID NO: 6302 - RNA, 19 nt, Homo sapiens
ugaagaaguaccugagcaa

SEQ ID NO: 6303 - RNA, 19 nt, Homo sapiens
cccauggccucaagugcaa

SEQ ID NO: 6304 - RNA, 19 nt, Homo sapiens
ccgagugggucuaauuggu

SEQ ID NO: 6305 - RNA, 19 nt, Homo sapiens
ugggcaagguggcagagaa

SEQ ID NO: 6306 - RNA, 19 nt, Homo sapiens
ccaaucuagcugaugaauu

SEQ ID NO: 6307 - RNA, 19 nt, Homo sapiens
gcaacaugggugcagaaau

SEQ ID NO: 6308 - RNA, 19 nt, Homo sapiens
ucaacagaaugaaggaacu

SEQ ID NO: 6309 - RNA, 19 nt, Homo sapiens
ugacccggcugacuacaac

SEQ ID NO: 6310 - RNA, 19 nt, Homo sapiens
gagaccaaccugaagaaac

SEQ ID NO: 6311 - RNA, 19 nt, Homo sapiens
cgagacccaugccuuuguc

SEQ ID NO: 6312 - RNA, 19 nt, Homo sapiens
caagugcaagucccaguuc

SEQ ID NO: 6313 - RNA, 19 nt, Homo sapiens
aacugcaggugccaaauau

SEQ ID NO: 6314 - RNA, 19 nt, Homo sapiens
gacaggaaggacaucaaga

SEQ ID NO: 6315 - RNA, 19 nt, Homo sapiens
cugcaccaauucaagcuau

SEQ ID NO: 6316 - RNA, 19 nt, Homo sapiens
aagaaguaccugagcaaga

SEQ ID NO: 6317 - RNA, 19 nt, Homo sapiens
cagaaugaaggaacugcaa

SEQ ID NO: 6318 - RNA, 19 nt, Homo sapiens
acacugcccgcuacuacaa

SEQ ID NO: 6319 - RNA, 19 nt, Homo sapiens
ugcuagagaagaacauuaa

SEQ ID NO: 6320 - RNA, 19 nt, Homo sapiens
gcauggcgacaaucugcaa

SEQ ID NO: 6321 - RNA, 19 nt, Homo sapiens
cuagagaagaacauuaaca

SEQ ID NO: 6322 - RNA, 19 nt, Homo sapiens
guguaccacugaccacauc

SEQ ID NO: 6323 - RNA, 19 nt, Homo sapiens
gugcaaucguggaauacca

SEQ ID NO: 6324 - RNA, 19 nt, Homo sapiens
aagaugugauccugaaggu

SEQ ID NO: 6325 - RNA, 19 nt, Homo sapiens
aagccuggaucuggaauca

SEQ ID NO: 6326 - RNA, 19 nt, Homo sapiens
ccacgagaccaaccugaag

SEQ ID NO: 6327 - RNA, 19 nt, Homo sapiens
uguauggacaccuggauga

SEQ ID NO: 6328 - RNA, 19 nt, Homo sapiens
cgugggcacuuggauaaca

SEQ ID NO: 6329 - RNA, 19 nt, Homo sapiens
agauggccaugcuccaguu

SEQ ID NO: 6330 - RNA, 19 nt, Homo sapiens
ucaagugcaagucccaguu

SEQ ID NO: 6331 - RNA, 19 nt, Homo sapiens
gccaugcuccaguucauca

SEQ ID NO: 6332 - RNA, 19 nt, Homo sapiens
gaaauuggggccaccacuu

SEQ ID NO: 6333 - RNA, 19 nt, Homo sapiens
gcgcuggcgucaaguucag

SEQ ID NO: 6334 - RNA, 19 nt, Homo sapiens
gaacagauuucagagauua

SEQ ID NO: 6335 - RNA, 19 nt, Homo sapiens
gaaggaaacuuauuggaaa

SEQ ID NO: 6336 - RNA, 19 nt, Homo sapiens
gcuaaucacuggcuauaua

SEQ ID NO: 6337 - RNA, 19 nt, Homo sapiens
gcaguggucuuccaaauau

SEQ ID NO: 6338 - RNA, 19 nt, Homo sapiens
ggaaagacuucaaaucaug

SEQ ID NO: 6339 - RNA, 19 nt, Homo sapiens
ucaaauagcuauagagcaa

SEQ ID NO: 6340 - RNA, 19 nt, Homo sapiens
gggcauggcuauucucauu

SEQ ID NO: 6341 - RNA, 19 nt, Homo sapiens
gaaaugcuauggauuacau

SEQ ID NO: 6342 - RNA, 19 nt, Homo sapiens
gcugauggauugcauuuau

SEQ ID NO: 6343 - RNA, 19 nt, Homo sapiens
ggaaggaaacuuauuggaa

SEQ ID NO: 6344 - RNA, 19 nt, Homo sapiens
gaaccuaacuucuguugac

SEQ ID NO: 6345 - RNA, 19 nt, Homo sapiens
caaaccauguguucugauu

SEQ ID NO: 6346 - RNA, 19 nt, Homo sapiens
gaaccagaaccacagauuu

SEQ ID NO: 6347 - RNA, 19 nt, Homo sapiens
caaguaaaccagcguguaa

SEQ ID NO: 6348 - RNA, 19 nt, Homo sapiens
guagaacccuuccaagcuu

SEQ ID NO: 6349 - RNA, 19 nt, Homo sapiens
ggaccauugucucguguaa

SEQ ID NO: 6350 - RNA, 19 nt, Homo sapiens
aaagagaccuguuaaacca

SEQ ID NO: 6351 - RNA, 19 nt, Homo sapiens
gcaccagucugaaaucaag

SEQ ID NO: 6352 - RNA, 19 nt, Homo sapiens
ggagaucauuggcacuuau

SEQ ID NO: 6353 - RNA, 19 nt, Homo sapiens
caagcugucuuaaggaguu

SEQ ID NO: 6354 - RNA, 19 nt, Homo sapiens
gcacuuaugcccagacaga

SEQ ID NO: 6355 - RNA, 19 nt, Homo sapiens
gcuuggagauuacuguauu

SEQ ID NO: 6356 - RNA, 19 nt, Homo sapiens
ggacaaguuuaaucugcuu

SEQ ID NO: 6357 - RNA, 19 nt, Homo sapiens
gcucagaugcuguugcuuu

SEQ ID NO: 6358 - RNA, 19 nt, Homo sapiens
gacuucaaaucaugcaaua

SEQ ID NO: 6359 - RNA, 19 nt, Homo sapiens
ugagguggcugucaggaaa

SEQ ID NO: 6360 - RNA, 19 nt, Homo sapiens
ucuaggagcuuucucugaa

SEQ ID NO: 6361 - RNA, 19 nt, Homo sapiens
gcagccagauuaguagaaa

SEQ ID NO: 6362 - RNA, 19 nt, Homo sapiens
ggagaccuaucaccggauu

SEQ ID NO: 6363 - RNA, 19 nt, Homo sapiens
gcuaagaacuccccacuga

SEQ ID NO: 6364 - RNA, 19 nt, Homo sapiens
ugacagagccucagauuac

SEQ ID NO: 6365 - RNA, 19 nt, Homo sapiens
ugaagaagaugagggaguu

SEQ ID NO: 6366 - RNA, 19 nt, Homo sapiens
ugaaaccgcugaguaacaa

SEQ ID NO: 6367 - RNA, 19 nt, Homo sapiens
guuuaugucugcuguauuc

SEQ ID NO: 6368 - RNA, 19 nt, Homo sapiens
gagaaaacaugcugaugaa

SEQ ID NO: 6369 - RNA, 19 nt, Homo sapiens
gaucuucacuugggcaugu

SEQ ID NO: 6370 - RNA, 19 nt, Homo sapiens
cuuaagaaaugcgauauga

SEQ ID NO: 6371 - RNA, 19 nt, Homo sapiens
ugaagucacugcaguccaa

SEQ ID NO: 6372 - RNA, 19 nt, Homo sapiens
uaacuucuguugaccuugu

SEQ ID NO: 6373 - RNA, 19 nt, Homo sapiens
ugaacgaccugcccaguca

SEQ ID NO: 6374 - RNA, 19 nt, Homo sapiens
caagccaggugaaccagaa

SEQ ID NO: 6375 - RNA, 19 nt, Homo sapiens
ugaguaacaagcugacuua

SEQ ID NO: 6376 - RNA, 19 nt, Homo sapiens
caaauuugguuaugaugag

SEQ ID NO: 6377 - RNA, 19 nt, Homo sapiens
gauaugacuuccuuuugua

SEQ ID NO: 6378 - RNA, 19 nt, Homo sapiens
ggccaaccaugguggauau

SEQ ID NO: 6379 - RNA, 19 nt, Homo sapiens
cuaauuguccuuucaguug

SEQ ID NO: 6380 - RNA, 19 nt, Homo sapiens
uagcagaauuuaacuacug

SEQ ID NO: 6381 - RNA, 19 nt, Homo sapiens
aagcagagguccacgaauc

SEQ ID NO: 6382 - RNA, 19 nt, Homo sapiens
ggcaugguguccuauuuga

SEQ ID NO: 6383 - RNA, 19 nt, Homo sapiens
ccgcuggacugaaggcuuu

SEQ ID NO: 6384 - RNA, 19 nt, Homo sapiens
uaucguaccuauucgugaa

SEQ ID NO: 6385 - RNA, 19 nt, Homo sapiens
gacaauggcuaccucaaaa

SEQ ID NO: 6386 - RNA, 19 nt, Homo sapiens
uaauuguccuuucaguuga

SEQ ID NO: 6387 - RNA, 19 nt, Homo sapiens
cacauauucugucaucuug

SEQ ID NO: 6388 - RNA, 19 nt, Homo sapiens
cgagagaucgagaacauga

SEQ ID NO: 6389 - RNA, 19 nt, Homo sapiens
gaaagagaccuguuaaacc

SEQ ID NO: 6390 - RNA, 19 nt, Homo sapiens
gccgagagaucgagaacau

SEQ ID NO: 6391 - RNA, 19 nt, Homo sapiens
gaguuuaugucugcuguau

SEQ ID NO: 6392 - RNA, 19 nt, Homo sapiens
caauuaacacugaaagaga

SEQ ID NO: 6393 - RNA, 19 nt, Homo sapiens
gcuauagagcaaaugauaa

SEQ ID NO: 6394 - RNA, 19 nt, Homo sapiens
gaauguguaugaaaacuug

SEQ ID NO: 6395 - RNA, 19 nt, Homo sapiens
caaccaugguggauaucaa

SEQ ID NO: 6396 - RNA, 19 nt, Homo sapiens
ccagcaguauaaacucuuu

SEQ ID NO: 6397 - RNA, 19 nt, Homo sapiens
ggaguucauucucaacagu

SEQ ID NO: 6398 - RNA, 19 nt, Homo sapiens
gcaauuaacacugaaagag

SEQ ID NO: 6399 - RNA, 19 nt, Homo sapiens
cauaagccuuugccaggaa

SEQ ID NO: 6400 - RNA, 19 nt, Homo sapiens
acugugaccuccauuaaau

SEQ ID NO: 6401 - RNA, 19 nt, Homo sapiens
ggaaaccacagccacguau

SEQ ID NO: 6402 - RNA, 19 nt, Homo sapiens
cugaugaaauuaugugguu

SEQ ID NO: 6403 - RNA, 19 nt, Homo sapiens
gagcaagugaggcacauug

SEQ ID NO: 6404 - RNA, 19 nt, Homo sapiens
aaaacaugcugaugaagua

SEQ ID NO: 6405 - RNA, 19 nt, Homo sapiens
accauugucucguguaauu

SEQ ID NO: 6406 - RNA, 19 nt, Homo sapiens
cccaguagacuaugacuuu

SEQ ID NO: 6407 - RNA, 19 nt, Homo sapiens
caaagcagagguccacgaa

SEQ ID NO: 6408 - RNA, 19 nt, Homo sapiens
uaaaccagcguguaaagga

SEQ ID NO: 6409 - RNA, 19 nt, Homo sapiens
uugcccagcucaucacuaa

SEQ ID NO: 6410 - RNA, 19 nt, Homo sapiens
gcacuguuguagcuuugga

SEQ ID NO: 6411 - RNA, 19 nt, Homo sapiens
agaaagcgccugugugcaa

SEQ ID NO: 6412 - RNA, 19 nt, Homo sapiens
gcuaugaugggaaugugua

SEQ ID NO: 6413 - RNA, 19 nt, Homo sapiens
caagauaaagccauucaag

SEQ ID NO: 6414 - RNA, 19 nt, Homo sapiens
ugcaaacacuggcauugaa

SEQ ID NO: 6415 - RNA, 19 nt, Homo sapiens
ucuaaggcgugcaccauug

SEQ ID NO: 6416 - RNA, 19 nt, Homo sapiens
ggaauuaccguuggugaca

SEQ ID NO: 6417 - RNA, 19 nt, Homo sapiens
gauuucacauauucuguca

SEQ ID NO: 6418 - RNA, 19 nt, Homo sapiens
uugcuaaauugucacagua

SEQ ID NO: 6419 - RNA, 19 nt, Homo sapiens
uugaaggauugcuaaauug

SEQ ID NO: 6420 - RNA, 19 nt, Homo sapiens
cagagguccacgaaucuua

SEQ ID NO: 6421 - RNA, 19 nt, Homo sapiens
cauucaagcugucuuaagg

SEQ ID NO: 6422 - RNA, 19 nt, Homo sapiens
gccuaugccuuccaguuug

SEQ ID NO: 6423 - RNA, 19 nt, Homo sapiens
ggggaaaugcuauggauua

SEQ ID NO: 6424 - RNA, 19 nt, Homo sapiens
uggaaagacuucaaaucau

SEQ ID NO: 6425 - RNA, 19 nt, Homo sapiens
ucacauauucugucaucuu

SEQ ID NO: 6426 - RNA, 19 nt, Homo sapiens
ggauugcauuuaucaaacu

SEQ ID NO: 6427 - RNA, 19 nt, Homo sapiens
gaugggaauguguaugaaa

SEQ ID NO: 6428 - RNA, 19 nt, Homo sapiens
guggcaugguguccuauuu

SEQ ID NO: 6429 - RNA, 19 nt, Homo sapiens
cgugaaaucgggacccaua

SEQ ID NO: 6430 - RNA, 19 nt, Homo sapiens
aaggauugcuaaauuguca

SEQ ID NO: 6431 - RNA, 19 nt, Homo sapiens
gcugaucccaguagacuau

SEQ ID NO: 6432 - RNA, 19 nt, Homo sapiens
agagaccuguuaaaccauu

SEQ ID NO: 6433 - RNA, 19 nt, Homo sapiens
uccaagcucugaaguguca

SEQ ID NO: 6434 - RNA, 19 nt, Homo sapiens
gaacagauuucagagauua

SEQ ID NO: 6435 - RNA, 19 nt, Homo sapiens
gaaggaaacuuauuggaaa

SEQ ID NO: 6436 - RNA, 19 nt, Homo sapiens
gcuaaucacuggcuauaua

SEQ ID NO: 6437 - RNA, 19 nt, Homo sapiens
gcaguggucuuccaaauau

SEQ ID NO: 6438 - RNA, 19 nt, Homo sapiens
ggaaagacuucaaaucaug

SEQ ID NO: 6439 - RNA, 19 nt, Homo sapiens
ucaaauagcuauagagcaa

SEQ ID NO: 6440 - RNA, 19 nt, Homo sapiens
gggcauggcuauucucauu

SEQ ID NO: 6441 - RNA, 19 nt, Homo sapiens
gaaaugcuauggauuacau

SEQ ID NO: 6442 - RNA, 19 nt, Homo sapiens
ccaaaggacuccagauaau

SEQ ID NO: 6443 - RNA, 19 nt, Homo sapiens
gcugauggauugcauuuau

SEQ ID NO: 6444 - RNA, 19 nt, Homo sapiens
ggaaggaaacuuauuggaa

SEQ ID NO: 6445 - RNA, 19 nt, Homo sapiens
gaaccuaacuucuguugac

SEQ ID NO: 6446 - RNA, 19 nt, Homo sapiens
caaaccauguguucugauu

SEQ ID NO: 6447 - RNA, 19 nt, Homo sapiens
gaaccagaaccacagauuu

SEQ ID NO: 6448 - RNA, 19 nt, Homo sapiens
caaguaaaccagcguguaa

SEQ ID NO: 6449 - RNA, 19 nt, Homo sapiens
guagaacccuuccaagcuu

SEQ ID NO: 6450 - RNA, 19 nt, Homo sapiens
ggaccauugucucguguaa

SEQ ID NO: 6451 - RNA, 19 nt, Homo sapiens
aaagagaccuguuaaacca

SEQ ID NO: 6452 - RNA, 19 nt, Homo sapiens
gggcaccacugcucagaaa

SEQ ID NO: 6453 - RNA, 19 nt, Homo sapiens
gcaccagucugaaaucaag

SEQ ID NO: 6454 - RNA, 19 nt, Homo sapiens
caagcugucuuaaggaguu

SEQ ID NO: 6455 - RNA, 19 nt, Homo sapiens
gcuuggagauuacuguauu

SEQ ID NO: 6456 - RNA, 19 nt, Homo sapiens
ggacaaguuuaaucugcuu

SEQ ID NO: 6457 - RNA, 19 nt, Homo sapiens
gcucagaugcuguugcuuu

SEQ ID NO: 6458 - RNA, 19 nt, Homo sapiens
gacuucaaaucaugcaaua

SEQ ID NO: 6459 - RNA, 19 nt, Homo sapiens
ugagguggcugucaggaaa

SEQ ID NO: 6460 - RNA, 19 nt, Homo sapiens
ucuaggagcuuucucugaa

SEQ ID NO: 6461 - RNA, 19 nt, Homo sapiens
gcagccagauuaguagaaa

SEQ ID NO: 6462 - RNA, 19 nt, Homo sapiens
ggagaccuaucaccggauu

SEQ ID NO: 6463 - RNA, 19 nt, Homo sapiens
ccacggaacucaccuucga

SEQ ID NO: 6464 - RNA, 19 nt, Homo sapiens
gcuaagaacuccccacuga

SEQ ID NO: 6465 - RNA, 19 nt, Homo sapiens
ugacagagccucagauuac

SEQ ID NO: 6466 - RNA, 19 nt, Homo sapiens
ugaagaagaugagggaguu

SEQ ID NO: 6467 - RNA, 19 nt, Homo sapiens
ugaaaccgcugaguaacaa

SEQ ID NO: 6468 - RNA, 19 nt, Homo sapiens
guuuaugucugcuguauuc

SEQ ID NO: 6469 - RNA, 19 nt, Homo sapiens
gagaaaacaugcugaugaa

SEQ ID NO: 6470 - RNA, 19 nt, Homo sapiens
cuuaagaaaugcgauauga

SEQ ID NO: 6471 - RNA, 19 nt, Homo sapiens
ugaagucacugcaguccaa

SEQ ID NO: 6472 - RNA, 19 nt, Homo sapiens
uaacuucuguugaccuugu

SEQ ID NO: 6473 - RNA, 19 nt, Homo sapiens
ugaacgaccugcccaguca

SEQ ID NO: 6474 - RNA, 19 nt, Homo sapiens
caagccaggugaaccagaa

SEQ ID NO: 6475 - RNA, 19 nt, Homo sapiens
ugaguaacaagcugacuua

SEQ ID NO: 6476 - RNA, 19 nt, Homo sapiens
caaauuugguuaugaugag

SEQ ID NO: 6477 - RNA, 19 nt, Homo sapiens
gauaugacuuccuuuugua

SEQ ID NO: 6478 - RNA, 19 nt, Homo sapiens
ggccaaccaugguggauau

SEQ ID NO: 6479 - RNA, 19 nt, Homo sapiens
cuaauuguccuuucaguug

SEQ ID NO: 6480 - RNA, 19 nt, Homo sapiens
uagcagaauuuaacuacug

SEQ ID NO: 6481 - RNA, 19 nt, Homo sapiens
aagcagagguccacgaauc

SEQ ID NO: 6482 - RNA, 19 nt, Homo sapiens
ggcaugguguccuauuuga

SEQ ID NO: 6483 - RNA, 19 nt, Homo sapiens
ccgcuggacugaaggcuuu

SEQ ID NO: 6484 - RNA, 19 nt, Homo sapiens
uaucguaccuauucgugaa

SEQ ID NO: 6485 - RNA, 19 nt, Homo sapiens
caaaggacuccagauaauu

SEQ ID NO: 6486 - RNA, 19 nt, Homo sapiens
cucaauuacuccauguuua

SEQ ID NO: 6487 - RNA, 19 nt, Homo sapiens
gacaauggcuaccucaaaa

SEQ ID NO: 6488 - RNA, 19 nt, Homo sapiens
uaauuguccuuucaguuga

SEQ ID NO: 6489 - RNA, 19 nt, Homo sapiens
cacauauucugucaucuug

SEQ ID NO: 6490 - RNA, 19 nt, Homo sapiens
gaaagagaccuguuaaacc

SEQ ID NO: 6491 - RNA, 19 nt, Homo sapiens
gccgagagaucgagaacau

SEQ ID NO: 6492 - RNA, 19 nt, Homo sapiens
gaguuuaugucugcuguau

SEQ ID NO: 6493 - RNA, 19 nt, Homo sapiens
cgagagaucgagaacauga

SEQ ID NO: 6494 - RNA, 19 nt, Homo sapiens
caauuaacacugaaagaga

SEQ ID NO: 6495 - RNA, 19 nt, Homo sapiens
gcuauagagcaaaugauaa

SEQ ID NO: 6496 - RNA, 19 nt, Homo sapiens
gaauguguaugaaaacuug

SEQ ID NO: 6497 - RNA, 19 nt, Homo sapiens
caaccaugguggauaucaa

SEQ ID NO: 6498 - RNA, 19 nt, Homo sapiens
ccagcaguauaaacucuuu

SEQ ID NO: 6499 - RNA, 19 nt, Homo sapiens
ggaguucauucucaacagu

SEQ ID NO: 6500 - RNA, 19 nt, Homo sapiens
gcaauuaacacugaaagag

SEQ ID NO: 6501 - RNA, 19 nt, Homo sapiens
cauaagccuuugccaggaa

SEQ ID NO: 6502 - RNA, 19 nt, Homo sapiens
acugugaccuccauuaaau

SEQ ID NO: 6503 - RNA, 19 nt, Homo sapiens
ggaaaccacagccacguau

SEQ ID NO: 6504 - RNA, 19 nt, Homo sapiens
gcaccacugcucagaaaga

SEQ ID NO: 6505 - RNA, 19 nt, Homo sapiens
cugaugaaauuaugugguu

SEQ ID NO: 6506 - RNA, 19 nt, Homo sapiens
gagcaagugaggcacauug

SEQ ID NO: 6507 - RNA, 19 nt, Homo sapiens
aaaacaugcugaugaagua

SEQ ID NO: 6508 - RNA, 19 nt, Homo sapiens
gaaccugugggccucaauu

SEQ ID NO: 6509 - RNA, 19 nt, Homo sapiens
accauugucucguguaauu

SEQ ID NO: 6510 - RNA, 19 nt, Homo sapiens
cccaguagacuaugacuuu

SEQ ID NO: 6511 - RNA, 19 nt, Homo sapiens
caaagcagagguccacgaa

SEQ ID NO: 6512 - RNA, 19 nt, Homo sapiens
uaaaccagcguguaaagga

SEQ ID NO: 6513 - RNA, 19 nt, Homo sapiens
uugcccagcucaucacuaa

SEQ ID NO: 6514 - RNA, 19 nt, Homo sapiens
ggaaaugggccacggaacu

SEQ ID NO: 6515 - RNA, 19 nt, Homo sapiens
aaaggacuccagauaauug

SEQ ID NO: 6516 - RNA, 19 nt, Homo sapiens
gcacuguuguagcuuugga

SEQ ID NO: 6517 - RNA, 19 nt, Homo sapiens
agaaagcgccugugugcaa

SEQ ID NO: 6518 - RNA, 19 nt, Homo sapiens
gcuaugaugggaaugugua

SEQ ID NO: 6519 - RNA, 19 nt, Homo sapiens
caagauaaagccauucaag

SEQ ID NO: 6520 - RNA, 19 nt, Homo sapiens
ugcaaacacuggcauugaa

SEQ ID NO: 6521 - RNA, 19 nt, Homo sapiens
ucuaaggcgugcaccauug

SEQ ID NO: 6522 - RNA, 19 nt, Homo sapiens
ggaauuaccguuggugaca

SEQ ID NO: 6523 - RNA, 19 nt, Homo sapiens
gauuucacauauucuguca

SEQ ID NO: 6524 - RNA, 19 nt, Homo sapiens
uugcuaaauugucacagua

SEQ ID NO: 6525 - RNA, 19 nt, Homo sapiens
uugaaggauugcuaaauug

SEQ ID NO: 6526 - RNA, 19 nt, Homo sapiens
cagagguccacgaaucuua

SEQ ID NO: 6527 - RNA, 19 nt, Homo sapiens
cauucaagcugucuuaagg

SEQ ID NO: 6528 - RNA, 19 nt, Homo sapiens
gccuaugccuuccaguuug

SEQ ID NO: 6529 - RNA, 19 nt, Homo sapiens
ggggaaaugcuauggauua

SEQ ID NO: 6530 - RNA, 19 nt, Homo sapiens
uggaaagacuucaaaucau

SEQ ID NO: 6531 - RNA, 19 nt, Homo sapiens
ucacauauucugucaucuu

SEQ ID NO: 6532 - RNA, 19 nt, Homo sapiens
ggauugcauuuaucaaacu

SEQ ID NO: 6533 - RNA, 19 nt, Homo sapiens
gaugggaauguguaugaaa

SEQ ID NO: 6534 - RNA, 19 nt, Homo sapiens
gaaggacacuuguaugcua

SEQ ID NO: 6535 - RNA, 19 nt, Homo sapiens
gaaagaaggacacuuguau

SEQ ID NO: 6536 - RNA, 19 nt, Homo sapiens
gggaagagagaaacauuua

SEQ ID NO: 6537 - RNA, 19 nt, Homo sapiens
ggaaaucaguuguguuugg

SEQ ID NO: 6538 - RNA, 19 nt, Homo sapiens
gauguaagguaauuucugu

SEQ ID NO: 6539 - RNA, 19 nt, Homo sapiens
gaagagagaaacauuuaug

SEQ ID NO: 6540 - RNA, 19 nt, Homo sapiens
uaacccaaauguccaauau

SEQ ID NO: 6541 - RNA, 19 nt, Homo sapiens
gagagaaacauuuauggaa

SEQ ID NO: 6542 - RNA, 19 nt, Homo sapiens
gcacacuuguauauugaaa

SEQ ID NO: 6543 - RNA, 19 nt, Homo sapiens
ggaaugacucugacuuuga

SEQ ID NO: 6544 - RNA, 19 nt, Homo sapiens
acccaaauguccaauauaa

SEQ ID NO: 6545 - RNA, 19 nt, Homo sapiens
gagaaacauuuauggaauc

SEQ ID NO: 6546 - RNA, 19 nt, Homo sapiens
cguaggagcucacagucua

SEQ ID NO: 6547 - RNA, 19 nt, Homo sapiens
guaagguaauuucugugua

SEQ ID NO: 6548 - RNA, 19 nt, Homo sapiens
gagcucacagucuagauua

SEQ ID NO: 6549 - RNA, 19 nt, Homo sapiens
gcuagucuauggucaguug

SEQ ID NO: 6550 - RNA, 19 nt, Homo sapiens
gaaugacucugacuuugag

SEQ ID NO: 6551 - RNA, 19 nt, Homo sapiens
gggaaugacucugacuuug

SEQ ID NO: 6552 - RNA, 19 nt, Homo sapiens
uauggucaguugaggaaua

SEQ ID NO: 6553 - RNA, 19 nt, Homo sapiens
ccagaaagaaggacacuug

SEQ ID NO: 6554 - RNA, 19 nt, Homo sapiens
gaaccacuuugccucugaa

SEQ ID NO: 6555 - RNA, 19 nt, Homo sapiens
gugcacacuuguauauuga

SEQ ID NO: 6556 - RNA, 19 nt, Homo sapiens
guuaaaaccugcaaagcua

SEQ ID NO: 6557 - RNA, 19 nt, Homo sapiens
cccauuggcucccaucuga

SEQ ID NO: 6558 - RNA, 19 nt, Homo sapiens
ccaaguccgugcuguuugu

SEQ ID NO: 6559 - RNA, 19 nt, Homo sapiens
ggaaacuuguaaccgauca

SEQ ID NO: 6560 - RNA, 19 nt, Homo sapiens
gcagauguaagguaauuuc

SEQ ID NO: 6561 - RNA, 19 nt, Homo sapiens
guagaacaagcaacauaaa

SEQ ID NO: 6562 - RNA, 19 nt, Homo sapiens
auaggcagauguaagguaa

SEQ ID NO: 6563 - RNA, 19 nt, Homo sapiens
gcgggaagauggcggaaca

SEQ ID NO: 6564 - RNA, 19 nt, Homo sapiens
guuggcaccuucaauacuu

SEQ ID NO: 6565 - RNA, 19 nt, Homo sapiens
acacuuguaugcuagucua

SEQ ID NO: 6566 - RNA, 19 nt, Homo sapiens
guuauuauuuggcaugcuu

SEQ ID NO: 6567 - RNA, 19 nt, Homo sapiens
ucugagagauuugaauaga

SEQ ID NO: 6568 - RNA, 19 nt, Homo sapiens
gcucccaucugaaccacuu

SEQ ID NO: 6569 - RNA, 19 nt, Homo sapiens
ggaagagagaaacauuuau

SEQ ID NO: 6570 - RNA, 19 nt, Homo sapiens
acccugagguccugcauuu

SEQ ID NO: 6571 - RNA, 19 nt, Homo sapiens
gcagauuaccaaagaagau

SEQ ID NO: 6572 - RNA, 19 nt, Homo sapiens
ggagcucacagucuagauu

SEQ ID NO: 6573 - RNA, 19 nt, Homo sapiens
agaaagaaggacacuugua

SEQ ID NO: 6574 - RNA, 19 nt, Homo sapiens
caccuucaauacuucauga

SEQ ID NO: 6575 - RNA, 19 nt, Homo sapiens
ggucaguugaggaauauga

SEQ ID NO: 6576 - RNA, 19 nt, Homo sapiens
ugaaccacuuugccucuga

SEQ ID NO: 6577 - RNA, 19 nt, Homo sapiens
uaguagaacaagcaacaua

SEQ ID NO: 6578 - RNA, 19 nt, Homo sapiens
ggaugaaagcaaucugaga

SEQ ID NO: 6579 - RNA, 19 nt, Homo sapiens
aggcagauguaagguaauu

SEQ ID NO: 6580 - RNA, 19 nt, Homo sapiens
uggcaugcuuaaauauuga

SEQ ID NO: 6581 - RNA, 19 nt, Homo sapiens
ugaggaauaugacuguuuu

SEQ ID NO: 6582 - RNA, 19 nt, Homo sapiens
gaaggaaaaccucacuuga

SEQ ID NO: 6583 - RNA, 19 nt, Homo sapiens
gaacaagcaacauaaaaca

SEQ ID NO: 6584 - RNA, 19 nt, Homo sapiens
uaguugaacaucucacuuu

SEQ ID NO: 6585 - RNA, 19 nt, Homo sapiens
ccagcucuuuguucaguug

SEQ ID NO: 6586 - RNA, 19 nt, Homo sapiens
ggguaacauuugucgauca

SEQ ID NO: 6587 - RNA, 19 nt, Homo sapiens
gaacuacuugggagcuaug

SEQ ID NO: 6588 - RNA, 19 nt, Homo sapiens
aaauguauaggcagaugua

SEQ ID NO: 6589 - RNA, 19 nt, Homo sapiens
guaacccaaauguccaaua

SEQ ID NO: 6590 - RNA, 19 nt, Homo sapiens
cuuacuguuucuuaccuua

SEQ ID NO: 6591 - RNA, 19 nt, Homo sapiens
gcccagcucuuuguucagu

SEQ ID NO: 6592 - RNA, 19 nt, Homo sapiens
aagcccagcucuuuguuca

SEQ ID NO: 6593 - RNA, 19 nt, Homo sapiens
ucaguagguuuguguggau

SEQ ID NO: 6594 - RNA, 19 nt, Homo sapiens
guugacuuacuguuucuua

SEQ ID NO: 6595 - RNA, 19 nt, Homo sapiens
cugcaaagcuaaaauugaa

SEQ ID NO: 6596 - RNA, 19 nt, Homo sapiens
cugagagauuugaauagaa

SEQ ID NO: 6597 - RNA, 19 nt, Homo sapiens
gucguuggcaccuucaaua

SEQ ID NO: 6598 - RNA, 19 nt, Homo sapiens
uugaagaucccuauuaugg

SEQ ID NO: 6599 - RNA, 19 nt, Homo sapiens
cccggcagauuaccaaaga

SEQ ID NO: 6600 - RNA, 19 nt, Homo sapiens
uuggcaugcuuaaauauug

SEQ ID NO: 6601 - RNA, 19 nt, Homo sapiens
ccacuuugccucugaaacu

SEQ ID NO: 6602 - RNA, 19 nt, Homo sapiens
gcaacuuccggguaugaga

SEQ ID NO: 6603 - RNA, 19 nt, Homo sapiens
aaagaaggacacuuguaug

SEQ ID NO: 6604 - RNA, 19 nt, Homo sapiens
uaauuucuacacacccaua

SEQ ID NO: 6605 - RNA, 19 nt, Homo sapiens
aguagaacaagcaacauaa

SEQ ID NO: 6606 - RNA, 19 nt, Homo sapiens
cagauuaccaaagaagauu

SEQ ID NO: 6607 - RNA, 19 nt, Homo sapiens
ccucugaaacuuaauuaca

SEQ ID NO: 6608 - RNA, 19 nt, Homo sapiens
cgagucuaccucuucagua

SEQ ID NO: 6609 - RNA, 19 nt, Homo sapiens
aaucgagucuaccucuuca

SEQ ID NO: 6610 - RNA, 19 nt, Homo sapiens
auggaaaucaguuguguuu

SEQ ID NO: 6611 - RNA, 19 nt, Homo sapiens
uauaggcagauguaaggua

SEQ ID NO: 6612 - RNA, 19 nt, Homo sapiens
cagaagcaguuuucaggaa

SEQ ID NO: 6613 - RNA, 19 nt, Homo sapiens
uaccaaguccgugcuguuu

SEQ ID NO: 6614 - RNA, 19 nt, Homo sapiens
cagcuuaugggguauuuua

SEQ ID NO: 6615 - RNA, 19 nt, Homo sapiens
aagaagauuuugccacauu

SEQ ID NO: 6616 - RNA, 19 nt, Homo sapiens
agagagaaacauuuaugga

SEQ ID NO: 6617 - RNA, 19 nt, Homo sapiens
guugagacuuagauaaucg

SEQ ID NO: 6618 - RNA, 19 nt, Homo sapiens
guagauggaaaucaguugu

SEQ ID NO: 6619 - RNA, 19 nt, Homo sapiens
caacuuccggguaugagau

SEQ ID NO: 6620 - RNA, 19 nt, Homo sapiens
ggacacuuguaugcuaguc

SEQ ID NO: 6621 - RNA, 19 nt, Homo sapiens
ugucgaguuuacuucauga

SEQ ID NO: 6622 - RNA, 19 nt, Homo sapiens
aaagauagggaagagagaa

SEQ ID NO: 6623 - RNA, 19 nt, Homo sapiens
ugaacuacuugggagcuau

SEQ ID NO: 6624 - RNA, 19 nt, Homo sapiens
auaaauguauaggcagaug

SEQ ID NO: 6625 - RNA, 19 nt, Homo sapiens
guauucuucaucagcauuu

SEQ ID NO: 6626 - RNA, 19 nt, Homo sapiens
aaacuuguaaccgaucaaa

SEQ ID NO: 6627 - RNA, 19 nt, Homo sapiens
gaggaggucagcccauugg

SEQ ID NO: 6628 - RNA, 19 nt, Homo sapiens
uagggaagagagaaacauu

SEQ ID NO: 6629 - RNA, 19 nt, Homo sapiens
gauagggaagagagaaaca

SEQ ID NO: 6630 - RNA, 19 nt, Homo sapiens
caagcaacauaaaacaaug

SEQ ID NO: 6631 - RNA, 19 nt, Homo sapiens
aauaguagaacaagcaaca

SEQ ID NO: 6632 - RNA, 19 nt, Homo sapiens
aagcauucuuagacuaguu

SEQ ID NO: 6633 - RNA, 19 nt, Homo sapiens
ugggaaugacucugacuuu

SEQ ID NO: 6634 - RNA, 19 nt, Homo sapiens
gaaggacacuuguaugcua

SEQ ID NO: 6635 - RNA, 19 nt, Homo sapiens
caagacagauuaccaaaga

SEQ ID NO: 6636 - RNA, 19 nt, Homo sapiens
gaaagaaggacacuuguau

SEQ ID NO: 6637 - RNA, 19 nt, Homo sapiens
gcugugagcugccuaagaa

SEQ ID NO: 6638 - RNA, 19 nt, Homo sapiens
gggaagagagaaacauuua

SEQ ID NO: 6639 - RNA, 19 nt, Homo sapiens
ggaaaucaguuguguuugg

SEQ ID NO: 6640 - RNA, 19 nt, Homo sapiens
gauguaagguaauuucugu

SEQ ID NO: 6641 - RNA, 19 nt, Homo sapiens
gaagagagaaacauuuaug

SEQ ID NO: 6642 - RNA, 19 nt, Homo sapiens
uaacccaaauguccaauau

SEQ ID NO: 6643 - RNA, 19 nt, Homo sapiens
gagagaaacauuuauggaa

SEQ ID NO: 6644 - RNA, 19 nt, Homo sapiens
gcacacuuguauauugaaa

SEQ ID NO: 6645 - RNA, 19 nt, Homo sapiens
ggaaugacucugacuuuga

SEQ ID NO: 6646 - RNA, 19 nt, Homo sapiens
acccaaauguccaauauaa

SEQ ID NO: 6647 - RNA, 19 nt, Homo sapiens
gagaaacauuuauggaauc

SEQ ID NO: 6648 - RNA, 19 nt, Homo sapiens
cguaggagcucacagucua

SEQ ID NO: 6649 - RNA, 19 nt, Homo sapiens
ccuaagaaaucauggcauu

SEQ ID NO: 6650 - RNA, 19 nt, Homo sapiens
guaagguaauuucugugua

SEQ ID NO: 6651 - RNA, 19 nt, Homo sapiens
gagcucacagucuagauua

SEQ ID NO: 6652 - RNA, 19 nt, Homo sapiens
gcuagucuauggucaguug

SEQ ID NO: 6653 - RNA, 19 nt, Homo sapiens
cauaaagcaagacagauua

SEQ ID NO: 6654 - RNA, 19 nt, Homo sapiens
gaaugacucugacuuugag

SEQ ID NO: 6655 - RNA, 19 nt, Homo sapiens
gggaaugacucugacuuug

SEQ ID NO: 6656 - RNA, 19 nt, Homo sapiens
uauggucaguugaggaaua

SEQ ID NO: 6657 - RNA, 19 nt, Homo sapiens
ccagaaagaaggacacuug

SEQ ID NO: 6658 - RNA, 19 nt, Homo sapiens
gaaccacuuugccucugaa

SEQ ID NO: 6659 - RNA, 19 nt, Homo sapiens
gugcacacuuguauauuga

SEQ ID NO: 6660 - RNA, 19 nt, Homo sapiens
guuaaaaccugcaaagcua

SEQ ID NO: 6661 - RNA, 19 nt, Homo sapiens
cccauuggcucccaucuga

SEQ ID NO: 6662 - RNA, 19 nt, Homo sapiens
ccauaaagcaagacagauu

SEQ ID NO: 6663 - RNA, 19 nt, Homo sapiens
ucacacagcccauaaagca

SEQ ID NO: 6664 - RNA, 19 nt, Homo sapiens
ccaaguccgugcuguuugu

SEQ ID NO: 6665 - RNA, 19 nt, Homo sapiens
ggaaacuuguaaccgauca

SEQ ID NO: 6666 - RNA, 19 nt, Homo sapiens
gcagauguaagguaauuuc

SEQ ID NO: 6667 - RNA, 19 nt, Homo sapiens
guagaacaagcaacauaaa

SEQ ID NO: 6668 - RNA, 19 nt, Homo sapiens
auaggcagauguaagguaa

SEQ ID NO: 6669 - RNA, 19 nt, Homo sapiens
gcgggaagauggcggaaca

SEQ ID NO: 6670 - RNA, 19 nt, Homo sapiens
guuggcaccuucaauacuu

SEQ ID NO: 6671 - RNA, 19 nt, Homo sapiens
acacuuguaugcuagucua

SEQ ID NO: 6672 - RNA, 19 nt, Homo sapiens
ucagagaauugggucauug

SEQ ID NO: 6673 - RNA, 19 nt, Homo sapiens
guuauuauuuggcaugcuu

SEQ ID NO: 6674 - RNA, 19 nt, Homo sapiens
ucugagagauuugaauaga

SEQ ID NO: 6675 - RNA, 19 nt, Homo sapiens
gcucccaucugaaccacuu

SEQ ID NO: 6676 - RNA, 19 nt, Homo sapiens
ggaagagagaaacauuuau

SEQ ID NO: 6677 - RNA, 19 nt, Homo sapiens
acccugagguccugcauuu

SEQ ID NO: 6678 - RNA, 19 nt, Homo sapiens
uaagaaaucauggcauuca

SEQ ID NO: 6679 - RNA, 19 nt, Homo sapiens
ggagcucacagucuagauu

SEQ ID NO: 6680 - RNA, 19 nt, Homo sapiens
agaaagaaggacacuugua

SEQ ID NO: 6681 - RNA, 19 nt, Homo sapiens
caccuucaauacuucauga

SEQ ID NO: 6682 - RNA, 19 nt, Homo sapiens
ggucaguugaggaauauga

SEQ ID NO: 6683 - RNA, 19 nt, Homo sapiens
ugaaccacuuugccucuga

SEQ ID NO: 6684 - RNA, 19 nt, Homo sapiens
uaguagaacaagcaacaua

SEQ ID NO: 6685 - RNA, 19 nt, Homo sapiens
ggaugaaagcaaucugaga

SEQ ID NO: 6686 - RNA, 19 nt, Homo sapiens
gcauucacacagcccauaa

SEQ ID NO: 6687 - RNA, 19 nt, Homo sapiens
aggcagauguaagguaauu

SEQ ID NO: 6688 - RNA, 19 nt, Homo sapiens
uggcaugcuuaaauauuga

SEQ ID NO: 6689 - RNA, 19 nt, Homo sapiens
ugaggaauaugacuguuuu

SEQ ID NO: 6690 - RNA, 19 nt, Homo sapiens
ggguaacauuugucgauca

SEQ ID NO: 6691 - RNA, 19 nt, Homo sapiens
gaaggaaaaccucacuuga

SEQ ID NO: 6692 - RNA, 19 nt, Homo sapiens
gaacaagcaacauaaaaca

SEQ ID NO: 6693 - RNA, 19 nt, Homo sapiens
uaguugaacaucucacuuu

SEQ ID NO: 6694 - RNA, 19 nt, Homo sapiens
ccagcucuuuguucaguug

SEQ ID NO: 6695 - RNA, 19 nt, Homo sapiens
gaacuacuugggagcuaug

SEQ ID NO: 6696 - RNA, 19 nt, Homo sapiens
gcaagacagauuaccaaag

SEQ ID NO: 6697 - RNA, 19 nt, Homo sapiens
aaauguauaggcagaugua

SEQ ID NO: 6698 - RNA, 19 nt, Homo sapiens
guaacccaaauguccaaua

SEQ ID NO: 6699 - RNA, 19 nt, Homo sapiens
cuuacuguuucuuaccuua

SEQ ID NO: 6700 - RNA, 19 nt, Homo sapiens
gcccagcucuuuguucagu

SEQ ID NO: 6701 - RNA, 19 nt, Homo sapiens
aagcccagcucuuuguuca

SEQ ID NO: 6702 - RNA, 19 nt, Homo sapiens
gcccauaaagcaagacaga

SEQ ID NO: 6703 - RNA, 19 nt, Homo sapiens
ucaguagguuuguguggau

SEQ ID NO: 6704 - RNA, 19 nt, Homo sapiens
guugacuuacuguuucuua

SEQ ID NO: 6705 - RNA, 19 nt, Homo sapiens
cugcaaagcuaaaauugaa

SEQ ID NO: 6706 - RNA, 19 nt, Homo sapiens
cugagagauuugaauagaa

SEQ ID NO: 6707 - RNA, 19 nt, Homo sapiens
gucguuggcaccuucaaua

SEQ ID NO: 6708 - RNA, 19 nt, Homo sapiens
uugaagaucccuauuaugg

SEQ ID NO: 6709 - RNA, 19 nt, Homo sapiens
uuggcaugcuuaaauauug

SEQ ID NO: 6710 - RNA, 19 nt, Homo sapiens
ccacuuugccucugaaacu

SEQ ID NO: 6711 - RNA, 19 nt, Homo sapiens
cagagaauugggucauuga

SEQ ID NO: 6712 - RNA, 19 nt, Homo sapiens
aaagaaggacacuuguaug

SEQ ID NO: 6713 - RNA, 19 nt, Homo sapiens
uaauuucuacacacccaua

SEQ ID NO: 6714 - RNA, 19 nt, Homo sapiens
aguagaacaagcaacauaa

SEQ ID NO: 6715 - RNA, 19 nt, Homo sapiens
cagauuaccaaagaagauu

SEQ ID NO: 6716 - RNA, 19 nt, Homo sapiens
ccucugaaacuuaauuaca

SEQ ID NO: 6717 - RNA, 19 nt, Homo sapiens
cgagucuaccucuucagua

SEQ ID NO: 6718 - RNA, 19 nt, Homo sapiens
aaucgagucuaccucuuca

SEQ ID NO: 6719 - RNA, 19 nt, Homo sapiens
auggaaaucaguuguguuu

SEQ ID NO: 6720 - RNA, 19 nt, Homo sapiens
uauaggcagauguaaggua

SEQ ID NO: 6721 - RNA, 19 nt, Homo sapiens
cagaagcaguuuucaggaa

SEQ ID NO: 6722 - RNA, 19 nt, Homo sapiens
uaccaaguccgugcuguuu

SEQ ID NO: 6723 - RNA, 19 nt, Homo sapiens
cagcuuaugggguauuuua

SEQ ID NO: 6724 - RNA, 19 nt, Homo sapiens
agagagaaacauuuaugga

SEQ ID NO: 6725 - RNA, 19 nt, Homo sapiens
guugagacuuagauaaucg

SEQ ID NO: 6726 - RNA, 19 nt, Homo sapiens
guagauggaaaucaguugu

SEQ ID NO: 6727 - RNA, 19 nt, Homo sapiens
aagaagauuuugccacauu

SEQ ID NO: 6728 - RNA, 19 nt, Homo sapiens
gacagauuaccaaagaaga

SEQ ID NO: 6729 - RNA, 19 nt, Homo sapiens
ugagcugccuaagaaauca

SEQ ID NO: 6730 - RNA, 19 nt, Homo sapiens
ggacacuuguaugcuaguc

SEQ ID NO: 6731 - RNA, 19 nt, Homo sapiens
ugucgaguuuacuucauga

SEQ ID NO: 6732 - RNA, 19 nt, Homo sapiens
aaagauagggaagagagaa

SEQ ID NO: 6733 - RNA, 19 nt, Homo sapiens
ugaacuacuugggagcuau

SEQ ID NO: 6734 - RNA, 19 nt, Homo sapiens
ggaagaaccugacccuaau

SEQ ID NO: 6735 - RNA, 19 nt, Homo sapiens
caaccuggcuggacucuuc

SEQ ID NO: 6736 - RNA, 19 nt, Homo sapiens
ggaagggaguugcuuguca

SEQ ID NO: 6737 - RNA, 19 nt, Homo sapiens
gcacgacacuacccugguu

SEQ ID NO: 6738 - RNA, 19 nt, Homo sapiens
gacacuggcuuucuccaaa

SEQ ID NO: 6739 - RNA, 19 nt, Homo sapiens
ccacauauuugaacuguac

SEQ ID NO: 6740 - RNA, 19 nt, Homo sapiens
ggaacuggaucacccaaca

SEQ ID NO: 6741 - RNA, 19 nt, Homo sapiens
gagaaugaauagugcuguu

SEQ ID NO: 6742 - RNA, 19 nt, Homo sapiens
uaucacggcuuccuaaaca

SEQ ID NO: 6743 - RNA, 19 nt, Homo sapiens
ggaagguugucuguacuug

SEQ ID NO: 6744 - RNA, 19 nt, Homo sapiens
gacggaagguugucuguac

SEQ ID NO: 6745 - RNA, 19 nt, Homo sapiens
ggacuuccuucgccucaca

SEQ ID NO: 6746 - RNA, 19 nt, Homo sapiens
acagaaugcuucaggaauc

SEQ ID NO: 6747 - RNA, 19 nt, Homo sapiens
gacacggucuugccucuca

SEQ ID NO: 6748 - RNA, 19 nt, Homo sapiens
gauccaccuugcacuucua

SEQ ID NO: 6749 - RNA, 19 nt, Homo sapiens
guuaugagcagcugcagaa

SEQ ID NO: 6750 - RNA, 19 nt, Homo sapiens
guugugagcuggaaaagaa

SEQ ID NO: 6751 - RNA, 19 nt, Homo sapiens
gaacuguaccaggaagauu

SEQ ID NO: 6752 - RNA, 19 nt, Homo sapiens
aaauggcacuggaugucua

SEQ ID NO: 6753 - RNA, 19 nt, Homo sapiens
gaaugaauagugcuguuuc

SEQ ID NO: 6754 - RNA, 19 nt, Homo sapiens
aggaagaaccugacccuaa

SEQ ID NO: 6755 - RNA, 19 nt, Homo sapiens
caccagaguaucagaauga

SEQ ID NO: 6756 - RNA, 19 nt, Homo sapiens
ggacggaagguugucugua

SEQ ID NO: 6757 - RNA, 19 nt, Homo sapiens
ugaauagugcuguuuccua

SEQ ID NO: 6758 - RNA, 19 nt, Homo sapiens
gcaaauggcacuggauguc

SEQ ID NO: 6759 - RNA, 19 nt, Homo sapiens
gaacgagacccggcagaca

SEQ ID NO: 6760 - RNA, 19 nt, Homo sapiens
ccauuagacucagacagaa

SEQ ID NO: 6761 - RNA, 19 nt, Homo sapiens
gaagaaccugacccuaaug

SEQ ID NO: 6762 - RNA, 19 nt, Homo sapiens
ggacacuggcuuucuccaa

SEQ ID NO: 6763 - RNA, 19 nt, Homo sapiens
ggaccacgccugacaacca

SEQ ID NO: 6764 - RNA, 19 nt, Homo sapiens
cuacgccuccugccacaua

SEQ ID NO: 6765 - RNA, 19 nt, Homo sapiens
ggcacuggaugucuacaau

SEQ ID NO: 6766 - RNA, 19 nt, Homo sapiens
aggacaggcugcugaaguu

SEQ ID NO: 6767 - RNA, 19 nt, Homo sapiens
gagcaggacggaagguugu

SEQ ID NO: 6768 - RNA, 19 nt, Homo sapiens
ugucuacaauggugaacaa

SEQ ID NO: 6769 - RNA, 19 nt, Homo sapiens
ccaagcugcugguuuacuc

SEQ ID NO: 6770 - RNA, 19 nt, Homo sapiens
acacugugcccaucacuga

SEQ ID NO: 6771 - RNA, 19 nt, Homo sapiens
gacagaaugcuucaggaau

SEQ ID NO: 6772 - RNA, 19 nt, Homo sapiens
gcacuggaugucuacaaug

SEQ ID NO: 6773 - RNA, 19 nt, Homo sapiens
gaggacaggcugcugaagu

SEQ ID NO: 6774 - RNA, 19 nt, Homo sapiens
gcgugaaccugguggugau

SEQ ID NO: 6775 - RNA, 19 nt, Homo sapiens
ggauccaccuugcacuucu

SEQ ID NO: 6776 - RNA, 19 nt, Homo sapiens
ugagcuacaugcagguugu

SEQ ID NO: 6777 - RNA, 19 nt, Homo sapiens
ccaccuugcacuucuauca

SEQ ID NO: 6778 - RNA, 19 nt, Homo sapiens
ccuccacgcucccuacaca

SEQ ID NO: 6779 - RNA, 19 nt, Homo sapiens
gauuguggccuuggcugua

SEQ ID NO: 6780 - RNA, 19 nt, Homo sapiens
cggagucugcgcuucguua

SEQ ID NO: 6781 - RNA, 19 nt, Homo sapiens
gggcagcucccagagaaug

SEQ ID NO: 6782 - RNA, 19 nt, Homo sapiens
cuaucaagcccuguucuuu

SEQ ID NO: 6783 - RNA, 19 nt, Homo sapiens
ggaccuaggauuagaaaau

SEQ ID NO: 6784 - RNA, 19 nt, Homo sapiens
ucacucaggaccuaggauu

SEQ ID NO: 6785 - RNA, 19 nt, Homo sapiens
ccagggguuuggucaguua

SEQ ID NO: 6786 - RNA, 19 nt, Homo sapiens
ucuagacuguggcccagaa

SEQ ID NO: 6787 - RNA, 19 nt, Homo sapiens
agacagaaugcuucaggaa

SEQ ID NO: 6788 - RNA, 19 nt, Homo sapiens
ucccaugccugauguuuac

SEQ ID NO: 6789 - RNA, 19 nt, Homo sapiens
ggaggaccacgccugacaa

SEQ ID NO: 6790 - RNA, 19 nt, Homo sapiens
cacaauuucuggacauggu

SEQ ID NO: 6791 - RNA, 19 nt, Homo sapiens
gaccuaggauuagaaaaug

SEQ ID NO: 6792 - RNA, 19 nt, Homo sapiens
caguggagauguacuuucg

SEQ ID NO: 6793 - RNA, 19 nt, Homo sapiens
cagcgucucagccggcuaa

SEQ ID NO: 6794 - RNA, 19 nt, Homo sapiens
ggcagacaccagaguauca

SEQ ID NO: 6795 - RNA, 19 nt, Homo sapiens
cagccagccagccacauuu

SEQ ID NO: 6796 - RNA, 19 nt, Homo sapiens
gcuaucacggcuuccuaaa

SEQ ID NO: 6797 - RNA, 19 nt, Homo sapiens
gcuccucaccguccucuuc

SEQ ID NO: 6798 - RNA, 19 nt, Homo sapiens
uggcucagauaaggaagaa

SEQ ID NO: 6799 - RNA, 19 nt, Homo sapiens
acaccagaguaucagaaug

SEQ ID NO: 6800 - RNA, 19 nt, Homo sapiens
gaaugcuucaggaaucguu

SEQ ID NO: 6801 - RNA, 19 nt, Homo sapiens
cauccucuuccuccucaua

SEQ ID NO: 6802 - RNA, 19 nt, Homo sapiens
cacuggaugucuacaaugg

SEQ ID NO: 6803 - RNA, 19 nt, Homo sapiens
uccccaagcugcugguuua

SEQ ID NO: 6804 - RNA, 19 nt, Homo sapiens
augagcagcugcagaacga

SEQ ID NO: 6805 - RNA, 19 nt, Homo sapiens
agaaugaauagugcuguuu

SEQ ID NO: 6806 - RNA, 19 nt, Homo sapiens
ugccugauguuuaccaagu

SEQ ID NO: 6807 - RNA, 19 nt, Homo sapiens
gcagacacagaggugauug

SEQ ID NO: 6808 - RNA, 19 nt, Homo sapiens
ucccagagaaugaauagug

SEQ ID NO: 6809 - RNA, 19 nt, Homo sapiens
ucacacgaaucaggaaacu

SEQ ID NO: 6810 - RNA, 19 nt, Homo sapiens
ggacaggcugcugaaguuc

SEQ ID NO: 6811 - RNA, 19 nt, Homo sapiens
cacucaggaccuaggauua

SEQ ID NO: 6812 - RNA, 19 nt, Homo sapiens
gccacauauuugaacugua

SEQ ID NO: 6813 - RNA, 19 nt, Homo sapiens
acacucuucugugagcaaa

SEQ ID NO: 6814 - RNA, 19 nt, Homo sapiens
guucucggaaugcacaauu

SEQ ID NO: 6815 - RNA, 19 nt, Homo sapiens
gacaccagaguaucagaau

SEQ ID NO: 6816 - RNA, 19 nt, Homo sapiens
agacuguggcccagaauag

SEQ ID NO: 6817 - RNA, 19 nt, Homo sapiens
gaacuggaucacccaacag

SEQ ID NO: 6818 - RNA, 19 nt, Homo sapiens
uaucaagcccuguucuuuu

SEQ ID NO: 6819 - RNA, 19 nt, Homo sapiens
guuggacacuggcuuucuc

SEQ ID NO: 6820 - RNA, 19 nt, Homo sapiens
ggaugucuacaauggugaa

SEQ ID NO: 6821 - RNA, 19 nt, Homo sapiens
cagcuuccgcuuccucuuc

SEQ ID NO: 6822 - RNA, 19 nt, Homo sapiens
ucagccggcuaaaggacuu

SEQ ID NO: 6823 - RNA, 19 nt, Homo sapiens
caaaccaugcagcgucuca

SEQ ID NO: 6824 - RNA, 19 nt, Homo sapiens
caacgagacagggcuuaca

SEQ ID NO: 6825 - RNA, 19 nt, Homo sapiens
gacuuugaccggacucuca

SEQ ID NO: 6826 - RNA, 19 nt, Homo sapiens
gcgcuaucacggcuuccua

SEQ ID NO: 6827 - RNA, 19 nt, Homo sapiens
uuuaccaagugcuguguug

SEQ ID NO: 6828 - RNA, 19 nt, Homo sapiens
ccauggugccugucacuca

SEQ ID NO: 6829 - RNA, 19 nt, Homo sapiens
gguugggccucccucugau

SEQ ID NO: 6830 - RNA, 19 nt, Homo sapiens
cgucucagccggcuaaagg

SEQ ID NO: 6831 - RNA, 19 nt, Homo sapiens
gagaucagcuccaaagaga

SEQ ID NO: 6832 - RNA, 19 nt, Homo sapiens
aaacacagcugaugaacug

SEQ ID NO: 6833 - RNA, 19 nt, Homo sapiens
gcacagaugcccacguaug

SEQ ID NO: 6834 - RNA, 19 nt, Homo sapiens
gauccugggugcagacuuc

SEQ ID NO: 6835 - RNA, 19 nt, Homo sapiens
ggcccgaucuccacuguug

SEQ ID NO: 6836 - RNA, 19 nt, Homo sapiens
uaucugcgcuuccacuaug

SEQ ID NO: 6837 - RNA, 19 nt, Homo sapiens
gaaagcuuccuccuaaauc

SEQ ID NO: 6838 - RNA, 19 nt, Homo sapiens
gaucagcuccaaagagaug

SEQ ID NO: 6839 - RNA, 19 nt, Homo sapiens
gacacuauguggcaacuca

SEQ ID NO: 6840 - RNA, 19 nt, Homo sapiens
ucaagcaucuuucuguuac

SEQ ID NO: 6841 - RNA, 19 nt, Homo sapiens
cagauugcauacucuaaga

SEQ ID NO: 6842 - RNA, 19 nt, Homo sapiens
ggagaccuuugaggacgua

SEQ ID NO: 6843 - RNA, 19 nt, Homo sapiens
uuacuucacuggugugcaa

SEQ ID NO: 6844 - RNA, 19 nt, Homo sapiens
gaccggcaguucuacucua

SEQ ID NO: 6845 - RNA, 19 nt, Homo sapiens
gggaaacacagcugaugaa

SEQ ID NO: 6846 - RNA, 19 nt, Homo sapiens
aaucaagcaucuuucuguu

SEQ ID NO: 6847 - RNA, 19 nt, Homo sapiens
aaagcuuccuccuaaauca

SEQ ID NO: 6848 - RNA, 19 nt, Homo sapiens
cagcuguccuggcucaaga

SEQ ID NO: 6849 - RNA, 19 nt, Homo sapiens
gcccugaacucccaugacu

SEQ ID NO: 6850 - RNA, 19 nt, Homo sapiens
gggcaagucccucuuuaag

SEQ ID NO: 6851 - RNA, 19 nt, Homo sapiens
uguccuggcucaagaaaca

SEQ ID NO: 6852 - RNA, 19 nt, Homo sapiens
ugcaagacaucaaugacaa

SEQ ID NO: 6853 - RNA, 19 nt, Homo sapiens
ucgggcaagucccucuuua

SEQ ID NO: 6854 - RNA, 19 nt, Homo sapiens
cuaugggacugaagacuca

SEQ ID NO: 6855 - RNA, 19 nt, Homo sapiens
cggaaaccaugaccaccuu

SEQ ID NO: 6856 - RNA, 19 nt, Homo sapiens
gguacgugcuagccggaaa

SEQ ID NO: 6857 - RNA, 19 nt, Homo sapiens
cagaugcccacguauguga

SEQ ID NO: 6858 - RNA, 19 nt, Homo sapiens
gaaacacagcugaugaacu

SEQ ID NO: 6859 - RNA, 19 nt, Homo sapiens
ugucccagccacaguguua

SEQ ID NO: 6860 - RNA, 19 nt, Homo sapiens
ucagggaccggcaguucua

SEQ ID NO: 6861 - RNA, 19 nt, Homo sapiens
ucacuggugugcaagacau

SEQ ID NO: 6862 - RNA, 19 nt, Homo sapiens
gcaucuuucuguuacugau

SEQ ID NO: 6863 - RNA, 19 nt, Homo sapiens
aaaucaagcaucuuucugu

SEQ ID NO: 6864 - RNA, 19 nt, Homo sapiens
gcaaagugcccugguacgu

SEQ ID NO: 6865 - RNA, 19 nt, Homo sapiens
uugaggacguauucucuga

SEQ ID NO: 6866 - RNA, 19 nt, Homo sapiens
gaggcccgaucuccacugu

SEQ ID NO: 6867 - RNA, 19 nt, Homo sapiens
caagacaucaaugacaaga

SEQ ID NO: 6868 - RNA, 19 nt, Homo sapiens
ccuccuaaaucaagcaucu

SEQ ID NO: 6869 - RNA, 19 nt, Homo sapiens
gugcaagacaucaaugaca

SEQ ID NO: 6870 - RNA, 19 nt, Homo sapiens
gaccuuugaggacguauuc

SEQ ID NO: 6871 - RNA, 19 nt, Homo sapiens
ugaccgcucccuucgcaaa

SEQ ID NO: 6872 - RNA, 19 nt, Homo sapiens
gcaagacaucaaugacaag

SEQ ID NO: 6873 - RNA, 19 nt, Homo sapiens
cacagaugcccacguaugu

SEQ ID NO: 6874 - RNA, 19 nt, Homo sapiens
gcuaucugcgcuuccacua

SEQ ID NO: 6875 - RNA, 19 nt, Homo sapiens
gggcugggaauuucaugga

SEQ ID NO: 6876 - RNA, 19 nt, Homo sapiens
gaugcccacguaugugaaa

SEQ ID NO: 6877 - RNA, 19 nt, Homo sapiens
uaaaucaagcaucuuucug

SEQ ID NO: 6878 - RNA, 19 nt, Homo sapiens
caagaucccacagaccaau

SEQ ID NO: 6879 - RNA, 19 nt, Homo sapiens
gauugcauacucuaagauc

SEQ ID NO: 6880 - RNA, 19 nt, Homo sapiens
cuaaaucaagcaucuuucu

SEQ ID NO: 6881 - RNA, 19 nt, Homo sapiens
gcuccaaagagaugacugu

SEQ ID NO: 6882 - RNA, 19 nt, Homo sapiens
uggcaacucagaugacuuc

SEQ ID NO: 6883 - RNA, 19 nt, Homo sapiens
ccagauugcauacucuaag

SEQ ID NO: 6884 - RNA, 19 nt, Homo sapiens
gcccagauugcauacucua

SEQ ID NO: 6885 - RNA, 19 nt, Homo sapiens
gacuucauccugucucuag

SEQ ID NO: 6886 - RNA, 19 nt, Homo sapiens
ggaaacacagcugaugaac

SEQ ID NO: 6887 - RNA, 19 nt, Homo sapiens
cgggcaagucccucuuuaa

SEQ ID NO: 6888 - RNA, 19 nt, Homo sapiens
guaccugcaagaugagaau

SEQ ID NO: 6889 - RNA, 19 nt, Homo sapiens
gaacauacuuuggccauua

SEQ ID NO: 6890 - RNA, 19 nt, Homo sapiens
ggagacaucuggaaaguuu

SEQ ID NO: 6891 - RNA, 19 nt, Homo sapiens
gaagagagcaacucagaua

SEQ ID NO: 6892 - RNA, 19 nt, Homo sapiens
acaaagacaucgauugaua

SEQ ID NO: 6893 - RNA, 19 nt, Homo sapiens
uauagcagcucuugaagua

SEQ ID NO: 6894 - RNA, 19 nt, Homo sapiens
gacccugucucaauaaaua

SEQ ID NO: 6895 - RNA, 19 nt, Homo sapiens
gaacuuggagaguauauaa

SEQ ID NO: 6896 - RNA, 19 nt, Homo sapiens
ggacacauaucaaacugaa

SEQ ID NO: 6897 - RNA, 19 nt, Homo sapiens
gcaagaagaaaucaugaua

SEQ ID NO: 6898 - RNA, 19 nt, Homo sapiens
agaagaggcugcacccuua

SEQ ID NO: 6899 - RNA, 19 nt, Homo sapiens
gaacagguuuauauucgaa

SEQ ID NO: 6900 - RNA, 19 nt, Homo sapiens
gauguugacucuaaaguug

SEQ ID NO: 6901 - RNA, 19 nt, Homo sapiens
ggucaaaguucauagaguu

SEQ ID NO: 6902 - RNA, 19 nt, Homo sapiens
uagcagcucuugaaguaua

SEQ ID NO: 6903 - RNA, 19 nt, Homo sapiens
ucaaugaaauccucaauca

SEQ ID NO: 6904 - RNA, 19 nt, Homo sapiens
ggauaaagaugagaugguu

SEQ ID NO: 6905 - RNA, 19 nt, Homo sapiens
gaacaaggaaggaaagaug

SEQ ID NO: 6906 - RNA, 19 nt, Homo sapiens
gaaaccuugucucuacaua

SEQ ID NO: 6907 - RNA, 19 nt, Homo sapiens
caacucagauaccaagcua

SEQ ID NO: 6908 - RNA, 19 nt, Homo sapiens
agaacacugugcucuauua

SEQ ID NO: 6909 - RNA, 19 nt, Homo sapiens
gcauggagcagcauuauga

SEQ ID NO: 6910 - RNA, 19 nt, Homo sapiens
ugauauagcuuuccaugug

SEQ ID NO: 6911 - RNA, 19 nt, Homo sapiens
uccagaagcuccagugaua

SEQ ID NO: 6912 - RNA, 19 nt, Homo sapiens
gcagugagccaaauguaaa

SEQ ID NO: 6913 - RNA, 19 nt, Homo sapiens
gauaugcuucuuuguguua

SEQ ID NO: 6914 - RNA, 19 nt, Homo sapiens
gcacacaguuccucuuucu

SEQ ID NO: 6915 - RNA, 19 nt, Homo sapiens
gcucacaccuguaauccuu

SEQ ID NO: 6916 - RNA, 19 nt, Homo sapiens
agauaaagcuuaggucaaa

SEQ ID NO: 6917 - RNA, 19 nt, Homo sapiens
ccaaggaguugaaguuugu

SEQ ID NO: 6918 - RNA, 19 nt, Homo sapiens
ggaagggacacauaucaaa

SEQ ID NO: 6919 - RNA, 19 nt, Homo sapiens
ggugaaaccuugucucuac

SEQ ID NO: 6920 - RNA, 19 nt, Homo sapiens
ugacggaauuguacuuuga

SEQ ID NO: 6921 - RNA, 19 nt, Homo sapiens
aaacagcucuccucaacau

SEQ ID NO: 6922 - RNA, 19 nt, Homo sapiens
ggccaggcauggugguuua

SEQ ID NO: 6923 - RNA, 19 nt, Homo sapiens
gaaggaaagaugugaauag

SEQ ID NO: 6924 - RNA, 19 nt, Homo sapiens
agagugugguuacgaaaua

SEQ ID NO: 6925 - RNA, 19 nt, Homo sapiens
gaaguguacuagccaagga

SEQ ID NO: 6926 - RNA, 19 nt, Homo sapiens
ugacaaagacaucgauuga

SEQ ID NO: 6927 - RNA, 19 nt, Homo sapiens
caaaguugauuaagaaagg

SEQ ID NO: 6928 - RNA, 19 nt, Homo sapiens
ugacuaaguugagagaauu

SEQ ID NO: 6929 - RNA, 19 nt, Homo sapiens
caacacaucaggaaagaga

SEQ ID NO: 6930 - RNA, 19 nt, Homo sapiens
gaaaaugggcuuuggauga

SEQ ID NO: 6931 - RNA, 19 nt, Homo sapiens
cuacgacccuuuauauugu

SEQ ID NO: 6932 - RNA, 19 nt, Homo sapiens
gaagaaaucaugauauagc

SEQ ID NO: 6933 - RNA, 19 nt, Homo sapiens
ggaaggaagggacacauau

SEQ ID NO: 6934 - RNA, 19 nt, Homo sapiens
gcuuguaacugucuucuag

SEQ ID NO: 6935 - RNA, 19 nt, Homo sapiens
gaugagaacaagcuauuug

SEQ ID NO: 6936 - RNA, 19 nt, Homo sapiens
acaaacagccaucaaggua

SEQ ID NO: 6937 - RNA, 19 nt, Homo sapiens
gaaauccucaaucacauga

SEQ ID NO: 6938 - RNA, 19 nt, Homo sapiens
gagaugguuucuagagaug

SEQ ID NO: 6939 - RNA, 19 nt, Homo sapiens
aagaugagaugguuucuag

SEQ ID NO: 6940 - RNA, 19 nt, Homo sapiens
cacaggaucuuuuguauuu

SEQ ID NO: 6941 - RNA, 19 nt, Homo sapiens
agauggcgcuagauguuua

SEQ ID NO: 6942 - RNA, 19 nt, Homo sapiens
ggagcagcauuaugaacuu

SEQ ID NO: 6943 - RNA, 19 nt, Homo sapiens
cgauugauaugcuucuuug

SEQ ID NO: 6944 - RNA, 19 nt, Homo sapiens
gagauacaguggagacauc

SEQ ID NO: 6945 - RNA, 19 nt, Homo sapiens
gaagucccauugacaccuu

SEQ ID NO: 6946 - RNA, 19 nt, Homo sapiens
ggacuuugaugagugcuau

SEQ ID NO: 6947 - RNA, 19 nt, Homo sapiens
cuauaaacaugaacagguu

SEQ ID NO: 6948 - RNA, 19 nt, Homo sapiens
agaaacagcucuccucaac

SEQ ID NO: 6949 - RNA, 19 nt, Homo sapiens
ggaaggaaagaugugaaua

SEQ ID NO: 6950 - RNA, 19 nt, Homo sapiens
ucagaggaauuccagaaga

SEQ ID NO: 6951 - RNA, 19 nt, Homo sapiens
gaacugcccucguuuucaa

SEQ ID NO: 6952 - RNA, 19 nt, Homo sapiens
caucuggaauccuauccua

SEQ ID NO: 6953 - RNA, 19 nt, Homo sapiens
gcaggaggaucacuuuagg

SEQ ID NO: 6954 - RNA, 19 nt, Homo sapiens
gcacaacacaucaggaaag

SEQ ID NO: 6955 - RNA, 19 nt, Homo sapiens
uuauuucccucccaaguaa

SEQ ID NO: 6956 - RNA, 19 nt, Homo sapiens
cagaaugacugacaaagac

SEQ ID NO: 6957 - RNA, 19 nt, Homo sapiens
gccaaggaguugaaguuug

SEQ ID NO: 6958 - RNA, 19 nt, Homo sapiens
ucaaggagaggcaaagaaa

SEQ ID NO: 6959 - RNA, 19 nt, Homo sapiens
gagugagacuuugaaauca

SEQ ID NO: 6960 - RNA, 19 nt, Homo sapiens
gaaugaguccuauaaacau

SEQ ID NO: 6961 - RNA, 19 nt, Homo sapiens
uggcagaucuacaugucua

SEQ ID NO: 6962 - RNA, 19 nt, Homo sapiens
aagcuuaggucaaaguuca

SEQ ID NO: 6963 - RNA, 19 nt, Homo sapiens
aagaguagcugcccuuucu

SEQ ID NO: 6964 - RNA, 19 nt, Homo sapiens
ggacaguacagauuagugu

SEQ ID NO: 6965 - RNA, 19 nt, Homo sapiens
gagauguacuaccggaaug

SEQ ID NO: 6966 - RNA, 19 nt, Homo sapiens
aaccuugucucuacauaaa

SEQ ID NO: 6967 - RNA, 19 nt, Homo sapiens
aaucagagauaaagcuuag

SEQ ID NO: 6968 - RNA, 19 nt, Homo sapiens
gcgcaugacacuacuguga

SEQ ID NO: 6969 - RNA, 19 nt, Homo sapiens
gaauuuggaguaaagucua

SEQ ID NO: 6970 - RNA, 19 nt, Homo sapiens
gaagaucaguugcuauacc

SEQ ID NO: 6971 - RNA, 19 nt, Homo sapiens
caaagacaucgauugauau

SEQ ID NO: 6972 - RNA, 19 nt, Homo sapiens
aaaggaauguguaagucuu

SEQ ID NO: 6973 - RNA, 19 nt, Homo sapiens
cuaagugccuccaaguuca

SEQ ID NO: 6974 - RNA, 19 nt, Homo sapiens
gaaaacugcuacuaucugu

SEQ ID NO: 6975 - RNA, 19 nt, Homo sapiens
ggaauuguacuuugagaag

SEQ ID NO: 6976 - RNA, 19 nt, Homo sapiens
cagaaagauuugauguaug

SEQ ID NO: 6977 - RNA, 19 nt, Homo sapiens
gggcuuuggaugauuauuu

SEQ ID NO: 6978 - RNA, 19 nt, Homo sapiens
gaugaugcuuugagaacau

SEQ ID NO: 6979 - RNA, 19 nt, Homo sapiens
gucagcaucuggaauccua

SEQ ID NO: 6980 - RNA, 19 nt, Homo sapiens
ugaaugaguccuauaaaca

SEQ ID NO: 6981 - RNA, 19 nt, Homo sapiens
gagcagcauuaugaacuug

SEQ ID NO: 6982 - RNA, 19 nt, Homo sapiens
gaggugggcagaucacuug

SEQ ID NO: 6983 - RNA, 19 nt, Homo sapiens
uagcaaauaagucaucuga

SEQ ID NO: 6984 - RNA, 19 nt, Homo sapiens
gagcaggauuagauaaguc

SEQ ID NO: 6985 - RNA, 19 nt, Homo sapiens
aaugggcuuuggaugauua

SEQ ID NO: 6986 - RNA, 19 nt, Homo sapiens
gaauucacaagcagaaaga

SEQ ID NO: 6987 - RNA, 19 nt, Homo sapiens
gagaguauauaagaaagag

SEQ ID NO: 6988 - RNA, 19 nt, Homo sapiens
ugagaugguuucuagagau

SEQ ID NO: 6989 - RNA, 19 nt, Homo sapiens
gaacgaggaugcaaauuau

SEQ ID NO: 6990 - RNA, 19 nt, Homo sapiens
gcucaaacauccuaucuuu

SEQ ID NO: 6991 - RNA, 19 nt, Homo sapiens
ggaacgaggaugcaaauua

SEQ ID NO: 6992 - RNA, 19 nt, Homo sapiens
gaacagguuucucuugcua

SEQ ID NO: 6993 - RNA, 19 nt, Homo sapiens
caaauuauaugcugucgaa

SEQ ID NO: 6994 - RNA, 19 nt, Homo sapiens
gagaacagccuuugaguga

SEQ ID NO: 6995 - RNA, 19 nt, Homo sapiens
gagaacaugugcccaucua

SEQ ID NO: 6996 - RNA, 19 nt, Homo sapiens
gaacaucaagucagccuaa

SEQ ID NO: 6997 - RNA, 19 nt, Homo sapiens
gaaccugcaucacucagaa

SEQ ID NO: 6998 - RNA, 19 nt, Homo sapiens
gaacauggcuccggugaac

SEQ ID NO: 6999 - RNA, 19 nt, Homo sapiens
gcucgcaguuugcuucaua

SEQ ID NO: 7000 - RNA, 19 nt, Homo sapiens
cauccuaucuuucuucuuc

SEQ ID NO: 7001 - RNA, 19 nt, Homo sapiens
gaacaugugcccaucuaug

SEQ ID NO: 7002 - RNA, 19 nt, Homo sapiens
ccaacucuuucucucaaua

SEQ ID NO: 7003 - RNA, 19 nt, Homo sapiens
gugcuuauaugaaugauca

SEQ ID NO: 7004 - RNA, 19 nt, Homo sapiens
cuacacaugugcuuauaug

SEQ ID NO: 7005 - RNA, 19 nt, Homo sapiens
gagaacaugcugagaguga

SEQ ID NO: 7006 - RNA, 19 nt, Homo sapiens
caucaagucagccuaauga

SEQ ID NO: 7007 - RNA, 19 nt, Homo sapiens
gcuaaugagucuuuaucug

SEQ ID NO: 7008 - RNA, 19 nt, Homo sapiens
cacaugugcuuauaugaau

SEQ ID NO: 7009 - RNA, 19 nt, Homo sapiens
ccugggcccuugcuuguuu

SEQ ID NO: 7010 - RNA, 19 nt, Homo sapiens
gcaccaauuucaagcacau

SEQ ID NO: 7011 - RNA, 19 nt, Homo sapiens
gcugaggcuuuauaugaga

SEQ ID NO: 7012 - RNA, 19 nt, Homo sapiens
uuaaauugcuacacaugug

SEQ ID NO: 7013 - RNA, 19 nt, Homo sapiens
ucaaacauccuaucuuucu

SEQ ID NO: 7014 - RNA, 19 nt, Homo sapiens
ggagagggaaccugcauca

SEQ ID NO: 7015 - RNA, 19 nt, Homo sapiens
ccauagaucaucaaacuuc

SEQ ID NO: 7016 - RNA, 19 nt, Homo sapiens
caaacauccuaucuuucuu

SEQ ID NO: 7017 - RNA, 19 nt, Homo sapiens
cagcagugcauguuaaaga

SEQ ID NO: 7018 - RNA, 19 nt, Homo sapiens
gaugaacagguuucucuug

SEQ ID NO: 7019 - RNA, 19 nt, Homo sapiens
cuucuucuauucaugcuuu

SEQ ID NO: 7020 - RNA, 19 nt, Homo sapiens
uauaugcugucgaaaucaa

SEQ ID NO: 7021 - RNA, 19 nt, Homo sapiens
acacaugugcuuauaugaa

SEQ ID NO: 7022 - RNA, 19 nt, Homo sapiens
ugagcagccuucaggagaa

SEQ ID NO: 7023 - RNA, 19 nt, Homo sapiens
cuacaggcacaauauuaaa

SEQ ID NO: 7024 - RNA, 19 nt, Homo sapiens
gaaggugagcauacuguag

SEQ ID NO: 7025 - RNA, 19 nt, Homo sapiens
aaauccagaugaacagguu

SEQ ID NO: 7026 - RNA, 19 nt, Homo sapiens
agguuucucuugcuaauga

SEQ ID NO: 7027 - RNA, 19 nt, Homo sapiens
gcccaucuaugaaccucuu

SEQ ID NO: 7028 - RNA, 19 nt, Homo sapiens
ggcuucaggugcaccaauu

SEQ ID NO: 7029 - RNA, 19 nt, Homo sapiens
cuccauagaucaucaaacu

SEQ ID NO: 7030 - RNA, 19 nt, Homo sapiens
ucccagcagugcauguuaa

SEQ ID NO: 7031 - RNA, 19 nt, Homo sapiens
ucaagggugugagaacaug

SEQ ID NO: 7032 - RNA, 19 nt, Homo sapiens
cagugcauguuaaagaaga

SEQ ID NO: 7033 - RNA, 19 nt, Homo sapiens
ucuacaggcacaauauuaa

SEQ ID NO: 7034 - RNA, 19 nt, Homo sapiens
cauagaucaucaaacuuca

SEQ ID NO: 7035 - RNA, 19 nt, Homo sapiens
augcugaggcuuuauauga

SEQ ID NO: 7036 - RNA, 19 nt, Homo sapiens
ucacaugguuaaagcaaaa

SEQ ID NO: 7037 - RNA, 19 nt, Homo sapiens
gacugaacaugcugaaggu

SEQ ID NO: 7038 - RNA, 19 nt, Homo sapiens
caacucuuucucucaauau

SEQ ID NO: 7039 - RNA, 19 nt, Homo sapiens
gaaccucuucucccaugga

SEQ ID NO: 7040 - RNA, 19 nt, Homo sapiens
gcacaucuacaggcacaau

SEQ ID NO: 7041 - RNA, 19 nt, Homo sapiens
aaacauccuaucuuucuuc

SEQ ID NO: 7042 - RNA, 19 nt, Homo sapiens
uggagaacaugcugagagu

SEQ ID NO: 7043 - RNA, 19 nt, Homo sapiens
caacaacugaccacaucug

SEQ ID NO: 7044 - RNA, 19 nt, Homo sapiens
auuauaugcugucgaaauc

SEQ ID NO: 7045 - RNA, 19 nt, Homo sapiens
caucuacaggcacaauauu

SEQ ID NO: 7046 - RNA, 19 nt, Homo sapiens
cagaugaacagguuucucu

SEQ ID NO: 7047 - RNA, 19 nt, Homo sapiens
aacaugugcccaucuauga

SEQ ID NO: 7048 - RNA, 19 nt, Homo sapiens
acagguuucucuugcuaau

SEQ ID NO: 7049 - RNA, 19 nt, Homo sapiens
ggaaccugcaucacucaga

SEQ ID NO: 7050 - RNA, 19 nt, Homo sapiens
uuuccuaaauccagaugaa

SEQ ID NO: 7051 - RNA, 19 nt, Homo sapiens
cacucuauuuggcucauuu

SEQ ID NO: 7052 - RNA, 19 nt, Homo sapiens
agcagugcauguuaaagaa

SEQ ID NO: 7053 - RNA, 19 nt, Homo sapiens
gagcuugagucaggugaac

SEQ ID NO: 7054 - RNA, 19 nt, Homo sapiens
cuccaacucuuucucucaa

SEQ ID NO: 7055 - RNA, 19 nt, Homo sapiens
ccagaggaacaucaaguca

SEQ ID NO: 7056 - RNA, 19 nt, Homo sapiens
gcugucgaaaucaaucuuu

SEQ ID NO: 7057 - RNA, 19 nt, Homo sapiens
ugaaggugagcauacugua

SEQ ID NO: 7058 - RNA, 19 nt, Homo sapiens
aagccuccaucacucuauu

SEQ ID NO: 7059 - RNA, 19 nt, Homo sapiens
ccaauuucaagcacaucua

SEQ ID NO: 7060 - RNA, 19 nt, Homo sapiens
cuucugaugcugaggcuuu

SEQ ID NO: 7061 - RNA, 19 nt, Homo sapiens
gcuccaacucuuucucuca

SEQ ID NO: 7062 - RNA, 19 nt, Homo sapiens
acgaggaugcaaauuauau

SEQ ID NO: 7063 - RNA, 19 nt, Homo sapiens
caugugcuuauaugaauga

SEQ ID NO: 7064 - RNA, 19 nt, Homo sapiens
cgaggaugcaaauuauaug

SEQ ID NO: 7065 - RNA, 19 nt, Homo sapiens
gagcagccuucaggagaac

SEQ ID NO: 7066 - RNA, 19 nt, Homo sapiens
ccagugagcaugguucaag

SEQ ID NO: 7067 - RNA, 19 nt, Homo sapiens
gcuacacaugugcuuauau

SEQ ID NO: 7068 - RNA, 19 nt, Homo sapiens
cucucaauauuccugauuu

SEQ ID NO: 7069 - RNA, 19 nt, Homo sapiens
ugccucugccugagcauua

SEQ ID NO: 7070 - RNA, 19 nt, Homo sapiens
cauggaacgaggaugcaaa

SEQ ID NO: 7071 - RNA, 19 nt, Homo sapiens
ugucuucccugcuccaacu

SEQ ID NO: 7072 - RNA, 19 nt, Homo sapiens
gcagugcauguuaaagaag

SEQ ID NO: 7073 - RNA, 19 nt, Homo sapiens
gugagcaugguuccaguga

SEQ ID NO: 7074 - RNA, 19 nt, Homo sapiens
gaacgaggaugcaaauuau

SEQ ID NO: 7075 - RNA, 19 nt, Homo sapiens
gcucaaacauccuaucuuu

SEQ ID NO: 7076 - RNA, 19 nt, Homo sapiens
ggaacgaggaugcaaauua

SEQ ID NO: 7077 - RNA, 19 nt, Homo sapiens
gaacagguuucucuugcua

SEQ ID NO: 7078 - RNA, 19 nt, Homo sapiens
caaauuauaugcugucgaa

SEQ ID NO: 7079 - RNA, 19 nt, Homo sapiens
gagaacagccuuugaguga

SEQ ID NO: 7080 - RNA, 19 nt, Homo sapiens
gagaacaugugcccaucua

SEQ ID NO: 7081 - RNA, 19 nt, Homo sapiens
gaacaucaagucagccuaa

SEQ ID NO: 7082 - RNA, 19 nt, Homo sapiens
gaaccugcaucacucagaa

SEQ ID NO: 7083 - RNA, 19 nt, Homo sapiens
gaacauggcuccggugaac

SEQ ID NO: 7084 - RNA, 19 nt, Homo sapiens
gcucgcaguuugcuucaua

SEQ ID NO: 7085 - RNA, 19 nt, Homo sapiens
cauccuaucuuucuucuuc

SEQ ID NO: 7086 - RNA, 19 nt, Homo sapiens
gaacaugugcccaucuaug

SEQ ID NO: 7087 - RNA, 19 nt, Homo sapiens
ccaacucuuucucucaaua

SEQ ID NO: 7088 - RNA, 19 nt, Homo sapiens
gugcuuauaugaaugauca

SEQ ID NO: 7089 - RNA, 19 nt, Homo sapiens
cuacacaugugcuuauaug

SEQ ID NO: 7090 - RNA, 19 nt, Homo sapiens
gagaacaugcugagaguga

SEQ ID NO: 7091 - RNA, 19 nt, Homo sapiens
caucaagucagccuaauga

SEQ ID NO: 7092 - RNA, 19 nt, Homo sapiens
gcuaaugagucuuuaucug

SEQ ID NO: 7093 - RNA, 19 nt, Homo sapiens
cacaugugcuuauaugaau

SEQ ID NO: 7094 - RNA, 19 nt, Homo sapiens
ccugggcccuugcuuguuu

SEQ ID NO: 7095 - RNA, 19 nt, Homo sapiens
gcugaggcuuuauaugaga

SEQ ID NO: 7096 - RNA, 19 nt, Homo sapiens
uuaaauugcuacacaugug

SEQ ID NO: 7097 - RNA, 19 nt, Homo sapiens
ucaaacauccuaucuuucu

SEQ ID NO: 7098 - RNA, 19 nt, Homo sapiens
ggagagggaaccugcauca

SEQ ID NO: 7099 - RNA, 19 nt, Homo sapiens
ccauagaucaucaaacuuc

SEQ ID NO: 7100 - RNA, 19 nt, Homo sapiens
caaacauccuaucuuucuu

SEQ ID NO: 7101 - RNA, 19 nt, Homo sapiens
cagcagugcauguuaaaga

SEQ ID NO: 7102 - RNA, 19 nt, Homo sapiens
gaugaacagguuucucuug

SEQ ID NO: 7103 - RNA, 19 nt, Homo sapiens
cuucuucuauucaugcuuu

SEQ ID NO: 7104 - RNA, 19 nt, Homo sapiens
uauaugcugucgaaaucaa

SEQ ID NO: 7105 - RNA, 19 nt, Homo sapiens
acacaugugcuuauaugaa

SEQ ID NO: 7106 - RNA, 19 nt, Homo sapiens
ugagcagccuucaggagaa

SEQ ID NO: 7107 - RNA, 19 nt, Homo sapiens
gaaggugagcauacuguag

SEQ ID NO: 7108 - RNA, 19 nt, Homo sapiens
cuuuagcacuggaagcuuu

SEQ ID NO: 7109 - RNA, 19 nt, Homo sapiens
aaauccagaugaacagguu

SEQ ID NO: 7110 - RNA, 19 nt, Homo sapiens
agguuucucuugcuaauga

SEQ ID NO: 7111 - RNA, 19 nt, Homo sapiens
gcccaucuaugaaccucuu

SEQ ID NO: 7112 - RNA, 19 nt, Homo sapiens
cuccauagaucaucaaacu

SEQ ID NO: 7113 - RNA, 19 nt, Homo sapiens
ucccagcagugcauguuaa

SEQ ID NO: 7114 - RNA, 19 nt, Homo sapiens
ucaagggugugagaacaug

SEQ ID NO: 7115 - RNA, 19 nt, Homo sapiens
cagugcauguuaaagaaga

SEQ ID NO: 7116 - RNA, 19 nt, Homo sapiens
cauagaucaucaaacuuca

SEQ ID NO: 7117 - RNA, 19 nt, Homo sapiens
augcugaggcuuuauauga

SEQ ID NO: 7118 - RNA, 19 nt, Homo sapiens
ucacaugguuaaagcaaaa

SEQ ID NO: 7119 - RNA, 19 nt, Homo sapiens
gacugaacaugcugaaggu

SEQ ID NO: 7120 - RNA, 19 nt, Homo sapiens
caacucuuucucucaauau

SEQ ID NO: 7121 - RNA, 19 nt, Homo sapiens
gaaccucuucucccaugga

SEQ ID NO: 7122 - RNA, 19 nt, Homo sapiens
aaacauccuaucuuucuuc

SEQ ID NO: 7123 - RNA, 19 nt, Homo sapiens
uggagaacaugcugagagu

SEQ ID NO: 7124 - RNA, 19 nt, Homo sapiens
cagaugaacagguuucucu

SEQ ID NO: 7125 - RNA, 19 nt, Homo sapiens
caacaacugaccacaucug

SEQ ID NO: 7126 - RNA, 19 nt, Homo sapiens
auuauaugcugucgaaauc

SEQ ID NO: 7127 - RNA, 19 nt, Homo sapiens
aacaugugcccaucuauga

SEQ ID NO: 7128 - RNA, 19 nt, Homo sapiens
uuuccuaaauccagaugaa

SEQ ID NO: 7129 - RNA, 19 nt, Homo sapiens
ggaaccugcaucacucaga

SEQ ID NO: 7130 - RNA, 19 nt, Homo sapiens
acagguuucucuugcuaau

SEQ ID NO: 7131 - RNA, 19 nt, Homo sapiens
cacucuauuuggcucauuu

SEQ ID NO: 7132 - RNA, 19 nt, Homo sapiens
agcagugcauguuaaagaa

SEQ ID NO: 7133 - RNA, 19 nt, Homo sapiens
gagcuugagucaggugaac

SEQ ID NO: 7134 - RNA, 19 nt, Homo sapiens
cuccaacucuuucucucaa

SEQ ID NO: 7135 - RNA, 19 nt, Homo sapiens
gcugucgaaaucaaucuuu

SEQ ID NO: 7136 - RNA, 19 nt, Homo sapiens
ugaaggugagcauacugua

SEQ ID NO: 7137 - RNA, 19 nt, Homo sapiens
ccagaggaacaucaaguca

SEQ ID NO: 7138 - RNA, 19 nt, Homo sapiens
aagccuccaucacucuauu

SEQ ID NO: 7139 - RNA, 19 nt, Homo sapiens
cuucugaugcugaggcuuu

SEQ ID NO: 7140 - RNA, 19 nt, Homo sapiens
gcuccaacucuuucucuca

SEQ ID NO: 7141 - RNA, 19 nt, Homo sapiens
acgaggaugcaaauuauau

SEQ ID NO: 7142 - RNA, 19 nt, Homo sapiens
caugugcuuauaugaauga

SEQ ID NO: 7143 - RNA, 19 nt, Homo sapiens
cgaggaugcaaauuauaug

SEQ ID NO: 7144 - RNA, 19 nt, Homo sapiens
gagcagccuucaggagaac

SEQ ID NO: 7145 - RNA, 19 nt, Homo sapiens
ccagugagcaugguucaag

SEQ ID NO: 7146 - RNA, 19 nt, Homo sapiens
gcuacacaugugcuuauau

SEQ ID NO: 7147 - RNA, 19 nt, Homo sapiens
cucucaauauuccugauuu

SEQ ID NO: 7148 - RNA, 19 nt, Homo sapiens
ugccucugccugagcauua

SEQ ID NO: 7149 - RNA, 19 nt, Homo sapiens
cauggaacgaggaugcaaa

SEQ ID NO: 7150 - RNA, 19 nt, Homo sapiens
cuucaggcacaauauuaaa

SEQ ID NO: 7151 - RNA, 19 nt, Homo sapiens
ccuucaggcacaauauuaa

SEQ ID NO: 7152 - RNA, 19 nt, Homo sapiens
ugucuucccugcuccaacu

SEQ ID NO: 7153 - RNA, 19 nt, Homo sapiens
gcagugcauguuaaagaag

SEQ ID NO: 7154 - RNA, 19 nt, Homo sapiens
gugagcaugguuccaguga

SEQ ID NO: 7155 - RNA, 19 nt, Homo sapiens
gaacgaggaugcaaauuau

SEQ ID NO: 7156 - RNA, 19 nt, Homo sapiens
gcucaaacauccuaucuuu

SEQ ID NO: 7157 - RNA, 19 nt, Homo sapiens
ggaacgaggaugcaaauua

SEQ ID NO: 7158 - RNA, 19 nt, Homo sapiens
gaacagguuucucuugcua

SEQ ID NO: 7159 - RNA, 19 nt, Homo sapiens
caaauuauaugcugucgaa

SEQ ID NO: 7160 - RNA, 19 nt, Homo sapiens
gagaacagccuuugaguga

SEQ ID NO: 7161 - RNA, 19 nt, Homo sapiens
gagaacaugugcccaucua

SEQ ID NO: 7162 - RNA, 19 nt, Homo sapiens
gaacaucaagucagccuaa

SEQ ID NO: 7163 - RNA, 19 nt, Homo sapiens
gaaccugcaucacucagaa

SEQ ID NO: 7164 - RNA, 19 nt, Homo sapiens
gaacauggcuccggugaac

SEQ ID NO: 7165 - RNA, 19 nt, Homo sapiens
gcucgcaguuugcuucaua

SEQ ID NO: 7166 - RNA, 19 nt, Homo sapiens
cauccuaucuuucuucuuc

SEQ ID NO: 7167 - RNA, 19 nt, Homo sapiens
gaacaugugcccaucuaug

SEQ ID NO: 7168 - RNA, 19 nt, Homo sapiens
ccaacucuuucucucaaua

SEQ ID NO: 7169 - RNA, 19 nt, Homo sapiens
gugcuuauaugaaugauca

SEQ ID NO: 7170 - RNA, 19 nt, Homo sapiens
cuacacaugugcuuauaug

SEQ ID NO: 7171 - RNA, 19 nt, Homo sapiens
caucaagucagccuaauga

SEQ ID NO: 7172 - RNA, 19 nt, Homo sapiens
gcuaaugagucuuuaucug

SEQ ID NO: 7173 - RNA, 19 nt, Homo sapiens
cacaugugcuuauaugaau

SEQ ID NO: 7174 - RNA, 19 nt, Homo sapiens
ccugggcccuugcuuguuu

SEQ ID NO: 7175 - RNA, 19 nt, Homo sapiens
gcaccaauuucaagcacau

SEQ ID NO: 7176 - RNA, 19 nt, Homo sapiens
uuaaauugcuacacaugug

SEQ ID NO: 7177 - RNA, 19 nt, Homo sapiens
ucaaacauccuaucuuucu

SEQ ID NO: 7178 - RNA, 19 nt, Homo sapiens
ggagagggaaccugcauca

SEQ ID NO: 7179 - RNA, 19 nt, Homo sapiens
ccauagaucaucaaacuuc

SEQ ID NO: 7180 - RNA, 19 nt, Homo sapiens
caaacauccuaucuuucuu

SEQ ID NO: 7181 - RNA, 19 nt, Homo sapiens
cagcagugcauguuaaaga

SEQ ID NO: 7182 - RNA, 19 nt, Homo sapiens
gaugaacagguuucucuug

SEQ ID NO: 7183 - RNA, 19 nt, Homo sapiens
cuucuucuauucaugcuuu

SEQ ID NO: 7184 - RNA, 19 nt, Homo sapiens
uauaugcugucgaaaucaa

SEQ ID NO: 7185 - RNA, 19 nt, Homo sapiens
acacaugugcuuauaugaa

SEQ ID NO: 7186 - RNA, 19 nt, Homo sapiens
ugagcagccuucaggagaa

SEQ ID NO: 7187 - RNA, 19 nt, Homo sapiens
cuacaggcacaauauuaaa

SEQ ID NO: 7188 - RNA, 19 nt, Homo sapiens
gaaggugagcauacuguag

SEQ ID NO: 7189 - RNA, 19 nt, Homo sapiens
aaauccagaugaacagguu

SEQ ID NO: 7190 - RNA, 19 nt, Homo sapiens
agguuucucuugcuaauga

SEQ ID NO: 7191 - RNA, 19 nt, Homo sapiens
gcccaucuaugaaccucuu

SEQ ID NO: 7192 - RNA, 19 nt, Homo sapiens
ggcuucaggugcaccaauu

SEQ ID NO: 7193 - RNA, 19 nt, Homo sapiens
cuccauagaucaucaaacu

SEQ ID NO: 7194 - RNA, 19 nt, Homo sapiens
ucccagcagugcauguuaa

SEQ ID NO: 7195 - RNA, 19 nt, Homo sapiens
ucaagggugugagaacaug

SEQ ID NO: 7196 - RNA, 19 nt, Homo sapiens
cagugcauguuaaagaaga

SEQ ID NO: 7197 - RNA, 19 nt, Homo sapiens
ucuacaggcacaauauuaa

SEQ ID NO: 7198 - RNA, 19 nt, Homo sapiens
cauagaucaucaaacuuca

SEQ ID NO: 7199 - RNA, 19 nt, Homo sapiens
ucacaugguuaaagcaaaa

SEQ ID NO: 7200 - RNA, 19 nt, Homo sapiens
gacugaacaugcugaaggu

SEQ ID NO: 7201 - RNA, 19 nt, Homo sapiens
caacucuuucucucaauau

SEQ ID NO: 7202 - RNA, 19 nt, Homo sapiens
gaaccucuucucccaugga

SEQ ID NO: 7203 - RNA, 19 nt, Homo sapiens
gcacaucuacaggcacaau

SEQ ID NO: 7204 - RNA, 19 nt, Homo sapiens
aaacauccuaucuuucuuc

SEQ ID NO: 7205 - RNA, 19 nt, Homo sapiens
caacaacugaccacaucug

SEQ ID NO: 7206 - RNA, 19 nt, Homo sapiens
auuauaugcugucgaaauc

SEQ ID NO: 7207 - RNA, 19 nt, Homo sapiens
caucuacaggcacaauauu

SEQ ID NO: 7208 - RNA, 19 nt, Homo sapiens
cagaugaacagguuucucu

SEQ ID NO: 7209 - RNA, 19 nt, Homo sapiens
aacaugugcccaucuauga

SEQ ID NO: 7210 - RNA, 19 nt, Homo sapiens
acagguuucucuugcuaau

SEQ ID NO: 7211 - RNA, 19 nt, Homo sapiens
uuuccuaaauccagaugaa

SEQ ID NO: 7212 - RNA, 19 nt, Homo sapiens
ggaaccugcaucacucaga

SEQ ID NO: 7213 - RNA, 19 nt, Homo sapiens
cacucuauuuggcucauuu

SEQ ID NO: 7214 - RNA, 19 nt, Homo sapiens
agcagugcauguuaaagaa

SEQ ID NO: 7215 - RNA, 19 nt, Homo sapiens
gagcuugagucaggugaac

SEQ ID NO: 7216 - RNA, 19 nt, Homo sapiens
cuccaacucuuucucucaa

SEQ ID NO: 7217 - RNA, 19 nt, Homo sapiens
gcugucgaaaucaaucuuu

SEQ ID NO: 7218 - RNA, 19 nt, Homo sapiens
ccagaggaacaucaaguca

SEQ ID NO: 7219 - RNA, 19 nt, Homo sapiens
ugaaggugagcauacugua

SEQ ID NO: 7220 - RNA, 19 nt, Homo sapiens
aagccuccaucacucuauu

SEQ ID NO: 7221 - RNA, 19 nt, Homo sapiens
ccaauuucaagcacaucua

SEQ ID NO: 7222 - RNA, 19 nt, Homo sapiens
gcuccaacucuuucucuca

SEQ ID NO: 7223 - RNA, 19 nt, Homo sapiens
acgaggaugcaaauuauau

SEQ ID NO: 7224 - RNA, 19 nt, Homo sapiens
caugugcuuauaugaauga

SEQ ID NO: 7225 - RNA, 19 nt, Homo sapiens
cgaggaugcaaauuauaug

SEQ ID NO: 7226 - RNA, 19 nt, Homo sapiens
gagcagccuucaggagaac

SEQ ID NO: 7227 - RNA, 19 nt, Homo sapiens
gcuacacaugugcuuauau

SEQ ID NO: 7228 - RNA, 19 nt, Homo sapiens
cucucaauauuccugauuu

SEQ ID NO: 7229 - RNA, 19 nt, Homo sapiens
ugccucugccugagcauua

SEQ ID NO: 7230 - RNA, 19 nt, Homo sapiens
cauggaacgaggaugcaaa

SEQ ID NO: 7231 - RNA, 19 nt, Homo sapiens
ugucuucccugcuccaacu

SEQ ID NO: 7232 - RNA, 19 nt, Homo sapiens
gcagugcauguuaaagaag

SEQ ID NO: 7233 - RNA, 19 nt, Homo sapiens
gaacgaggaugcaaauuau

SEQ ID NO: 7234 - RNA, 19 nt, Homo sapiens
gcucaaacauccuaucuuu

SEQ ID NO: 7235 - RNA, 19 nt, Homo sapiens
ggaacgaggaugcaaauua

SEQ ID NO: 7236 - RNA, 19 nt, Homo sapiens
gaacagguuucucuugcua

SEQ ID NO: 7237 - RNA, 19 nt, Homo sapiens
caaauuauaugcugucgaa

SEQ ID NO: 7238 - RNA, 19 nt, Homo sapiens
gagaacagccuuugaguga

SEQ ID NO: 7239 - RNA, 19 nt, Homo sapiens
gagaacaugugcccaucua

SEQ ID NO: 7240 - RNA, 19 nt, Homo sapiens
gaacaucaagucagccuaa

SEQ ID NO: 7241 - RNA, 19 nt, Homo sapiens
gaaccugcaucacucagaa

SEQ ID NO: 7242 - RNA, 19 nt, Homo sapiens
gaacauggcuccggugaac

SEQ ID NO: 7243 - RNA, 19 nt, Homo sapiens
gcucgcaguuugcuucaua

SEQ ID NO: 7244 - RNA, 19 nt, Homo sapiens
cauccuaucuuucuucuuc

SEQ ID NO: 7245 - RNA, 19 nt, Homo sapiens
gaacaugugcccaucuaug

SEQ ID NO: 7246 - RNA, 19 nt, Homo sapiens
ccaacucuuucucucaaua

SEQ ID NO: 7247 - RNA, 19 nt, Homo sapiens
gugcuuauaugaaugauca

SEQ ID NO: 7248 - RNA, 19 nt, Homo sapiens
cuacacaugugcuuauaug

SEQ ID NO: 7249 - RNA, 19 nt, Homo sapiens
caucaagucagccuaauga

SEQ ID NO: 7250 - RNA, 19 nt, Homo sapiens
gcuaaugagucuuuaucug

SEQ ID NO: 7251 - RNA, 19 nt, Homo sapiens
cacaugugcuuauaugaau

SEQ ID NO: 7252 - RNA, 19 nt, Homo sapiens
ccugggcccuugcuuguuu

SEQ ID NO: 7253 - RNA, 19 nt, Homo sapiens
gcaccaauuucaagcacau

SEQ ID NO: 7254 - RNA, 19 nt, Homo sapiens
uuaaauugcuacacaugug

SEQ ID NO: 7255 - RNA, 19 nt, Homo sapiens
ucaaacauccuaucuuucu

SEQ ID NO: 7256 - RNA, 19 nt, Homo sapiens
ggagagggaaccugcauca

SEQ ID NO: 7257 - RNA, 19 nt, Homo sapiens
ccauagaucaucaaacuuc

SEQ ID NO: 7258 - RNA, 19 nt, Homo sapiens
caaacauccuaucuuucuu

SEQ ID NO: 7259 - RNA, 19 nt, Homo sapiens
cagcagugcauguuaaaga

SEQ ID NO: 7260 - RNA, 19 nt, Homo sapiens
gaugaacagguuucucuug

SEQ ID NO: 7261 - RNA, 19 nt, Homo sapiens
cuucuucuauucaugcuuu

SEQ ID NO: 7262 - RNA, 19 nt, Homo sapiens
uauaugcugucgaaaucaa

SEQ ID NO: 7263 - RNA, 19 nt, Homo sapiens
acacaugugcuuauaugaa

SEQ ID NO: 7264 - RNA, 19 nt, Homo sapiens
ugagcagccuucaggagaa

SEQ ID NO: 7265 - RNA, 19 nt, Homo sapiens
cuacaggcacaauauuaaa

SEQ ID NO: 7266 - RNA, 19 nt, Homo sapiens
aaauccagaugaacagguu

SEQ ID NO: 7267 - RNA, 19 nt, Homo sapiens
agguuucucuugcuaauga

SEQ ID NO: 7268 - RNA, 19 nt, Homo sapiens
gcccaucuaugaaccucuu

SEQ ID NO: 7269 - RNA, 19 nt, Homo sapiens
ggcuucaggugcaccaauu

SEQ ID NO: 7270 - RNA, 19 nt, Homo sapiens
cuccauagaucaucaaacu

SEQ ID NO: 7271 - RNA, 19 nt, Homo sapiens
ucccagcagugcauguuaa

SEQ ID NO: 7272 - RNA, 19 nt, Homo sapiens
ucaagggugugagaacaug

SEQ ID NO: 7273 - RNA, 19 nt, Homo sapiens
cagugcauguuaaagaaga

SEQ ID NO: 7274 - RNA, 19 nt, Homo sapiens
ucuacaggcacaauauuaa

SEQ ID NO: 7275 - RNA, 19 nt, Homo sapiens
cauagaucaucaaacuuca

SEQ ID NO: 7276 - RNA, 19 nt, Homo sapiens
ucacaugguuaaagcaaaa

SEQ ID NO: 7277 - RNA, 19 nt, Homo sapiens
caacucuuucucucaauau

SEQ ID NO: 7278 - RNA, 19 nt, Homo sapiens
gaaccucuucucccaugga

SEQ ID NO: 7279 - RNA, 19 nt, Homo sapiens
gcacaucuacaggcacaau

SEQ ID NO: 7280 - RNA, 19 nt, Homo sapiens
aaacauccuaucuuucuuc

SEQ ID NO: 7281 - RNA, 19 nt, Homo sapiens
caacaacugaccacaucug

SEQ ID NO: 7282 - RNA, 19 nt, Homo sapiens
auuauaugcugucgaaauc

SEQ ID NO: 7283 - RNA, 19 nt, Homo sapiens
cagaugaacagguuucucu

SEQ ID NO: 7284 - RNA, 19 nt, Homo sapiens
caucuacaggcacaauauu

SEQ ID NO: 7285 - RNA, 19 nt, Homo sapiens
aacaugugcccaucuauga

SEQ ID NO: 7286 - RNA, 19 nt, Homo sapiens
uuuccuaaauccagaugaa

SEQ ID NO: 7287 - RNA, 19 nt, Homo sapiens
ggaaccugcaucacucaga

SEQ ID NO: 7288 - RNA, 19 nt, Homo sapiens
acagguuucucuugcuaau

SEQ ID NO: 7289 - RNA, 19 nt, Homo sapiens
cacucuauuuggcucauuu

SEQ ID NO: 7290 - RNA, 19 nt, Homo sapiens
agcagugcauguuaaagaa

SEQ ID NO: 7291 - RNA, 19 nt, Homo sapiens
gagcuugagucaggugaac

SEQ ID NO: 7292 - RNA, 19 nt, Homo sapiens
cuccaacucuuucucucaa

SEQ ID NO: 7293 - RNA, 19 nt, Homo sapiens
gcugucgaaaucaaucuuu

SEQ ID NO: 7294 - RNA, 19 nt, Homo sapiens
ccagaggaacaucaaguca

SEQ ID NO: 7295 - RNA, 19 nt, Homo sapiens
aagccuccaucacucuauu

SEQ ID NO: 7296 - RNA, 19 nt, Homo sapiens
ccaauuucaagcacaucua

SEQ ID NO: 7297 - RNA, 19 nt, Homo sapiens
gcuccaacucuuucucuca

SEQ ID NO: 7298 - RNA, 19 nt, Homo sapiens
acgaggaugcaaauuauau

SEQ ID NO: 7299 - RNA, 19 nt, Homo sapiens
caugugcuuauaugaauga

SEQ ID NO: 7300 - RNA, 19 nt, Homo sapiens
cgaggaugcaaauuauaug

SEQ ID NO: 7301 - RNA, 19 nt, Homo sapiens
gagcagccuucaggagaac

SEQ ID NO: 7302 - RNA, 19 nt, Homo sapiens
gcuacacaugugcuuauau

SEQ ID NO: 7303 - RNA, 19 nt, Homo sapiens
cucucaauauuccugauuu

SEQ ID NO: 7304 - RNA, 19 nt, Homo sapiens
ugccucugccugagcauua

SEQ ID NO: 7305 - RNA, 19 nt, Homo sapiens
cauggaacgaggaugcaaa

SEQ ID NO: 7306 - RNA, 19 nt, Homo sapiens
ugucuucccugcuccaacu

SEQ ID NO: 7307 - RNA, 19 nt, Homo sapiens
gcagugcauguuaaagaag

SEQ ID NO: 7308 - RNA, 19 nt, Homo sapiens
gaacgaggaugcaaauuau

SEQ ID NO: 7309 - RNA, 19 nt, Homo sapiens
gcucaaacauccuaucuuu

SEQ ID NO: 7310 - RNA, 19 nt, Homo sapiens
ggaacgaggaugcaaauua

SEQ ID NO: 7311 - RNA, 19 nt, Homo sapiens
gaacagguuucucuugcua

SEQ ID NO: 7312 - RNA, 19 nt, Homo sapiens
caaauuauaugcugucgaa

SEQ ID NO: 7313 - RNA, 19 nt, Homo sapiens
gagaacagccuuugaguga

SEQ ID NO: 7314 - RNA, 19 nt, Homo sapiens
gagaacaugugcccaucua

SEQ ID NO: 7315 - RNA, 19 nt, Homo sapiens
gaacaucaagucagccuaa

SEQ ID NO: 7316 - RNA, 19 nt, Homo sapiens
gaaccugcaucacucagaa

SEQ ID NO: 7317 - RNA, 19 nt, Homo sapiens
gaacauggcuccggugaac

SEQ ID NO: 7318 - RNA, 19 nt, Homo sapiens
gcucgcaguuugcuucaua

SEQ ID NO: 7319 - RNA, 19 nt, Homo sapiens
cauccuaucuuucuucuuc

SEQ ID NO: 7320 - RNA, 19 nt, Homo sapiens
gaacaugugcccaucuaug

SEQ ID NO: 7321 - RNA, 19 nt, Homo sapiens
ccaacucuuucucucaaua

SEQ ID NO: 7322 - RNA, 19 nt, Homo sapiens
gugcuuauaugaaugauca

SEQ ID NO: 7323 - RNA, 19 nt, Homo sapiens
cuacacaugugcuuauaug

SEQ ID NO: 7324 - RNA, 19 nt, Homo sapiens
caucaagucagccuaauga

SEQ ID NO: 7325 - RNA, 19 nt, Homo sapiens
gcuaaugagucuuuaucug

SEQ ID NO: 7326 - RNA, 19 nt, Homo sapiens
cacaugugcuuauaugaau

SEQ ID NO: 7327 - RNA, 19 nt, Homo sapiens
ccugggcccuugcuuguuu

SEQ ID NO: 7328 - RNA, 19 nt, Homo sapiens
uuaaauugcuacacaugug

SEQ ID NO: 7329 - RNA, 19 nt, Homo sapiens
ucaaacauccuaucuuucu

SEQ ID NO: 7330 - RNA, 19 nt, Homo sapiens
ggagagggaaccugcauca

SEQ ID NO: 7331 - RNA, 19 nt, Homo sapiens
ccauagaucaucaaacuuc

SEQ ID NO: 7332 - RNA, 19 nt, Homo sapiens
caaacauccuaucuuucuu

SEQ ID NO: 7333 - RNA, 19 nt, Homo sapiens
cagcagugcauguuaaaga

SEQ ID NO: 7334 - RNA, 19 nt, Homo sapiens
gaugaacagguuucucuug

SEQ ID NO: 7335 - RNA, 19 nt, Homo sapiens
cuucuucuauucaugcuuu

SEQ ID NO: 7336 - RNA, 19 nt, Homo sapiens
uauaugcugucgaaaucaa

SEQ ID NO: 7337 - RNA, 19 nt, Homo sapiens
acacaugugcuuauaugaa

SEQ ID NO: 7338 - RNA, 19 nt, Homo sapiens
ugagcagccuucaggagaa

SEQ ID NO: 7339 - RNA, 19 nt, Homo sapiens
aaauccagaugaacagguu

SEQ ID NO: 7340 - RNA, 19 nt, Homo sapiens
agguuucucuugcuaauga

SEQ ID NO: 7341 - RNA, 19 nt, Homo sapiens
gcccaucuaugaaccucuu

SEQ ID NO: 7342 - RNA, 19 nt, Homo sapiens
cuccauagaucaucaaacu

SEQ ID NO: 7343 - RNA, 19 nt, Homo sapiens
ucccagcagugcauguuaa

SEQ ID NO: 7344 - RNA, 19 nt, Homo sapiens
ucaagggugugagaacaug

SEQ ID NO: 7345 - RNA, 19 nt, Homo sapiens
cagugcauguuaaagaaga

SEQ ID NO: 7346 - RNA, 19 nt, Homo sapiens
cauagaucaucaaacuuca

SEQ ID NO: 7347 - RNA, 19 nt, Homo sapiens
ucacaugguuaaagcaaaa

SEQ ID NO: 7348 - RNA, 19 nt, Homo sapiens
caacucuuucucucaauau

SEQ ID NO: 7349 - RNA, 19 nt, Homo sapiens
gaaccucuucucccaugga

SEQ ID NO: 7350 - RNA, 19 nt, Homo sapiens
aaacauccuaucuuucuuc

SEQ ID NO: 7351 - RNA, 19 nt, Homo sapiens
caacaacugaccacaucug

SEQ ID NO: 7352 - RNA, 19 nt, Homo sapiens
auuauaugcugucgaaauc

SEQ ID NO: 7353 - RNA, 19 nt, Homo sapiens
cagaugaacagguuucucu

SEQ ID NO: 7354 - RNA, 19 nt, Homo sapiens
acagguuucucuugcuaau

SEQ ID NO: 7355 - RNA, 19 nt, Homo sapiens
aacaugugcccaucuauga

SEQ ID NO: 7356 - RNA, 19 nt, Homo sapiens
uuuccuaaauccagaugaa

SEQ ID NO: 7357 - RNA, 19 nt, Homo sapiens
ggaaccugcaucacucaga

SEQ ID NO: 7358 - RNA, 19 nt, Homo sapiens
cacucuauuuggcucauuu

SEQ ID NO: 7359 - RNA, 19 nt, Homo sapiens
agcagugcauguuaaagaa

SEQ ID NO: 7360 - RNA, 19 nt, Homo sapiens
gagcuugagucaggugaac

SEQ ID NO: 7361 - RNA, 19 nt, Homo sapiens
cuccaacucuuucucucaa

SEQ ID NO: 7362 - RNA, 19 nt, Homo sapiens
gcugucgaaaucaaucuuu

SEQ ID NO: 7363 - RNA, 19 nt, Homo sapiens
ccagaggaacaucaaguca

SEQ ID NO: 7364 - RNA, 19 nt, Homo sapiens
aagccuccaucacucuauu

SEQ ID NO: 7365 - RNA, 19 nt, Homo sapiens
gcuccaacucuuucucuca

SEQ ID NO: 7366 - RNA, 19 nt, Homo sapiens
acgaggaugcaaauuauau

SEQ ID NO: 7367 - RNA, 19 nt, Homo sapiens
caugugcuuauaugaauga

SEQ ID NO: 7368 - RNA, 19 nt, Homo sapiens
cgaggaugcaaauuauaug

SEQ ID NO: 7369 - RNA, 19 nt, Homo sapiens
gagcagccuucaggagaac

SEQ ID NO: 7370 - RNA, 19 nt, Homo sapiens
gcuacacaugugcuuauau

SEQ ID NO: 7371 - RNA, 19 nt, Homo sapiens
cucucaauauuccugauuu

SEQ ID NO: 7372 - RNA, 19 nt, Homo sapiens
ugccucugccugagcauua

SEQ ID NO: 7373 - RNA, 19 nt, Homo sapiens
cauggaacgaggaugcaaa

SEQ ID NO: 7374 - RNA, 19 nt, Homo sapiens
cuucaggcacaauauuaaa

SEQ ID NO: 7375 - RNA, 19 nt, Homo sapiens
ccuucaggcacaauauuaa

SEQ ID NO: 7376 - RNA, 19 nt, Homo sapiens
ugucuucccugcuccaacu

SEQ ID NO: 7377 - RNA, 19 nt, Homo sapiens
gcagugcauguuaaagaag

SEQ ID NO: 7378 - RNA, 19 nt, Homo sapiens
gaacgaggaugcaaauuau

SEQ ID NO: 7379 - RNA, 19 nt, Homo sapiens
gcucaaacauccuaucuuu

SEQ ID NO: 7380 - RNA, 19 nt, Homo sapiens
ggaacgaggaugcaaauua

SEQ ID NO: 7381 - RNA, 19 nt, Homo sapiens
gaacagguuucucuugcua

SEQ ID NO: 7382 - RNA, 19 nt, Homo sapiens
caaauuauaugcugucgaa

SEQ ID NO: 7383 - RNA, 19 nt, Homo sapiens
gagaacaugugcccaucua

SEQ ID NO: 7384 - RNA, 19 nt, Homo sapiens
gaacaucaagucagccuaa

SEQ ID NO: 7385 - RNA, 19 nt, Homo sapiens
gaaccugcaucacucagaa

SEQ ID NO: 7386 - RNA, 19 nt, Homo sapiens
gcucgcaguuugcuucaua

SEQ ID NO: 7387 - RNA, 19 nt, Homo sapiens
cauccuaucuuucuucuuc

SEQ ID NO: 7388 - RNA, 19 nt, Homo sapiens
gaacaugugcccaucuaug

SEQ ID NO: 7389 - RNA, 19 nt, Homo sapiens
ccaacucuuucucucaaua

SEQ ID NO: 7390 - RNA, 19 nt, Homo sapiens
gugcuuauaugaaugauca

SEQ ID NO: 7391 - RNA, 19 nt, Homo sapiens
cuacacaugugcuuauaug

SEQ ID NO: 7392 - RNA, 19 nt, Homo sapiens
caucaagucagccuaauga

SEQ ID NO: 7393 - RNA, 19 nt, Homo sapiens
gcuaaugagucuuuaucug

SEQ ID NO: 7394 - RNA, 19 nt, Homo sapiens
cacaugugcuuauaugaau

SEQ ID NO: 7395 - RNA, 19 nt, Homo sapiens
caacuuccaggcacaauau

SEQ ID NO: 7396 - RNA, 19 nt, Homo sapiens
gcaacuuccaggcacaaua

SEQ ID NO: 7397 - RNA, 19 nt, Homo sapiens
ccugggcccuugcuuguuu

SEQ ID NO: 7398 - RNA, 19 nt, Homo sapiens
uuaaauugcuacacaugug

SEQ ID NO: 7399 - RNA, 19 nt, Homo sapiens
ucaaacauccuaucuuucu

SEQ ID NO: 7400 - RNA, 19 nt, Homo sapiens
ggagagggaaccugcauca

SEQ ID NO: 7401 - RNA, 19 nt, Homo sapiens
ccauagaucaucaaacuuc

SEQ ID NO: 7402 - RNA, 19 nt, Homo sapiens
caaacauccuaucuuucuu

SEQ ID NO: 7403 - RNA, 19 nt, Homo sapiens
cagcagugcauguuaaaga

SEQ ID NO: 7404 - RNA, 19 nt, Homo sapiens
gaugaacagguuucucuug

SEQ ID NO: 7405 - RNA, 19 nt, Homo sapiens
cuucuucuauucaugcuuu

SEQ ID NO: 7406 - RNA, 19 nt, Homo sapiens
uauaugcugucgaaaucaa

SEQ ID NO: 7407 - RNA, 19 nt, Homo sapiens
acacaugugcuuauaugaa

SEQ ID NO: 7408 - RNA, 19 nt, Homo sapiens
ccaggcacaauauuaaauu

SEQ ID NO: 7409 - RNA, 19 nt, Homo sapiens
aaauccagaugaacagguu

SEQ ID NO: 7410 - RNA, 19 nt, Homo sapiens
agguuucucuugcuaauga

SEQ ID NO: 7411 - RNA, 19 nt, Homo sapiens
gcccaucuaugaaccucuu

SEQ ID NO: 7412 - RNA, 19 nt, Homo sapiens
cuccauagaucaucaaacu

SEQ ID NO: 7413 - RNA, 19 nt, Homo sapiens
ucccagcagugcauguuaa

SEQ ID NO: 7414 - RNA, 19 nt, Homo sapiens
ucaagggugugagaacaug

SEQ ID NO: 7415 - RNA, 19 nt, Homo sapiens
cagugcauguuaaagaaga

SEQ ID NO: 7416 - RNA, 19 nt, Homo sapiens
cauagaucaucaaacuuca

SEQ ID NO: 7417 - RNA, 19 nt, Homo sapiens
ucacaugguuaaagcaaaa

SEQ ID NO: 7418 - RNA, 19 nt, Homo sapiens
caacucuuucucucaauau

SEQ ID NO: 7419 - RNA, 19 nt, Homo sapiens
gaaccucuucucccaugga

SEQ ID NO: 7420 - RNA, 19 nt, Homo sapiens
aaacauccuaucuuucuuc

SEQ ID NO: 7421 - RNA, 19 nt, Homo sapiens
caacaacugaccacaucug

SEQ ID NO: 7422 - RNA, 19 nt, Homo sapiens
auuauaugcugucgaaauc

SEQ ID NO: 7423 - RNA, 19 nt, Homo sapiens
cagaugaacagguuucucu

SEQ ID NO: 7424 - RNA, 19 nt, Homo sapiens
acagguuucucuugcuaau

SEQ ID NO: 7425 - RNA, 19 nt, Homo sapiens
aacaugugcccaucuauga

SEQ ID NO: 7426 - RNA, 19 nt, Homo sapiens
uuuccuaaauccagaugaa

SEQ ID NO: 7427 - RNA, 19 nt, Homo sapiens
ggaaccugcaucacucaga

SEQ ID NO: 7428 - RNA, 19 nt, Homo sapiens
cacucuauuuggcucauuu

SEQ ID NO: 7429 - RNA, 19 nt, Homo sapiens
agcagugcauguuaaagaa

SEQ ID NO: 7430 - RNA, 19 nt, Homo sapiens
cuuccaggcacaauauuaa

SEQ ID NO: 7431 - RNA, 19 nt, Homo sapiens
cuccaacucuuucucucaa

SEQ ID NO: 7432 - RNA, 19 nt, Homo sapiens
gcugucgaaaucaaucuuu

SEQ ID NO: 7433 - RNA, 19 nt, Homo sapiens
ccagaggaacaucaaguca

SEQ ID NO: 7434 - RNA, 19 nt, Homo sapiens
aagccuccaucacucuauu

SEQ ID NO: 7435 - RNA, 19 nt, Homo sapiens
gcuccaacucuuucucuca

SEQ ID NO: 7436 - RNA, 19 nt, Homo sapiens
acgaggaugcaaauuauau

SEQ ID NO: 7437 - RNA, 19 nt, Homo sapiens
caugugcuuauaugaauga

SEQ ID NO: 7438 - RNA, 19 nt, Homo sapiens
cgaggaugcaaauuauaug

SEQ ID NO: 7439 - RNA, 19 nt, Homo sapiens
gcuacacaugugcuuauau

SEQ ID NO: 7440 - RNA, 19 nt, Homo sapiens
cucucaauauuccugauuu

SEQ ID NO: 7441 - RNA, 19 nt, Homo sapiens
ugccucugccugagcauua

SEQ ID NO: 7442 - RNA, 19 nt, Homo sapiens
cauggaacgaggaugcaaa

SEQ ID NO: 7443 - RNA, 19 nt, Homo sapiens
ugucuucccugcuccaacu

SEQ ID NO: 7444 - RNA, 19 nt, Homo sapiens
gcagugcauguuaaagaag

SEQ ID NO: 7445 - RNA, 19 nt, Homo sapiens
gaacgaggaugcaaauuau

SEQ ID NO: 7446 - RNA, 19 nt, Homo sapiens
gcucaaacauccuaucuuu

SEQ ID NO: 7447 - RNA, 19 nt, Homo sapiens
ggaacgaggaugcaaauua

SEQ ID NO: 7448 - RNA, 19 nt, Homo sapiens
gaacagguuucucuugcua

SEQ ID NO: 7449 - RNA, 19 nt, Homo sapiens
caaauuauaugcugucgaa

SEQ ID NO: 7450 - RNA, 19 nt, Homo sapiens
gagaacaugugcccaucua

SEQ ID NO: 7451 - RNA, 19 nt, Homo sapiens
gaacaucaagucagccuaa

SEQ ID NO: 7452 - RNA, 19 nt, Homo sapiens
gaaccugcaucacucagaa

SEQ ID NO: 7453 - RNA, 19 nt, Homo sapiens
gaacauggcuccggugaac

SEQ ID NO: 7454 - RNA, 19 nt, Homo sapiens
gcucgcaguuugcuucaua

SEQ ID NO: 7455 - RNA, 19 nt, Homo sapiens
cauccuaucuuucuucuuc

SEQ ID NO: 7456 - RNA, 19 nt, Homo sapiens
gaacaugugcccaucuaug

SEQ ID NO: 7457 - RNA, 19 nt, Homo sapiens
ccaacucuuucucucaaua

SEQ ID NO: 7458 - RNA, 19 nt, Homo sapiens
gugcuuauaugaaugauca

SEQ ID NO: 7459 - RNA, 19 nt, Homo sapiens
cuacacaugugcuuauaug

SEQ ID NO: 7460 - RNA, 19 nt, Homo sapiens
caucaagucagccuaauga

SEQ ID NO: 7461 - RNA, 19 nt, Homo sapiens
gcuaaugagucuuuaucug

SEQ ID NO: 7462 - RNA, 19 nt, Homo sapiens
cacaugugcuuauaugaau

SEQ ID NO: 7463 - RNA, 19 nt, Homo sapiens
ccugggcccuugcuuguuu

SEQ ID NO: 7464 - RNA, 19 nt, Homo sapiens
gcaccaauuucaagcacau

SEQ ID NO: 7465 - RNA, 19 nt, Homo sapiens
uuaaauugcuacacaugug

SEQ ID NO: 7466 - RNA, 19 nt, Homo sapiens
ucaaacauccuaucuuucu

SEQ ID NO: 7467 - RNA, 19 nt, Homo sapiens
ggagagggaaccugcauca

SEQ ID NO: 7468 - RNA, 19 nt, Homo sapiens
ccauagaucaucaaacuuc

SEQ ID NO: 7469 - RNA, 19 nt, Homo sapiens
caaacauccuaucuuucuu

SEQ ID NO: 7470 - RNA, 19 nt, Homo sapiens
cagcagugcauguuaaaga

SEQ ID NO: 7471 - RNA, 19 nt, Homo sapiens
gaugaacagguuucucuug

SEQ ID NO: 7472 - RNA, 19 nt, Homo sapiens
cuucuucuauucaugcuuu

SEQ ID NO: 7473 - RNA, 19 nt, Homo sapiens
uauaugcugucgaaaucaa

SEQ ID NO: 7474 - RNA, 19 nt, Homo sapiens
acacaugugcuuauaugaa

SEQ ID NO: 7475 - RNA, 19 nt, Homo sapiens
cuacaggcacaauauuaaa

SEQ ID NO: 7476 - RNA, 19 nt, Homo sapiens
aaauccagaugaacagguu

SEQ ID NO: 7477 - RNA, 19 nt, Homo sapiens
agguuucucuugcuaauga

SEQ ID NO: 7478 - RNA, 19 nt, Homo sapiens
gcccaucuaugaaccucuu

SEQ ID NO: 7479 - RNA, 19 nt, Homo sapiens
ggcuucaggugcaccaauu

SEQ ID NO: 7480 - RNA, 19 nt, Homo sapiens
cuccauagaucaucaaacu

SEQ ID NO: 7481 - RNA, 19 nt, Homo sapiens
ucccagcagugcauguuaa

SEQ ID NO: 7482 - RNA, 19 nt, Homo sapiens
ucaagggugugagaacaug

SEQ ID NO: 7483 - RNA, 19 nt, Homo sapiens
cagugcauguuaaagaaga

SEQ ID NO: 7484 - RNA, 19 nt, Homo sapiens
ucuacaggcacaauauuaa

SEQ ID NO: 7485 - RNA, 19 nt, Homo sapiens
cauagaucaucaaacuuca

SEQ ID NO: 7486 - RNA, 19 nt, Homo sapiens
ucacaugguuaaagcaaaa

SEQ ID NO: 7487 - RNA, 19 nt, Homo sapiens
caacucuuucucucaauau

SEQ ID NO: 7488 - RNA, 19 nt, Homo sapiens
gaaccucuucucccaugga

SEQ ID NO: 7489 - RNA, 19 nt, Homo sapiens
gcacaucuacaggcacaau

SEQ ID NO: 7490 - RNA, 19 nt, Homo sapiens
aaacauccuaucuuucuuc

SEQ ID NO: 7491 - RNA, 19 nt, Homo sapiens
caacaacugaccacaucug

SEQ ID NO: 7492 - RNA, 19 nt, Homo sapiens
auuauaugcugucgaaauc

SEQ ID NO: 7493 - RNA, 19 nt, Homo sapiens
caucuacaggcacaauauu

SEQ ID NO: 7494 - RNA, 19 nt, Homo sapiens
cagaugaacagguuucucu

SEQ ID NO: 7495 - RNA, 19 nt, Homo sapiens
acagguuucucuugcuaau

SEQ ID NO: 7496 - RNA, 19 nt, Homo sapiens
aacaugugcccaucuauga

SEQ ID NO: 7497 - RNA, 19 nt, Homo sapiens
uuuccuaaauccagaugaa

SEQ ID NO: 7498 - RNA, 19 nt, Homo sapiens
ggaaccugcaucacucaga

SEQ ID NO: 7499 - RNA, 19 nt, Homo sapiens
cacucuauuuggcucauuu

SEQ ID NO: 7500 - RNA, 19 nt, Homo sapiens
agcagugcauguuaaagaa

SEQ ID NO: 7501 - RNA, 19 nt, Homo sapiens
cuccaacucuuucucucaa

SEQ ID NO: 7502 - RNA, 19 nt, Homo sapiens
gcugucgaaaucaaucuuu

SEQ ID NO: 7503 - RNA, 19 nt, Homo sapiens
ucagcaacuuccaggugaa

SEQ ID NO: 7504 - RNA, 19 nt, Homo sapiens
ccagaggaacaucaaguca

SEQ ID NO: 7505 - RNA, 19 nt, Homo sapiens
aagccuccaucacucuauu

SEQ ID NO: 7506 - RNA, 19 nt, Homo sapiens
ccaauuucaagcacaucua

SEQ ID NO: 7507 - RNA, 19 nt, Homo sapiens
gcuccaacucuuucucuca

SEQ ID NO: 7508 - RNA, 19 nt, Homo sapiens
acgaggaugcaaauuauau

SEQ ID NO: 7509 - RNA, 19 nt, Homo sapiens
caugugcuuauaugaauga

SEQ ID NO: 7510 - RNA, 19 nt, Homo sapiens
cgaggaugcaaauuauaug

SEQ ID NO: 7511 - RNA, 19 nt, Homo sapiens
gcuacacaugugcuuauau

SEQ ID NO: 7512 - RNA, 19 nt, Homo sapiens
cucucaauauuccugauuu

SEQ ID NO: 7513 - RNA, 19 nt, Homo sapiens
ugccucugccugagcauua

SEQ ID NO: 7514 - RNA, 19 nt, Homo sapiens
cauggaacgaggaugcaaa

SEQ ID NO: 7515 - RNA, 19 nt, Homo sapiens
ugucuucccugcuccaacu

SEQ ID NO: 7516 - RNA, 19 nt, Homo sapiens
gcagugcauguuaaagaag

SEQ ID NO: 7517 - RNA, 19 nt, Homo sapiens
gaacgaggaugcaaauuau

SEQ ID NO: 7518 - RNA, 19 nt, Homo sapiens
gcucaaacauccuaucuuu

SEQ ID NO: 7519 - RNA, 19 nt, Homo sapiens
ggaacgaggaugcaaauua

SEQ ID NO: 7520 - RNA, 19 nt, Homo sapiens
gaacagguuucucuugcua

SEQ ID NO: 7521 - RNA, 19 nt, Homo sapiens
caaauuauaugcugucgaa

SEQ ID NO: 7522 - RNA, 19 nt, Homo sapiens
gagaacaugugcccaucua

SEQ ID NO: 7523 - RNA, 19 nt, Homo sapiens
gaacaucaagucagccuaa

SEQ ID NO: 7524 - RNA, 19 nt, Homo sapiens
gaaccugcaucacucagaa

SEQ ID NO: 7525 - RNA, 19 nt, Homo sapiens
gcucgcaguuugcuucaua

SEQ ID NO: 7526 - RNA, 19 nt, Homo sapiens
cauccuaucuuucuucuuc

SEQ ID NO: 7527 - RNA, 19 nt, Homo sapiens
gaacaugugcccaucuaug

SEQ ID NO: 7528 - RNA, 19 nt, Homo sapiens
ccaacucuuucucucaaua

SEQ ID NO: 7529 - RNA, 19 nt, Homo sapiens
gugcuuauaugaaugauca

SEQ ID NO: 7530 - RNA, 19 nt, Homo sapiens
cuacacaugugcuuauaug

SEQ ID NO: 7531 - RNA, 19 nt, Homo sapiens
caucaagucagccuaauga

SEQ ID NO: 7532 - RNA, 19 nt, Homo sapiens
gcuaaugagucuuuaucug

SEQ ID NO: 7533 - RNA, 19 nt, Homo sapiens
cacaugugcuuauaugaau

SEQ ID NO: 7534 - RNA, 19 nt, Homo sapiens
ccugggcccuugcuuguuu

SEQ ID NO: 7535 - RNA, 19 nt, Homo sapiens
gcaccaauuucaagcacau

SEQ ID NO: 7536 - RNA, 19 nt, Homo sapiens
uuaaauugcuacacaugug

SEQ ID NO: 7537 - RNA, 19 nt, Homo sapiens
ucaaacauccuaucuuucu

SEQ ID NO: 7538 - RNA, 19 nt, Homo sapiens
ggagagggaaccugcauca

SEQ ID NO: 7539 - RNA, 19 nt, Homo sapiens
ccauagaucaucaaacuuc

SEQ ID NO: 7540 - RNA, 19 nt, Homo sapiens
caaacauccuaucuuucuu

SEQ ID NO: 7541 - RNA, 19 nt, Homo sapiens
cagcagugcauguuaaaga

SEQ ID NO: 7542 - RNA, 19 nt, Homo sapiens
gaugaacagguuucucuug

SEQ ID NO: 7543 - RNA, 19 nt, Homo sapiens
cuucuucuauucaugcuuu

SEQ ID NO: 7544 - RNA, 19 nt, Homo sapiens
uauaugcugucgaaaucaa

SEQ ID NO: 7545 - RNA, 19 nt, Homo sapiens
acacaugugcuuauaugaa

SEQ ID NO: 7546 - RNA, 19 nt, Homo sapiens
cuacaggcacaauauuaaa

SEQ ID NO: 7547 - RNA, 19 nt, Homo sapiens
gaaggugagcauacuguag

SEQ ID NO: 7548 - RNA, 19 nt, Homo sapiens
aaauccagaugaacagguu

SEQ ID NO: 7549 - RNA, 19 nt, Homo sapiens
agguuucucuugcuaauga

SEQ ID NO: 7550 - RNA, 19 nt, Homo sapiens
gcccaucuaugaaccucuu

SEQ ID NO: 7551 - RNA, 19 nt, Homo sapiens
ggcuucaggugcaccaauu

SEQ ID NO: 7552 - RNA, 19 nt, Homo sapiens
cuccauagaucaucaaacu

SEQ ID NO: 7553 - RNA, 19 nt, Homo sapiens
ucccagcagugcauguuaa

SEQ ID NO: 7554 - RNA, 19 nt, Homo sapiens
ucaagggugugagaacaug

SEQ ID NO: 7555 - RNA, 19 nt, Homo sapiens
cagugcauguuaaagaaga

SEQ ID NO: 7556 - RNA, 19 nt, Homo sapiens
ucuacaggcacaauauuaa

SEQ ID NO: 7557 - RNA, 19 nt, Homo sapiens
cauagaucaucaaacuuca

SEQ ID NO: 7558 - RNA, 19 nt, Homo sapiens
ucacaugguuaaagcaaaa

SEQ ID NO: 7559 - RNA, 19 nt, Homo sapiens
gacugaacaugcugaaggu

SEQ ID NO: 7560 - RNA, 19 nt, Homo sapiens
caacucuuucucucaauau

SEQ ID NO: 7561 - RNA, 19 nt, Homo sapiens
gaaccucuucucccaugga

SEQ ID NO: 7562 - RNA, 19 nt, Homo sapiens
gcacaucuacaggcacaau

SEQ ID NO: 7563 - RNA, 19 nt, Homo sapiens
aaacauccuaucuuucuuc

SEQ ID NO: 7564 - RNA, 19 nt, Homo sapiens
caacaacugaccacaucug

SEQ ID NO: 7565 - RNA, 19 nt, Homo sapiens
auuauaugcugucgaaauc

SEQ ID NO: 7566 - RNA, 19 nt, Homo sapiens
caucuacaggcacaauauu

SEQ ID NO: 7567 - RNA, 19 nt, Homo sapiens
cagaugaacagguuucucu

SEQ ID NO: 7568 - RNA, 19 nt, Homo sapiens
acagguuucucuugcuaau

SEQ ID NO: 7569 - RNA, 19 nt, Homo sapiens
uuuccuaaauccagaugaa

SEQ ID NO: 7570 - RNA, 19 nt, Homo sapiens
aacaugugcccaucuauga

SEQ ID NO: 7571 - RNA, 19 nt, Homo sapiens
ggaaccugcaucacucaga

SEQ ID NO: 7572 - RNA, 19 nt, Homo sapiens
cacucuauuuggcucauuu

SEQ ID NO: 7573 - RNA, 19 nt, Homo sapiens
agcagugcauguuaaagaa

SEQ ID NO: 7574 - RNA, 19 nt, Homo sapiens
cuccaacucuuucucucaa

SEQ ID NO: 7575 - RNA, 19 nt, Homo sapiens
gcugucgaaaucaaucuuu

SEQ ID NO: 7576 - RNA, 19 nt, Homo sapiens
ugaaggugagcauacugua

SEQ ID NO: 7577 - RNA, 19 nt, Homo sapiens
ccagaggaacaucaaguca

SEQ ID NO: 7578 - RNA, 19 nt, Homo sapiens
aagccuccaucacucuauu

SEQ ID NO: 7579 - RNA, 19 nt, Homo sapiens
ccaauuucaagcacaucua

SEQ ID NO: 7580 - RNA, 19 nt, Homo sapiens
gcuccaacucuuucucuca

SEQ ID NO: 7581 - RNA, 19 nt, Homo sapiens
acgaggaugcaaauuauau

SEQ ID NO: 7582 - RNA, 19 nt, Homo sapiens
caugugcuuauaugaauga

SEQ ID NO: 7583 - RNA, 19 nt, Homo sapiens
cgaggaugcaaauuauaug

SEQ ID NO: 7584 - RNA, 19 nt, Homo sapiens
gcuacacaugugcuuauau

SEQ ID NO: 7585 - RNA, 19 nt, Homo sapiens
cucucaauauuccugauuu

SEQ ID NO: 7586 - RNA, 19 nt, Homo sapiens
ugccucugccugagcauua

SEQ ID NO: 7587 - RNA, 19 nt, Homo sapiens
cauggaacgaggaugcaaa

SEQ ID NO: 7588 - RNA, 19 nt, Homo sapiens
ugucuucccugcuccaacu

SEQ ID NO: 7589 - RNA, 19 nt, Homo sapiens
gcagugcauguuaaagaag

SEQ ID NO: 7590 - RNA, 19 nt, Homo sapiens
gaacgaggaugcaaauuau

SEQ ID NO: 7591 - RNA, 19 nt, Homo sapiens
gcucaaacauccuaucuuu

SEQ ID NO: 7592 - RNA, 19 nt, Homo sapiens
ggaacgaggaugcaaauua

SEQ ID NO: 7593 - RNA, 19 nt, Homo sapiens
gaacagguuucucuugcua

SEQ ID NO: 7594 - RNA, 19 nt, Homo sapiens
caaauuauaugcugucgaa

SEQ ID NO: 7595 - RNA, 19 nt, Homo sapiens
gagaacagccuuugaguga

SEQ ID NO: 7596 - RNA, 19 nt, Homo sapiens
gagaacaugugcccaucua

SEQ ID NO: 7597 - RNA, 19 nt, Homo sapiens
gaacaucaagucagccuaa

SEQ ID NO: 7598 - RNA, 19 nt, Homo sapiens
gaacauggcuccggugaac

SEQ ID NO: 7599 - RNA, 19 nt, Homo sapiens
gcucgcaguuugcuucaua

SEQ ID NO: 7600 - RNA, 19 nt, Homo sapiens
cauccuaucuuucuucuuc

SEQ ID NO: 7601 - RNA, 19 nt, Homo sapiens
gaacaugugcccaucuaug

SEQ ID NO: 7602 - RNA, 19 nt, Homo sapiens
ccaacucuuucucucaaua

SEQ ID NO: 7603 - RNA, 19 nt, Homo sapiens
caucaagucagccuaauga

SEQ ID NO: 7604 - RNA, 19 nt, Homo sapiens
gcuaaugagucuuuaucug

SEQ ID NO: 7605 - RNA, 19 nt, Homo sapiens
ccugggcccuugcuuguuu

SEQ ID NO: 7606 - RNA, 19 nt, Homo sapiens
gcaccaauuucaagcacau

SEQ ID NO: 7607 - RNA, 19 nt, Homo sapiens
ucaaacauccuaucuuucu

SEQ ID NO: 7608 - RNA, 19 nt, Homo sapiens
ccauagaucaucaaacuuc

SEQ ID NO: 7609 - RNA, 19 nt, Homo sapiens
caaacauccuaucuuucuu

SEQ ID NO: 7610 - RNA, 19 nt, Homo sapiens
gaugaacagguuucucuug

SEQ ID NO: 7611 - RNA, 19 nt, Homo sapiens
cuucuucuauucaugcuuu

SEQ ID NO: 7612 - RNA, 19 nt, Homo sapiens
uauaugcugucgaaaucaa

SEQ ID NO: 7613 - RNA, 19 nt, Homo sapiens
ugagcagccuucaggagaa

SEQ ID NO: 7614 - RNA, 19 nt, Homo sapiens
agguuucucuugcuaauga

SEQ ID NO: 7615 - RNA, 19 nt, Homo sapiens
aaauccagaugaacagguu

SEQ ID NO: 7616 - RNA, 19 nt, Homo sapiens
gcccaucuaugaaccucuu

SEQ ID NO: 7617 - RNA, 19 nt, Homo sapiens
gcacaucuacagguggaaa

SEQ ID NO: 7618 - RNA, 19 nt, Homo sapiens
ggcuucaggugcaccaauu

SEQ ID NO: 7619 - RNA, 19 nt, Homo sapiens
cuccauagaucaucaaacu

SEQ ID NO: 7620 - RNA, 19 nt, Homo sapiens
ucaagggugugagaacaug

SEQ ID NO: 7621 - RNA, 19 nt, Homo sapiens
cauagaucaucaaacuuca

SEQ ID NO: 7622 - RNA, 19 nt, Homo sapiens
ucacaugguuaaagcaaaa

SEQ ID NO: 7623 - RNA, 19 nt, Homo sapiens
caacucuuucucucaauau

SEQ ID NO: 7624 - RNA, 19 nt, Homo sapiens
gaaccucuucucccaugga

SEQ ID NO: 7625 - RNA, 19 nt, Homo sapiens
aaacauccuaucuuucuuc

SEQ ID NO: 7626 - RNA, 19 nt, Homo sapiens
cagaugaacagguuucucu

SEQ ID NO: 7627 - RNA, 19 nt, Homo sapiens
caacaacugaccacaucug

SEQ ID NO: 7628 - RNA, 19 nt, Homo sapiens
auuauaugcugucgaaauc

SEQ ID NO: 7629 - RNA, 19 nt, Homo sapiens
uuuccuaaauccagaugaa

SEQ ID NO: 7630 - RNA, 19 nt, Homo sapiens
aacaugugcccaucuauga

SEQ ID NO: 7631 - RNA, 19 nt, Homo sapiens
acagguuucucuugcuaau

SEQ ID NO: 7632 - RNA, 19 nt, Homo sapiens
cacucuauuuggcucauuu

SEQ ID NO: 7633 - RNA, 19 nt, Homo sapiens
gagcuugagucaggugaac

SEQ ID NO: 7634 - RNA, 19 nt, Homo sapiens
cuccaacucuuucucucaa

SEQ ID NO: 7635 - RNA, 19 nt, Homo sapiens
gcugucgaaaucaaucuuu

SEQ ID NO: 7636 - RNA, 19 nt, Homo sapiens
ccagaggaacaucaaguca

SEQ ID NO: 7637 - RNA, 19 nt, Homo sapiens
aagccuccaucacucuauu

SEQ ID NO: 7638 - RNA, 19 nt, Homo sapiens
ccaauuucaagcacaucua

SEQ ID NO: 7639 - RNA, 19 nt, Homo sapiens
gcuccaacucuuucucuca

SEQ ID NO: 7640 - RNA, 19 nt, Homo sapiens
acgaggaugcaaauuauau

SEQ ID NO: 7641 - RNA, 19 nt, Homo sapiens
cgaggaugcaaauuauaug

SEQ ID NO: 7642 - RNA, 19 nt, Homo sapiens
gagcagccuucaggagaac

SEQ ID NO: 7643 - RNA, 19 nt, Homo sapiens
cucucaauauuccugauuu

SEQ ID NO: 7644 - RNA, 19 nt, Homo sapiens
ugccucugccugagcauua

SEQ ID NO: 7645 - RNA, 19 nt, Homo sapiens
cauggaacgaggaugcaaa

SEQ ID NO: 7646 - RNA, 19 nt, Homo sapiens
ugucuucccugcuccaacu

SEQ ID NO: 7647 - RNA, 19 nt, Homo sapiens
gaacgaggaugcaaauuau

SEQ ID NO: 7648 - RNA, 19 nt, Homo sapiens
gcucaaacauccuaucuuu

SEQ ID NO: 7649 - RNA, 19 nt, Homo sapiens
ggaacgaggaugcaaauua

SEQ ID NO: 7650 - RNA, 19 nt, Homo sapiens
gaacagguuucucuugcua

SEQ ID NO: 7651 - RNA, 19 nt, Homo sapiens
caaauuauaugcugucgaa

SEQ ID NO: 7652 - RNA, 19 nt, Homo sapiens
gagaacaugugcccaucua

SEQ ID NO: 7653 - RNA, 19 nt, Homo sapiens
gaacaucaagucagccuaa

SEQ ID NO: 7654 - RNA, 19 nt, Homo sapiens
gaaccugcaucacucagaa

SEQ ID NO: 7655 - RNA, 19 nt, Homo sapiens
gcucgcaguuugcuucaua

SEQ ID NO: 7656 - RNA, 19 nt, Homo sapiens
cauccuaucuuucuucuuc

SEQ ID NO: 7657 - RNA, 19 nt, Homo sapiens
gaacaugugcccaucuaug

SEQ ID NO: 7658 - RNA, 19 nt, Homo sapiens
ccaacucuuucucucaaua

SEQ ID NO: 7659 - RNA, 19 nt, Homo sapiens
gugcuuauaugaaugauca

SEQ ID NO: 7660 - RNA, 19 nt, Homo sapiens
cuacacaugugcuuauaug

SEQ ID NO: 7661 - RNA, 19 nt, Homo sapiens
caucaagucagccuaauga

SEQ ID NO: 7662 - RNA, 19 nt, Homo sapiens
gcuaaugagucuuuaucug

SEQ ID NO: 7663 - RNA, 19 nt, Homo sapiens
cacaugugcuuauaugaau

SEQ ID NO: 7664 - RNA, 19 nt, Homo sapiens
ccugggcccuugcuuguuu

SEQ ID NO: 7665 - RNA, 19 nt, Homo sapiens
gcaccaauuucaagcacau

SEQ ID NO: 7666 - RNA, 19 nt, Homo sapiens
uuaaauugcuacacaugug

SEQ ID NO: 7667 - RNA, 19 nt, Homo sapiens
ucaaacauccuaucuuucu

SEQ ID NO: 7668 - RNA, 19 nt, Homo sapiens
ggagagggaaccugcauca

SEQ ID NO: 7669 - RNA, 19 nt, Homo sapiens
ccauagaucaucaaacuuc

SEQ ID NO: 7670 - RNA, 19 nt, Homo sapiens
caaacauccuaucuuucuu

SEQ ID NO: 7671 - RNA, 19 nt, Homo sapiens
cagcagugcauguuaaaga

SEQ ID NO: 7672 - RNA, 19 nt, Homo sapiens
gaugaacagguuucucuug

SEQ ID NO: 7673 - RNA, 19 nt, Homo sapiens
cuucuucuauucaugcuuu

SEQ ID NO: 7674 - RNA, 19 nt, Homo sapiens
uauaugcugucgaaaucaa

SEQ ID NO: 7675 - RNA, 19 nt, Homo sapiens
acacaugugcuuauaugaa

SEQ ID NO: 7676 - RNA, 19 nt, Homo sapiens
ugagcagccuucaggagaa

SEQ ID NO: 7677 - RNA, 19 nt, Homo sapiens
cuacaggcacaauauuaaa

SEQ ID NO: 7678 - RNA, 19 nt, Homo sapiens
aaauccagaugaacagguu

SEQ ID NO: 7679 - RNA, 19 nt, Homo sapiens
agguuucucuugcuaauga

SEQ ID NO: 7680 - RNA, 19 nt, Homo sapiens
gcccaucuaugaaccucuu

SEQ ID NO: 7681 - RNA, 19 nt, Homo sapiens
ggcuucaggugcaccaauu

SEQ ID NO: 7682 - RNA, 19 nt, Homo sapiens
cuccauagaucaucaaacu

SEQ ID NO: 7683 - RNA, 19 nt, Homo sapiens
ucccagcagugcauguuaa

SEQ ID NO: 7684 - RNA, 19 nt, Homo sapiens
ucaagggugugagaacaug

SEQ ID NO: 7685 - RNA, 19 nt, Homo sapiens
cagugcauguuaaagaaga

SEQ ID NO: 7686 - RNA, 19 nt, Homo sapiens
ucuacaggcacaauauuaa

SEQ ID NO: 7687 - RNA, 19 nt, Homo sapiens
cauagaucaucaaacuuca

SEQ ID NO: 7688 - RNA, 19 nt, Homo sapiens
ucacaugguuaaagcaaaa

SEQ ID NO: 7689 - RNA, 19 nt, Homo sapiens
caacucuuucucucaauau

SEQ ID NO: 7690 - RNA, 19 nt, Homo sapiens
gaaccucuucucccaugga

SEQ ID NO: 7691 - RNA, 19 nt, Homo sapiens
gcacaucuacaggcacaau

SEQ ID NO: 7692 - RNA, 19 nt, Homo sapiens
aaacauccuaucuuucuuc

SEQ ID NO: 7693 - RNA, 19 nt, Homo sapiens
caacaacugaccacaucug

SEQ ID NO: 7694 - RNA, 19 nt, Homo sapiens
auuauaugcugucgaaauc

SEQ ID NO: 7695 - RNA, 19 nt, Homo sapiens
caucuacaggcacaauauu

SEQ ID NO: 7696 - RNA, 19 nt, Homo sapiens
cagaugaacagguuucucu

SEQ ID NO: 7697 - RNA, 19 nt, Homo sapiens
acagguuucucuugcuaau

SEQ ID NO: 7698 - RNA, 19 nt, Homo sapiens
uuuccuaaauccagaugaa

SEQ ID NO: 7699 - RNA, 19 nt, Homo sapiens
aacaugugcccaucuauga

SEQ ID NO: 7700 - RNA, 19 nt, Homo sapiens
ggaaccugcaucacucaga

SEQ ID NO: 7701 - RNA, 19 nt, Homo sapiens
cacucuauuuggcucauuu

SEQ ID NO: 7702 - RNA, 19 nt, Homo sapiens
agcagugcauguuaaagaa

SEQ ID NO: 7703 - RNA, 19 nt, Homo sapiens
cuccaacucuuucucucaa

SEQ ID NO: 7704 - RNA, 19 nt, Homo sapiens
gcugucgaaaucaaucuuu

SEQ ID NO: 7705 - RNA, 19 nt, Homo sapiens
ccagaggaacaucaaguca

SEQ ID NO: 7706 - RNA, 19 nt, Homo sapiens
aagccuccaucacucuauu

SEQ ID NO: 7707 - RNA, 19 nt, Homo sapiens
ccaauuucaagcacaucua

SEQ ID NO: 7708 - RNA, 19 nt, Homo sapiens
gcuccaacucuuucucuca

SEQ ID NO: 7709 - RNA, 19 nt, Homo sapiens
acgaggaugcaaauuauau

SEQ ID NO: 7710 - RNA, 19 nt, Homo sapiens
caugugcuuauaugaauga

SEQ ID NO: 7711 - RNA, 19 nt, Homo sapiens
cgaggaugcaaauuauaug

SEQ ID NO: 7712 - RNA, 19 nt, Homo sapiens
gagcagccuucaggagaac

SEQ ID NO: 7713 - RNA, 19 nt, Homo sapiens
gcuacacaugugcuuauau

SEQ ID NO: 7714 - RNA, 19 nt, Homo sapiens
cucucaauauuccugauuu

SEQ ID NO: 7715 - RNA, 19 nt, Homo sapiens
ugccucugccugagcauua

SEQ ID NO: 7716 - RNA, 19 nt, Homo sapiens
cauggaacgaggaugcaaa

SEQ ID NO: 7717 - RNA, 19 nt, Homo sapiens
ugucuucccugcuccaacu

SEQ ID NO: 7718 - RNA, 19 nt, Homo sapiens
gcagugcauguuaaagaag

SEQ ID NO: 7719 - RNA, 19 nt, Homo sapiens
gaacgaggaugcaaauuau

SEQ ID NO: 7720 - RNA, 19 nt, Homo sapiens
gcucaaacauccuaucuuu

SEQ ID NO: 7721 - RNA, 19 nt, Homo sapiens
ggaacgaggaugcaaauua

SEQ ID NO: 7722 - RNA, 19 nt, Homo sapiens
gaacagguuucucuugcua

SEQ ID NO: 7723 - RNA, 19 nt, Homo sapiens
caaauuauaugcugucgaa

SEQ ID NO: 7724 - RNA, 19 nt, Homo sapiens
gagaacaugugcccaucua

SEQ ID NO: 7725 - RNA, 19 nt, Homo sapiens
gaacaucaagucagccuaa

SEQ ID NO: 7726 - RNA, 19 nt, Homo sapiens
gcucgcaguuugcuucaua

SEQ ID NO: 7727 - RNA, 19 nt, Homo sapiens
cauccuaucuuucuucuuc

SEQ ID NO: 7728 - RNA, 19 nt, Homo sapiens
gaacaugugcccaucuaug

SEQ ID NO: 7729 - RNA, 19 nt, Homo sapiens
ccaacucuuucucucaaua

SEQ ID NO: 7730 - RNA, 19 nt, Homo sapiens
caucaagucagccuaauga

SEQ ID NO: 7731 - RNA, 19 nt, Homo sapiens
gcuaaugagucuuuaucug

SEQ ID NO: 7732 - RNA, 19 nt, Homo sapiens
ccugggcccuugcuuguuu

SEQ ID NO: 7733 - RNA, 19 nt, Homo sapiens
ucaaacauccuaucuuucu

SEQ ID NO: 7734 - RNA, 19 nt, Homo sapiens
ccauagaucaucaaacuuc

SEQ ID NO: 7735 - RNA, 19 nt, Homo sapiens
caaacauccuaucuuucuu

SEQ ID NO: 7736 - RNA, 19 nt, Homo sapiens
gaugaacagguuucucuug

SEQ ID NO: 7737 - RNA, 19 nt, Homo sapiens
cuucuucuauucaugcuuu

SEQ ID NO: 7738 - RNA, 19 nt, Homo sapiens
uauaugcugucgaaaucaa

SEQ ID NO: 7739 - RNA, 19 nt, Homo sapiens
agguuucucuugcuaauga

SEQ ID NO: 7740 - RNA, 19 nt, Homo sapiens
aaauccagaugaacagguu

SEQ ID NO: 7741 - RNA, 19 nt, Homo sapiens
gcccaucuaugaaccucuu

SEQ ID NO: 7742 - RNA, 19 nt, Homo sapiens
cuccauagaucaucaaacu

SEQ ID NO: 7743 - RNA, 19 nt, Homo sapiens
ucaagggugugagaacaug

SEQ ID NO: 7744 - RNA, 19 nt, Homo sapiens
cauagaucaucaaacuuca

SEQ ID NO: 7745 - RNA, 19 nt, Homo sapiens
ucacaugguuaaagcaaaa

SEQ ID NO: 7746 - RNA, 19 nt, Homo sapiens
caacucuuucucucaauau

SEQ ID NO: 7747 - RNA, 19 nt, Homo sapiens
gaaccucuucucccaugga

SEQ ID NO: 7748 - RNA, 19 nt, Homo sapiens
aaacauccuaucuuucuuc

SEQ ID NO: 7749 - RNA, 19 nt, Homo sapiens
caacaacugaccacaucug

SEQ ID NO: 7750 - RNA, 19 nt, Homo sapiens
auuauaugcugucgaaauc

SEQ ID NO: 7751 - RNA, 19 nt, Homo sapiens
cagaugaacagguuucucu

SEQ ID NO: 7752 - RNA, 19 nt, Homo sapiens
uuuccuaaauccagaugaa

SEQ ID NO: 7753 - RNA, 19 nt, Homo sapiens
aacaugugcccaucuauga

SEQ ID NO: 7754 - RNA, 19 nt, Homo sapiens
acagguuucucuugcuaau

SEQ ID NO: 7755 - RNA, 19 nt, Homo sapiens
cacucuauuuggcucauuu

SEQ ID NO: 7756 - RNA, 19 nt, Homo sapiens
cuccaacucuuucucucaa

SEQ ID NO: 7757 - RNA, 19 nt, Homo sapiens
gcugucgaaaucaaucuuu

SEQ ID NO: 7758 - RNA, 19 nt, Homo sapiens
ccagaggaacaucaaguca

SEQ ID NO: 7759 - RNA, 19 nt, Homo sapiens
aagccuccaucacucuauu

SEQ ID NO: 7760 - RNA, 19 nt, Homo sapiens
gcuccaacucuuucucuca

SEQ ID NO: 7761 - RNA, 19 nt, Homo sapiens
acgaggaugcaaauuauau

SEQ ID NO: 7762 - RNA, 19 nt, Homo sapiens
cgaggaugcaaauuauaug

SEQ ID NO: 7763 - RNA, 19 nt, Homo sapiens
cucucaauauuccugauuu

SEQ ID NO: 7764 - RNA, 19 nt, Homo sapiens
ugccucugccugagcauua

SEQ ID NO: 7765 - RNA, 19 nt, Homo sapiens
cauggaacgaggaugcaaa

SEQ ID NO: 7766 - RNA, 19 nt, Homo sapiens
ugucuucccugcuccaacu

SEQ ID NO: 7767 - RNA, 19 nt, Homo sapiens
gcagucacuuucuuuguaa

SEQ ID NO: 7768 - RNA, 19 nt, Homo sapiens
cgacgaaucuucucaaugg

SEQ ID NO: 7769 - RNA, 19 nt, Homo sapiens
ugaugaagauccucacuga

SEQ ID NO: 7770 - RNA, 19 nt, Homo sapiens
gcgagaagaugacccagau

SEQ ID NO: 7771 - RNA, 19 nt, Homo sapiens
gggaugacauggagaagau

SEQ ID NO: 7772 - RNA, 19 nt, Homo sapiens
ugacccagaucauguuuga

SEQ ID NO: 7773 - RNA, 19 nt, Homo sapiens
cgcagucacuuucuuugua

SEQ ID NO: 7774 - RNA, 19 nt, Homo sapiens
gcaaauacucgguguggau

SEQ ID NO: 7775 - RNA, 19 nt, Homo sapiens
gagaagaugacccagauca

SEQ ID NO: 7776 - RNA, 19 nt, Homo sapiens
gcacccagcaccaugaaga

SEQ ID NO: 7777 - RNA, 19 nt, Homo sapiens
cccacaacgugcccauuua

SEQ ID NO: 7778 - RNA, 19 nt, Homo sapiens
ccgacuaccugaugaagau

SEQ ID NO: 7779 - RNA, 19 nt, Homo sapiens
ucaaggagaagcugugcua

SEQ ID NO: 7780 - RNA, 19 nt, Homo sapiens
gagaguagcaguuguagcu

SEQ ID NO: 7781 - RNA, 19 nt, Homo sapiens
gagguauccugacccugaa

SEQ ID NO: 7782 - RNA, 19 nt, Homo sapiens
ggaccuguaugccaacaac

SEQ ID NO: 7783 - RNA, 19 nt, Homo sapiens
gccgcgaucucaccgacua

SEQ ID NO: 7784 - RNA, 19 nt, Homo sapiens
gacgacgaaucuucucaau

SEQ ID NO: 7785 - RNA, 19 nt, Homo sapiens
ggacuucgagaacgagaug

SEQ ID NO: 7786 - RNA, 19 nt, Homo sapiens
ggacgacgaaucuucucaa

SEQ ID NO: 7787 - RNA, 19 nt, Homo sapiens
cgcaaaugcuucuaacaca

SEQ ID NO: 7788 - RNA, 19 nt, Homo sapiens
acaacgugcccauuuauga

SEQ ID NO: 7789 - RNA, 19 nt, Homo sapiens
ccacaacgugcccauuuau

SEQ ID NO: 7790 - RNA, 19 nt, Homo sapiens
cccagaaacuagacacaau

SEQ ID NO: 7791 - RNA, 19 nt, Homo sapiens
acaacagcaucaugaagug

SEQ ID NO: 7792 - RNA, 19 nt, Homo sapiens
gcaccacaccuucuacaac

SEQ ID NO: 7793 - RNA, 19 nt, Homo sapiens
gguaugggucagaaagauu

SEQ ID NO: 7794 - RNA, 19 nt, Homo sapiens
gccgagaguagcaguugua

SEQ ID NO: 7795 - RNA, 19 nt, Homo sapiens
ccaccgcaaaugcuucuaa

SEQ ID NO: 7796 - RNA, 19 nt, Homo sapiens
ucaccaagcaggaguacga

SEQ ID NO: 7797 - RNA, 19 nt, Homo sapiens
gaagugugacaucgacauc

SEQ ID NO: 7798 - RNA, 19 nt, Homo sapiens
ccagaaacuagacacaaug

SEQ ID NO: 7799 - RNA, 19 nt, Homo sapiens
gcggacagcgccaagugaa

SEQ ID NO: 7800 - RNA, 19 nt, Homo sapiens
ccagcaccaugaagaucaa

SEQ ID NO: 7801 - RNA, 19 nt, Homo sapiens
gagccgagaguagcaguug

SEQ ID NO: 7802 - RNA, 19 nt, Homo sapiens
gcaccaugaagaucaagau

SEQ ID NO: 7803 - RNA, 19 nt, Homo sapiens
caacgugcccauuuaugag

SEQ ID NO: 7804 - RNA, 19 nt, Homo sapiens
guaugggucagaaagauuc

SEQ ID NO: 7805 - RNA, 19 nt, Homo sapiens
uuccguugcugccaucgua

SEQ ID NO: 7806 - RNA, 19 nt, Homo sapiens
agauguggaucaccaagca

SEQ ID NO: 7807 - RNA, 19 nt, Homo sapiens
gcauucacgagaccaccua

SEQ ID NO: 7808 - RNA, 19 nt, Homo sapiens
gaucgugcgcgacaucaag

SEQ ID NO: 7809 - RNA, 19 nt, Homo sapiens
cagaaacuagacacaaugu

SEQ ID NO: 7810 - RNA, 19 nt, Homo sapiens
gccaaccgcgagaagauga

SEQ ID NO: 7811 - RNA, 19 nt, Homo sapiens
uggccucgcuguccaccuu

SEQ ID NO: 7812 - RNA, 19 nt, Homo sapiens
uacaacagcaucaugaagu

SEQ ID NO: 7813 - RNA, 19 nt, Homo sapiens
acagcaucaugaaguguga

SEQ ID NO: 7814 - RNA, 19 nt, Homo sapiens
caaaugcuucuaacacacu

SEQ ID NO: 7815 - RNA, 19 nt, Homo sapiens
ggaucaccaagcaggagua

SEQ ID NO: 7816 - RNA, 19 nt, Homo sapiens
caucaugaagugugacauc

SEQ ID NO: 7817 - RNA, 19 nt, Homo sapiens
cuacguggcccuggacuuc

SEQ ID NO: 7818 - RNA, 19 nt, Homo sapiens
gcccagaaacuagacacaa

SEQ ID NO: 7819 - RNA, 19 nt, Homo sapiens
aggagaagcugugcuacgu

SEQ ID NO: 7820 - RNA, 19 nt, Homo sapiens
gaccgcaugcagaaagaga

SEQ ID NO: 7821 - RNA, 19 nt, Homo sapiens
ucgcugaccgcaugcagaa

SEQ ID NO: 7822 - RNA, 19 nt, Homo sapiens
caacagcaucaugaagugu

SEQ ID NO: 7823 - RNA, 19 nt, Homo sapiens
ccauguacguggccaucca

SEQ ID NO: 7824 - RNA, 19 nt, Homo sapiens
acccagaucauguuugaga

SEQ ID NO: 7825 - RNA, 19 nt, Homo sapiens
ggaaggaccucuaugcuaa

SEQ ID NO: 7826 - RNA, 19 nt, Homo sapiens
ccaaagcucugacucguua

SEQ ID NO: 7827 - RNA, 19 nt, Homo sapiens
gagaaacuguguuauguag

SEQ ID NO: 7828 - RNA, 19 nt, Homo sapiens
ugaaauaggcuacugguaa

SEQ ID NO: 7829 - RNA, 19 nt, Homo sapiens
gcaccacucuuucuacaau

SEQ ID NO: 7830 - RNA, 19 nt, Homo sapiens
ugaauguccuguggaauua

SEQ ID NO: 7831 - RNA, 19 nt, Homo sapiens
gauagaacauggcaucauc

SEQ ID NO: 7832 - RNA, 19 nt, Homo sapiens
ggaauuaugccuucaguuc

SEQ ID NO: 7833 - RNA, 19 nt, Homo sapiens
gccgagaucucacugacua

SEQ ID NO: 7834 - RNA, 19 nt, Homo sapiens
gcacugccuugguguguga

SEQ ID NO: 7835 - RNA, 19 nt, Homo sapiens
gcaaacaggaauacgauga

SEQ ID NO: 7836 - RNA, 19 nt, Homo sapiens
ggagaaacuguguuaugua

SEQ ID NO: 7837 - RNA, 19 nt, Homo sapiens
ucaugaagauccugacuga

SEQ ID NO: 7838 - RNA, 19 nt, Homo sapiens
ggaccucuaugcuaacaau

SEQ ID NO: 7839 - RNA, 19 nt, Homo sapiens
ucaaggagaaacuguguua

SEQ ID NO: 7840 - RNA, 19 nt, Homo sapiens
ugagaagaguuacgaguug

SEQ ID NO: 7841 - RNA, 19 nt, Homo sapiens
gaagugugauauugacauc

SEQ ID NO: 7842 - RNA, 19 nt, Homo sapiens
gaaacuguguuauguagcu

SEQ ID NO: 7843 - RNA, 19 nt, Homo sapiens
uuauguagcucuggacuuu

SEQ ID NO: 7844 - RNA, 19 nt, Homo sapiens
gcaaauacucugucuggau

SEQ ID NO: 7845 - RNA, 19 nt, Homo sapiens
caacugggacgacauggaa

SEQ ID NO: 7846 - RNA, 19 nt, Homo sapiens
gugaauguccuguggaauu

SEQ ID NO: 7847 - RNA, 19 nt, Homo sapiens
gccaagcacugucaggaau

SEQ ID NO: 7848 - RNA, 19 nt, Homo sapiens
gcacccagcaccaugaaga

SEQ ID NO: 7849 - RNA, 19 nt, Homo sapiens
ugaaguacccgauagaaca

SEQ ID NO: 7850 - RNA, 19 nt, Homo sapiens
caaaucauuccuagccaaa

SEQ ID NO: 7851 - RNA, 19 nt, Homo sapiens
gcacagagcaaaagaggaa

SEQ ID NO: 7852 - RNA, 19 nt, Homo sapiens
caaacaggaauacgaugaa

SEQ ID NO: 7853 - RNA, 19 nt, Homo sapiens
aggagaaacuguguuaugu

SEQ ID NO: 7854 - RNA, 19 nt, Homo sapiens
ugacugagcguggcuauuc

SEQ ID NO: 7855 - RNA, 19 nt, Homo sapiens
cuacgugggugacgaagca

SEQ ID NO: 7856 - RNA, 19 nt, Homo sapiens
caccgcaaaugcuucuaaa

SEQ ID NO: 7857 - RNA, 19 nt, Homo sapiens
gagcgcaaauacucugucu

SEQ ID NO: 7858 - RNA, 19 nt, Homo sapiens
ggagaucacggcccuagca

SEQ ID NO: 7859 - RNA, 19 nt, Homo sapiens
ggagucugcuggcauccau

SEQ ID NO: 7860 - RNA, 19 nt, Homo sapiens
ugacgaagcacagagcaaa

SEQ ID NO: 7861 - RNA, 19 nt, Homo sapiens
gaauuaugccuucaguucu

SEQ ID NO: 7862 - RNA, 19 nt, Homo sapiens
gcuauuccuucguuacuac

SEQ ID NO: 7863 - RNA, 19 nt, Homo sapiens
cugacuaccucaugaagau

SEQ ID NO: 7864 - RNA, 19 nt, Homo sapiens
gaaguacccgauagaacau

SEQ ID NO: 7865 - RNA, 19 nt, Homo sapiens
acaacagcaucaugaagug

SEQ ID NO: 7866 - RNA, 19 nt, Homo sapiens
gaauccugacccugaagua

SEQ ID NO: 7867 - RNA, 19 nt, Homo sapiens
aauuaugccuucaguucuu

SEQ ID NO: 7868 - RNA, 19 nt, Homo sapiens
gcagauguggaucagcaaa

SEQ ID NO: 7869 - RNA, 19 nt, Homo sapiens
gggagaaaaugacucaaau

SEQ ID NO: 7870 - RNA, 19 nt, Homo sapiens
caauggcucugggcucugu

SEQ ID NO: 7871 - RNA, 19 nt, Homo sapiens
caugaaaccaccuacaaca

SEQ ID NO: 7872 - RNA, 19 nt, Homo sapiens
gaucaccaucggaaaugaa

SEQ ID NO: 7873 - RNA, 19 nt, Homo sapiens
cauccucccuugagaagag

SEQ ID NO: 7874 - RNA, 19 nt, Homo sapiens
gcuggacucuggagauggu

SEQ ID NO: 7875 - RNA, 19 nt, Homo sapiens
gugcuggacucuggagaug

SEQ ID NO: 7876 - RNA, 19 nt, Homo sapiens
gcucugacucguuaccuau

SEQ ID NO: 7877 - RNA, 19 nt, Homo sapiens
ccaccgcaaaugcuucuaa

SEQ ID NO: 7878 - RNA, 19 nt, Homo sapiens
gcguggcuauuccuucguu

SEQ ID NO: 7879 - RNA, 19 nt, Homo sapiens
gcggugcugucucucuaug

SEQ ID NO: 7880 - RNA, 19 nt, Homo sapiens
caaugucccagccauguau

SEQ ID NO: 7881 - RNA, 19 nt, Homo sapiens
gaucuggcaccacucuuuc

SEQ ID NO: 7882 - RNA, 19 nt, Homo sapiens
aaacaggaauacgaugaag

SEQ ID NO: 7883 - RNA, 19 nt, Homo sapiens
ccagcaccaugaagaucaa

SEQ ID NO: 7884 - RNA, 19 nt, Homo sapiens
ggacaucaaggagaaacug

SEQ ID NO: 7885 - RNA, 19 nt, Homo sapiens
ggcuauuccuucguuacua

SEQ ID NO: 7886 - RNA, 19 nt, Homo sapiens
cagcaaacaggaauacgau

SEQ ID NO: 7887 - RNA, 19 nt, Homo sapiens
caucaggaaggaccucuau

SEQ ID NO: 7888 - RNA, 19 nt, Homo sapiens
ucaugaagugugauauuga

SEQ ID NO: 7889 - RNA, 19 nt, Homo sapiens
gcaccaugaagaucaagau

SEQ ID NO: 7890 - RNA, 19 nt, Homo sapiens
aggaaggaccucuaugcua

SEQ ID NO: 7891 - RNA, 19 nt, Homo sapiens
gcucuggacuuugaaaaug

SEQ ID NO: 7892 - RNA, 19 nt, Homo sapiens
aaggagaaacuguguuaug

SEQ ID NO: 7893 - RNA, 19 nt, Homo sapiens
ucaaugucccagccaugua

SEQ ID NO: 7894 - RNA, 19 nt, Homo sapiens
caugaagugugauauugac

SEQ ID NO: 7895 - RNA, 19 nt, Homo sapiens
uacaaugagcuucguguug

SEQ ID NO: 7896 - RNA, 19 nt, Homo sapiens
gaucagcaaacaggaauac

SEQ ID NO: 7897 - RNA, 19 nt, Homo sapiens
caucaaggagaaacugugu

SEQ ID NO: 7898 - RNA, 19 nt, Homo sapiens
ccauguauguggcuaucca

SEQ ID NO: 7899 - RNA, 19 nt, Homo sapiens
ggagaaaaugacucaaauu

SEQ ID NO: 7900 - RNA, 19 nt, Homo sapiens
ggaucagcaaacaggaaua

SEQ ID NO: 7901 - RNA, 19 nt, Homo sapiens
ccucuaugcuaacaauguc

SEQ ID NO: 7902 - RNA, 19 nt, Homo sapiens
uacaacagcaucaugaagu

SEQ ID NO: 7903 - RNA, 19 nt, Homo sapiens
auguagcucuggacuuuga

SEQ ID NO: 7904 - RNA, 19 nt, Homo sapiens
ucacugacuaccucaugaa

SEQ ID NO: 7905 - RNA, 19 nt, Homo sapiens
uggcaccacucuuucuaca

SEQ ID NO: 7906 - RNA, 19 nt, Homo sapiens
acucguuaccuauguguuu

SEQ ID NO: 7907 - RNA, 19 nt, Homo sapiens
acagcaucaugaaguguga

SEQ ID NO: 7908 - RNA, 19 nt, Homo sapiens
ugaucaccaucggaaauga

SEQ ID NO: 7909 - RNA, 19 nt, Homo sapiens
ccagcuaugugugaagaag

SEQ ID NO: 7910 - RNA, 19 nt, Homo sapiens
aggcggugcugucucucua

SEQ ID NO: 7911 - RNA, 19 nt, Homo sapiens
guggaauuaugccuucagu

SEQ ID NO: 7912 - RNA, 19 nt, Homo sapiens
cugcugagcgugagauugu

SEQ ID NO: 7913 - RNA, 19 nt, Homo sapiens
caucaugcgucuggaucug

SEQ ID NO: 7914 - RNA, 19 nt, Homo sapiens
gcaaaugcuucuaaaacac

SEQ ID NO: 7915 - RNA, 19 nt, Homo sapiens
gacccugaaguacccgaua

SEQ ID NO: 7916 - RNA, 19 nt, Homo sapiens
ugcuaacaauguccuauca

SEQ ID NO: 7917 - RNA, 19 nt, Homo sapiens
cguuuccgcugcccagaga

SEQ ID NO: 7918 - RNA, 19 nt, Homo sapiens
ucagcaaacaggaauacga

SEQ ID NO: 7919 - RNA, 19 nt, Homo sapiens
agauguggaucagcaaaca

SEQ ID NO: 7920 - RNA, 19 nt, Homo sapiens
gcuccauccuggccucucu

SEQ ID NO: 7921 - RNA, 19 nt, Homo sapiens
uccgggacaucaaggagaa

SEQ ID NO: 7922 - RNA, 19 nt, Homo sapiens
gccaaagcucugacucguu

SEQ ID NO: 7923 - RNA, 19 nt, Homo sapiens
agaucuggcaccacucuuu

SEQ ID NO: 7924 - RNA, 19 nt, Homo sapiens
aauguccuguggaauuaug

SEQ ID NO: 7925 - RNA, 19 nt, Homo sapiens
gggcuuaccuguacacuga

SEQ ID NO: 7926 - RNA, 19 nt, Homo sapiens
ggacuuugauugcacauug

SEQ ID NO: 7927 - RNA, 19 nt, Homo sapiens
gcacagagccucgccuuug

SEQ ID NO: 7928 - RNA, 19 nt, Homo sapiens
aaaccuaacuugcgcagaa

SEQ ID NO: 7929 - RNA, 19 nt, Homo sapiens
uggcauggcuuuauuuguu

SEQ ID NO: 7930 - RNA, 19 nt, Homo sapiens
gaaaucgugcgugacauua

SEQ ID NO: 7931 - RNA, 19 nt, Homo sapiens
ugagauguaugaaggcuuu

SEQ ID NO: 7932 - RNA, 19 nt, Homo sapiens
ccaaauaugagaugcauug

SEQ ID NO: 7933 - RNA, 19 nt, Homo sapiens
gcgagaagaugacccagau

SEQ ID NO: 7934 - RNA, 19 nt, Homo sapiens
ggaaaucgugcgugacauu

SEQ ID NO: 7935 - RNA, 19 nt, Homo sapiens
ugacccagaucauguuuga

SEQ ID NO: 7936 - RNA, 19 nt, Homo sapiens
caccacaccuucuacaaug

SEQ ID NO: 7937 - RNA, 19 nt, Homo sapiens
uggcuugacucaggauuua

SEQ ID NO: 7938 - RNA, 19 nt, Homo sapiens
gaagucccuugccauccua

SEQ ID NO: 7939 - RNA, 19 nt, Homo sapiens
ggcauggcuuuauuuguuu

SEQ ID NO: 7940 - RNA, 19 nt, Homo sapiens
gcauugcuuucguguaaau

SEQ ID NO: 7941 - RNA, 19 nt, Homo sapiens
gcacccagcacaaugaaga

SEQ ID NO: 7942 - RNA, 19 nt, Homo sapiens
gccgggaccugacugacua

SEQ ID NO: 7943 - RNA, 19 nt, Homo sapiens
gcacaaugaagaucaagau

SEQ ID NO: 7944 - RNA, 19 nt, Homo sapiens
ccacgaaacuaccuucaac

SEQ ID NO: 7945 - RNA, 19 nt, Homo sapiens
ggacuucgagcaagagaug

SEQ ID NO: 7946 - RNA, 19 nt, Homo sapiens
gagaagaugacccagauca

SEQ ID NO: 7947 - RNA, 19 nt, Homo sapiens
gcaccacaccuucuacaau

SEQ ID NO: 7948 - RNA, 19 nt, Homo sapiens
gaauaaaagugcacaccuu

SEQ ID NO: 7949 - RNA, 19 nt, Homo sapiens
caccauggaugaugauauc

SEQ ID NO: 7950 - RNA, 19 nt, Homo sapiens
ucagcaagcaggaguauga

SEQ ID NO: 7951 - RNA, 19 nt, Homo sapiens
cuugagaccaguugaauaa

SEQ ID NO: 7952 - RNA, 19 nt, Homo sapiens
gagauuggcauggcuuuau

SEQ ID NO: 7953 - RNA, 19 nt, Homo sapiens
gacaacggcuccggcaugu

SEQ ID NO: 7954 - RNA, 19 nt, Homo sapiens
ggaagucccuugccauccu

SEQ ID NO: 7955 - RNA, 19 nt, Homo sapiens
caauguggccgaggacuuu

SEQ ID NO: 7956 - RNA, 19 nt, Homo sapiens
ccuguacacugacuugaga

SEQ ID NO: 7957 - RNA, 19 nt, Homo sapiens
aaucuucgccuuaauacuu

SEQ ID NO: 7958 - RNA, 19 nt, Homo sapiens
ucaacuccaucaugaagug

SEQ ID NO: 7959 - RNA, 19 nt, Homo sapiens
cuaggcggacuaugacuua

SEQ ID NO: 7960 - RNA, 19 nt, Homo sapiens
gcaaguacuccguguggau

SEQ ID NO: 7961 - RNA, 19 nt, Homo sapiens
gggcaugggucagaaggau

SEQ ID NO: 7962 - RNA, 19 nt, Homo sapiens
guuacacccuuucuugaca

SEQ ID NO: 7963 - RNA, 19 nt, Homo sapiens
cugacuaccucaugaagau

SEQ ID NO: 7964 - RNA, 19 nt, Homo sapiens
agauuggcauggcuuuauu

SEQ ID NO: 7965 - RNA, 19 nt, Homo sapiens
gcuucuaggcggacuauga

SEQ ID NO: 7966 - RNA, 19 nt, Homo sapiens
uuaaggagaagcugugcua

SEQ ID NO: 7967 - RNA, 19 nt, Homo sapiens
ggccaggucaucaccauug

SEQ ID NO: 7968 - RNA, 19 nt, Homo sapiens
ccagcacaaugaagaucaa

SEQ ID NO: 7969 - RNA, 19 nt, Homo sapiens
gcaugggucagaaggauuc

SEQ ID NO: 7970 - RNA, 19 nt, Homo sapiens
caacuugagauguaugaag

SEQ ID NO: 7971 - RNA, 19 nt, Homo sapiens
gauuggcauggcuuuauuu

SEQ ID NO: 7972 - RNA, 19 nt, Homo sapiens
ccgacaggaugcagaagga

SEQ ID NO: 7973 - RNA, 19 nt, Homo sapiens
ugagaccaguugaauaaaa

SEQ ID NO: 7974 - RNA, 19 nt, Homo sapiens
gcccaguccucucccaagu

SEQ ID NO: 7975 - RNA, 19 nt, Homo sapiens
gaucagcaagcaggaguau

SEQ ID NO: 7976 - RNA, 19 nt, Homo sapiens
aaacuaccuucaacuccau

SEQ ID NO: 7977 - RNA, 19 nt, Homo sapiens
gcuugacucaggauuuaaa

SEQ ID NO: 7978 - RNA, 19 nt, Homo sapiens
ccaccccacuucucucuaa

SEQ ID NO: 7979 - RNA, 19 nt, Homo sapiens
gauugcacauuguuguuuu

SEQ ID NO: 7980 - RNA, 19 nt, Homo sapiens
gcguuacacccuuucuuga

SEQ ID NO: 7981 - RNA, 19 nt, Homo sapiens
gcuuucguguaaauuaugu

SEQ ID NO: 7982 - RNA, 19 nt, Homo sapiens
uuacacccuuucuugacaa

SEQ ID NO: 7983 - RNA, 19 nt, Homo sapiens
ugacguggacauccgcaaa

SEQ ID NO: 7984 - RNA, 19 nt, Homo sapiens
ugcgugacauuaaggagaa

SEQ ID NO: 7985 - RNA, 19 nt, Homo sapiens
gacuuugauugcacauugu

SEQ ID NO: 7986 - RNA, 19 nt, Homo sapiens
cugacugacuaccucauga

SEQ ID NO: 7987 - RNA, 19 nt, Homo sapiens
ccauguacguugcuaucca

SEQ ID NO: 7988 - RNA, 19 nt, Homo sapiens
gccaaccgcgagaagauga

SEQ ID NO: 7989 - RNA, 19 nt, Homo sapiens
gggacgacauggagaaaau

SEQ ID NO: 7990 - RNA, 19 nt, Homo sapiens
gaaaacaagaugagauugg

SEQ ID NO: 7991 - RNA, 19 nt, Homo sapiens
gacgaggcccagagcaaga

SEQ ID NO: 7992 - RNA, 19 nt, Homo sapiens
uggccucgcuguccaccuu

SEQ ID NO: 7993 - RNA, 19 nt, Homo sapiens
gaagugugacguggacauc

SEQ ID NO: 7994 - RNA, 19 nt, Homo sapiens
aaucgugcgugacauuaag

SEQ ID NO: 7995 - RNA, 19 nt, Homo sapiens
ugacugacuaccucaugaa

SEQ ID NO: 7996 - RNA, 19 nt, Homo sapiens
ugacuugagaccaguugaa

SEQ ID NO: 7997 - RNA, 19 nt, Homo sapiens
caggggaggugauagcauu

SEQ ID NO: 7998 - RNA, 19 nt, Homo sapiens
ugacuuaguugcguuacac

SEQ ID NO: 7999 - RNA, 19 nt, Homo sapiens
aggcugugcuaucccugua

SEQ ID NO: 8000 - RNA, 19 nt, Homo sapiens
gagaccaguugaauaaaag

SEQ ID NO: 8001 - RNA, 19 nt, Homo sapiens
ugagauuggcauggcuuua

SEQ ID NO: 8002 - RNA, 19 nt, Homo sapiens
ggaucagcaagcaggagua

SEQ ID NO: 8003 - RNA, 19 nt, Homo sapiens
cuacgucgcccuggacuuc

SEQ ID NO: 8004 - RNA, 19 nt, Homo sapiens
aaaucgugcgugacauuaa

SEQ ID NO: 8005 - RNA, 19 nt, Homo sapiens
acacugugcccaucuacga

SEQ ID NO: 8006 - RNA, 19 nt, Homo sapiens
ugauugcacauuguuguuu

SEQ ID NO: 8007 - RNA, 19 nt, Homo sapiens
gccgaggacuuugauugca

SEQ ID NO: 8008 - RNA, 19 nt, Homo sapiens
aaacuggaacggugaaggu

SEQ ID NO: 8009 - RNA, 19 nt, Homo sapiens
caccauguacccuggcauu

SEQ ID NO: 8010 - RNA, 19 nt, Homo sapiens
aauaaaagugcacaccuua

SEQ ID NO: 8011 - RNA, 19 nt, Homo sapiens
cacagagccucgccuuugc

SEQ ID NO: 8012 - RNA, 19 nt, Homo sapiens
cagaaaacaagaugagauu

SEQ ID NO: 8013 - RNA, 19 nt, Homo sapiens
uaguugcguuacacccuuu

SEQ ID NO: 8014 - RNA, 19 nt, Homo sapiens
aggagaagcugugcuacgu

SEQ ID NO: 8015 - RNA, 19 nt, Homo sapiens
uaugagaugcauuguuaca

SEQ ID NO: 8016 - RNA, 19 nt, Homo sapiens
gcagaaaacaagaugagau

SEQ ID NO: 8017 - RNA, 19 nt, Homo sapiens
aaccuaacuugcgcagaaa

SEQ ID NO: 8018 - RNA, 19 nt, Homo sapiens
acccagaucauguuugaga

SEQ ID NO: 8019 - RNA, 19 nt, Homo sapiens
uaaauacucugucuggauu

SEQ ID NO: 8020 - RNA, 19 nt, Homo sapiens
ugacucagaucauguuuga

SEQ ID NO: 8021 - RNA, 19 nt, Homo sapiens
gagcguggcuacuccuuug

SEQ ID NO: 8022 - RNA, 19 nt, Homo sapiens
gggagaagaugacucagau

SEQ ID NO: 8023 - RNA, 19 nt, Homo sapiens
gaaacaacuuacaauagca

SEQ ID NO: 8024 - RNA, 19 nt, Homo sapiens
ucaugaagauccucacuga

SEQ ID NO: 8025 - RNA, 19 nt, Homo sapiens
cagcaaauguggauuagca

SEQ ID NO: 8026 - RNA, 19 nt, Homo sapiens
ggaccuguaugccaacaau

SEQ ID NO: 8027 - RNA, 19 nt, Homo sapiens
caaaccaccuucccucauc

SEQ ID NO: 8028 - RNA, 19 nt, Homo sapiens
aagagaagcugugcuaugu

SEQ ID NO: 8029 - RNA, 19 nt, Homo sapiens
caccacaccuucuacaaug

SEQ ID NO: 8030 - RNA, 19 nt, Homo sapiens
ugaaacaacuuacaauagc

SEQ ID NO: 8031 - RNA, 19 nt, Homo sapiens
gcagugcuaucccuguaug

SEQ ID NO: 8032 - RNA, 19 nt, Homo sapiens
gagaagaugacucagauca

SEQ ID NO: 8033 - RNA, 19 nt, Homo sapiens
gagcguaaauacucugucu

SEQ ID NO: 8034 - RNA, 19 nt, Homo sapiens
gcaagcaagaguacgauga

SEQ ID NO: 8035 - RNA, 19 nt, Homo sapiens
acaauagcaucaugaagug

SEQ ID NO: 8036 - RNA, 19 nt, Homo sapiens
ggaaucugcuggcauccau

SEQ ID NO: 8037 - RNA, 19 nt, Homo sapiens
gcaccacaccuucuacaau

SEQ ID NO: 8038 - RNA, 19 nt, Homo sapiens
uuacacacgugcaauuugu

SEQ ID NO: 8039 - RNA, 19 nt, Homo sapiens
ccucaucuuucaucaauca

SEQ ID NO: 8040 - RNA, 19 nt, Homo sapiens
ggaugacgguauuaugcuu

SEQ ID NO: 8041 - RNA, 19 nt, Homo sapiens
ccuagcaccaugaagauua

SEQ ID NO: 8042 - RNA, 19 nt, Homo sapiens
cgcaaaugcuucuaagaug

SEQ ID NO: 8043 - RNA, 19 nt, Homo sapiens
uuaaagagaagcugugcua

SEQ ID NO: 8044 - RNA, 19 nt, Homo sapiens
gcaauuuguuugugcuucu

SEQ ID NO: 8045 - RNA, 19 nt, Homo sapiens
guaaauacucugucuggau

SEQ ID NO: 8046 - RNA, 19 nt, Homo sapiens
cuagcaccaugaagauuaa

SEQ ID NO: 8047 - RNA, 19 nt, Homo sapiens
gaucguaugcagaaggaaa

SEQ ID NO: 8048 - RNA, 19 nt, Homo sapiens
gggacgacauggagaagau

SEQ ID NO: 8049 - RNA, 19 nt, Homo sapiens
caccuucccucaucuuuca

SEQ ID NO: 8050 - RNA, 19 nt, Homo sapiens
ggagaagagcuaugaacug

SEQ ID NO: 8051 - RNA, 19 nt, Homo sapiens
caaugucccugccauguac

SEQ ID NO: 8052 - RNA, 19 nt, Homo sapiens
gcuccuagcaccaugaaga

SEQ ID NO: 8053 - RNA, 19 nt, Homo sapiens
gucgggaccucacugacua

SEQ ID NO: 8054 - RNA, 19 nt, Homo sapiens
gaggcaggcccauccauug

SEQ ID NO: 8055 - RNA, 19 nt, Homo sapiens
gaugaagcccagagcaaga

SEQ ID NO: 8056 - RNA, 19 nt, Homo sapiens
caugaagugugacauugau

SEQ ID NO: 8057 - RNA, 19 nt, Homo sapiens
ggauuagcaagcaagagua

SEQ ID NO: 8058 - RNA, 19 nt, Homo sapiens
caucgagcaugguaucauc

SEQ ID NO: 8059 - RNA, 19 nt, Homo sapiens
caucaugaagugugacauu

SEQ ID NO: 8060 - RNA, 19 nt, Homo sapiens
ucaaugucccugccaugua

SEQ ID NO: 8061 - RNA, 19 nt, Homo sapiens
uacaauagcaucaugaagu

SEQ ID NO: 8062 - RNA, 19 nt, Homo sapiens
aaagagaagcugugcuaug

SEQ ID NO: 8063 - RNA, 19 nt, Homo sapiens
cuucuaagaugccuucucu

SEQ ID NO: 8064 - RNA, 19 nt, Homo sapiens
gaagugugacauugauauc

SEQ ID NO: 8065 - RNA, 19 nt, Homo sapiens
cugacuaccucaugaagau

SEQ ID NO: 8066 - RNA, 19 nt, Homo sapiens
gggaugguguaacucacaa

SEQ ID NO: 8067 - RNA, 19 nt, Homo sapiens
ccgcaaaugcuucuaagau

SEQ ID NO: 8068 - RNA, 19 nt, Homo sapiens
caauuuguuugugcuucua

SEQ ID NO: 8069 - RNA, 19 nt, Homo sapiens
ugccuucucucuccaucua

SEQ ID NO: 8070 - RNA, 19 nt, Homo sapiens
gcauccaugaaacaacuua

SEQ ID NO: 8071 - RNA, 19 nt, Homo sapiens
ucccucaucuuucaucaau

SEQ ID NO: 8072 - RNA, 19 nt, Homo sapiens
guaugccaacaaugucuua

SEQ ID NO: 8073 - RNA, 19 nt, Homo sapiens
ugaagugugacauugauau

SEQ ID NO: 8074 - RNA, 19 nt, Homo sapiens
cagcccuccuucauuggua

SEQ ID NO: 8075 - RNA, 19 nt, Homo sapiens
uuccagcccuccuucauug

SEQ ID NO: 8076 - RNA, 19 nt, Homo sapiens
caccacugcugaacgugaa

SEQ ID NO: 8077 - RNA, 19 nt, Homo sapiens
ccaccgcaaaugcuucuaa

SEQ ID NO: 8078 - RNA, 19 nt, Homo sapiens
gcaccaugaagauuaagau

SEQ ID NO: 8079 - RNA, 19 nt, Homo sapiens
gcuaugucgcccuggauuu

SEQ ID NO: 8080 - RNA, 19 nt, Homo sapiens
aggcagugcuaucccugua

SEQ ID NO: 8081 - RNA, 19 nt, Homo sapiens
acacacgugcaauuuguuu

SEQ ID NO: 8082 - RNA, 19 nt, Homo sapiens
uccgugacauuaaagagaa

SEQ ID NO: 8083 - RNA, 19 nt, Homo sapiens
gaggcauccugacccugaa

SEQ ID NO: 8084 - RNA, 19 nt, Homo sapiens
ucuaugagggcuacgcuuu

SEQ ID NO: 8085 - RNA, 19 nt, Homo sapiens
ugccaacaaugucuuaucu

SEQ ID NO: 8086 - RNA, 19 nt, Homo sapiens
gaugguguaacucacaaug

SEQ ID NO: 8087 - RNA, 19 nt, Homo sapiens
ucaugaagugugacauuga

SEQ ID NO: 8088 - RNA, 19 nt, Homo sapiens
agucaucacuaucggcaau

SEQ ID NO: 8089 - RNA, 19 nt, Homo sapiens
ggaguuaugguggguaugg

SEQ ID NO: 8090 - RNA, 19 nt, Homo sapiens
gacgguauuaugcuucuug

SEQ ID NO: 8091 - RNA, 19 nt, Homo sapiens
aaauguggauuagcaagca

SEQ ID NO: 8092 - RNA, 19 nt, Homo sapiens
ccaugaaacaacuuacaau

SEQ ID NO: 8093 - RNA, 19 nt, Homo sapiens
gcauccugacccugaagua

SEQ ID NO: 8094 - RNA, 19 nt, Homo sapiens
ugaggcaggcccauccauu

SEQ ID NO: 8095 - RNA, 19 nt, Homo sapiens
ugguauugcugaucguaug

SEQ ID NO: 8096 - RNA, 19 nt, Homo sapiens
acauugauauccgcaagga

SEQ ID NO: 8097 - RNA, 19 nt, Homo sapiens
uacaaugagcuccguguug

SEQ ID NO: 8098 - RNA, 19 nt, Homo sapiens
ucacugacuaccucaugaa

SEQ ID NO: 8099 - RNA, 19 nt, Homo sapiens
guuuacacacgugcaauuu

SEQ ID NO: 8100 - RNA, 19 nt, Homo sapiens
gaaguaucccaucgagcau

SEQ ID NO: 8101 - RNA, 19 nt, Homo sapiens
gugaugaagcccagagcaa

SEQ ID NO: 8102 - RNA, 19 nt, Homo sapiens
caacuuacaauagcaucau

SEQ ID NO: 8103 - RNA, 19 nt, Homo sapiens
uggcauccaugaaacaacu

SEQ ID NO: 8104 - RNA, 19 nt, Homo sapiens
caucaugcgucuggaucug

SEQ ID NO: 8105 - RNA, 19 nt, Homo sapiens
ugguguaacucacaauguc

SEQ ID NO: 8106 - RNA, 19 nt, Homo sapiens
caccaugaagauuaagauu

SEQ ID NO: 8107 - RNA, 19 nt, Homo sapiens
ucaggaugacgguauuaug

SEQ ID NO: 8108 - RNA, 19 nt, Homo sapiens
ucuaagaugccuucucucu

SEQ ID NO: 8109 - RNA, 19 nt, Homo sapiens
caagcaagaguacgaugag

SEQ ID NO: 8110 - RNA, 19 nt, Homo sapiens
aaaccaccuucccucaucu

SEQ ID NO: 8111 - RNA, 19 nt, Homo sapiens
ccauguacguggccaucca

SEQ ID NO: 8112 - RNA, 19 nt, Homo sapiens
caggaugacgguauuaugc

SEQ ID NO: 8113 - RNA, 19 nt, Homo sapiens
ggccguaccacaggcauug

SEQ ID NO: 8114 - RNA, 19 nt, Homo sapiens
cugcugaacgugaaauugu

SEQ ID NO: 8115 - RNA, 19 nt, Homo sapiens
ugucaccacugcugaacgu

SEQ ID NO: 8116 - RNA, 19 nt, Homo sapiens
gaagagaugacaacaaauu

SEQ ID NO: 8117 - RNA, 19 nt, Homo sapiens
gaagaugacucagauuaug

SEQ ID NO: 8118 - RNA, 19 nt, Homo sapiens
gagaagaugacucagauua

SEQ ID NO: 8119 - RNA, 19 nt, Homo sapiens
gaaaagaaauuguccuuga

SEQ ID NO: 8120 - RNA, 19 nt, Homo sapiens
guacauaucuuugaguuca

SEQ ID NO: 8121 - RNA, 19 nt, Homo sapiens
ugacucagauuauguuuga

SEQ ID NO: 8122 - RNA, 19 nt, Homo sapiens
gagagaagaugacucagau

SEQ ID NO: 8123 - RNA, 19 nt, Homo sapiens
uuucuuagcugaugucuuu

SEQ ID NO: 8124 - RNA, 19 nt, Homo sapiens
gaccuuguauugaaguuaa

SEQ ID NO: 8125 - RNA, 19 nt, Homo sapiens
gcacuggauuguagaacuu

SEQ ID NO: 8126 - RNA, 19 nt, Homo sapiens
uugaagagaugacaacaaa

SEQ ID NO: 8127 - RNA, 19 nt, Homo sapiens
guauugaaguuaacuguuc

SEQ ID NO: 8128 - RNA, 19 nt, Homo sapiens
ccuugaagcuuguaucuga

SEQ ID NO: 8129 - RNA, 19 nt, Homo sapiens
ucaugaagauccucacuga

SEQ ID NO: 8130 - RNA, 19 nt, Homo sapiens
uggaagcgguuugcauuua

SEQ ID NO: 8131 - RNA, 19 nt, Homo sapiens
gacccaguuuccuuucuua

SEQ ID NO: 8132 - RNA, 19 nt, Homo sapiens
gcaauucucgauucuuuga

SEQ ID NO: 8133 - RNA, 19 nt, Homo sapiens
uaucagcacuggauuguag

SEQ ID NO: 8134 - RNA, 19 nt, Homo sapiens
gagcgaggcuacagcuuca

SEQ ID NO: 8135 - RNA, 19 nt, Homo sapiens
gaaauuguccuugaagcuu

SEQ ID NO: 8136 - RNA, 19 nt, Homo sapiens
ucacgaaacuggaauaagc

SEQ ID NO: 8137 - RNA, 19 nt, Homo sapiens
cagcagauguggauuagca

SEQ ID NO: 8138 - RNA, 19 nt, Homo sapiens
gacaauggcuccggcaugu

SEQ ID NO: 8139 - RNA, 19 nt, Homo sapiens
ggacccaguuuccuuucuu

SEQ ID NO: 8140 - RNA, 19 nt, Homo sapiens
acgcaauucucgauucuuu

SEQ ID NO: 8141 - RNA, 19 nt, Homo sapiens
ggaauaagccuucgaaaag

SEQ ID NO: 8142 - RNA, 19 nt, Homo sapiens
ggaagcgguuugcauuuac

SEQ ID NO: 8143 - RNA, 19 nt, Homo sapiens
uuaauacccuguacauauc

SEQ ID NO: 8144 - RNA, 19 nt, Homo sapiens
gaaaguccaagccguagga

SEQ ID NO: 8145 - RNA, 19 nt, Homo sapiens
gaauaagccuucgaaaaga

SEQ ID NO: 8146 - RNA, 19 nt, Homo sapiens
guucugggauuucucuaga

SEQ ID NO: 8147 - RNA, 19 nt, Homo sapiens
cugcauggguuaauugaga

SEQ ID NO: 8148 - RNA, 19 nt, Homo sapiens
uagaacuuguugcugauuu

SEQ ID NO: 8149 - RNA, 19 nt, Homo sapiens
caaaugcacacaccucaug

SEQ ID NO: 8150 - RNA, 19 nt, Homo sapiens
ccacuggcauugucaugga

SEQ ID NO: 8151 - RNA, 19 nt, Homo sapiens
gggacgacauggagaagau

SEQ ID NO: 8152 - RNA, 19 nt, Homo sapiens
ccgacuaccucaugaagau

SEQ ID NO: 8153 - RNA, 19 nt, Homo sapiens
uaaacggacucagcagaug

SEQ ID NO: 8154 - RNA, 19 nt, Homo sapiens
ucaaggagaagcugugcua

SEQ ID NO: 8155 - RNA, 19 nt, Homo sapiens
gcaagaaccaguuguuuug

SEQ ID NO: 8156 - RNA, 19 nt, Homo sapiens
gaucugugcaggguauuaa

SEQ ID NO: 8157 - RNA, 19 nt, Homo sapiens
agaacgugcuuguggaaga

SEQ ID NO: 8158 - RNA, 19 nt, Homo sapiens
ucaacuccaucaugaagug

SEQ ID NO: 8159 - RNA, 19 nt, Homo sapiens
guacgcaauucucgauucu

SEQ ID NO: 8160 - RNA, 19 nt, Homo sapiens
gcugaguguucugggauuu

SEQ ID NO: 8161 - RNA, 19 nt, Homo sapiens
gcaaguacucgguguggau

SEQ ID NO: 8162 - RNA, 19 nt, Homo sapiens
gcuguuacuugcuuugagu

SEQ ID NO: 8163 - RNA, 19 nt, Homo sapiens
caccgcaaaugcuucuaaa

SEQ ID NO: 8164 - RNA, 19 nt, Homo sapiens
ggaaaucgugcgcgacauc

SEQ ID NO: 8165 - RNA, 19 nt, Homo sapiens
gcgcaccacuggcauuguc

SEQ ID NO: 8166 - RNA, 19 nt, Homo sapiens
gauaucagcacuggauugu

SEQ ID NO: 8167 - RNA, 19 nt, Homo sapiens
guuggaagcgguuugcauu

SEQ ID NO: 8168 - RNA, 19 nt, Homo sapiens
gaacgugcuuguggaagac

SEQ ID NO: 8169 - RNA, 19 nt, Homo sapiens
ggauuagcaagcaggagua

SEQ ID NO: 8170 - RNA, 19 nt, Homo sapiens
acagagagaagaugacuca

SEQ ID NO: 8171 - RNA, 19 nt, Homo sapiens
gcauuugcugcauggguua

SEQ ID NO: 8172 - RNA, 19 nt, Homo sapiens
ggccaggucaucaccauug

SEQ ID NO: 8173 - RNA, 19 nt, Homo sapiens
uaagaacgugcuuguggaa

SEQ ID NO: 8174 - RNA, 19 nt, Homo sapiens
ucacuucguggcuaaggua

SEQ ID NO: 8175 - RNA, 19 nt, Homo sapiens
ggacuucgagcaggagaug

SEQ ID NO: 8176 - RNA, 19 nt, Homo sapiens
gcaccacaccuucuacaac

SEQ ID NO: 8177 - RNA, 19 nt, Homo sapiens
ccaccgcaaaugcuucuaa

SEQ ID NO: 8178 - RNA, 19 nt, Homo sapiens
ccgacaggaugcagaagga

SEQ ID NO: 8179 - RNA, 19 nt, Homo sapiens
gaaaucgugcgcgacauca

SEQ ID NO: 8180 - RNA, 19 nt, Homo sapiens
agaagaugacucagauuau

SEQ ID NO: 8181 - RNA, 19 nt, Homo sapiens
ccaguuuccuuucuuagcu

SEQ ID NO: 8182 - RNA, 19 nt, Homo sapiens
ucuagaggcuggcaagaac

SEQ ID NO: 8183 - RNA, 19 nt, Homo sapiens
gcaggguauuaacguguca

SEQ ID NO: 8184 - RNA, 19 nt, Homo sapiens
ccagcaccaugaagaucaa

SEQ ID NO: 8185 - RNA, 19 nt, Homo sapiens
gccaacagagagaagauga

SEQ ID NO: 8186 - RNA, 19 nt, Homo sapiens
uuucuacuguuaugugaga

SEQ ID NO: 8187 - RNA, 19 nt, Homo sapiens
cuucguggcuaagguaaga

SEQ ID NO: 8188 - RNA, 19 nt, Homo sapiens
uuacuugcuuugaguugga

SEQ ID NO: 8189 - RNA, 19 nt, Homo sapiens
gcaccaugaagaucaagau

SEQ ID NO: 8190 - RNA, 19 nt, Homo sapiens
agagagaagaugacucaga

SEQ ID NO: 8191 - RNA, 19 nt, Homo sapiens
ucugaucugugcaggguau

SEQ ID NO: 8192 - RNA, 19 nt, Homo sapiens
caccgugggcuguuacuug

SEQ ID NO: 8193 - RNA, 19 nt, Homo sapiens
gcgcccagcaccaugaaga

SEQ ID NO: 8194 - RNA, 19 nt, Homo sapiens
ugacguggacauccgcaaa

SEQ ID NO: 8195 - RNA, 19 nt, Homo sapiens
gaagcgguuugcauuuacg

SEQ ID NO: 8196 - RNA, 19 nt, Homo sapiens
ccagcagccucugaucugu

SEQ ID NO: 8197 - RNA, 19 nt, Homo sapiens
cuguacauaucuuugaguu

SEQ ID NO: 8198 - RNA, 19 nt, Homo sapiens
gcaaaugcacacaccucau

SEQ ID NO: 8199 - RNA, 19 nt, Homo sapiens
gcauccugacccugaagua

SEQ ID NO: 8200 - RNA, 19 nt, Homo sapiens
gaagugugacguggacauc

SEQ ID NO: 8201 - RNA, 19 nt, Homo sapiens
uguacgcaauucucgauuc

SEQ ID NO: 8202 - RNA, 19 nt, Homo sapiens
guuuaauacccuguacaua

SEQ ID NO: 8203 - RNA, 19 nt, Homo sapiens
aaagaaauuguccuugaag

SEQ ID NO: 8204 - RNA, 19 nt, Homo sapiens
caacagagagaagaugacu

SEQ ID NO: 8205 - RNA, 19 nt, Homo sapiens
gaugacucagauuauguuu

SEQ ID NO: 8206 - RNA, 19 nt, Homo sapiens
cuaaacggacucagcagau

SEQ ID NO: 8207 - RNA, 19 nt, Homo sapiens
cuacgucgcccuggacuuc

SEQ ID NO: 8208 - RNA, 19 nt, Homo sapiens
ggcaagaaccaguuguuuu

SEQ ID NO: 8209 - RNA, 19 nt, Homo sapiens
uggcaagaaccaguuguuu

SEQ ID NO: 8210 - RNA, 19 nt, Homo sapiens
ggcugaguguucugggauu

SEQ ID NO: 8211 - RNA, 19 nt, Homo sapiens
guagaacuuguugcugauu

SEQ ID NO: 8212 - RNA, 19 nt, Homo sapiens
gcaugugcaaagcugguuu

SEQ ID NO: 8213 - RNA, 19 nt, Homo sapiens
gccagcagccucugaucug

SEQ ID NO: 8214 - RNA, 19 nt, Homo sapiens
uguagaacuuguugcugau

SEQ ID NO: 8215 - RNA, 19 nt, Homo sapiens
aggagaagcugugcuacgu

SEQ ID NO: 8216 - RNA, 19 nt, Homo sapiens
ggacuuauaugccaacaau

SEQ ID NO: 8217 - RNA, 19 nt, Homo sapiens
gauccuaacucucaaauac

SEQ ID NO: 8218 - RNA, 19 nt, Homo sapiens
gagagaggcuauuccuuug

SEQ ID NO: 8219 - RNA, 19 nt, Homo sapiens
ccaugaagaucaagauuau

SEQ ID NO: 8220 - RNA, 19 nt, Homo sapiens
ccucgagacuacucuguua

SEQ ID NO: 8221 - RNA, 19 nt, Homo sapiens
gaccacagcugagagagaa

SEQ ID NO: 8222 - RNA, 19 nt, Homo sapiens
gggaugacauggagaagau

SEQ ID NO: 8223 - RNA, 19 nt, Homo sapiens
uaccagucaugaaacauua

SEQ ID NO: 8224 - RNA, 19 nt, Homo sapiens
ugacccagaucauguuuga

SEQ ID NO: 8225 - RNA, 19 nt, Homo sapiens
gagaggcuauuccuuugug

SEQ ID NO: 8226 - RNA, 19 nt, Homo sapiens
ucaugaagauccucacaga

SEQ ID NO: 8227 - RNA, 19 nt, Homo sapiens
agagagaggcuauuccuuu

SEQ ID NO: 8228 - RNA, 19 nt, Homo sapiens
ggaguccgcuggaauucau

SEQ ID NO: 8229 - RNA, 19 nt, Homo sapiens
ggaaugggccagaaagaca

SEQ ID NO: 8230 - RNA, 19 nt, Homo sapiens
acaauuccaucaugaagug

SEQ ID NO: 8231 - RNA, 19 nt, Homo sapiens
gcaccacuccuucuacaau

SEQ ID NO: 8232 - RNA, 19 nt, Homo sapiens
gaaauugugcgagacauca

SEQ ID NO: 8233 - RNA, 19 nt, Homo sapiens
gagcggaaguacucagucu

SEQ ID NO: 8234 - RNA, 19 nt, Homo sapiens
cgagggauccuaacucuca

SEQ ID NO: 8235 - RNA, 19 nt, Homo sapiens
cggacuaccucaugaagau

SEQ ID NO: 8236 - RNA, 19 nt, Homo sapiens
aggagaagcugugcuaugu

SEQ ID NO: 8237 - RNA, 19 nt, Homo sapiens
ucaaggagaagcugugcua

SEQ ID NO: 8238 - RNA, 19 nt, Homo sapiens
caaugucccugccauguac

SEQ ID NO: 8239 - RNA, 19 nt, Homo sapiens
gagacaaccuacaauucca

SEQ ID NO: 8240 - RNA, 19 nt, Homo sapiens
gaauucaugagacaaccua

SEQ ID NO: 8241 - RNA, 19 nt, Homo sapiens
gcugugcucucccucuaug

SEQ ID NO: 8242 - RNA, 19 nt, Homo sapiens
ccauguacgucgccauuca

SEQ ID NO: 8243 - RNA, 19 nt, Homo sapiens
gaagauccucacagagaga

SEQ ID NO: 8244 - RNA, 19 nt, Homo sapiens
gcaagccugaguaugauga

SEQ ID NO: 8245 - RNA, 19 nt, Homo sapiens
gcuauguggcccuggauuu

SEQ ID NO: 8246 - RNA, 19 nt, Homo sapiens
gaaaagaugacccagauca

SEQ ID NO: 8247 - RNA, 19 nt, Homo sapiens
cagcaagccugaguaugau

SEQ ID NO: 8248 - RNA, 19 nt, Homo sapiens
caugagacaaccuacaauu

SEQ ID NO: 8249 - RNA, 19 nt, Homo sapiens
gggaaaagaugacccagau

SEQ ID NO: 8250 - RNA, 19 nt, Homo sapiens
caucaugaagugugacauu

SEQ ID NO: 8251 - RNA, 19 nt, Homo sapiens
ccacagcagcuuccucuuc

SEQ ID NO: 8252 - RNA, 19 nt, Homo sapiens
ucaaugucccugccaugua

SEQ ID NO: 8253 - RNA, 19 nt, Homo sapiens
ccagaaagacagcuaugug

SEQ ID NO: 8254 - RNA, 19 nt, Homo sapiens
cuuccagccuuccuuuauu

SEQ ID NO: 8255 - RNA, 19 nt, Homo sapiens
gaagugugacauugacauc

SEQ ID NO: 8256 - RNA, 19 nt, Homo sapiens
aagcugugcucucccucua

SEQ ID NO: 8257 - RNA, 19 nt, Homo sapiens
gcucuauccuggccucucu

SEQ ID NO: 8258 - RNA, 19 nt, Homo sapiens
ggaaguacucagucuggau

SEQ ID NO: 8259 - RNA, 19 nt, Homo sapiens
cauggaguccgcuggaauu

SEQ ID NO: 8260 - RNA, 19 nt, Homo sapiens
caccacuccuucuacaaug

SEQ ID NO: 8261 - RNA, 19 nt, Homo sapiens
ugcgagacaucaaggagaa

SEQ ID NO: 8262 - RNA, 19 nt, Homo sapiens
ccagcaccaugaagaucaa

SEQ ID NO: 8263 - RNA, 19 nt, Homo sapiens
ucacagagagaggcuauuc

SEQ ID NO: 8264 - RNA, 19 nt, Homo sapiens
ggauccuaacucucaaaua

SEQ ID NO: 8265 - RNA, 19 nt, Homo sapiens
accaugaagaucaagauua

SEQ ID NO: 8266 - RNA, 19 nt, Homo sapiens
ucuguuaccagucaugaaa

SEQ ID NO: 8267 - RNA, 19 nt, Homo sapiens
gcaccaugaagaucaagau

SEQ ID NO: 8268 - RNA, 19 nt, Homo sapiens
aaccuacaauuccaucaug

SEQ ID NO: 8269 - RNA, 19 nt, Homo sapiens
gagggauccuaacucucaa

SEQ ID NO: 8270 - RNA, 19 nt, Homo sapiens
gagaaauugugcgagacau

SEQ ID NO: 8271 - RNA, 19 nt, Homo sapiens
guacgucgccauucaagcu

SEQ ID NO: 8272 - RNA, 19 nt, Homo sapiens
acccagaucauguuugaaa

SEQ ID NO: 8273 - RNA, 19 nt, Homo sapiens
ucuaaagucagaacagguu

SEQ ID NO: 8274 - RNA, 19 nt, Homo sapiens
gcauggaguccgcuggaau

SEQ ID NO: 8275 - RNA, 19 nt, Homo sapiens
gggcagguuaucaccauug

SEQ ID NO: 8276 - RNA, 19 nt, Homo sapiens
augaagauccucacagaga

SEQ ID NO: 8277 - RNA, 19 nt, Homo sapiens
ucaugaagugugacauuga

SEQ ID NO: 8278 - RNA, 19 nt, Homo sapiens
cagcugagagagaaauugu

SEQ ID NO: 8279 - RNA, 19 nt, Homo sapiens
uuaccagucaugaaacauu

SEQ ID NO: 8280 - RNA, 19 nt, Homo sapiens
ccagucaugaaacauuaaa

SEQ ID NO: 8281 - RNA, 19 nt, Homo sapiens
gaagaucaagauuauugcu

SEQ ID NO: 8282 - RNA, 19 nt, Homo sapiens
acauugacauccguaagga

SEQ ID NO: 8283 - RNA, 19 nt, Homo sapiens
caugaagugugacauugac

SEQ ID NO: 8284 - RNA, 19 nt, Homo sapiens
uuccagccuuccuuuauug

SEQ ID NO: 8285 - RNA, 19 nt, Homo sapiens
gagcaagcgagggauccua

SEQ ID NO: 8286 - RNA, 19 nt, Homo sapiens
ggagaagcugugcuaugug

SEQ ID NO: 8287 - RNA, 19 nt, Homo sapiens
cacagaggcuccccuaaau

SEQ ID NO: 8288 - RNA, 19 nt, Homo sapiens
cugacaggaugcagaagga

SEQ ID NO: 8289 - RNA, 19 nt, Homo sapiens
gacauugacauccguaagg

SEQ ID NO: 8290 - RNA, 19 nt, Homo sapiens
caaccuacaauuccaucau

SEQ ID NO: 8291 - RNA, 19 nt, Homo sapiens
ccagaugggcagguuauca

SEQ ID NO: 8292 - RNA, 19 nt, Homo sapiens
ucacagaggcuccccuaaa

SEQ ID NO: 8293 - RNA, 19 nt, Homo sapiens
gcgcucgugugugacaaug

SEQ ID NO: 8294 - RNA, 19 nt, Homo sapiens
caccauguacccuggcauu

SEQ ID NO: 8295 - RNA, 19 nt, Homo sapiens
uggcaccacuccuucuaca

SEQ ID NO: 8296 - RNA, 19 nt, Homo sapiens
ucacggacuaccucaugaa

SEQ ID NO: 8297 - RNA, 19 nt, Homo sapiens
caucaugcgccuggacuug

SEQ ID NO: 8298 - RNA, 19 nt, Homo sapiens
aggcagggcccuccauugu

SEQ ID NO: 8299 - RNA, 19 nt, Homo sapiens
ggcauggaguccgcuggaa

SEQ ID NO: 8300 - RNA, 19 nt, Homo sapiens
gcguguagcaccugaagag

SEQ ID NO: 8301 - RNA, 19 nt, Homo sapiens
cauguacccuggcauugcu

SEQ ID NO: 8302 - RNA, 19 nt, Homo sapiens
ggugggaaugggccagaaa

SEQ ID NO: 8303 - RNA, 19 nt, Homo sapiens
ccucacggacuaccucaug

SEQ ID NO: 8304 - RNA, 19 nt, Homo sapiens
gauggcgucacccacaaug

SEQ ID NO: 8305 - RNA, 19 nt, Homo sapiens
gaccagagcugauugagua

SEQ ID NO: 8306 - RNA, 19 nt, Homo sapiens
ucaacgagcuggauuacua

SEQ ID NO: 8307 - RNA, 19 nt, Homo sapiens
gcacacagaucgagaacau

SEQ ID NO: 8308 - RNA, 19 nt, Homo sapiens
gaacaaugccuucgaagug

SEQ ID NO: 8309 - RNA, 19 nt, Homo sapiens
gaacauugaugaggacuuc

SEQ ID NO: 8310 - RNA, 19 nt, Homo sapiens
gugcagaacuuccacauca

SEQ ID NO: 8311 - RNA, 19 nt, Homo sapiens
ggucaucgcuuccuucaag

SEQ ID NO: 8312 - RNA, 19 nt, Homo sapiens
ccagagaccugacccaaca

SEQ ID NO: 8313 - RNA, 19 nt, Homo sapiens
gcacagaccagagcugauu

SEQ ID NO: 8314 - RNA, 19 nt, Homo sapiens
cgaaguggcugagaaauac

SEQ ID NO: 8315 - RNA, 19 nt, Homo sapiens
ggacaucaaagcccucauu

SEQ ID NO: 8316 - RNA, 19 nt, Homo sapiens
aggaguggcugcugaauga

SEQ ID NO: 8317 - RNA, 19 nt, Homo sapiens
ggacaagaacuucaucaca

SEQ ID NO: 8318 - RNA, 19 nt, Homo sapiens
ggaaggaagccaugcugaa

SEQ ID NO: 8319 - RNA, 19 nt, Homo sapiens
guaaggugcuggcugucaa

SEQ ID NO: 8320 - RNA, 19 nt, Homo sapiens
gcaagcagcaguccaacga

SEQ ID NO: 8321 - RNA, 19 nt, Homo sapiens
ugagccaccugaagcagua

SEQ ID NO: 8322 - RNA, 19 nt, Homo sapiens
ucaacacgcugcagaccaa

SEQ ID NO: 8323 - RNA, 19 nt, Homo sapiens
ucaccaaccugaacaaugc

SEQ ID NO: 8324 - RNA, 19 nt, Homo sapiens
cagagcugauugaguauga

SEQ ID NO: 8325 - RNA, 19 nt, Homo sapiens
gaaagacagccccguauaa

SEQ ID NO: 8326 - RNA, 19 nt, Homo sapiens
caacaagcacaccaacuau

SEQ ID NO: 8327 - RNA, 19 nt, Homo sapiens
ggaccaucauccuuagguu

SEQ ID NO: 8328 - RNA, 19 nt, Homo sapiens
acaacaagcacaccaacua

SEQ ID NO: 8329 - RNA, 19 nt, Homo sapiens
gcaagauggucucggacau

SEQ ID NO: 8330 - RNA, 19 nt, Homo sapiens
gacgagaaggccauaauga

SEQ ID NO: 8331 - RNA, 19 nt, Homo sapiens
gaacgucaaugugcagaac

SEQ ID NO: 8332 - RNA, 19 nt, Homo sapiens
gaagaugagagugcacaaa

SEQ ID NO: 8333 - RNA, 19 nt, Homo sapiens
ggacggcaacgcaaagaug

SEQ ID NO: 8334 - RNA, 19 nt, Homo sapiens
gaaggaagccaugcugaag

SEQ ID NO: 8335 - RNA, 19 nt, Homo sapiens
acacagaucgagaacauug

SEQ ID NO: 8336 - RNA, 19 nt, Homo sapiens
gaguucaaccgcaucauga

SEQ ID NO: 8337 - RNA, 19 nt, Homo sapiens
ggugcuggcugucaaccaa

SEQ ID NO: 8338 - RNA, 19 nt, Homo sapiens
ucgaaguggcugagaaaua

SEQ ID NO: 8339 - RNA, 19 nt, Homo sapiens
agaccaagauggaggagau

SEQ ID NO: 8340 - RNA, 19 nt, Homo sapiens
ugaccuauguguccagcuu

SEQ ID NO: 8341 - RNA, 19 nt, Homo sapiens
gcuacgacguggagaacga

SEQ ID NO: 8342 - RNA, 19 nt, Homo sapiens
gcugagagcaaccacauca

SEQ ID NO: 8343 - RNA, 19 nt, Homo sapiens
gagacgggcucaagcucau

SEQ ID NO: 8344 - RNA, 19 nt, Homo sapiens
ggacaucuccguggaagag

SEQ ID NO: 8345 - RNA, 19 nt, Homo sapiens
ucaacgagguggagaacca

SEQ ID NO: 8346 - RNA, 19 nt, Homo sapiens
cagagaaguuccggcagaa

SEQ ID NO: 8347 - RNA, 19 nt, Homo sapiens
agaaggccauaaugaccua

SEQ ID NO: 8348 - RNA, 19 nt, Homo sapiens
aaccauagcggccuuguga

SEQ ID NO: 8349 - RNA, 19 nt, Homo sapiens
ccugaacaaugccuucgaa

SEQ ID NO: 8350 - RNA, 19 nt, Homo sapiens
gcagcaucguggacuacaa

SEQ ID NO: 8351 - RNA, 19 nt, Homo sapiens
ucucggacaucaacaaugg

SEQ ID NO: 8352 - RNA, 19 nt, Homo sapiens
gaaggcaggcacacagauc

SEQ ID NO: 8353 - RNA, 19 nt, Homo sapiens
uccaggagaugcagcagaa

SEQ ID NO: 8354 - RNA, 19 nt, Homo sapiens
cguauaagaacgucaaugu

SEQ ID NO: 8355 - RNA, 19 nt, Homo sapiens
ucaacaaugugaacaaagc

SEQ ID NO: 8356 - RNA, 19 nt, Homo sapiens
ugagaaauaccucgacauc

SEQ ID NO: 8357 - RNA, 19 nt, Homo sapiens
gaucuggaccaucauccuu

SEQ ID NO: 8358 - RNA, 19 nt, Homo sapiens
cugaggagcugcggagaga

SEQ ID NO: 8359 - RNA, 19 nt, Homo sapiens
agcagaagcuggaggacuu

SEQ ID NO: 8360 - RNA, 19 nt, Homo sapiens
gagaagcagcagcgcaaga

SEQ ID NO: 8361 - RNA, 19 nt, Homo sapiens
cgaaccagucguaccagua

SEQ ID NO: 8362 - RNA, 19 nt, Homo sapiens
aagaugacccugggaauga

SEQ ID NO: 8363 - RNA, 19 nt, Homo sapiens
cagcuucuaccaugccuuu

SEQ ID NO: 8364 - RNA, 19 nt, Homo sapiens
caaaucaucaacuccaagu

SEQ ID NO: 8365 - RNA, 19 nt, Homo sapiens
gaggaguggcugcugaaug

SEQ ID NO: 8366 - RNA, 19 nt, Homo sapiens
ccuccacucuguaucuaug

SEQ ID NO: 8367 - RNA, 19 nt, Homo sapiens
ccggugcccucgacuacaa

SEQ ID NO: 8368 - RNA, 19 nt, Homo sapiens
cgacgagaaggccauaaug

SEQ ID NO: 8369 - RNA, 19 nt, Homo sapiens
caaagaugacccugggaau

SEQ ID NO: 8370 - RNA, 19 nt, Homo sapiens
gacggcaacgcaaagauga

SEQ ID NO: 8371 - RNA, 19 nt, Homo sapiens
gcgucaagcuggucuccau

SEQ ID NO: 8372 - RNA, 19 nt, Homo sapiens
ucaaccacuucgacaagga

SEQ ID NO: 8373 - RNA, 19 nt, Homo sapiens
gggcguccuucaaccacuu

SEQ ID NO: 8374 - RNA, 19 nt, Homo sapiens
aggagcagaugcaggaguu

SEQ ID NO: 8375 - RNA, 19 nt, Homo sapiens
cagcugcucaccaccauug

SEQ ID NO: 8376 - RNA, 19 nt, Homo sapiens
aacaagcacaccaacuaua

SEQ ID NO: 8377 - RNA, 19 nt, Homo sapiens
cacacuaucggacaucaaa

SEQ ID NO: 8378 - RNA, 19 nt, Homo sapiens
ccaaggugcaggagaagug

SEQ ID NO: 8379 - RNA, 19 nt, Homo sapiens
gauggaggacuacgagaag

SEQ ID NO: 8380 - RNA, 19 nt, Homo sapiens
ccgccaaccggaucuguaa

SEQ ID NO: 8381 - RNA, 19 nt, Homo sapiens
guauaagaacgucaaugug

SEQ ID NO: 8382 - RNA, 19 nt, Homo sapiens
gcccucaucuucgacaaca

SEQ ID NO: 8383 - RNA, 19 nt, Homo sapiens
cgcccaaggugcaggagaa

SEQ ID NO: 8384 - RNA, 19 nt, Homo sapiens
cagaggacaucgugaacac

SEQ ID NO: 8385 - RNA, 19 nt, Homo sapiens
gcagaggacaucgugaaca

SEQ ID NO: 8386 - RNA, 19 nt, Homo sapiens
aggauggucuugccuucaa

SEQ ID NO: 8387 - RNA, 19 nt, Homo sapiens
aaagaugacccugggaaug

SEQ ID NO: 8388 - RNA, 19 nt, Homo sapiens
ggaaggcaggcacacagau

SEQ ID NO: 8389 - RNA, 19 nt, Homo sapiens
ggagauugagggccugauc

SEQ ID NO: 8390 - RNA, 19 nt, Homo sapiens
ggaccuccaggacauguuc

SEQ ID NO: 8391 - RNA, 19 nt, Homo sapiens
ggauggucuugccuucaau

SEQ ID NO: 8392 - RNA, 19 nt, Homo sapiens
acaaggaggcccagaggau

SEQ ID NO: 8393 - RNA, 19 nt, Homo sapiens
uuacuacgacucccacaau

SEQ ID NO: 8394 - RNA, 19 nt, Homo sapiens
cuacgagacggccacacua

SEQ ID NO: 8395 - RNA, 19 nt, Homo sapiens
ucgaccaccuggcagagaa

SEQ ID NO: 8396 - RNA, 19 nt, Homo sapiens
cgaguucaaccgcaucaug

SEQ ID NO: 8397 - RNA, 19 nt, Homo sapiens
agaacgagcaccugaugga

SEQ ID NO: 8398 - RNA, 19 nt, Homo sapiens
gggaagcccuggagaaaac

SEQ ID NO: 8399 - RNA, 19 nt, Homo sapiens
ggaagaugagagugcacaa

SEQ ID NO: 8400 - RNA, 19 nt, Homo sapiens
gacaucaaagcccucauuc

SEQ ID NO: 8401 - RNA, 19 nt, Homo sapiens
ugaacaaagcgcuggacuu

SEQ ID NO: 8402 - RNA, 19 nt, Homo sapiens
acaagcacaccaacuauac

SEQ ID NO: 8403 - RNA, 19 nt, Homo sapiens
ugauggaggacuacgagaa

SEQ ID NO: 8404 - RNA, 19 nt, Homo sapiens
ugaacaaugccuucgaagu

SEQ ID NO: 8405 - RNA, 19 nt, Homo sapiens
ggaaauagauggcgauaaa

SEQ ID NO: 8406 - RNA, 19 nt, Homo sapiens
gcaagaauaugaagaagga

SEQ ID NO: 8407 - RNA, 19 nt, Homo sapiens
caacaucccugccuucuuc

SEQ ID NO: 8408 - RNA, 19 nt, Homo sapiens
ggaagcacauuaauggaaa

SEQ ID NO: 8409 - RNA, 19 nt, Homo sapiens
gcacauuaauggaaauaga

SEQ ID NO: 8410 - RNA, 19 nt, Homo sapiens
gcagucacuucgccaguua

SEQ ID NO: 8411 - RNA, 19 nt, Homo sapiens
gaacggagguuuagcucau

SEQ ID NO: 8412 - RNA, 19 nt, Homo sapiens
ugacagaguuaauguuuga

SEQ ID NO: 8413 - RNA, 19 nt, Homo sapiens
gcuggagacuuuauuacua

SEQ ID NO: 8414 - RNA, 19 nt, Homo sapiens
gcaaagagagagaaacuga

SEQ ID NO: 8415 - RNA, 19 nt, Homo sapiens
gaagcaguguguagaaaga

SEQ ID NO: 8416 - RNA, 19 nt, Homo sapiens
ggaaacacacuaauacaga

SEQ ID NO: 8417 - RNA, 19 nt, Homo sapiens
gaaguuggagcccuuguuu

SEQ ID NO: 8418 - RNA, 19 nt, Homo sapiens
gaugccaacuguucauuau

SEQ ID NO: 8419 - RNA, 19 nt, Homo sapiens
acaaguggcugcacagaug

SEQ ID NO: 8420 - RNA, 19 nt, Homo sapiens
ggucuuggcacaauuauau

SEQ ID NO: 8421 - RNA, 19 nt, Homo sapiens
gcagagcggcuaaagauuc

SEQ ID NO: 8422 - RNA, 19 nt, Homo sapiens
ugaauugguuccuccauau

SEQ ID NO: 8423 - RNA, 19 nt, Homo sapiens
agaaagaguucccaagcuu

SEQ ID NO: 8424 - RNA, 19 nt, Homo sapiens
gcuaaagauuccagaagga

SEQ ID NO: 8425 - RNA, 19 nt, Homo sapiens
gagaaguugccucagguua

SEQ ID NO: 8426 - RNA, 19 nt, Homo sapiens
caaaaugcaugucaaauca

SEQ ID NO: 8427 - RNA, 19 nt, Homo sapiens
gacauuggauccuauacug

SEQ ID NO: 8428 - RNA, 19 nt, Homo sapiens
ccaacucuguuuaguguau

SEQ ID NO: 8429 - RNA, 19 nt, Homo sapiens
caaguaugcgguugaaauu

SEQ ID NO: 8430 - RNA, 19 nt, Homo sapiens
ggaggaaacacacuaauac

SEQ ID NO: 8431 - RNA, 19 nt, Homo sapiens
aaagauuccagaaggauua

SEQ ID NO: 8432 - RNA, 19 nt, Homo sapiens
gaauugguuccuccauaua

SEQ ID NO: 8433 - RNA, 19 nt, Homo sapiens
gggaagcaguguguagaaa

SEQ ID NO: 8434 - RNA, 19 nt, Homo sapiens
caagcaagaauaugaagaa

SEQ ID NO: 8435 - RNA, 19 nt, Homo sapiens
ugaaggaucuccagcaaac

SEQ ID NO: 8436 - RNA, 19 nt, Homo sapiens
guaaagggguuaucaggaa

SEQ ID NO: 8437 - RNA, 19 nt, Homo sapiens
aaaagaagcuguucgugaa

SEQ ID NO: 8438 - RNA, 19 nt, Homo sapiens
ccuacuacauagauacuaa

SEQ ID NO: 8439 - RNA, 19 nt, Homo sapiens
gagaaagaguucccaagcu

SEQ ID NO: 8440 - RNA, 19 nt, Homo sapiens
gaggcaccguggaauacua

SEQ ID NO: 8441 - RNA, 19 nt, Homo sapiens
ggauuuccaagcaagaaua

SEQ ID NO: 8442 - RNA, 19 nt, Homo sapiens
gcaggaggaaacacacuaa

SEQ ID NO: 8443 - RNA, 19 nt, Homo sapiens
ugggauaguuuccaagcua

SEQ ID NO: 8444 - RNA, 19 nt, Homo sapiens
guugaagacugggauaguu

SEQ ID NO: 8445 - RNA, 19 nt, Homo sapiens
gaugacggaagcacauuaa

SEQ ID NO: 8446 - RNA, 19 nt, Homo sapiens
agguuuagcucauggauug

SEQ ID NO: 8447 - RNA, 19 nt, Homo sapiens
aguaugcgguugaaauuga

SEQ ID NO: 8448 - RNA, 19 nt, Homo sapiens
gaagcacauuaauggaaau

SEQ ID NO: 8449 - RNA, 19 nt, Homo sapiens
gguugaaauugauugcaaa

SEQ ID NO: 8450 - RNA, 19 nt, Homo sapiens
ccaaguaugcgguugaaau

SEQ ID NO: 8451 - RNA, 19 nt, Homo sapiens
guugggaugugugauauug

SEQ ID NO: 8452 - RNA, 19 nt, Homo sapiens
gugcagagcggcuaaagau

SEQ ID NO: 8453 - RNA, 19 nt, Homo sapiens
gaucauaccuacaaaaugc

SEQ ID NO: 8454 - RNA, 19 nt, Homo sapiens
ccuuaggcuuacagaauua

SEQ ID NO: 8455 - RNA, 19 nt, Homo sapiens
aaaaugcccuugagaaaga

SEQ ID NO: 8456 - RNA, 19 nt, Homo sapiens
gaaagaaaaugcccuugag

SEQ ID NO: 8457 - RNA, 19 nt, Homo sapiens
gcuccauucuagccucuuu

SEQ ID NO: 8458 - RNA, 19 nt, Homo sapiens
ggguggcgguggaaguuaa

SEQ ID NO: 8459 - RNA, 19 nt, Homo sapiens
cuacauagauacuaaugcu

SEQ ID NO: 8460 - RNA, 19 nt, Homo sapiens
gaacaaguggcugcacaga

SEQ ID NO: 8461 - RNA, 19 nt, Homo sapiens
cagauucaacuuaugauga

SEQ ID NO: 8462 - RNA, 19 nt, Homo sapiens
ucagaggcaccguggaaua

SEQ ID NO: 8463 - RNA, 19 nt, Homo sapiens
aaaugcaugucaaaucaga

SEQ ID NO: 8464 - RNA, 19 nt, Homo sapiens
gaaaacuccuccaaguaug

SEQ ID NO: 8465 - RNA, 19 nt, Homo sapiens
gauuccagaaggauuauuu

SEQ ID NO: 8466 - RNA, 19 nt, Homo sapiens
cgaggucuuggcacaauua

SEQ ID NO: 8467 - RNA, 19 nt, Homo sapiens
uugaauugguuccuccaua

SEQ ID NO: 8468 - RNA, 19 nt, Homo sapiens
gacggaagcacauuaaugg

SEQ ID NO: 8469 - RNA, 19 nt, Homo sapiens
acacacuaauacagaguuu

SEQ ID NO: 8470 - RNA, 19 nt, Homo sapiens
gaaaagaaaagagaaguug

SEQ ID NO: 8471 - RNA, 19 nt, Homo sapiens
gagcaaagagagagaaacu

SEQ ID NO: 8472 - RNA, 19 nt, Homo sapiens
cuggagacuuuauuacuau

SEQ ID NO: 8473 - RNA, 19 nt, Homo sapiens
gaggaaacacacuaauaca

SEQ ID NO: 8474 - RNA, 19 nt, Homo sapiens
gaaguugccucagguuacg

SEQ ID NO: 8475 - RNA, 19 nt, Homo sapiens
agacugggauaguuuccaa

SEQ ID NO: 8476 - RNA, 19 nt, Homo sapiens
ugacggaagcacauuaaug

SEQ ID NO: 8477 - RNA, 19 nt, Homo sapiens
guaaaaugcuuuccaacuc

SEQ ID NO: 8478 - RNA, 19 nt, Homo sapiens
cgugaaggaucuccagcaa

SEQ ID NO: 8479 - RNA, 19 nt, Homo sapiens
ggucccaccuacuacauag

SEQ ID NO: 8480 - RNA, 19 nt, Homo sapiens
uuggguaccuuucaacaga

SEQ ID NO: 8481 - RNA, 19 nt, Homo sapiens
aaaaugggaugguugaaga

SEQ ID NO: 8482 - RNA, 19 nt, Homo sapiens
caacucuguuuaguguauu

SEQ ID NO: 8483 - RNA, 19 nt, Homo sapiens
uaaagauuccagaaggauu

SEQ ID NO: 8484 - RNA, 19 nt, Homo sapiens
gcuuuaacuggcucuauaa

SEQ ID NO: 8485 - RNA, 19 nt, Homo sapiens
ggagggaagcaguguguag

SEQ ID NO: 8486 - RNA, 19 nt, Homo sapiens
ugugagagcugguuaugcu

SEQ ID NO: 8487 - RNA, 19 nt, Homo sapiens
aggaggaaacacacuaaua

SEQ ID NO: 8488 - RNA, 19 nt, Homo sapiens
guuccuccauauaugauug

SEQ ID NO: 8489 - RNA, 19 nt, Homo sapiens
gcuaauggucguucuacug

SEQ ID NO: 8490 - RNA, 19 nt, Homo sapiens
agcuuuaacuggcucuaua

SEQ ID NO: 8491 - RNA, 19 nt, Homo sapiens
gaaugaccaucuuuuguag

SEQ ID NO: 8492 - RNA, 19 nt, Homo sapiens
ggaagcaguguguagaaag

SEQ ID NO: 8493 - RNA, 19 nt, Homo sapiens
ugucagauucaacuuauga

SEQ ID NO: 8494 - RNA, 19 nt, Homo sapiens
cggaagcacauuaauggaa

SEQ ID NO: 8495 - RNA, 19 nt, Homo sapiens
gauuggcggcuccauucua

SEQ ID NO: 8496 - RNA, 19 nt, Homo sapiens
acaguggaacggagguuua

SEQ ID NO: 8497 - RNA, 19 nt, Homo sapiens
ucagaaaacuccuccaagu

SEQ ID NO: 8498 - RNA, 19 nt, Homo sapiens
guauggugguagaaagaga

SEQ ID NO: 8499 - RNA, 19 nt, Homo sapiens
gagacuuuauuacuaugca

SEQ ID NO: 8500 - RNA, 19 nt, Homo sapiens
aaauuagccauuccagaaa

SEQ ID NO: 8501 - RNA, 19 nt, Homo sapiens
aaaauuagccauuccagaa

SEQ ID NO: 8502 - RNA, 19 nt, Homo sapiens
uuccaacucuguuuagugu

SEQ ID NO: 8503 - RNA, 19 nt, Homo sapiens
gcuuuaguauacucaggaa

SEQ ID NO: 8504 - RNA, 19 nt, Homo sapiens
gagggaagcaguguguaga

SEQ ID NO: 8505 - RNA, 19 nt, Homo sapiens
ucaaugagcuggacuauua

SEQ ID NO: 8506 - RNA, 19 nt, Homo sapiens
gcaccgaaaugucuuguuu

SEQ ID NO: 8507 - RNA, 19 nt, Homo sapiens
agaaagccaucaugacuua

SEQ ID NO: 8508 - RNA, 19 nt, Homo sapiens
gagagaagguggaggaaga

SEQ ID NO: 8509 - RNA, 19 nt, Homo sapiens
ggacacagaucgagaacau

SEQ ID NO: 8510 - RNA, 19 nt, Homo sapiens
gcacaaaguuauauuccau

SEQ ID NO: 8511 - RNA, 19 nt, Homo sapiens
ggagaucaauggcaaaugg

SEQ ID NO: 8512 - RNA, 19 nt, Homo sapiens
cagcuuggguuaugauauu

SEQ ID NO: 8513 - RNA, 19 nt, Homo sapiens
ucaaggcccugcucaagaa

SEQ ID NO: 8514 - RNA, 19 nt, Homo sapiens
gacaagaacuacauuacca

SEQ ID NO: 8515 - RNA, 19 nt, Homo sapiens
gaauuugcccgcaucauga

SEQ ID NO: 8516 - RNA, 19 nt, Homo sapiens
acaaugagguguccaagau

SEQ ID NO: 8517 - RNA, 19 nt, Homo sapiens
ggcccgagcugauugacua

SEQ ID NO: 8518 - RNA, 19 nt, Homo sapiens
gggagaagcagcagagaaa

SEQ ID NO: 8519 - RNA, 19 nt, Homo sapiens
ccagggagaagcagaauuu

SEQ ID NO: 8520 - RNA, 19 nt, Homo sapiens
acgagaagcuggccaguga

SEQ ID NO: 8521 - RNA, 19 nt, Homo sapiens
gccaggagcagaugaauga

SEQ ID NO: 8522 - RNA, 19 nt, Homo sapiens
agaagagcaucgucaacua

SEQ ID NO: 8523 - RNA, 19 nt, Homo sapiens
caaccggccugccuucaug

SEQ ID NO: 8524 - RNA, 19 nt, Homo sapiens
caucaugacuuacgugucu

SEQ ID NO: 8525 - RNA, 19 nt, Homo sapiens
gaggagugguugcugaaug

SEQ ID NO: 8526 - RNA, 19 nt, Homo sapiens
ugacuuacgugucuagcuu

SEQ ID NO: 8527 - RNA, 19 nt, Homo sapiens
caacaaggcccuggauuuc

SEQ ID NO: 8528 - RNA, 19 nt, Homo sapiens
cgaaaugucuuguuuuguu

SEQ ID NO: 8529 - RNA, 19 nt, Homo sapiens
gaacgagcagcuuauggaa

SEQ ID NO: 8530 - RNA, 19 nt, Homo sapiens
auccagaacuuccacauaa

SEQ ID NO: 8531 - RNA, 19 nt, Homo sapiens
gcaaaccaacgauuacaug

SEQ ID NO: 8532 - RNA, 19 nt, Homo sapiens
cgaagugacaguuuacaaa

SEQ ID NO: 8533 - RNA, 19 nt, Homo sapiens
gaagguggaggaagaaauc

SEQ ID NO: 8534 - RNA, 19 nt, Homo sapiens
gaacugcccgaccggauga

SEQ ID NO: 8535 - RNA, 19 nt, Homo sapiens
ucaacaaggcccuggauuu

SEQ ID NO: 8536 - RNA, 19 nt, Homo sapiens
gaaaauaaccaagcacaaa

SEQ ID NO: 8537 - RNA, 19 nt, Homo sapiens
guucaaagccugccucauc

SEQ ID NO: 8538 - RNA, 19 nt, Homo sapiens
ucaacacgcugcagaccaa

SEQ ID NO: 8539 - RNA, 19 nt, Homo sapiens
caacuacaagccaaagauu

SEQ ID NO: 8540 - RNA, 19 nt, Homo sapiens
acaacaagcacaccaacua

SEQ ID NO: 8541 - RNA, 19 nt, Homo sapiens
ccaagauuguccagaccua

SEQ ID NO: 8542 - RNA, 19 nt, Homo sapiens
gagaaagccaucaugacuu

SEQ ID NO: 8543 - RNA, 19 nt, Homo sapiens
gagaagcagcagagaaaga

SEQ ID NO: 8544 - RNA, 19 nt, Homo sapiens
gcuggacuauuaugacuca

SEQ ID NO: 8545 - RNA, 19 nt, Homo sapiens
cuagcucacuuguccauga

SEQ ID NO: 8546 - RNA, 19 nt, Homo sapiens
ucaaugagguagagaacca

SEQ ID NO: 8547 - RNA, 19 nt, Homo sapiens
gagcuggacuauuaugacu

SEQ ID NO: 8548 - RNA, 19 nt, Homo sapiens
ggccuggacugacggcaaa

SEQ ID NO: 8549 - RNA, 19 nt, Homo sapiens
aacagaagcuggaggacuu

SEQ ID NO: 8550 - RNA, 19 nt, Homo sapiens
acgagcagcuuauggaaga

SEQ ID NO: 8551 - RNA, 19 nt, Homo sapiens
gcaggacaccuucauugug

SEQ ID NO: 8552 - RNA, 19 nt, Homo sapiens
caggagaacgagcagcuua

SEQ ID NO: 8553 - RNA, 19 nt, Homo sapiens
gauccacucacaaaucuga

SEQ ID NO: 8554 - RNA, 19 nt, Homo sapiens
gaaaugucuuguuuuguug

SEQ ID NO: 8555 - RNA, 19 nt, Homo sapiens
gaugauccacucacaaauc

SEQ ID NO: 8556 - RNA, 19 nt, Homo sapiens
ggaagcugcggaaggauga

SEQ ID NO: 8557 - RNA, 19 nt, Homo sapiens
cagcaaaggcgucaaacug

SEQ ID NO: 8558 - RNA, 19 nt, Homo sapiens
agaacuacauuaccaugga

SEQ ID NO: 8559 - RNA, 19 nt, Homo sapiens
agucauggcuuccuucaag

SEQ ID NO: 8560 - RNA, 19 nt, Homo sapiens
aaugagguguccaagauug

SEQ ID NO: 8561 - RNA, 19 nt, Homo sapiens
agaccaagauggaggagau

SEQ ID NO: 8562 - RNA, 19 nt, Homo sapiens
gaagacaucguuggaacug

SEQ ID NO: 8563 - RNA, 19 nt, Homo sapiens
caucugcuguauucauuuc

SEQ ID NO: 8564 - RNA, 19 nt, Homo sapiens
cgagacagccgacacagau

SEQ ID NO: 8565 - RNA, 19 nt, Homo sapiens
gaagagcaucgucaacuac

SEQ ID NO: 8566 - RNA, 19 nt, Homo sapiens
ccacagcccaugagcaguu

SEQ ID NO: 8567 - RNA, 19 nt, Homo sapiens
gaggagauccagggacuga

SEQ ID NO: 8568 - RNA, 19 nt, Homo sapiens
ccacucacaaaucugaaua

SEQ ID NO: 8569 - RNA, 19 nt, Homo sapiens
ggacaucuccguggaagag

SEQ ID NO: 8570 - RNA, 19 nt, Homo sapiens
gaagugacaguuuacaaaa

SEQ ID NO: 8571 - RNA, 19 nt, Homo sapiens
gaucaaggcccugcucaag

SEQ ID NO: 8572 - RNA, 19 nt, Homo sapiens
cagagaaguuccggcagaa

SEQ ID NO: 8573 - RNA, 19 nt, Homo sapiens
gcaagguguuggccgucaa

SEQ ID NO: 8574 - RNA, 19 nt, Homo sapiens
ccagagcgaggcaagauga

SEQ ID NO: 8575 - RNA, 19 nt, Homo sapiens
uuaacuauuugcaccgaaa

SEQ ID NO: 8576 - RNA, 19 nt, Homo sapiens
gagacagccgacacagaua

SEQ ID NO: 8577 - RNA, 19 nt, Homo sapiens
gcgcucaucuucgacaaca

SEQ ID NO: 8578 - RNA, 19 nt, Homo sapiens
gggcugcacccuucaacaa

SEQ ID NO: 8579 - RNA, 19 nt, Homo sapiens
aggagugguugcugaauga

SEQ ID NO: 8580 - RNA, 19 nt, Homo sapiens
ggaugggaaugugaagaug

SEQ ID NO: 8581 - RNA, 19 nt, Homo sapiens
guuaugauauuggcaacga

SEQ ID NO: 8582 - RNA, 19 nt, Homo sapiens
gagaagagcaucgucaacu

SEQ ID NO: 8583 - RNA, 19 nt, Homo sapiens
agaccuaccacgucaauau

SEQ ID NO: 8584 - RNA, 19 nt, Homo sapiens
gcaugaggccuucgagagu

SEQ ID NO: 8585 - RNA, 19 nt, Homo sapiens
cgacagaaggacuaugaga

SEQ ID NO: 8586 - RNA, 19 nt, Homo sapiens
gaugggaaugugaagauga

SEQ ID NO: 8587 - RNA, 19 nt, Homo sapiens
cauuaugauucucagcaaa

SEQ ID NO: 8588 - RNA, 19 nt, Homo sapiens
aggagcagaugaaugaguu

SEQ ID NO: 8589 - RNA, 19 nt, Homo sapiens
gaugagagugcacaagauc

SEQ ID NO: 8590 - RNA, 19 nt, Homo sapiens
gcaggauggucucggacau

SEQ ID NO: 8591 - RNA, 19 nt, Homo sapiens
ggccucggcuucugugcuu

SEQ ID NO: 8592 - RNA, 19 nt, Homo sapiens
cauccagaacuuccacaua

SEQ ID NO: 8593 - RNA, 19 nt, Homo sapiens
guauucauuucuccaaucu

SEQ ID NO: 8594 - RNA, 19 nt, Homo sapiens
gcacaccauugaggagauc

SEQ ID NO: 8595 - RNA, 19 nt, Homo sapiens
cagcagagaaagacauuca

SEQ ID NO: 8596 - RNA, 19 nt, Homo sapiens
gcuggccagugaucuguug

SEQ ID NO: 8597 - RNA, 19 nt, Homo sapiens
caaaucugaauacggcuuu

SEQ ID NO: 8598 - RNA, 19 nt, Homo sapiens
acaaggcccuggauuucau

SEQ ID NO: 8599 - RNA, 19 nt, Homo sapiens
caggugcucuggacuacau

SEQ ID NO: 8600 - RNA, 19 nt, Homo sapiens
gaccaucaaugagguagag

SEQ ID NO: 8601 - RNA, 19 nt, Homo sapiens
ccauuaugauucucagcaa

SEQ ID NO: 8602 - RNA, 19 nt, Homo sapiens
ggagaacgagcagcuuaug

SEQ ID NO: 8603 - RNA, 19 nt, Homo sapiens
gggauggccugaagcucau

SEQ ID NO: 8604 - RNA, 19 nt, Homo sapiens
ggaaagauuaacuauuugc

SEQ ID NO: 8605 - RNA, 19 nt, Homo sapiens
ucaaugaacuggacuauca

SEQ ID NO: 8606 - RNA, 19 nt, Homo sapiens
ggaggugaguucuuucuuu

SEQ ID NO: 8607 - RNA, 19 nt, Homo sapiens
caucggcgcugaagaaauu

SEQ ID NO: 8608 - RNA, 19 nt, Homo sapiens
auagugcgcuucauaaaua

SEQ ID NO: 8609 - RNA, 19 nt, Homo sapiens
agaaacaucugccaaagaa

SEQ ID NO: 8610 - RNA, 19 nt, Homo sapiens
caagagggcugcuccuuuc

SEQ ID NO: 8611 - RNA, 19 nt, Homo sapiens
gcaagauggugucggauau

SEQ ID NO: 8612 - RNA, 19 nt, Homo sapiens
gaauuugcccgcauuauga

SEQ ID NO: 8613 - RNA, 19 nt, Homo sapiens
ugaaccagcugaagcagua

SEQ ID NO: 8614 - RNA, 19 nt, Homo sapiens
gagagaagcccuagagaga

SEQ ID NO: 8615 - RNA, 19 nt, Homo sapiens
acucaaagcuuaacaagga

SEQ ID NO: 8616 - RNA, 19 nt, Homo sapiens
cuaaaggccugcuccauga

SEQ ID NO: 8617 - RNA, 19 nt, Homo sapiens
cauacuagcuggaaagaug

SEQ ID NO: 8618 - RNA, 19 nt, Homo sapiens
gaagaaacaucugccaaag

SEQ ID NO: 8619 - RNA, 19 nt, Homo sapiens
guugacagcuuguagagaa

SEQ ID NO: 8620 - RNA, 19 nt, Homo sapiens
gagaagcccuagagagaau

SEQ ID NO: 8621 - RNA, 19 nt, Homo sapiens
agaagaagcuggaggacuu

SEQ ID NO: 8622 - RNA, 19 nt, Homo sapiens
uaaauaagcagguuucugu

SEQ ID NO: 8623 - RNA, 19 nt, Homo sapiens
aaagagccaucaugacgua

SEQ ID NO: 8624 - RNA, 19 nt, Homo sapiens
ggccugaccucauugacua

SEQ ID NO: 8625 - RNA, 19 nt, Homo sapiens
cucaagagaugaccacaua

SEQ ID NO: 8626 - RNA, 19 nt, Homo sapiens
gcaccuggauauuccuaaa

SEQ ID NO: 8627 - RNA, 19 nt, Homo sapiens
uaagcagguuucuguagua

SEQ ID NO: 8628 - RNA, 19 nt, Homo sapiens
ggacagaaggaaagugaaa

SEQ ID NO: 8629 - RNA, 19 nt, Homo sapiens
auucagaacuuccauacua

SEQ ID NO: 8630 - RNA, 19 nt, Homo sapiens
caaagaaggucugcugcuu

SEQ ID NO: 8631 - RNA, 19 nt, Homo sapiens
gcacgagacuugggcuuau

SEQ ID NO: 8632 - RNA, 19 nt, Homo sapiens
gaaccggacucccgagaag

SEQ ID NO: 8633 - RNA, 19 nt, Homo sapiens
guacgucucuugcuucuac

SEQ ID NO: 8634 - RNA, 19 nt, Homo sapiens
gaaaacugcuccuuauaga

SEQ ID NO: 8635 - RNA, 19 nt, Homo sapiens
ugacauagugcgcuucaua

SEQ ID NO: 8636 - RNA, 19 nt, Homo sapiens
gauccuggcuucugauaag

SEQ ID NO: 8637 - RNA, 19 nt, Homo sapiens
uagagagaauggagaaauu

SEQ ID NO: 8638 - RNA, 19 nt, Homo sapiens
gacagcggcuaacaggaua

SEQ ID NO: 8639 - RNA, 19 nt, Homo sapiens
aaacugcuccuuauagaaa

SEQ ID NO: 8640 - RNA, 19 nt, Homo sapiens
gcacccagauugagaacau

SEQ ID NO: 8641 - RNA, 19 nt, Homo sapiens
caagagaugaccacauaaa

SEQ ID NO: 8642 - RNA, 19 nt, Homo sapiens
gaggaagaauggccugaug

SEQ ID NO: 8643 - RNA, 19 nt, Homo sapiens
uaacaaggaugaccccaua

SEQ ID NO: 8644 - RNA, 19 nt, Homo sapiens
ggaauggccuuaagcucau

SEQ ID NO: 8645 - RNA, 19 nt, Homo sapiens
uagcacaucuugaucuguu

SEQ ID NO: 8646 - RNA, 19 nt, Homo sapiens
ucucuuauccuccagaaua

SEQ ID NO: 8647 - RNA, 19 nt, Homo sapiens
gacaagcuuuauuaaguug

SEQ ID NO: 8648 - RNA, 19 nt, Homo sapiens
ccaggaggcccuugucuuu

SEQ ID NO: 8649 - RNA, 19 nt, Homo sapiens
guaagguucuugcugugaa

SEQ ID NO: 8650 - RNA, 19 nt, Homo sapiens
gcagguuucuguaguacug

SEQ ID NO: 8651 - RNA, 19 nt, Homo sapiens
gaaacuuugacaagcuuua

SEQ ID NO: 8652 - RNA, 19 nt, Homo sapiens
gaggagugguugcucaaug

SEQ ID NO: 8653 - RNA, 19 nt, Homo sapiens
gacuugggcuuauggcaaa

SEQ ID NO: 8654 - RNA, 19 nt, Homo sapiens
cagaacaaauuacuugagu

SEQ ID NO: 8655 - RNA, 19 nt, Homo sapiens
gagcuucuguaaucacuca

SEQ ID NO: 8656 - RNA, 19 nt, Homo sapiens
gagaagcaccuggauauuc

SEQ ID NO: 8657 - RNA, 19 nt, Homo sapiens
gggaguauauuugggauuc

SEQ ID NO: 8658 - RNA, 19 nt, Homo sapiens
ugggaacgcuuacucagaa

SEQ ID NO: 8659 - RNA, 19 nt, Homo sapiens
aagaaggucugcugcuuug

SEQ ID NO: 8660 - RNA, 19 nt, Homo sapiens
gaucugugaugcugagcuu

SEQ ID NO: 8661 - RNA, 19 nt, Homo sapiens
gaaauugcuagaaaccauu

SEQ ID NO: 8662 - RNA, 19 nt, Homo sapiens
gagaauggagaaauugcua

SEQ ID NO: 8663 - RNA, 19 nt, Homo sapiens
gcggaagcuuuacauaugu

SEQ ID NO: 8664 - RNA, 19 nt, Homo sapiens
uguuagagcuuauuaguac

SEQ ID NO: 8665 - RNA, 19 nt, Homo sapiens
gaguauauuugggauucua

SEQ ID NO: 8666 - RNA, 19 nt, Homo sapiens
gggagaagcagcagaggaa

SEQ ID NO: 8667 - RNA, 19 nt, Homo sapiens
ggaagucacaguuuguuuc

SEQ ID NO: 8668 - RNA, 19 nt, Homo sapiens
gcacaacaucaucaacuau

SEQ ID NO: 8669 - RNA, 19 nt, Homo sapiens
ucaacacgcugcagaccaa

SEQ ID NO: 8670 - RNA, 19 nt, Homo sapiens
uaaggagaagccagaguua

SEQ ID NO: 8671 - RNA, 19 nt, Homo sapiens
ucacaaggcaagucagaaa

SEQ ID NO: 8672 - RNA, 19 nt, Homo sapiens
gaaagccggcacccagauu

SEQ ID NO: 8673 - RNA, 19 nt, Homo sapiens
gacauagugcgcuucauaa

SEQ ID NO: 8674 - RNA, 19 nt, Homo sapiens
ccauggaaaucgcugagaa

SEQ ID NO: 8675 - RNA, 19 nt, Homo sapiens
ugaagaaacaucugccaaa

SEQ ID NO: 8676 - RNA, 19 nt, Homo sapiens
gcccaguacugcaucaaga

SEQ ID NO: 8677 - RNA, 19 nt, Homo sapiens
acaacaagcacacgaacua

SEQ ID NO: 8678 - RNA, 19 nt, Homo sapiens
uggaacaccuggcugagaa

SEQ ID NO: 8679 - RNA, 19 nt, Homo sapiens
cgagugagcuuuuggaaug

SEQ ID NO: 8680 - RNA, 19 nt, Homo sapiens
cgacgaggaugaguacaug

SEQ ID NO: 8681 - RNA, 19 nt, Homo sapiens
auucagagcuacaacauca

SEQ ID NO: 8682 - RNA, 19 nt, Homo sapiens
agaaggugauucagagcua

SEQ ID NO: 8683 - RNA, 19 nt, Homo sapiens
ccaagagggcugcuccuuu

SEQ ID NO: 8684 - RNA, 19 nt, Homo sapiens
caaccguccugccuucaug

SEQ ID NO: 8685 - RNA, 19 nt, Homo sapiens
caguggaggugaguucuuu

SEQ ID NO: 8686 - RNA, 19 nt, Homo sapiens
augcugagcuucuguaauc

SEQ ID NO: 8687 - RNA, 19 nt, Homo sapiens
cacaacaucaucaacuaua

SEQ ID NO: 8688 - RNA, 19 nt, Homo sapiens
gaacaagauggaggagauu

SEQ ID NO: 8689 - RNA, 19 nt, Homo sapiens
gggaaaggcugcccaaacc

SEQ ID NO: 8690 - RNA, 19 nt, Homo sapiens
ggauauuucgguugaagaa

SEQ ID NO: 8691 - RNA, 19 nt, Homo sapiens
gacagcuuguagagaauaa

SEQ ID NO: 8692 - RNA, 19 nt, Homo sapiens
ugcggaagcuuuacauaug

SEQ ID NO: 8693 - RNA, 19 nt, Homo sapiens
gaggugaguucuuucuuuu

SEQ ID NO: 8694 - RNA, 19 nt, Homo sapiens
ggaagaauggccugaugga

SEQ ID NO: 8695 - RNA, 19 nt, Homo sapiens
agaacaagauggaggagau

SEQ ID NO: 8696 - RNA, 19 nt, Homo sapiens
gcacugucaccauggauga

SEQ ID NO: 8697 - RNA, 19 nt, Homo sapiens
gacaguguauccuaacaag

SEQ ID NO: 8698 - RNA, 19 nt, Homo sapiens
guggaagucaguuuaauug

SEQ ID NO: 8699 - RNA, 19 nt, Homo sapiens
acacguggaagucaguuua

SEQ ID NO: 8700 - RNA, 19 nt, Homo sapiens
ucaacucagucagugauuu

SEQ ID NO: 8701 - RNA, 19 nt, Homo sapiens
cagguugauuucuuugauu

SEQ ID NO: 8702 - RNA, 19 nt, Homo sapiens
cgaauuugcccgcauuaug

SEQ ID NO: 8703 - RNA, 19 nt, Homo sapiens
ugcaagauauguucauugu

SEQ ID NO: 8704 - RNA, 19 nt, Homo sapiens
acaccggccugaccucauu

SEQ ID NO: 8705 - RNA, 19 nt, Homo sapiens
ggacaucucuguggaagaa

SEQ ID NO: 8706 - RNA, 19 nt, Homo sapiens
gccaagugcuucugaauaa

SEQ ID NO: 8707 - RNA, 19 nt, Homo sapiens
gaacaucgaggaagauuuc

SEQ ID NO: 8708 - RNA, 19 nt, Homo sapiens
ggaguuugcucgcaucaug

SEQ ID NO: 8709 - RNA, 19 nt, Homo sapiens
gcaaggugcuggcagugaa

SEQ ID NO: 8710 - RNA, 19 nt, Homo sapiens
ucaaugagcuggacuacca

SEQ ID NO: 8711 - RNA, 19 nt, Homo sapiens
ccacugagguucucuaugc

SEQ ID NO: 8712 - RNA, 19 nt, Homo sapiens
gcccugaccucaucgacua

SEQ ID NO: 8713 - RNA, 19 nt, Homo sapiens
gauggagccugaugacuuc

SEQ ID NO: 8714 - RNA, 19 nt, Homo sapiens
gcaccuggcugagaaguuc

SEQ ID NO: 8715 - RNA, 19 nt, Homo sapiens
gcaauggccucaaacucau

SEQ ID NO: 8716 - RNA, 19 nt, Homo sapiens
gagcaagggccuaagagaa

SEQ ID NO: 8717 - RNA, 19 nt, Homo sapiens
gcacccagaucgagaacau

SEQ ID NO: 8718 - RNA, 19 nt, Homo sapiens
gagcauccuucaaccacuu

SEQ ID NO: 8719 - RNA, 19 nt, Homo sapiens
gagcuugccucaucuccau

SEQ ID NO: 8720 - RNA, 19 nt, Homo sapiens
augagaagcuugccaguga

SEQ ID NO: 8721 - RNA, 19 nt, Homo sapiens
caagaugcgcuuccacaaa

SEQ ID NO: 8722 - RNA, 19 nt, Homo sapiens
ugacacgacugagcaaguu

SEQ ID NO: 8723 - RNA, 19 nt, Homo sapiens
gacgggaaccugaagauga

SEQ ID NO: 8724 - RNA, 19 nt, Homo sapiens
gagcagaacauuaucaacu

SEQ ID NO: 8725 - RNA, 19 nt, Homo sapiens
cagcaggagcagaacauua

SEQ ID NO: 8726 - RNA, 19 nt, Homo sapiens
uaacaaggcccuggacuuc

SEQ ID NO: 8727 - RNA, 19 nt, Homo sapiens
gcagaacauuaucaacuac

SEQ ID NO: 8728 - RNA, 19 nt, Homo sapiens
cgacuacgauucggcuuug

SEQ ID NO: 8729 - RNA, 19 nt, Homo sapiens
ucaaugaaguggagaacca

SEQ ID NO: 8730 - RNA, 19 nt, Homo sapiens
ggagaucaacuucaacaca

SEQ ID NO: 8731 - RNA, 19 nt, Homo sapiens
agaaggccaucaugaccua

SEQ ID NO: 8732 - RNA, 19 nt, Homo sapiens
ugacagcgcacgaucaguu

SEQ ID NO: 8733 - RNA, 19 nt, Homo sapiens
ccaagugcuucugaauaaa

SEQ ID NO: 8734 - RNA, 19 nt, Homo sapiens
acaauaagcacaccgucua

SEQ ID NO: 8735 - RNA, 19 nt, Homo sapiens
gauguuggaugcagaagac

SEQ ID NO: 8736 - RNA, 19 nt, Homo sapiens
cauuggugcugaagagauu

SEQ ID NO: 8737 - RNA, 19 nt, Homo sapiens
gagagacagccgagacuga

SEQ ID NO: 8738 - RNA, 19 nt, Homo sapiens
gaagcggaaugggaugaug

SEQ ID NO: 8739 - RNA, 19 nt, Homo sapiens
agcagaacauuaucaacua

SEQ ID NO: 8740 - RNA, 19 nt, Homo sapiens
ucaacacacugcagaccaa

SEQ ID NO: 8741 - RNA, 19 nt, Homo sapiens
cagaagacauugugaacac

SEQ ID NO: 8742 - RNA, 19 nt, Homo sapiens
gcaagaugcgcuuccacaa

SEQ ID NO: 8743 - RNA, 19 nt, Homo sapiens
caacuacaagacuaacauu

SEQ ID NO: 8744 - RNA, 19 nt, Homo sapiens
ggaggaguaugagaagcuu

SEQ ID NO: 8745 - RNA, 19 nt, Homo sapiens
ugaccuauguguccugcuu

SEQ ID NO: 8746 - RNA, 19 nt, Homo sapiens
agaagcugauggaggagua

SEQ ID NO: 8747 - RNA, 19 nt, Homo sapiens
ggagcaagggccuaagaga

SEQ ID NO: 8748 - RNA, 19 nt, Homo sapiens
gagguucucuaugcaagau

SEQ ID NO: 8749 - RNA, 19 nt, Homo sapiens
ccugaugacuuccgagcuu

SEQ ID NO: 8750 - RNA, 19 nt, Homo sapiens
ggguuaaacugguguccau

SEQ ID NO: 8751 - RNA, 19 nt, Homo sapiens
gaccuuccaggccuucaua

SEQ ID NO: 8752 - RNA, 19 nt, Homo sapiens
agagcgaggugccaucaug

SEQ ID NO: 8753 - RNA, 19 nt, Homo sapiens
gagaacaucgaggaagauu

SEQ ID NO: 8754 - RNA, 19 nt, Homo sapiens
gagaaaagccagccaagug

SEQ ID NO: 8755 - RNA, 19 nt, Homo sapiens
ccuuugagguggcagagaa

SEQ ID NO: 8756 - RNA, 19 nt, Homo sapiens
cuacaagacuaacauugac

SEQ ID NO: 8757 - RNA, 19 nt, Homo sapiens
gaacauuaucaacuacaag

SEQ ID NO: 8758 - RNA, 19 nt, Homo sapiens
gaucuggaccaucauccuu

SEQ ID NO: 8759 - RNA, 19 nt, Homo sapiens
gcaagggccuaagagaaaa

SEQ ID NO: 8760 - RNA, 19 nt, Homo sapiens
ggagacaagaacuacauca

SEQ ID NO: 8761 - RNA, 19 nt, Homo sapiens
ugauggagccugaugacuu

SEQ ID NO: 8762 - RNA, 19 nt, Homo sapiens
gcaagcuggucucggacau

SEQ ID NO: 8763 - RNA, 19 nt, Homo sapiens
ggagcccgaucgagaugau

SEQ ID NO: 8764 - RNA, 19 nt, Homo sapiens
gcagaagacauugugaaca

SEQ ID NO: 8765 - RNA, 19 nt, Homo sapiens
cuuccgagcuugccucauc

SEQ ID NO: 8766 - RNA, 19 nt, Homo sapiens
ccucaucgacuacgccaaa

SEQ ID NO: 8767 - RNA, 19 nt, Homo sapiens
gccugguguucgacaauaa

SEQ ID NO: 8768 - RNA, 19 nt, Homo sapiens
aagaugcgcuuccacaaaa

SEQ ID NO: 8769 - RNA, 19 nt, Homo sapiens
cgcaauggccucaaacuca

SEQ ID NO: 8770 - RNA, 19 nt, Homo sapiens
gcgcaaacuagaggacuuu

SEQ ID NO: 8771 - RNA, 19 nt, Homo sapiens
ccaaacugcgaaaggauga

SEQ ID NO: 8772 - RNA, 19 nt, Homo sapiens
guuaaacugguguccauug

SEQ ID NO: 8773 - RNA, 19 nt, Homo sapiens
acaaggcccuggacuucau

SEQ ID NO: 8774 - RNA, 19 nt, Homo sapiens
guagcuuccuucaagaucu

SEQ ID NO: 8775 - RNA, 19 nt, Homo sapiens
ugaaguggagaaccaggua

SEQ ID NO: 8776 - RNA, 19 nt, Homo sapiens
agggugagauccagaagau

SEQ ID NO: 8777 - RNA, 19 nt, Homo sapiens
caagauguuggaugcagaa

SEQ ID NO: 8778 - RNA, 19 nt, Homo sapiens
agcaagggccuaagagaaa

SEQ ID NO: 8779 - RNA, 19 nt, Homo sapiens
gaggucauuucaggugaga

SEQ ID NO: 8780 - RNA, 19 nt, Homo sapiens
acuacaagacuaacauuga

SEQ ID NO: 8781 - RNA, 19 nt, Homo sapiens
gaaggccucccugcacgaa

SEQ ID NO: 8782 - RNA, 19 nt, Homo sapiens
caagugcuucugaauaaag

SEQ ID NO: 8783 - RNA, 19 nt, Homo sapiens
ccaagcaggccgaguacug

SEQ ID NO: 8784 - RNA, 19 nt, Homo sapiens
aguuguagcuuccuucaag

SEQ ID NO: 8785 - RNA, 19 nt, Homo sapiens
cagcugcucaccuccauug

SEQ ID NO: 8786 - RNA, 19 nt, Homo sapiens
uagaggacuuucgggacua

SEQ ID NO: 8787 - RNA, 19 nt, Homo sapiens
ucgagaugaugaugguuau

SEQ ID NO: 8788 - RNA, 19 nt, Homo sapiens
cgaucgagaugaugauggu

SEQ ID NO: 8789 - RNA, 19 nt, Homo sapiens
cacaaaaucgccaacguua

SEQ ID NO: 8790 - RNA, 19 nt, Homo sapiens
ccagccaagugcuucugaa

SEQ ID NO: 8791 - RNA, 19 nt, Homo sapiens
guuguagcuuccuucaaga

SEQ ID NO: 8792 - RNA, 19 nt, Homo sapiens
cgcaggacaucaacaccaa

SEQ ID NO: 8793 - RNA, 19 nt, Homo sapiens
gcgacuacgauucggcuuu

SEQ ID NO: 8794 - RNA, 19 nt, Homo sapiens
ccugaacacugccuuugag

SEQ ID NO: 8795 - RNA, 19 nt, Homo sapiens
uagcuuccuucaagaucuu

SEQ ID NO: 8796 - RNA, 19 nt, Homo sapiens
aggcgaagguggaggaagu

SEQ ID NO: 8797 - RNA, 19 nt, Homo sapiens
agugggauaugguccgaaa

SEQ ID NO: 8798 - RNA, 19 nt, Homo sapiens
ccaacaggaucugcaaggu

SEQ ID NO: 8799 - RNA, 19 nt, Homo sapiens
acaccgcccugaccucauc

SEQ ID NO: 8800 - RNA, 19 nt, Homo sapiens
gugcugaagagauuguuga

SEQ ID NO: 8801 - RNA, 19 nt, Homo sapiens
ggaugauggagccugauga

SEQ ID NO: 8802 - RNA, 19 nt, Homo sapiens
acacacugcagaccaaguu

SEQ ID NO: 8803 - RNA, 19 nt, Homo sapiens
ggaugcagaagacauugug

SEQ ID NO: 8804 - RNA, 19 nt, Homo sapiens
uuaaacugguguccauugg

SEQ ID NO: 8805 - RNA, 19 nt, Homo sapiens
ucaaggagguggugaauuu

SEQ ID NO: 8806 - RNA, 19 nt, Homo sapiens
gugcauauguuaaagcuua

SEQ ID NO: 8807 - RNA, 19 nt, Homo sapiens
aaagagaucugggcauuaa

SEQ ID NO: 8808 - RNA, 19 nt, Homo sapiens
aaagaaugcugguaucaaa

SEQ ID NO: 8809 - RNA, 19 nt, Homo sapiens
gaacacagagaaauccuaa

SEQ ID NO: 8810 - RNA, 19 nt, Homo sapiens
gugcugauguuuacaauga

SEQ ID NO: 8811 - RNA, 19 nt, Homo sapiens
gugcuucucuucuuuauug

SEQ ID NO: 8812 - RNA, 19 nt, Homo sapiens
gaacugggcauuucacgaa

SEQ ID NO: 8813 - RNA, 19 nt, Homo sapiens
gcaaagauuucaguagaau

SEQ ID NO: 8814 - RNA, 19 nt, Homo sapiens
ggaaagaugaccuguaaga

SEQ ID NO: 8815 - RNA, 19 nt, Homo sapiens
gcacuguuacucuuaauuu

SEQ ID NO: 8816 - RNA, 19 nt, Homo sapiens
gaaacggaauuguacaaca

SEQ ID NO: 8817 - RNA, 19 nt, Homo sapiens
gaacacagaauuuccacuu

SEQ ID NO: 8818 - RNA, 19 nt, Homo sapiens
acaguuagcugccuucgaa

SEQ ID NO: 8819 - RNA, 19 nt, Homo sapiens
gaacguauuuagccauuac

SEQ ID NO: 8820 - RNA, 19 nt, Homo sapiens
caacaaaggccaaacauac

SEQ ID NO: 8821 - RNA, 19 nt, Homo sapiens
cuaguggucuugcacauuu

SEQ ID NO: 8822 - RNA, 19 nt, Homo sapiens
gagccugcauuaaguugua

SEQ ID NO: 8823 - RNA, 19 nt, Homo sapiens
aagcaaagauuucaguaga

SEQ ID NO: 8824 - RNA, 19 nt, Homo sapiens
ccaagagccugcauuaagu

SEQ ID NO: 8825 - RNA, 19 nt, Homo sapiens
agggaaagaugaccuguaa

SEQ ID NO: 8826 - RNA, 19 nt, Homo sapiens
uaagaagaauggacagugu

SEQ ID NO: 8827 - RNA, 19 nt, Homo sapiens
gcagauuuauuggaucauu

SEQ ID NO: 8828 - RNA, 19 nt, Homo sapiens
guaaugaggaccacuguga

SEQ ID NO: 8829 - RNA, 19 nt, Homo sapiens
ccacuggucugucuuugga

SEQ ID NO: 8830 - RNA, 19 nt, Homo sapiens
gaauggacaguguugcaua

SEQ ID NO: 8831 - RNA, 19 nt, Homo sapiens
ugacaaggcagacgucgua

SEQ ID NO: 8832 - RNA, 19 nt, Homo sapiens
gaaaggcugcuuccagguu

SEQ ID NO: 8833 - RNA, 19 nt, Homo sapiens
guacgacuaucuucagcuu

SEQ ID NO: 8834 - RNA, 19 nt, Homo sapiens
acccagcugugguuaauua

SEQ ID NO: 8835 - RNA, 19 nt, Homo sapiens
gaaagaaugcugguaucaa

SEQ ID NO: 8836 - RNA, 19 nt, Homo sapiens
uggauuguuucgauucuua

SEQ ID NO: 8837 - RNA, 19 nt, Homo sapiens
agacagcacuuuagcagau

SEQ ID NO: 8838 - RNA, 19 nt, Homo sapiens
ugaccaagagccugcauua

SEQ ID NO: 8839 - RNA, 19 nt, Homo sapiens
gggcagaugugaccaagag

SEQ ID NO: 8840 - RNA, 19 nt, Homo sapiens
gaacucauaaucccaggaa

SEQ ID NO: 8841 - RNA, 19 nt, Homo sapiens
uugcauagcuuucacaagu

SEQ ID NO: 8842 - RNA, 19 nt, Homo sapiens
ggugagcaaugguauagug

SEQ ID NO: 8843 - RNA, 19 nt, Homo sapiens
gaauagugcuguccauagc

SEQ ID NO: 8844 - RNA, 19 nt, Homo sapiens
agugagagcugcuggagaa

SEQ ID NO: 8845 - RNA, 19 nt, Homo sapiens
guauguguguagacuguaa

SEQ ID NO: 8846 - RNA, 19 nt, Homo sapiens
gaagguagucuguguggau

SEQ ID NO: 8847 - RNA, 19 nt, Homo sapiens
gacaccaccgaauauauua

SEQ ID NO: 8848 - RNA, 19 nt, Homo sapiens
uuuaagugcuucacauuug

SEQ ID NO: 8849 - RNA, 19 nt, Homo sapiens
uggccaagcuaaugaaaga

SEQ ID NO: 8850 - RNA, 19 nt, Homo sapiens
guacccagcugugguuaau

SEQ ID NO: 8851 - RNA, 19 nt, Homo sapiens
gaaggacugugggcagaug

SEQ ID NO: 8852 - RNA, 19 nt, Homo sapiens
ugacaccaccgaauauauu

SEQ ID NO: 8853 - RNA, 19 nt, Homo sapiens
cagaacguauuuagccauu

SEQ ID NO: 8854 - RNA, 19 nt, Homo sapiens
gguagggacuggaggaaca

SEQ ID NO: 8855 - RNA, 19 nt, Homo sapiens
aaaggcugcuuccagguuu

SEQ ID NO: 8856 - RNA, 19 nt, Homo sapiens
ggucugucuuuggauaaua

SEQ ID NO: 8857 - RNA, 19 nt, Homo sapiens
ucacagcacugcguaucaa

SEQ ID NO: 8858 - RNA, 19 nt, Homo sapiens
ugaggaagguagucugugu

SEQ ID NO: 8859 - RNA, 19 nt, Homo sapiens
ccagguggauuguuucgau

SEQ ID NO: 8860 - RNA, 19 nt, Homo sapiens
aaugguagauggagugaug

SEQ ID NO: 8861 - RNA, 19 nt, Homo sapiens
uccauuacgugcauuuaaa

SEQ ID NO: 8862 - RNA, 19 nt, Homo sapiens
gaagcaaagauuucaguag

SEQ ID NO: 8863 - RNA, 19 nt, Homo sapiens
guacuccacuggucugucu

SEQ ID NO: 8864 - RNA, 19 nt, Homo sapiens
uaaaagagaucugggcauu

SEQ ID NO: 8865 - RNA, 19 nt, Homo sapiens
guccauagcuaguggucuu

SEQ ID NO: 8866 - RNA, 19 nt, Homo sapiens
uagcagauuuauuggauca

SEQ ID NO: 8867 - RNA, 19 nt, Homo sapiens
ucaacaaaggccaaacaua

SEQ ID NO: 8868 - RNA, 19 nt, Homo sapiens
uuacuacucuggauacagu

SEQ ID NO: 8869 - RNA, 19 nt, Homo sapiens
gacaugacaucaagacacu

SEQ ID NO: 8870 - RNA, 19 nt, Homo sapiens
ucagggaaacggaauugua

SEQ ID NO: 8871 - RNA, 19 nt, Homo sapiens
guagauggagugaugauuc

SEQ ID NO: 8872 - RNA, 19 nt, Homo sapiens
cgauuuagaagcaaagauu

SEQ ID NO: 8873 - RNA, 19 nt, Homo sapiens
gcauuaagucaguggcuuu

SEQ ID NO: 8874 - RNA, 19 nt, Homo sapiens
cauugcccaucgagauuua

SEQ ID NO: 8875 - RNA, 19 nt, Homo sapiens
gcacuuuagcagauuuauu

SEQ ID NO: 8876 - RNA, 19 nt, Homo sapiens
guguguagacuguaacuuu

SEQ ID NO: 8877 - RNA, 19 nt, Homo sapiens
ugucagacuuugcugcauu

SEQ ID NO: 8878 - RNA, 19 nt, Homo sapiens
gcauagcuuucacaagucu

SEQ ID NO: 8879 - RNA, 19 nt, Homo sapiens
ggaggaacacagagaaauc

SEQ ID NO: 8880 - RNA, 19 nt, Homo sapiens
agacacuguugcaaaggua

SEQ ID NO: 8881 - RNA, 19 nt, Homo sapiens
guucucagacccgacauua

SEQ ID NO: 8882 - RNA, 19 nt, Homo sapiens
gaucaacaaaggccaaaca

SEQ ID NO: 8883 - RNA, 19 nt, Homo sapiens
gcacauuugcacauagaga

SEQ ID NO: 8884 - RNA, 19 nt, Homo sapiens
uuucauugcuucagacaug

SEQ ID NO: 8885 - RNA, 19 nt, Homo sapiens
cacuuuagcagauuuauug

SEQ ID NO: 8886 - RNA, 19 nt, Homo sapiens
gcucaucaccaccaauguu

SEQ ID NO: 8887 - RNA, 19 nt, Homo sapiens
uuccuuacuugcacuguua

SEQ ID NO: 8888 - RNA, 19 nt, Homo sapiens
uaucuuagguuucauugcu

SEQ ID NO: 8889 - RNA, 19 nt, Homo sapiens
caaccaagaacgccucaau

SEQ ID NO: 8890 - RNA, 19 nt, Homo sapiens
gcugauguuuacaaugaug

SEQ ID NO: 8891 - RNA, 19 nt, Homo sapiens
gcacuaggaauucuuugca

SEQ ID NO: 8892 - RNA, 19 nt, Homo sapiens
ggaacacagagaaauccua

SEQ ID NO: 8893 - RNA, 19 nt, Homo sapiens
ccaagcuaaugaaagaaug

SEQ ID NO: 8894 - RNA, 19 nt, Homo sapiens
gucagacuuugcugcauuu

SEQ ID NO: 8895 - RNA, 19 nt, Homo sapiens
acagagaaauccuaaaaga

SEQ ID NO: 8896 - RNA, 19 nt, Homo sapiens
aggaagauuugacguuguu

SEQ ID NO: 8897 - RNA, 19 nt, Homo sapiens
gagagcugcuggagaacuc

SEQ ID NO: 8898 - RNA, 19 nt, Homo sapiens
gaccaagagccugcauuaa

SEQ ID NO: 8899 - RNA, 19 nt, Homo sapiens
uuacaaugaugccgaacau

SEQ ID NO: 8900 - RNA, 19 nt, Homo sapiens
ccaaacauacccaacagau

SEQ ID NO: 8901 - RNA, 19 nt, Homo sapiens
cuucagacaugacaucaag

SEQ ID NO: 8902 - RNA, 19 nt, Homo sapiens
aaaacugacuguugacauu

SEQ ID NO: 8903 - RNA, 19 nt, Homo sapiens
gauaauucccucgacaaau

SEQ ID NO: 8904 - RNA, 19 nt, Homo sapiens
caaacauacccaacagaug

SEQ ID NO: 8905 - RNA, 19 nt, Homo sapiens
gaaacacuuugacuccuuu

SEQ ID NO: 8906 - RNA, 19 nt, Homo sapiens
gcugccauauuacgacuua

SEQ ID NO: 8907 - RNA, 19 nt, Homo sapiens
gagcacgggucccuguuug

SEQ ID NO: 8908 - RNA, 19 nt, Homo sapiens
gacggaaucugccgcuuug

SEQ ID NO: 8909 - RNA, 19 nt, Homo sapiens
gcucgaagaugcaauucug

SEQ ID NO: 8910 - RNA, 19 nt, Homo sapiens
gguacacagugacaauuga

SEQ ID NO: 8911 - RNA, 19 nt, Homo sapiens
acagacaccuuuucuauuu

SEQ ID NO: 8912 - RNA, 19 nt, Homo sapiens
gaggaguccaugaagaaua

SEQ ID NO: 8913 - RNA, 19 nt, Homo sapiens
acgggucccuguuugauua

SEQ ID NO: 8914 - RNA, 19 nt, Homo sapiens
ugcgaaagguuguauguga

SEQ ID NO: 8915 - RNA, 19 nt, Homo sapiens
aagaauaucagcugccaua

SEQ ID NO: 8916 - RNA, 19 nt, Homo sapiens
gcaacaggaucgacuugag

SEQ ID NO: 8917 - RNA, 19 nt, Homo sapiens
aggaagacgugaagaucua

SEQ ID NO: 8918 - RNA, 19 nt, Homo sapiens
uggaagaucccucauguga

SEQ ID NO: 8919 - RNA, 19 nt, Homo sapiens
gaagcugcgucccaacauc

SEQ ID NO: 8920 - RNA, 19 nt, Homo sapiens
gaaagguuguaugugauca

SEQ ID NO: 8921 - RNA, 19 nt, Homo sapiens
guucagggaagcagagaua

SEQ ID NO: 8922 - RNA, 19 nt, Homo sapiens
acaagacgcuccaggaucu

SEQ ID NO: 8923 - RNA, 19 nt, Homo sapiens
gcgaaagguuguaugugau

SEQ ID NO: 8924 - RNA, 19 nt, Homo sapiens
ugaaacacuuugacuccuu

SEQ ID NO: 8925 - RNA, 19 nt, Homo sapiens
guacuugaugaaaccauua

SEQ ID NO: 8926 - RNA, 19 nt, Homo sapiens
ugauuaagcuggccuuguc

SEQ ID NO: 8927 - RNA, 19 nt, Homo sapiens
aauauucucuucucgugaa

SEQ ID NO: 8928 - RNA, 19 nt, Homo sapiens
agaugugucucuccaaaga

SEQ ID NO: 8929 - RNA, 19 nt, Homo sapiens
gaaaugcgaaagguuguau

SEQ ID NO: 8930 - RNA, 19 nt, Homo sapiens
ccucugacccuuccauuga

SEQ ID NO: 8931 - RNA, 19 nt, Homo sapiens
gcuuguauauugggagauu

SEQ ID NO: 8932 - RNA, 19 nt, Homo sapiens
caagggaagccuggaauug

SEQ ID NO: 8933 - RNA, 19 nt, Homo sapiens
cgaauuguguggagaacuc

SEQ ID NO: 8934 - RNA, 19 nt, Homo sapiens
ucagggaagcagagauaua

SEQ ID NO: 8935 - RNA, 19 nt, Homo sapiens
gucuguaggugcgcacuua

SEQ ID NO: 8936 - RNA, 19 nt, Homo sapiens
caacuacacgugugagaca

SEQ ID NO: 8937 - RNA, 19 nt, Homo sapiens
gaagaugaugcgagagugu

SEQ ID NO: 8938 - RNA, 19 nt, Homo sapiens
ggaaaugcgaaagguugua

SEQ ID NO: 8939 - RNA, 19 nt, Homo sapiens
aggaguccaugaagaauau

SEQ ID NO: 8940 - RNA, 19 nt, Homo sapiens
cacuuugacuccuuuaaau

SEQ ID NO: 8941 - RNA, 19 nt, Homo sapiens
gcaggaagacgugaagauc

SEQ ID NO: 8942 - RNA, 19 nt, Homo sapiens
gcuccaggaucuugucuac

SEQ ID NO: 8943 - RNA, 19 nt, Homo sapiens
gguuguaugugaucagaag

SEQ ID NO: 8944 - RNA, 19 nt, Homo sapiens
uggcacaccugcacaugga

SEQ ID NO: 8945 - RNA, 19 nt, Homo sapiens
guagugagcagcaucuagu

SEQ ID NO: 8946 - RNA, 19 nt, Homo sapiens
ggaagacgugaagaucuaa

SEQ ID NO: 8947 - RNA, 19 nt, Homo sapiens
gguccaggcucugcugugu

SEQ ID NO: 8948 - RNA, 19 nt, Homo sapiens
gagcgaauuguguggagaa

SEQ ID NO: 8949 - RNA, 19 nt, Homo sapiens
acacuuugacuccuuuaaa

SEQ ID NO: 8950 - RNA, 19 nt, Homo sapiens
ugauguggcugugaaaaua

SEQ ID NO: 8951 - RNA, 19 nt, Homo sapiens
uccaggaucuugucuacga

SEQ ID NO: 8952 - RNA, 19 nt, Homo sapiens
ggaaucugccgcuuugucu

SEQ ID NO: 8953 - RNA, 19 nt, Homo sapiens
gauggggccugcaugguuu

SEQ ID NO: 8954 - RNA, 19 nt, Homo sapiens
guggugauguggcugugaa

SEQ ID NO: 8955 - RNA, 19 nt, Homo sapiens
gaaccaucguuuuacaaga

SEQ ID NO: 8956 - RNA, 19 nt, Homo sapiens
ggugcgcacuuaccugcuu

SEQ ID NO: 8957 - RNA, 19 nt, Homo sapiens
cuaauggcauggagacucu

SEQ ID NO: 8958 - RNA, 19 nt, Homo sapiens
gaugcgagaguguugguau

SEQ ID NO: 8959 - RNA, 19 nt, Homo sapiens
ccaagggaagccuggaauu

SEQ ID NO: 8960 - RNA, 19 nt, Homo sapiens
gcacgggucccuguuugau

SEQ ID NO: 8961 - RNA, 19 nt, Homo sapiens
cugcugacaauaaagauaa

SEQ ID NO: 8962 - RNA, 19 nt, Homo sapiens
ggccuugucugcugcuagu

SEQ ID NO: 8963 - RNA, 19 nt, Homo sapiens
gcugcugacaauaaagaua

SEQ ID NO: 8964 - RNA, 19 nt, Homo sapiens
gcccugcgcaucaagaaga

SEQ ID NO: 8965 - RNA, 19 nt, Homo sapiens
ugacggcccugcgcaucaa

SEQ ID NO: 8966 - RNA, 19 nt, Homo sapiens
gggaagaugaugcgagagu

SEQ ID NO: 8967 - RNA, 19 nt, Homo sapiens
cccucgggcuuguauauug

SEQ ID NO: 8968 - RNA, 19 nt, Homo sapiens
ugaaguacuugaugaaacc

SEQ ID NO: 8969 - RNA, 19 nt, Homo sapiens
agacggaaucugccgcuuu

SEQ ID NO: 8970 - RNA, 19 nt, Homo sapiens
gcccaguggucaccucaag

SEQ ID NO: 8971 - RNA, 19 nt, Homo sapiens
cagacaccuuuucuauuua

SEQ ID NO: 8972 - RNA, 19 nt, Homo sapiens
gaaccgguacacagugaca

SEQ ID NO: 8973 - RNA, 19 nt, Homo sapiens
cugaaccgguacacaguga

SEQ ID NO: 8974 - RNA, 19 nt, Homo sapiens
auacauggccccugaagua

SEQ ID NO: 8975 - RNA, 19 nt, Homo sapiens
gcaacacccacugcugcua

SEQ ID NO: 8976 - RNA, 19 nt, Homo sapiens
gugagcagcaucuaguuuc

SEQ ID NO: 8977 - RNA, 19 nt, Homo sapiens
ggaggaguccaugaagaau

SEQ ID NO: 8978 - RNA, 19 nt, Homo sapiens
caauugaggggaugauuaa

SEQ ID NO: 8979 - RNA, 19 nt, Homo sapiens
gcguugagcguacgaugga

SEQ ID NO: 8980 - RNA, 19 nt, Homo sapiens
ccaguggucaccucaagga

SEQ ID NO: 8981 - RNA, 19 nt, Homo sapiens
ucacugacaccauugacau

SEQ ID NO: 8982 - RNA, 19 nt, Homo sapiens
gaauugcucaucgagacuu

SEQ ID NO: 8983 - RNA, 19 nt, Homo sapiens
uccuuuaaaugugcugaua

SEQ ID NO: 8984 - RNA, 19 nt, Homo sapiens
agcuguggcuuguuucuga

SEQ ID NO: 8985 - RNA, 19 nt, Homo sapiens
gcccacagcacaccaaggu

SEQ ID NO: 8986 - RNA, 19 nt, Homo sapiens
cggaggaaccgagguguug

SEQ ID NO: 8987 - RNA, 19 nt, Homo sapiens
cgaaagguuguaugugauc

SEQ ID NO: 8988 - RNA, 19 nt, Homo sapiens
cugaaguacuugaugaaac

SEQ ID NO: 8989 - RNA, 19 nt, Homo sapiens
aauugcucaucgagacuua

SEQ ID NO: 8990 - RNA, 19 nt, Homo sapiens
cucaucaucaucauuguuu

SEQ ID NO: 8991 - RNA, 19 nt, Homo sapiens
gcuuguuucugacuaucau

SEQ ID NO: 8992 - RNA, 19 nt, Homo sapiens
cagggaagcagagauauac

SEQ ID NO: 8993 - RNA, 19 nt, Homo sapiens
agacaagacgcuccaggau

SEQ ID NO: 8994 - RNA, 19 nt, Homo sapiens
agacagacaccuuuucuau

SEQ ID NO: 8995 - RNA, 19 nt, Homo sapiens
cagaagcugcgucccaaca

SEQ ID NO: 8996 - RNA, 19 nt, Homo sapiens
gcaccugcauccccaaagu

SEQ ID NO: 8997 - RNA, 19 nt, Homo sapiens
aguacuugaugaaaccauu

SEQ ID NO: 8998 - RNA, 19 nt, Homo sapiens
aggccuaccucucguuucu

SEQ ID NO: 8999 - RNA, 19 nt, Homo sapiens
ugagcacgggucccuguuu

SEQ ID NO: 9000 - RNA, 19 nt, Homo sapiens
gcauaggccuguaaucgua

SEQ ID NO: 9001 - RNA, 19 nt, Homo sapiens
gaaacacuuugacuccuuu

SEQ ID NO: 9002 - RNA, 19 nt, Homo sapiens
ucagagaguucgagacaaa

SEQ ID NO: 9003 - RNA, 19 nt, Homo sapiens
gcugccauauuacgacuua

SEQ ID NO: 9004 - RNA, 19 nt, Homo sapiens
agacaaaccugggcaaugu

SEQ ID NO: 9005 - RNA, 19 nt, Homo sapiens
gagcacgggucccuguuug

SEQ ID NO: 9006 - RNA, 19 nt, Homo sapiens
gagagugucaguuauuauu

SEQ ID NO: 9007 - RNA, 19 nt, Homo sapiens
gcucgaagaugcaauucug

SEQ ID NO: 9008 - RNA, 19 nt, Homo sapiens
gcagaguuaugagguaaga

SEQ ID NO: 9009 - RNA, 19 nt, Homo sapiens
gguacacagugacaauuga

SEQ ID NO: 9010 - RNA, 19 nt, Homo sapiens
gaggaguccaugaagaaua

SEQ ID NO: 9011 - RNA, 19 nt, Homo sapiens
acgggucccuguuugauua

SEQ ID NO: 9012 - RNA, 19 nt, Homo sapiens
ugcgaaagguuguauguga

SEQ ID NO: 9013 - RNA, 19 nt, Homo sapiens
aagaauaucagcugccaua

SEQ ID NO: 9014 - RNA, 19 nt, Homo sapiens
gcaacaggaucgacuugag

SEQ ID NO: 9015 - RNA, 19 nt, Homo sapiens
uggaagaucccucauguga

SEQ ID NO: 9016 - RNA, 19 nt, Homo sapiens
gaagcugcgucccaacauc

SEQ ID NO: 9017 - RNA, 19 nt, Homo sapiens
gaaagguuguaugugauca

SEQ ID NO: 9018 - RNA, 19 nt, Homo sapiens
guucagggaagcagagaua

SEQ ID NO: 9019 - RNA, 19 nt, Homo sapiens
acaagacgcuccaggaucu

SEQ ID NO: 9020 - RNA, 19 nt, Homo sapiens
gcgaaagguuguaugugau

SEQ ID NO: 9021 - RNA, 19 nt, Homo sapiens
ugaaacacuuugacuccuu

SEQ ID NO: 9022 - RNA, 19 nt, Homo sapiens
guacuugaugaaaccauua

SEQ ID NO: 9023 - RNA, 19 nt, Homo sapiens
ugauuaagcuggccuuguc

SEQ ID NO: 9024 - RNA, 19 nt, Homo sapiens
aauauucucuucucgugaa

SEQ ID NO: 9025 - RNA, 19 nt, Homo sapiens
agaugugucucuccaaaga

SEQ ID NO: 9026 - RNA, 19 nt, Homo sapiens
ggccuggugugguggcaua

SEQ ID NO: 9027 - RNA, 19 nt, Homo sapiens
gaaaugcgaaagguuguau

SEQ ID NO: 9028 - RNA, 19 nt, Homo sapiens
ccucugacccuuccauuga

SEQ ID NO: 9029 - RNA, 19 nt, Homo sapiens
caagggaagccuggaauug

SEQ ID NO: 9030 - RNA, 19 nt, Homo sapiens
gcucagagaguucgagaca

SEQ ID NO: 9031 - RNA, 19 nt, Homo sapiens
ucagggaagcagagauaua

SEQ ID NO: 9032 - RNA, 19 nt, Homo sapiens
ggaaaugcgaaagguugua

SEQ ID NO: 9033 - RNA, 19 nt, Homo sapiens
caacuacacgugugagaca

SEQ ID NO: 9034 - RNA, 19 nt, Homo sapiens
aggaguccaugaagaauau

SEQ ID NO: 9035 - RNA, 19 nt, Homo sapiens
cacuuugacuccuuuaaau

SEQ ID NO: 9036 - RNA, 19 nt, Homo sapiens
gcuccaggaucuugucuac

SEQ ID NO: 9037 - RNA, 19 nt, Homo sapiens
gguuguaugugaucagaag

SEQ ID NO: 9038 - RNA, 19 nt, Homo sapiens
uggcacaccugcacaugga

SEQ ID NO: 9039 - RNA, 19 nt, Homo sapiens
gguccaggcucugcugugu

SEQ ID NO: 9040 - RNA, 19 nt, Homo sapiens
gagacaaaccugggcaaug

SEQ ID NO: 9041 - RNA, 19 nt, Homo sapiens
uggcagaguuaugagguaa

SEQ ID NO: 9042 - RNA, 19 nt, Homo sapiens
acacuuugacuccuuuaaa

SEQ ID NO: 9043 - RNA, 19 nt, Homo sapiens
ugauguggcugugaaaaua

SEQ ID NO: 9044 - RNA, 19 nt, Homo sapiens
uccaggaucuugucuacga

SEQ ID NO: 9045 - RNA, 19 nt, Homo sapiens
guggcagaguuaugaggua

SEQ ID NO: 9046 - RNA, 19 nt, Homo sapiens
gauggggccugcaugguuu

SEQ ID NO: 9047 - RNA, 19 nt, Homo sapiens
guggugauguggcugugaa

SEQ ID NO: 9048 - RNA, 19 nt, Homo sapiens
gaaccaucguuuuacaaga

SEQ ID NO: 9049 - RNA, 19 nt, Homo sapiens
ggaguucacagccuagaag

SEQ ID NO: 9050 - RNA, 19 nt, Homo sapiens
ccaagggaagccuggaauu

SEQ ID NO: 9051 - RNA, 19 nt, Homo sapiens
gcacgggucccuguuugau

SEQ ID NO: 9052 - RNA, 19 nt, Homo sapiens
cugcugacaauaaagauaa

SEQ ID NO: 9053 - RNA, 19 nt, Homo sapiens
ggccuugucugcugcuagu

SEQ ID NO: 9054 - RNA, 19 nt, Homo sapiens
gcugcugacaauaaagaua

SEQ ID NO: 9055 - RNA, 19 nt, Homo sapiens
ucacagccuagaagaagaa

SEQ ID NO: 9056 - RNA, 19 nt, Homo sapiens
gggccugcaugguuuccuu

SEQ ID NO: 9057 - RNA, 19 nt, Homo sapiens
ugaaguacuugaugaaacc

SEQ ID NO: 9058 - RNA, 19 nt, Homo sapiens
gaaccgguacacagugaca

SEQ ID NO: 9059 - RNA, 19 nt, Homo sapiens
cugaaccgguacacaguga

SEQ ID NO: 9060 - RNA, 19 nt, Homo sapiens
gcccaguggucaccucaag

SEQ ID NO: 9061 - RNA, 19 nt, Homo sapiens
cguuguauauugggagauu

SEQ ID NO: 9062 - RNA, 19 nt, Homo sapiens
auacauggccccugaagua

SEQ ID NO: 9063 - RNA, 19 nt, Homo sapiens
gcaacacccacugcugcua

SEQ ID NO: 9064 - RNA, 19 nt, Homo sapiens
guucacagccuagaagaag

SEQ ID NO: 9065 - RNA, 19 nt, Homo sapiens
ccugauuucuccaccuuag

SEQ ID NO: 9066 - RNA, 19 nt, Homo sapiens
ggaggaguccaugaagaau

SEQ ID NO: 9067 - RNA, 19 nt, Homo sapiens
caauugaggggaugauuaa

SEQ ID NO: 9068 - RNA, 19 nt, Homo sapiens
acauaucccaagcccuuua

SEQ ID NO: 9069 - RNA, 19 nt, Homo sapiens
ccaguggucaccucaagga

SEQ ID NO: 9070 - RNA, 19 nt, Homo sapiens
ucacugacaccauugacau

SEQ ID NO: 9071 - RNA, 19 nt, Homo sapiens
gaauugcucaucgagacuu

SEQ ID NO: 9072 - RNA, 19 nt, Homo sapiens
gcuggccuccugcugcuuu

SEQ ID NO: 9073 - RNA, 19 nt, Homo sapiens
ccucggcguuguauauugg

SEQ ID NO: 9074 - RNA, 19 nt, Homo sapiens
uccuuuaaaugugcugaua

SEQ ID NO: 9075 - RNA, 19 nt, Homo sapiens
agcuguggcuuguuucuga

SEQ ID NO: 9076 - RNA, 19 nt, Homo sapiens
aaggguuucuugacaaugg

SEQ ID NO: 9077 - RNA, 19 nt, Homo sapiens
cgaaagguuguaugugauc

SEQ ID NO: 9078 - RNA, 19 nt, Homo sapiens
ccuguagggugccauuugg

SEQ ID NO: 9079 - RNA, 19 nt, Homo sapiens
cugaaguacuugaugaaac

SEQ ID NO: 9080 - RNA, 19 nt, Homo sapiens
aauugcucaucgagacuua

SEQ ID NO: 9081 - RNA, 19 nt, Homo sapiens
cucaucaucaucauuguuu

SEQ ID NO: 9082 - RNA, 19 nt, Homo sapiens
gcuuguuucugacuaucau

SEQ ID NO: 9083 - RNA, 19 nt, Homo sapiens
cagggaagcagagauauac

SEQ ID NO: 9084 - RNA, 19 nt, Homo sapiens
agacaagacgcuccaggau

SEQ ID NO: 9085 - RNA, 19 nt, Homo sapiens
cagaagcugcgucccaaca

SEQ ID NO: 9086 - RNA, 19 nt, Homo sapiens
gcaccugcauccccaaagu

SEQ ID NO: 9087 - RNA, 19 nt, Homo sapiens
aguacuugaugaaaccauu

SEQ ID NO: 9088 - RNA, 19 nt, Homo sapiens
ugagcacgggucccuguuu

SEQ ID NO: 9089 - RNA, 19 nt, Homo sapiens
ugaauagcguuguguguua

SEQ ID NO: 9090 - RNA, 19 nt, Homo sapiens
gggaucaguuuguugaaua

SEQ ID NO: 9091 - RNA, 19 nt, Homo sapiens
gaaacacuuugacuccuuu

SEQ ID NO: 9092 - RNA, 19 nt, Homo sapiens
gagccugaaucaucguuua

SEQ ID NO: 9093 - RNA, 19 nt, Homo sapiens
caucaaagguguggaggua

SEQ ID NO: 9094 - RNA, 19 nt, Homo sapiens
gagcacgggucccuguuug

SEQ ID NO: 9095 - RNA, 19 nt, Homo sapiens
gcucgaagaugcaauucug

SEQ ID NO: 9096 - RNA, 19 nt, Homo sapiens
gaauagcguuguguguuau

SEQ ID NO: 9097 - RNA, 19 nt, Homo sapiens
ggagguagcugugcuuagg

SEQ ID NO: 9098 - RNA, 19 nt, Homo sapiens
gcaguggucuccuucacau

SEQ ID NO: 9099 - RNA, 19 nt, Homo sapiens
gguacacagugacaauuga

SEQ ID NO: 9100 - RNA, 19 nt, Homo sapiens
gaaggcucguuuggcuuua

SEQ ID NO: 9101 - RNA, 19 nt, Homo sapiens
acgggucccuguuugauua

SEQ ID NO: 9102 - RNA, 19 nt, Homo sapiens
gcaacaggaucgacuugag

SEQ ID NO: 9103 - RNA, 19 nt, Homo sapiens
uggaagaucccucauguga

SEQ ID NO: 9104 - RNA, 19 nt, Homo sapiens
guucagggaagcagagaua

SEQ ID NO: 9105 - RNA, 19 nt, Homo sapiens
acaagacgcuccaggaucu

SEQ ID NO: 9106 - RNA, 19 nt, Homo sapiens
caucagaagcaguauauuc

SEQ ID NO: 9107 - RNA, 19 nt, Homo sapiens
ugaaacacuuugacuccuu

SEQ ID NO: 9108 - RNA, 19 nt, Homo sapiens
guacuugaugaaaccauua

SEQ ID NO: 9109 - RNA, 19 nt, Homo sapiens
ugauuaagcuggccuuguc

SEQ ID NO: 9110 - RNA, 19 nt, Homo sapiens
aauauucucuucucgugaa

SEQ ID NO: 9111 - RNA, 19 nt, Homo sapiens
agaugugucucuccaaaga

SEQ ID NO: 9112 - RNA, 19 nt, Homo sapiens
guuuaagguugccaucaaa

SEQ ID NO: 9113 - RNA, 19 nt, Homo sapiens
ggaucaguuuguugaauag

SEQ ID NO: 9114 - RNA, 19 nt, Homo sapiens
caagggaagccuggaauug

SEQ ID NO: 9115 - RNA, 19 nt, Homo sapiens
gcauagcacgggauucaug

SEQ ID NO: 9116 - RNA, 19 nt, Homo sapiens
ugaaucaucguuuaagguu

SEQ ID NO: 9117 - RNA, 19 nt, Homo sapiens
gcgcauagcacgggauuca

SEQ ID NO: 9118 - RNA, 19 nt, Homo sapiens
ucagggaagcagagauaua

SEQ ID NO: 9119 - RNA, 19 nt, Homo sapiens
ugaaggcucguuuggcuuu

SEQ ID NO: 9120 - RNA, 19 nt, Homo sapiens
caacuacacgugugagaca

SEQ ID NO: 9121 - RNA, 19 nt, Homo sapiens
cacuuugacuccuuuaaau

SEQ ID NO: 9122 - RNA, 19 nt, Homo sapiens
gaugcuggaucacccaaag

SEQ ID NO: 9123 - RNA, 19 nt, Homo sapiens
gcuccaggaucuugucuac

SEQ ID NO: 9124 - RNA, 19 nt, Homo sapiens
gaagcaguauauucuaacg

SEQ ID NO: 9125 - RNA, 19 nt, Homo sapiens
ucagggaucaguuuguuga

SEQ ID NO: 9126 - RNA, 19 nt, Homo sapiens
uggcacaccugcacaugga

SEQ ID NO: 9127 - RNA, 19 nt, Homo sapiens
gguccaggcucugcugugu

SEQ ID NO: 9128 - RNA, 19 nt, Homo sapiens
gugcuuagggugcguuuau

SEQ ID NO: 9129 - RNA, 19 nt, Homo sapiens
gcuccuaccucccauucca

SEQ ID NO: 9130 - RNA, 19 nt, Homo sapiens
acacuuugacuccuuuaaa

SEQ ID NO: 9131 - RNA, 19 nt, Homo sapiens
ugauguggcugugaaaaua

SEQ ID NO: 9132 - RNA, 19 nt, Homo sapiens
uccaggaucuugucuacga

SEQ ID NO: 9133 - RNA, 19 nt, Homo sapiens
ucacaucagaagcaguaua

SEQ ID NO: 9134 - RNA, 19 nt, Homo sapiens
cguuuaagguugccaucaa

SEQ ID NO: 9135 - RNA, 19 nt, Homo sapiens
gauggggccugcaugguuu

SEQ ID NO: 9136 - RNA, 19 nt, Homo sapiens
guggugauguggcugugaa

SEQ ID NO: 9137 - RNA, 19 nt, Homo sapiens
uagggugcguuuauucuuc

SEQ ID NO: 9138 - RNA, 19 nt, Homo sapiens
gaaccaucguuuuacaaga

SEQ ID NO: 9139 - RNA, 19 nt, Homo sapiens
cacaucagaagcaguauau

SEQ ID NO: 9140 - RNA, 19 nt, Homo sapiens
cuucagggaucaguuuguu

SEQ ID NO: 9141 - RNA, 19 nt, Homo sapiens
ccaagggaagccuggaauu

SEQ ID NO: 9142 - RNA, 19 nt, Homo sapiens
gcacgggucccuguuugau

SEQ ID NO: 9143 - RNA, 19 nt, Homo sapiens
cugcugacaauaaagauaa

SEQ ID NO: 9144 - RNA, 19 nt, Homo sapiens
ggccuugucugcugcuagu

SEQ ID NO: 9145 - RNA, 19 nt, Homo sapiens
gcugcugacaauaaagaua

SEQ ID NO: 9146 - RNA, 19 nt, Homo sapiens
ugccagagccugaaucauc

SEQ ID NO: 9147 - RNA, 19 nt, Homo sapiens
ugaaguacuugaugaaacc

SEQ ID NO: 9148 - RNA, 19 nt, Homo sapiens
gggccugcaugguuuccuu

SEQ ID NO: 9149 - RNA, 19 nt, Homo sapiens
gcccaguggucaccucaag

SEQ ID NO: 9150 - RNA, 19 nt, Homo sapiens
gaaccgguacacagugaca

SEQ ID NO: 9151 - RNA, 19 nt, Homo sapiens
cugaaccgguacacaguga

SEQ ID NO: 9152 - RNA, 19 nt, Homo sapiens
gcaacacccacugcugcua

SEQ ID NO: 9153 - RNA, 19 nt, Homo sapiens
cguuguauauugggagauu

SEQ ID NO: 9154 - RNA, 19 nt, Homo sapiens
auacauggccccugaagua

SEQ ID NO: 9155 - RNA, 19 nt, Homo sapiens
caauugaggggaugauuaa

SEQ ID NO: 9156 - RNA, 19 nt, Homo sapiens
gcucguuuggcuuuauaaa

SEQ ID NO: 9157 - RNA, 19 nt, Homo sapiens
ccaguggucaccucaagga

SEQ ID NO: 9158 - RNA, 19 nt, Homo sapiens
ucacugacaccauugacau

SEQ ID NO: 9159 - RNA, 19 nt, Homo sapiens
gaauugcucaucgagacuu

SEQ ID NO: 9160 - RNA, 19 nt, Homo sapiens
aggcucguuuggcuuuaua

SEQ ID NO: 9161 - RNA, 19 nt, Homo sapiens
ccucggcguuguauauugg

SEQ ID NO: 9162 - RNA, 19 nt, Homo sapiens
uccuuuaaaugugcugaua

SEQ ID NO: 9163 - RNA, 19 nt, Homo sapiens
agcuguggcuuguuucuga

SEQ ID NO: 9164 - RNA, 19 nt, Homo sapiens
cugaaguacuugaugaaac

SEQ ID NO: 9165 - RNA, 19 nt, Homo sapiens
aauugcucaucgagacuua

SEQ ID NO: 9166 - RNA, 19 nt, Homo sapiens
gcuuagggugcguuuauuc

SEQ ID NO: 9167 - RNA, 19 nt, Homo sapiens
cucaucaucaucauuguuu

SEQ ID NO: 9168 - RNA, 19 nt, Homo sapiens
gcuuguuucugacuaucau

SEQ ID NO: 9169 - RNA, 19 nt, Homo sapiens
cagggaagcagagauauac

SEQ ID NO: 9170 - RNA, 19 nt, Homo sapiens
agacaagacgcuccaggau

SEQ ID NO: 9171 - RNA, 19 nt, Homo sapiens
agcguuguguguuauggua

SEQ ID NO: 9172 - RNA, 19 nt, Homo sapiens
uaagguugccaucaaaggu

SEQ ID NO: 9173 - RNA, 19 nt, Homo sapiens
aguacuugaugaaaccauu

SEQ ID NO: 9174 - RNA, 19 nt, Homo sapiens
gcaccugcauccccaaagu

SEQ ID NO: 9175 - RNA, 19 nt, Homo sapiens
ugagcacgggucccuguuu

SEQ ID NO: 9176 - RNA, 19 nt, Homo sapiens
caaagaaucuagucuauga

SEQ ID NO: 9177 - RNA, 19 nt, Homo sapiens
guacauggcuccagaggua

SEQ ID NO: 9178 - RNA, 19 nt, Homo sapiens
gcagaaacaugcuggaaug

SEQ ID NO: 9179 - RNA, 19 nt, Homo sapiens
gaauacauguugccauuug

SEQ ID NO: 9180 - RNA, 19 nt, Homo sapiens
ggucugggcuuccgaauau

SEQ ID NO: 9181 - RNA, 19 nt, Homo sapiens
ccacaaaccugccauaucu

SEQ ID NO: 9182 - RNA, 19 nt, Homo sapiens
ggcaauauguguaaugaaa

SEQ ID NO: 9183 - RNA, 19 nt, Homo sapiens
gaauauuucugguuccauu

SEQ ID NO: 9184 - RNA, 19 nt, Homo sapiens
gacaucagauuucuuaaug

SEQ ID NO: 9185 - RNA, 19 nt, Homo sapiens
ugacaggacugauugugua

SEQ ID NO: 9186 - RNA, 19 nt, Homo sapiens
agacagcccugaaguauau

SEQ ID NO: 9187 - RNA, 19 nt, Homo sapiens
gaauguagcccucuccaaa

SEQ ID NO: 9188 - RNA, 19 nt, Homo sapiens
ggugacaaauguugacuuu

SEQ ID NO: 9189 - RNA, 19 nt, Homo sapiens
agaagacacuaauuccuua

SEQ ID NO: 9190 - RNA, 19 nt, Homo sapiens
gaacuggcuucucgcugua

SEQ ID NO: 9191 - RNA, 19 nt, Homo sapiens
gauaucaacugcuaugaca

SEQ ID NO: 9192 - RNA, 19 nt, Homo sapiens
guuaucagcuggaugugua

SEQ ID NO: 9193 - RNA, 19 nt, Homo sapiens
gaauggcaaugcucuguga

SEQ ID NO: 9194 - RNA, 19 nt, Homo sapiens
ugaaaccacugcaguuauu

SEQ ID NO: 9195 - RNA, 19 nt, Homo sapiens
ggauauaccuggccuaaaa

SEQ ID NO: 9196 - RNA, 19 nt, Homo sapiens
caaauccaguuacaccuaa

SEQ ID NO: 9197 - RNA, 19 nt, Homo sapiens
gaucacagcauuucaugaa

SEQ ID NO: 9198 - RNA, 19 nt, Homo sapiens
caccuaagccacccuauua

SEQ ID NO: 9199 - RNA, 19 nt, Homo sapiens
ucacacagcccacuucaaa

SEQ ID NO: 9200 - RNA, 19 nt, Homo sapiens
gacaugagacuaagagaaa

SEQ ID NO: 9201 - RNA, 19 nt, Homo sapiens
gacaaacagucauggcaaa

SEQ ID NO: 9202 - RNA, 19 nt, Homo sapiens
gaaaugggacucugaacug

SEQ ID NO: 9203 - RNA, 19 nt, Homo sapiens
cuagaggauuggcauauuu

SEQ ID NO: 9204 - RNA, 19 nt, Homo sapiens
gaagcaugagaacauauua

SEQ ID NO: 9205 - RNA, 19 nt, Homo sapiens
guuguuggcuggaugauau

SEQ ID NO: 9206 - RNA, 19 nt, Homo sapiens
gguauuagagggugcuaua

SEQ ID NO: 9207 - RNA, 19 nt, Homo sapiens
gaaugaagcaugagaacau

SEQ ID NO: 9208 - RNA, 19 nt, Homo sapiens
gcuguucuguguacauaaa

SEQ ID NO: 9209 - RNA, 19 nt, Homo sapiens
gacacuaauuccuuaaaug

SEQ ID NO: 9210 - RNA, 19 nt, Homo sapiens
ggaaguuguugugcauaaa

SEQ ID NO: 9211 - RNA, 19 nt, Homo sapiens
guuccacgguugcuaaauu

SEQ ID NO: 9212 - RNA, 19 nt, Homo sapiens
gcuaauggaguguuugaaa

SEQ ID NO: 9213 - RNA, 19 nt, Homo sapiens
ggaugucucuuggaaaugu

SEQ ID NO: 9214 - RNA, 19 nt, Homo sapiens
gcaggaaguuguugugcau

SEQ ID NO: 9215 - RNA, 19 nt, Homo sapiens
gcuagaggauuggcauauu

SEQ ID NO: 9216 - RNA, 19 nt, Homo sapiens
cccaguugcuuaacgaaua

SEQ ID NO: 9217 - RNA, 19 nt, Homo sapiens
gauugucauuugugcauuu

SEQ ID NO: 9218 - RNA, 19 nt, Homo sapiens
cacgguugcuaaauuauaa

SEQ ID NO: 9219 - RNA, 19 nt, Homo sapiens
ggacaugagacuaagagaa

SEQ ID NO: 9220 - RNA, 19 nt, Homo sapiens
aauacgaagucuacaguuu

SEQ ID NO: 9221 - RNA, 19 nt, Homo sapiens
gaaaccacugcaguuauua

SEQ ID NO: 9222 - RNA, 19 nt, Homo sapiens
augcagagacuaacaaaua

SEQ ID NO: 9223 - RNA, 19 nt, Homo sapiens
ugaaagaauuacccagaug

SEQ ID NO: 9224 - RNA, 19 nt, Homo sapiens
agagaaaccuugcaaacuc

SEQ ID NO: 9225 - RNA, 19 nt, Homo sapiens
agaagacccuuuguugaaa

SEQ ID NO: 9226 - RNA, 19 nt, Homo sapiens
gcaaugcucugugaaacca

SEQ ID NO: 9227 - RNA, 19 nt, Homo sapiens
gaaauuggccagcauccau

SEQ ID NO: 9228 - RNA, 19 nt, Homo sapiens
uaggaugucucuuggaaau

SEQ ID NO: 9229 - RNA, 19 nt, Homo sapiens
gggagcugcugcaaaguug

SEQ ID NO: 9230 - RNA, 19 nt, Homo sapiens
gcaguuauuagaagugaaa

SEQ ID NO: 9231 - RNA, 19 nt, Homo sapiens
gcuguuguuucuauaaaug

SEQ ID NO: 9232 - RNA, 19 nt, Homo sapiens
gagaaaccuugcaaacucu

SEQ ID NO: 9233 - RNA, 19 nt, Homo sapiens
uggaugauaucaacugcua

SEQ ID NO: 9234 - RNA, 19 nt, Homo sapiens
guacauaaagucaucaaag

SEQ ID NO: 9235 - RNA, 19 nt, Homo sapiens
caucagauuucuuaauguc

SEQ ID NO: 9236 - RNA, 19 nt, Homo sapiens
gugaaggacaugagacuaa

SEQ ID NO: 9237 - RNA, 19 nt, Homo sapiens
gaaauagugaaacaagguu

SEQ ID NO: 9238 - RNA, 19 nt, Homo sapiens
aagaagacccuuuguugaa

SEQ ID NO: 9239 - RNA, 19 nt, Homo sapiens
cagaggacauuguaacagu

SEQ ID NO: 9240 - RNA, 19 nt, Homo sapiens
cgacgcagaagccagguua

SEQ ID NO: 9241 - RNA, 19 nt, Homo sapiens
agauggaccuguagaugaa

SEQ ID NO: 9242 - RNA, 19 nt, Homo sapiens
ggauuggcauauuuacaug

SEQ ID NO: 9243 - RNA, 19 nt, Homo sapiens
cagacuuucuuaaggcuaa

SEQ ID NO: 9244 - RNA, 19 nt, Homo sapiens
ccacugcaguuauuagaag

SEQ ID NO: 9245 - RNA, 19 nt, Homo sapiens
gaagacacuaauuccuuaa

SEQ ID NO: 9246 - RNA, 19 nt, Homo sapiens
uaacaguggucacaauggu

SEQ ID NO: 9247 - RNA, 19 nt, Homo sapiens
gcagagacuaacaaauauu

SEQ ID NO: 9248 - RNA, 19 nt, Homo sapiens
aaccauggcuagaggauug

SEQ ID NO: 9249 - RNA, 19 nt, Homo sapiens
guugaaaccacugcaguua

SEQ ID NO: 9250 - RNA, 19 nt, Homo sapiens
aaagacagaaccaaucaaa

SEQ ID NO: 9251 - RNA, 19 nt, Homo sapiens
ccacgguugcuaaauuaua

SEQ ID NO: 9252 - RNA, 19 nt, Homo sapiens
cgccaucugugcacacuaa

SEQ ID NO: 9253 - RNA, 19 nt, Homo sapiens
ugacaaauguugacuuucc

SEQ ID NO: 9254 - RNA, 19 nt, Homo sapiens
aaacgaggcaccaguguug

SEQ ID NO: 9255 - RNA, 19 nt, Homo sapiens
ggccuacccuccuguacuu

SEQ ID NO: 9256 - RNA, 19 nt, Homo sapiens
cuugcaaacucuauaaaga

SEQ ID NO: 9257 - RNA, 19 nt, Homo sapiens
gugaaagaauuacccagau

SEQ ID NO: 9258 - RNA, 19 nt, Homo sapiens
cagauggaccuguagauga

SEQ ID NO: 9259 - RNA, 19 nt, Homo sapiens
gaggauauaccuggccuaa

SEQ ID NO: 9260 - RNA, 19 nt, Homo sapiens
cuaauguggucucuuggaa

SEQ ID NO: 9261 - RNA, 19 nt, Homo sapiens
uuugcuaccuggaagaaua

SEQ ID NO: 9262 - RNA, 19 nt, Homo sapiens
cccaaagaaucuagucuau

SEQ ID NO: 9263 - RNA, 19 nt, Homo sapiens
aaagaggccuguuuuaaga

SEQ ID NO: 9264 - RNA, 19 nt, Homo sapiens
ccuaaaagauggccacaaa

SEQ ID NO: 9265 - RNA, 19 nt, Homo sapiens
uagaggauuggcauauuua

SEQ ID NO: 9266 - RNA, 19 nt, Homo sapiens
aaugaagcaugagaacaua

SEQ ID NO: 9267 - RNA, 19 nt, Homo sapiens
ccauugaaauagugaaaca

SEQ ID NO: 9268 - RNA, 19 nt, Homo sapiens
uuccacgguugcuaaauua

SEQ ID NO: 9269 - RNA, 19 nt, Homo sapiens
cagaagacacuaauuccuu

SEQ ID NO: 9270 - RNA, 19 nt, Homo sapiens
cagcauccaucucuugaag

SEQ ID NO: 9271 - RNA, 19 nt, Homo sapiens
ggaggaaauuggccagcau

SEQ ID NO: 9272 - RNA, 19 nt, Homo sapiens
gcagauggaccuguagaug

SEQ ID NO: 9273 - RNA, 19 nt, Homo sapiens
ccaguugcuuaacgaauau

SEQ ID NO: 9274 - RNA, 19 nt, Homo sapiens
aaagacagcccugaaguau

SEQ ID NO: 9275 - RNA, 19 nt, Homo sapiens
gaagacccuuuguugaaaa

SEQ ID NO: 9276 - RNA, 19 nt, Homo sapiens
gaacgaacugugucaugua

SEQ ID NO: 9277 - RNA, 19 nt, Homo sapiens
ggaacgaacugugucaugu

SEQ ID NO: 9278 - RNA, 19 nt, Homo sapiens
uggcuuggcuguucgauuu

SEQ ID NO: 9279 - RNA, 19 nt, Homo sapiens
guaagaauguauugcugaa

SEQ ID NO: 9280 - RNA, 19 nt, Homo sapiens
ccaucgagcucgugaagaa

SEQ ID NO: 9281 - RNA, 19 nt, Homo sapiens
gacuucaacugcuacgaua

SEQ ID NO: 9282 - RNA, 19 nt, Homo sapiens
aagaugaggcccaccauua

SEQ ID NO: 9283 - RNA, 19 nt, Homo sapiens
gcaacgagcgcuucacuca

SEQ ID NO: 9284 - RNA, 19 nt, Homo sapiens
gcuccaaccucgaaguaga

SEQ ID NO: 9285 - RNA, 19 nt, Homo sapiens
uaaagagucaagcaucuaa

SEQ ID NO: 9286 - RNA, 19 nt, Homo sapiens
ggaacaucaucacauggaa

SEQ ID NO: 9287 - RNA, 19 nt, Homo sapiens
gggagugcaucuacuacaa

SEQ ID NO: 9288 - RNA, 19 nt, Homo sapiens
gagcgggugucccugauuc

SEQ ID NO: 9289 - RNA, 19 nt, Homo sapiens
ggacacccacggacaggua

SEQ ID NO: 9290 - RNA, 19 nt, Homo sapiens
aaagaucacugguugaaac

SEQ ID NO: 9291 - RNA, 19 nt, Homo sapiens
aagaauguauugcugaaga

SEQ ID NO: 9292 - RNA, 19 nt, Homo sapiens
acaagcggcugcacugcua

SEQ ID NO: 9293 - RNA, 19 nt, Homo sapiens
uagaugacuucaacugcua

SEQ ID NO: 9294 - RNA, 19 nt, Homo sapiens
gaugaggcccaccauuaaa

SEQ ID NO: 9295 - RNA, 19 nt, Homo sapiens
gaagaugaggcccaccauu

SEQ ID NO: 9296 - RNA, 19 nt, Homo sapiens
cagcacaccuggcaugaag

SEQ ID NO: 9297 - RNA, 19 nt, Homo sapiens
aacgagcgcuucacucauu

SEQ ID NO: 9298 - RNA, 19 nt, Homo sapiens
ggaaggcccagcucaugaa

SEQ ID NO: 9299 - RNA, 19 nt, Homo sapiens
acgagaaccugcuacaguu

SEQ ID NO: 9300 - RNA, 19 nt, Homo sapiens
guucauugcugccgagaag

SEQ ID NO: 9301 - RNA, 19 nt, Homo sapiens
cgagggagccaucaacuuc

SEQ ID NO: 9302 - RNA, 19 nt, Homo sapiens
caucuaagcccaggacaug

SEQ ID NO: 9303 - RNA, 19 nt, Homo sapiens
agaugaggcccaccauuaa

SEQ ID NO: 9304 - RNA, 19 nt, Homo sapiens
ggccacaagccgucuauug

SEQ ID NO: 9305 - RNA, 19 nt, Homo sapiens
cgaacugugucauguagca

SEQ ID NO: 9306 - RNA, 19 nt, Homo sapiens
gggaacaucaucacaugga

SEQ ID NO: 9307 - RNA, 19 nt, Homo sapiens
gcccggaagucacguacga

SEQ ID NO: 9308 - RNA, 19 nt, Homo sapiens
ccuaaagagucaagcaucu

SEQ ID NO: 9309 - RNA, 19 nt, Homo sapiens
gacuuuggcuuggcuguuc

SEQ ID NO: 9310 - RNA, 19 nt, Homo sapiens
gcugcuggcuagaugacuu

SEQ ID NO: 9311 - RNA, 19 nt, Homo sapiens
cuuuguagcugucaagauc

SEQ ID NO: 9312 - RNA, 19 nt, Homo sapiens
guacuucugcugcugugaa

SEQ ID NO: 9313 - RNA, 19 nt, Homo sapiens
uuaaagaucacugguugaa

SEQ ID NO: 9314 - RNA, 19 nt, Homo sapiens
ucacggugcuggccuacuc

SEQ ID NO: 9315 - RNA, 19 nt, Homo sapiens
ggcccaccauuaaagauca

SEQ ID NO: 9316 - RNA, 19 nt, Homo sapiens
ccucacggauuaccucaag

SEQ ID NO: 9317 - RNA, 19 nt, Homo sapiens
ucacggccuuccaugacaa

SEQ ID NO: 9318 - RNA, 19 nt, Homo sapiens
aguacaugcugcccuuuga

SEQ ID NO: 9319 - RNA, 19 nt, Homo sapiens
ccaucaacuuccagagaga

SEQ ID NO: 9320 - RNA, 19 nt, Homo sapiens
cuaaagagucaagcaucua

SEQ ID NO: 9321 - RNA, 19 nt, Homo sapiens
gaguacaugcugcccuuug

SEQ ID NO: 9322 - RNA, 19 nt, Homo sapiens
uaaagaucacugguugaaa

SEQ ID NO: 9323 - RNA, 19 nt, Homo sapiens
gaagggcugcuggcuagau

SEQ ID NO: 9324 - RNA, 19 nt, Homo sapiens
gcuuggcuguucgauuuga

SEQ ID NO: 9325 - RNA, 19 nt, Homo sapiens
gcacaccuggcaugaagca

SEQ ID NO: 9326 - RNA, 19 nt, Homo sapiens
caucaucacauggaacgaa

SEQ ID NO: 9327 - RNA, 19 nt, Homo sapiens
gaaggcccagcucaugaau

SEQ ID NO: 9328 - RNA, 19 nt, Homo sapiens
ccauuaaagaucacugguu

SEQ ID NO: 9329 - RNA, 19 nt, Homo sapiens
gcaugaagcacgagaaccu

SEQ ID NO: 9330 - RNA, 19 nt, Homo sapiens
gcacuaccucggacugucu

SEQ ID NO: 9331 - RNA, 19 nt, Homo sapiens
cacgagaaccugcuacagu

SEQ ID NO: 9332 - RNA, 19 nt, Homo sapiens
ggagcgggugucccugauu

SEQ ID NO: 9333 - RNA, 19 nt, Homo sapiens
ugacuucaacugcuacgau

SEQ ID NO: 9334 - RNA, 19 nt, Homo sapiens
aacgaacugugucauguag

SEQ ID NO: 9335 - RNA, 19 nt, Homo sapiens
uggaaggcccagcucauga

SEQ ID NO: 9336 - RNA, 19 nt, Homo sapiens
gcucaucacggccuuccau

SEQ ID NO: 9337 - RNA, 19 nt, Homo sapiens
gaggugguggugcacaaga

SEQ ID NO: 9338 - RNA, 19 nt, Homo sapiens
gccacaagccgucuauugc

SEQ ID NO: 9339 - RNA, 19 nt, Homo sapiens
agagugaacgggagaucuu

SEQ ID NO: 9340 - RNA, 19 nt, Homo sapiens
gccagcacccuucguugga

SEQ ID NO: 9341 - RNA, 19 nt, Homo sapiens
gcugaagagcgaccucaca

SEQ ID NO: 9342 - RNA, 19 nt, Homo sapiens
ggaagacgcuggaauaaga

SEQ ID NO: 9343 - RNA, 19 nt, Homo sapiens
gcaggaagacgcuggaaua

SEQ ID NO: 9344 - RNA, 19 nt, Homo sapiens
gcaaugugcuggucaagag

SEQ ID NO: 9345 - RNA, 19 nt, Homo sapiens
ugaagaagguggugugugu

SEQ ID NO: 9346 - RNA, 19 nt, Homo sapiens
ggaaaggccuucugaugcu

SEQ ID NO: 9347 - RNA, 19 nt, Homo sapiens
ugagaucuauaacacagua

SEQ ID NO: 9348 - RNA, 19 nt, Homo sapiens
agagaagccuaaagugauu

SEQ ID NO: 9349 - RNA, 19 nt, Homo sapiens
ccagagaagccuaaaguga

SEQ ID NO: 9350 - RNA, 19 nt, Homo sapiens
agccuaaagugauucaaua

SEQ ID NO: 9351 - RNA, 19 nt, Homo sapiens
gcuggaauaagaaacauuu

SEQ ID NO: 9352 - RNA, 19 nt, Homo sapiens
gggagacugagaucuauaa

SEQ ID NO: 9353 - RNA, 19 nt, Homo sapiens
gacaugaccucccgcaacu

SEQ ID NO: 9354 - RNA, 19 nt, Homo sapiens
agaccacccuucuaugaug

SEQ ID NO: 9355 - RNA, 19 nt, Homo sapiens
gcacgcagcuguggcucau

SEQ ID NO: 9356 - RNA, 19 nt, Homo sapiens
agacugagaucuauaacac

SEQ ID NO: 9357 - RNA, 19 nt, Homo sapiens
gaagacgcuggaauaagaa

SEQ ID NO: 9358 - RNA, 19 nt, Homo sapiens
cagagaagccuaaagugau

SEQ ID NO: 9359 - RNA, 19 nt, Homo sapiens
gggaugaacaguccugguu

SEQ ID NO: 9360 - RNA, 19 nt, Homo sapiens
caggaaaggccuucugaug

SEQ ID NO: 9361 - RNA, 19 nt, Homo sapiens
gcucagacacgacaacauc

SEQ ID NO: 9362 - RNA, 19 nt, Homo sapiens
gaucuauaacacaguauug

SEQ ID NO: 9363 - RNA, 19 nt, Homo sapiens
gagcagggcgacacgaugu

SEQ ID NO: 9364 - RNA, 19 nt, Homo sapiens
ggguagagguagugugagu

SEQ ID NO: 9365 - RNA, 19 nt, Homo sapiens
gaucaagaagacacuacaa

SEQ ID NO: 9366 - RNA, 19 nt, Homo sapiens
uagcaacaguccagagaag

SEQ ID NO: 9367 - RNA, 19 nt, Homo sapiens
gaccacccuucuaugaugu

SEQ ID NO: 9368 - RNA, 19 nt, Homo sapiens
caggaagacgcuggaauaa

SEQ ID NO: 9369 - RNA, 19 nt, Homo sapiens
gcuuugaggacaugaagaa

SEQ ID NO: 9370 - RNA, 19 nt, Homo sapiens
ccaccgaguucgucaacca

SEQ ID NO: 9371 - RNA, 19 nt, Homo sapiens
ccagagggaccaugaccuu

SEQ ID NO: 9372 - RNA, 19 nt, Homo sapiens
cuucaucgccucagacaug

SEQ ID NO: 9373 - RNA, 19 nt, Homo sapiens
gagcagccgggaacagaug

SEQ ID NO: 9374 - RNA, 19 nt, Homo sapiens
gaaggugguguguguggau

SEQ ID NO: 9375 - RNA, 19 nt, Homo sapiens
gaguguggccgucaagauc

SEQ ID NO: 9376 - RNA, 19 nt, Homo sapiens
gggaccuccuggacaguga

SEQ ID NO: 9377 - RNA, 19 nt, Homo sapiens
guagagguagugugagugu

SEQ ID NO: 9378 - RNA, 19 nt, Homo sapiens
gcucugaggcuagcugugu

SEQ ID NO: 9379 - RNA, 19 nt, Homo sapiens
uaacacaguauugcucaga

SEQ ID NO: 9380 - RNA, 19 nt, Homo sapiens
gcgcugcggaucaagaaga

SEQ ID NO: 9381 - RNA, 19 nt, Homo sapiens
gacaacauccuaggcuuca

SEQ ID NO: 9382 - RNA, 19 nt, Homo sapiens
aggccuagcucagaugaug

SEQ ID NO: 9383 - RNA, 19 nt, Homo sapiens
caucguggaggacuauaga

SEQ ID NO: 9384 - RNA, 19 nt, Homo sapiens
caacauccuaggcuucauc

SEQ ID NO: 9385 - RNA, 19 nt, Homo sapiens
guccagagaagccuaaagu

SEQ ID NO: 9386 - RNA, 19 nt, Homo sapiens
ucucaggccuagcucagau

SEQ ID NO: 9387 - RNA, 19 nt, Homo sapiens
ccgaguucgucaaccacua

SEQ ID NO: 9388 - RNA, 19 nt, Homo sapiens
gagacugagaucuauaaca

SEQ ID NO: 9389 - RNA, 19 nt, Homo sapiens
ccgggagacugagaucuau

SEQ ID NO: 9390 - RNA, 19 nt, Homo sapiens
gcagggcgacacgauguug

SEQ ID NO: 9391 - RNA, 19 nt, Homo sapiens
gcuuugaguccuacaagug

SEQ ID NO: 9392 - RNA, 19 nt, Homo sapiens
acgcagcuguggcucauca

SEQ ID NO: 9393 - RNA, 19 nt, Homo sapiens
ucaagaagacacuacaaaa

SEQ ID NO: 9394 - RNA, 19 nt, Homo sapiens
augauguggugcccaauga

SEQ ID NO: 9395 - RNA, 19 nt, Homo sapiens
caagagcaaccugcagugu

SEQ ID NO: 9396 - RNA, 19 nt, Homo sapiens
acacaguauugcucagaca

SEQ ID NO: 9397 - RNA, 19 nt, Homo sapiens
uugaggacaugaagaaggu

SEQ ID NO: 9398 - RNA, 19 nt, Homo sapiens
cuacgacuuucugcagaga

SEQ ID NO: 9399 - RNA, 19 nt, Homo sapiens
gugagaguguggccgucaa

SEQ ID NO: 9400 - RNA, 19 nt, Homo sapiens
ggaucaagaagacacuaca

SEQ ID NO: 9401 - RNA, 19 nt, Homo sapiens
gacuauagaccacccuucu

SEQ ID NO: 9402 - RNA, 19 nt, Homo sapiens
acucacagggcagcgauua

SEQ ID NO: 9403 - RNA, 19 nt, Homo sapiens
guggagaucuucgguacac

SEQ ID NO: 9404 - RNA, 19 nt, Homo sapiens
gacaguggcacggcagguu

SEQ ID NO: 9405 - RNA, 19 nt, Homo sapiens
cagacacgacaacauccua

SEQ ID NO: 9406 - RNA, 19 nt, Homo sapiens
aguccagucucauccugaa

SEQ ID NO: 9407 - RNA, 19 nt, Homo sapiens
cagagaagcugcacaaggu

SEQ ID NO: 9408 - RNA, 19 nt, Homo sapiens
ggacacagcagcagagaag

SEQ ID NO: 9409 - RNA, 19 nt, Homo sapiens
uaaacuccauccuggcauu

SEQ ID NO: 9410 - RNA, 19 nt, Homo sapiens
gagcugcuguggcuuucuu

SEQ ID NO: 9411 - RNA, 19 nt, Homo sapiens
gcccaagccugacuaugga

SEQ ID NO: 9412 - RNA, 19 nt, Homo sapiens
caagugacaccuacugaug

SEQ ID NO: 9413 - RNA, 19 nt, Homo sapiens
ggcugucucugaaguacua

SEQ ID NO: 9414 - RNA, 19 nt, Homo sapiens
gaaccugacuaagcuagag

SEQ ID NO: 9415 - RNA, 19 nt, Homo sapiens
ggccaugccucacgcuuca

SEQ ID NO: 9416 - RNA, 19 nt, Homo sapiens
ggccugggcugucagaaag

SEQ ID NO: 9417 - RNA, 19 nt, Homo sapiens
ccacugaugccuucacugu

SEQ ID NO: 9418 - RNA, 19 nt, Homo sapiens
gcuauguggugaccguguu

SEQ ID NO: 9419 - RNA, 19 nt, Homo sapiens
gcagcgccaugaccagcaa

SEQ ID NO: 9420 - RNA, 19 nt, Homo sapiens
gcauagccaaucccacuga

SEQ ID NO: 9421 - RNA, 19 nt, Homo sapiens
caccggauguggacuucaa

SEQ ID NO: 9422 - RNA, 19 nt, Homo sapiens
ugaccuuugugccugauga

SEQ ID NO: 9423 - RNA, 19 nt, Homo sapiens
ucugagggcuacaucuaug

SEQ ID NO: 9424 - RNA, 19 nt, Homo sapiens
ccacugacaaccgcuauau

SEQ ID NO: 9425 - RNA, 19 nt, Homo sapiens
gaggguggcguggccuaua

SEQ ID NO: 9426 - RNA, 19 nt, Homo sapiens
gaaccauccacaugaccuu

SEQ ID NO: 9427 - RNA, 19 nt, Homo sapiens
cuaggcuucucacccauga

SEQ ID NO: 9428 - RNA, 19 nt, Homo sapiens
agccgggucugcaaggaua

SEQ ID NO: 9429 - RNA, 19 nt, Homo sapiens
aggguggcguggccuauaa

SEQ ID NO: 9430 - RNA, 19 nt, Homo sapiens
gggccugggcugucagaaa

SEQ ID NO: 9431 - RNA, 19 nt, Homo sapiens
ucaaggaacauuggaguca

SEQ ID NO: 9432 - RNA, 19 nt, Homo sapiens
ccugggcugucagaaagua

SEQ ID NO: 9433 - RNA, 19 nt, Homo sapiens
ucucugaaguacuaacaca

SEQ ID NO: 9434 - RNA, 19 nt, Homo sapiens
cuggaacuccuaaaccuuu

SEQ ID NO: 9435 - RNA, 19 nt, Homo sapiens
gacaccuacugaugacuca

SEQ ID NO: 9436 - RNA, 19 nt, Homo sapiens
cccuagaguuugcucagaa

SEQ ID NO: 9437 - RNA, 19 nt, Homo sapiens
gaugagggcauagccaauc

SEQ ID NO: 9438 - RNA, 19 nt, Homo sapiens
ccagaaccauccacaugac

SEQ ID NO: 9439 - RNA, 19 nt, Homo sapiens
cguggccuauaacgugaua

SEQ ID NO: 9440 - RNA, 19 nt, Homo sapiens
gagcgccagcuuugacuuc

SEQ ID NO: 9441 - RNA, 19 nt, Homo sapiens
caccaugagcgccagcuuu

SEQ ID NO: 9442 - RNA, 19 nt, Homo sapiens
cccagaaccauccacauga

SEQ ID NO: 9443 - RNA, 19 nt, Homo sapiens
ugacagcugagcccuggaa

SEQ ID NO: 9444 - RNA, 19 nt, Homo sapiens
acgaugaacggcugcauga

SEQ ID NO: 9445 - RNA, 19 nt, Homo sapiens
acugaugccuucacugucu

SEQ ID NO: 9446 - RNA, 19 nt, Homo sapiens
ccauccacaugaccuuugu

SEQ ID NO: 9447 - RNA, 19 nt, Homo sapiens
ccuacacucuccuccaucu

SEQ ID NO: 9448 - RNA, 19 nt, Homo sapiens
ccaagugacaccuacugau

SEQ ID NO: 9449 - RNA, 19 nt, Homo sapiens
uggaacuccuaaaccuuug

SEQ ID NO: 9450 - RNA, 19 nt, Homo sapiens
uguggugccugucuucaag

SEQ ID NO: 9451 - RNA, 19 nt, Homo sapiens
cagcugagcccuggaacuc

SEQ ID NO: 9452 - RNA, 19 nt, Homo sapiens
ugccugcccuugccagugu

SEQ ID NO: 9453 - RNA, 19 nt, Homo sapiens
ggaugagggcauagccaau

SEQ ID NO: 9454 - RNA, 19 nt, Homo sapiens
ggauguggugccugucuuc

SEQ ID NO: 9455 - RNA, 19 nt, Homo sapiens
gaaggaaacacccugauau

SEQ ID NO: 9456 - RNA, 19 nt, Homo sapiens
gauuaccacuguacacaaa

SEQ ID NO: 9457 - RNA, 19 nt, Homo sapiens
aagcaaacuucaacaauga

SEQ ID NO: 9458 - RNA, 19 nt, Homo sapiens
aaagcaaacuucaacaaug

SEQ ID NO: 9459 - RNA, 19 nt, Homo sapiens
ugauaucaguggauuauga

SEQ ID NO: 9460 - RNA, 19 nt, Homo sapiens
uaagauaaacucagugguu

SEQ ID NO: 9461 - RNA, 19 nt, Homo sapiens
caaagcaaacuucaacaau

SEQ ID NO: 9462 - RNA, 19 nt, Homo sapiens
uuacucagacuuccaaauu

SEQ ID NO: 9463 - RNA, 19 nt, Homo sapiens
ccacuguacacaaaucuaa

SEQ ID NO: 9464 - RNA, 19 nt, Homo sapiens
uaaaucacacaucgacaaa

SEQ ID NO: 9465 - RNA, 19 nt, Homo sapiens
gcaggaauggcuugaaaca

SEQ ID NO: 9466 - RNA, 19 nt, Homo sapiens
agaaggaaacacccugaua

SEQ ID NO: 9467 - RNA, 19 nt, Homo sapiens
gauaucaguggauuaugaa

SEQ ID NO: 9468 - RNA, 19 nt, Homo sapiens
cgacaaagcaaacuucaac

SEQ ID NO: 9469 - RNA, 19 nt, Homo sapiens
auaauggccugaauuuaag

SEQ ID NO: 9470 - RNA, 19 nt, Homo sapiens
gagcauggcagaaggaaac

SEQ ID NO: 9471 - RNA, 19 nt, Homo sapiens
acucagacuuccaaauugu

SEQ ID NO: 9472 - RNA, 19 nt, Homo sapiens
cuaaaucacacaucgacaa

SEQ ID NO: 9473 - RNA, 19 nt, Homo sapiens
gaaccuucugcuuagagua

SEQ ID NO: 9474 - RNA, 19 nt, Homo sapiens
ggaaggauuaccacuguac

SEQ ID NO: 9475 - RNA, 19 nt, Homo sapiens
ggauuacucagacuuccaa

SEQ ID NO: 9476 - RNA, 19 nt, Homo sapiens
ucagacuuccaaauuguaa

SEQ ID NO: 9477 - RNA, 19 nt, Homo sapiens
acaaagcaaacuucaacaa

SEQ ID NO: 9478 - RNA, 19 nt, Homo sapiens
augcaggaauggcuugaaa

SEQ ID NO: 9479 - RNA, 19 nt, Homo sapiens
ggauuaccacuguacacaa

SEQ ID NO: 9480 - RNA, 19 nt, Homo sapiens
guaaaauaauggccugaau

SEQ ID NO: 9481 - RNA, 19 nt, Homo sapiens
uacucagacuuccaaauug

SEQ ID NO: 9482 - RNA, 19 nt, Homo sapiens
ccuguaugauggaaggauu

SEQ ID NO: 9483 - RNA, 19 nt, Homo sapiens
ucuccaaggugcgucauau

SEQ ID NO: 9484 - RNA, 19 nt, Homo sapiens
gaaggauuaccacuguaca

SEQ ID NO: 9485 - RNA, 19 nt, Homo sapiens
ucacacaucgacaaagcaa

SEQ ID NO: 9486 - RNA, 19 nt, Homo sapiens
uggaaggauuaccacugua

SEQ ID NO: 9487 - RNA, 19 nt, Homo sapiens
aaucacacaucgacaaagc

SEQ ID NO: 9488 - RNA, 19 nt, Homo sapiens
uacgugcuguguccgauga

SEQ ID NO: 9489 - RNA, 19 nt, Homo sapiens
ugaaguuggauuacucaga

SEQ ID NO: 9490 - RNA, 19 nt, Homo sapiens
uuaccacuguacacaaauc

SEQ ID NO: 9491 - RNA, 19 nt, Homo sapiens
auggaaggauuaccacugu

SEQ ID NO: 9492 - RNA, 19 nt, Homo sapiens
ucaucuugaaguuggauua

SEQ ID NO: 9493 - RNA, 19 nt, Homo sapiens
cacagugcaaggacaauug

SEQ ID NO: 9494 - RNA, 19 nt, Homo sapiens
caucgacaaagcaaacuuc

SEQ ID NO: 9495 - RNA, 19 nt, Homo sapiens
cagaguaccuugaucaauu

SEQ ID NO: 9496 - RNA, 19 nt, Homo sapiens
gcacaaacuuuucuaauga

SEQ ID NO: 9497 - RNA, 19 nt, Homo sapiens
gaacagaguaccuugauca

SEQ ID NO: 9498 - RNA, 19 nt, Homo sapiens
guaacacacugaacaauag

SEQ ID NO: 9499 - RNA, 19 nt, Homo sapiens
ccacaaauauacccaacuu

SEQ ID NO: 9500 - RNA, 19 nt, Homo sapiens
gaauaauaguagcagagua

SEQ ID NO: 9501 - RNA, 19 nt, Homo sapiens
agaguaccuugaucaauua

SEQ ID NO: 9502 - RNA, 19 nt, Homo sapiens
aaacuugucucauggaauc

SEQ ID NO: 9503 - RNA, 19 nt, Homo sapiens
caaagucaauuccaugaag

SEQ ID NO: 9504 - RNA, 19 nt, Homo sapiens
gaauguauacagaagauga

SEQ ID NO: 9505 - RNA, 19 nt, Homo sapiens
gguguuugcuucagaaugu

SEQ ID NO: 9506 - RNA, 19 nt, Homo sapiens
ucucuaagcuugaauacuc

SEQ ID NO: 9507 - RNA, 19 nt, Homo sapiens
ggcgagacaucaaauaaag

SEQ ID NO: 9508 - RNA, 19 nt, Homo sapiens
ucaaauccguggacuacga

SEQ ID NO: 9509 - RNA, 19 nt, Homo sapiens
gggcacagcauccggcuuu

SEQ ID NO: 9510 - RNA, 19 nt, Homo sapiens
cagaauguauacagaagau

SEQ ID NO: 9511 - RNA, 19 nt, Homo sapiens
gcaggguguuugcuucaga

SEQ ID NO: 9512 - RNA, 19 nt, Homo sapiens
ggugaagaauaccagcaaa

SEQ ID NO: 9513 - RNA, 19 nt, Homo sapiens
gucugacacugaaauaauu

SEQ ID NO: 9514 - RNA, 19 nt, Homo sapiens
gacuguacgugcuacuaaa

SEQ ID NO: 9515 - RNA, 19 nt, Homo sapiens
uguaacacacugaacaaua

SEQ ID NO: 9516 - RNA, 19 nt, Homo sapiens
gcauugaccgcacaaacuu

SEQ ID NO: 9517 - RNA, 19 nt, Homo sapiens
gacaaagucaauuccauga

SEQ ID NO: 9518 - RNA, 19 nt, Homo sapiens
cgagacaucaaauaaaguu

SEQ ID NO: 9519 - RNA, 19 nt, Homo sapiens
gagaacagaguaccuugau

SEQ ID NO: 9520 - RNA, 19 nt, Homo sapiens
cgacuguacgugcuacuaa

SEQ ID NO: 9521 - RNA, 19 nt, Homo sapiens
gaagagugcaggguguuug

SEQ ID NO: 9522 - RNA, 19 nt, Homo sapiens
gccaagcagucccaugugu

SEQ ID NO: 9523 - RNA, 19 nt, Homo sapiens
cagaagacaaagucaauuc

SEQ ID NO: 9524 - RNA, 19 nt, Homo sapiens
ggaagagugcaggguguuu

SEQ ID NO: 9525 - RNA, 19 nt, Homo sapiens
uaacuuugagaacagagua

SEQ ID NO: 9526 - RNA, 19 nt, Homo sapiens
gggaagagaggccuaggau

SEQ ID NO: 9527 - RNA, 19 nt, Homo sapiens
acacacugaacaauagaua

SEQ ID NO: 9528 - RNA, 19 nt, Homo sapiens
gaagacaaagucaauucca

SEQ ID NO: 9529 - RNA, 19 nt, Homo sapiens
gugguuggcugggugaaga

SEQ ID NO: 9530 - RNA, 19 nt, Homo sapiens
gaagaugaagcuaggaaaa

SEQ ID NO: 9531 - RNA, 19 nt, Homo sapiens
uuaaacuugucucauggaa

SEQ ID NO: 9532 - RNA, 19 nt, Homo sapiens
aaagucaauuccaugaagu

SEQ ID NO: 9533 - RNA, 19 nt, Homo sapiens
agaugaagcuaggaaaaua

SEQ ID NO: 9534 - RNA, 19 nt, Homo sapiens
gcgccaagcagucccaugu

SEQ ID NO: 9535 - RNA, 19 nt, Homo sapiens
gccagaagacaaagucaau

SEQ ID NO: 9536 - RNA, 19 nt, Homo sapiens
gcuucagaauguauacaga

SEQ ID NO: 9537 - RNA, 19 nt, Homo sapiens
uuacuaacuuugagaacag

SEQ ID NO: 9538 - RNA, 19 nt, Homo sapiens
uauguuauuuggcgagaca

SEQ ID NO: 9539 - RNA, 19 nt, Homo sapiens
cagcaaaggcaccgugaca

SEQ ID NO: 9540 - RNA, 19 nt, Homo sapiens
cagaagaugaagcuaggaa

SEQ ID NO: 9541 - RNA, 19 nt, Homo sapiens
caggguguuugcuucagaa

SEQ ID NO: 9542 - RNA, 19 nt, Homo sapiens
aauaauaguagcagaguag

SEQ ID NO: 9543 - RNA, 19 nt, Homo sapiens
uaacacacugaacaauaga

SEQ ID NO: 9544 - RNA, 19 nt, Homo sapiens
gcacagcauccggcuuuua

SEQ ID NO: 9545 - RNA, 19 nt, Homo sapiens
ccagaagacaaagucaauu

SEQ ID NO: 9546 - RNA, 19 nt, Homo sapiens
uggcgagacaucaaauaaa

SEQ ID NO: 9547 - RNA, 19 nt, Homo sapiens
guagcagaguagggugaaa

SEQ ID NO: 9548 - RNA, 19 nt, Homo sapiens
aagacaaagucaauuccau

SEQ ID NO: 9549 - RNA, 19 nt, Homo sapiens
ugagaacagaguaccuuga

SEQ ID NO: 9550 - RNA, 19 nt, Homo sapiens
aaccaucucuaagcuugaa

SEQ ID NO: 9551 - RNA, 19 nt, Homo sapiens
ccaucucuaagcuugaaua

SEQ ID NO: 9552 - RNA, 19 nt, Homo sapiens
ugaaagcuaagcgacugua

SEQ ID NO: 9553 - RNA, 19 nt, Homo sapiens
acugaacaauagauacugu

SEQ ID NO: 9554 - RNA, 19 nt, Homo sapiens
cgcacaaacuuuucuaaug

SEQ ID NO: 9555 - RNA, 19 nt, Homo sapiens
guuggaagcccuaguucuc

SEQ ID NO: 9556 - RNA, 19 nt, Homo sapiens
gaaagcuaagcgacuguac

SEQ ID NO: 9557 - RNA, 19 nt, Homo sapiens
acaaagucaauuccaugaa

SEQ ID NO: 9558 - RNA, 19 nt, Homo sapiens
ggccagaagacaaagucaa

SEQ ID NO: 9559 - RNA, 19 nt, Homo sapiens
gggugaagaauaccagcaa

SEQ ID NO: 9560 - RNA, 19 nt, Homo sapiens
gaaaccaucuuauacuaug

SEQ ID NO: 9561 - RNA, 19 nt, Homo sapiens
gaacaucaaugcggccaaa

SEQ ID NO: 9562 - RNA, 19 nt, Homo sapiens
ggacacugauuaccagaug

SEQ ID NO: 9563 - RNA, 19 nt, Homo sapiens
ggacaugggcuuuacugaa

SEQ ID NO: 9564 - RNA, 19 nt, Homo sapiens
gacaugggcuuuacugaag

SEQ ID NO: 9565 - RNA, 19 nt, Homo sapiens
ucacuucucugauuaugug

SEQ ID NO: 9566 - RNA, 19 nt, Homo sapiens
gaagaccaggcccuuuaua

SEQ ID NO: 9567 - RNA, 19 nt, Homo sapiens
gggcaugguugaaucugaa

SEQ ID NO: 9568 - RNA, 19 nt, Homo sapiens
ccaaagagggcguggugua

SEQ ID NO: 9569 - RNA, 19 nt, Homo sapiens
cugaaaccaucuuauacua

SEQ ID NO: 9570 - RNA, 19 nt, Homo sapiens
gaaaaucuggugcucaaua

SEQ ID NO: 9571 - RNA, 19 nt, Homo sapiens
cgacaagcccaaaguagaa

SEQ ID NO: 9572 - RNA, 19 nt, Homo sapiens
ucaaaaggaucgccuauga

SEQ ID NO: 9573 - RNA, 19 nt, Homo sapiens
ggaucgcccucccagcuaa

SEQ ID NO: 9574 - RNA, 19 nt, Homo sapiens
ccgcgucacuucucugauu

SEQ ID NO: 9575 - RNA, 19 nt, Homo sapiens
gggcucggccgaaguagua

SEQ ID NO: 9576 - RNA, 19 nt, Homo sapiens
caaauuugacuacuacaug

SEQ ID NO: 9577 - RNA, 19 nt, Homo sapiens
gaucgccuaugaguuugua

SEQ ID NO: 9578 - RNA, 19 nt, Homo sapiens
aaggaucgccuaugaguuu

SEQ ID NO: 9579 - RNA, 19 nt, Homo sapiens
gaccaggcccuuuauaaca

SEQ ID NO: 9580 - RNA, 19 nt, Homo sapiens
aaaagaggcuguggacaua

SEQ ID NO: 9581 - RNA, 19 nt, Homo sapiens
cagacuuccuggccaaauu

SEQ ID NO: 9582 - RNA, 19 nt, Homo sapiens
gaagaccaugaucucaaua

SEQ ID NO: 9583 - RNA, 19 nt, Homo sapiens
uggaagaccaggcccuuua

SEQ ID NO: 9584 - RNA, 19 nt, Homo sapiens
agaagaccaugaucucaau

SEQ ID NO: 9585 - RNA, 19 nt, Homo sapiens
ggccaaauuugacuacuac

SEQ ID NO: 9586 - RNA, 19 nt, Homo sapiens
ugaucucaauagucaguua

SEQ ID NO: 9587 - RNA, 19 nt, Homo sapiens
ccuaugaguuuguagagau

SEQ ID NO: 9588 - RNA, 19 nt, Homo sapiens
ggaagaccaggcccuuuau

SEQ ID NO: 9589 - RNA, 19 nt, Homo sapiens
uuacugaagaggaguuuaa

SEQ ID NO: 9590 - RNA, 19 nt, Homo sapiens
gcuaacuacucgcucaaca

SEQ ID NO: 9591 - RNA, 19 nt, Homo sapiens
accaugaucucaauaguca

SEQ ID NO: 9592 - RNA, 19 nt, Homo sapiens
gaagacgccacuccuccaa

SEQ ID NO: 9593 - RNA, 19 nt, Homo sapiens
caaagagggcgugguguau

SEQ ID NO: 9594 - RNA, 19 nt, Homo sapiens
uuaaaaggcugaacaucaa

SEQ ID NO: 9595 - RNA, 19 nt, Homo sapiens
uggccaaauuugacuacua

SEQ ID NO: 9596 - RNA, 19 nt, Homo sapiens
aaaaucuggugcucaauaa

SEQ ID NO: 9597 - RNA, 19 nt, Homo sapiens
agaacugcauguccaccua

SEQ ID NO: 9598 - RNA, 19 nt, Homo sapiens
cuaguuuccucccagaaga

SEQ ID NO: 9599 - RNA, 19 nt, Homo sapiens
aaacgggacaugggcuuua

SEQ ID NO: 9600 - RNA, 19 nt, Homo sapiens
ucaaugcggccaaaucuag

SEQ ID NO: 9601 - RNA, 19 nt, Homo sapiens
acuacucgcucaacacaga

SEQ ID NO: 9602 - RNA, 19 nt, Homo sapiens
uaacuacucgcucaacaca

SEQ ID NO: 9603 - RNA, 19 nt, Homo sapiens
aaacaugcacuucgagauc

SEQ ID NO: 9604 - RNA, 19 nt, Homo sapiens
aagaccaggcccuuuauaa

SEQ ID NO: 9605 - RNA, 19 nt, Homo sapiens
ugaccuggcuggagaugag

SEQ ID NO: 9606 - RNA, 19 nt, Homo sapiens
ugguggagcuguguaagaa

SEQ ID NO: 9607 - RNA, 19 nt, Homo sapiens
gcucacccuuccagacuuc

SEQ ID NO: 9608 - RNA, 19 nt, Homo sapiens
guggcaacuuguacugaaa

SEQ ID NO: 9609 - RNA, 19 nt, Homo sapiens
cgcgucacuucucugauua

SEQ ID NO: 9610 - RNA, 19 nt, Homo sapiens
ccaagaagaccaugaucuc

SEQ ID NO: 9611 - RNA, 19 nt, Homo sapiens
gaccagcgcccuugcacau

SEQ ID NO: 9612 - RNA, 19 nt, Homo sapiens
caagaagaccaugaucuca

SEQ ID NO: 9613 - RNA, 19 nt, Homo sapiens
gacacugauuaccagauga

SEQ ID NO: 9614 - RNA, 19 nt, Homo sapiens
aagagggcgugguguaugu

SEQ ID NO: 9615 - RNA, 19 nt, Homo sapiens
uguggcaacuuguacugaa

SEQ ID NO: 9616 - RNA, 19 nt, Homo sapiens
cacggagcaugcagucauu

SEQ ID NO: 9617 - RNA, 19 nt, Homo sapiens
ucugaaacccuccuucugu

SEQ ID NO: 9618 - RNA, 19 nt, Homo sapiens
aaaaugaccaggcuaacua

SEQ ID NO: 9619 - RNA, 19 nt, Homo sapiens
caaaguagaacugcauguc

SEQ ID NO: 9620 - RNA, 19 nt, Homo sapiens
agacuuccuggccaaauuu

SEQ ID NO: 9621 - RNA, 19 nt, Homo sapiens
caucaaugcggccaaaucu

SEQ ID NO: 9622 - RNA, 19 nt, Homo sapiens
gcuguggacauacucaaga

SEQ ID NO: 9623 - RNA, 19 nt, Homo sapiens
ccucuugccuggacauguc

SEQ ID NO: 9624 - RNA, 19 nt, Homo sapiens
agccugaaaccaucuuaua

SEQ ID NO: 9625 - RNA, 19 nt, Homo sapiens
gcagaccgugguagccauu

SEQ ID NO: 9626 - RNA, 19 nt, Homo sapiens
gaacccuauguguccauuu

SEQ ID NO: 9627 - RNA, 19 nt, Homo sapiens
gaccaugaucucaauaguc

SEQ ID NO: 9628 - RNA, 19 nt, Homo sapiens
aagaagaccaugaucucaa

SEQ ID NO: 9629 - RNA, 19 nt, Homo sapiens
ucgacaagcccaaaguaga

SEQ ID NO: 9630 - RNA, 19 nt, Homo sapiens
uucucgaccugcucuauaa

SEQ ID NO: 9631 - RNA, 19 nt, Homo sapiens
ccacccuggacacugauua

SEQ ID NO: 9632 - RNA, 19 nt, Homo sapiens
acuacuacaugccugcuau

SEQ ID NO: 9633 - RNA, 19 nt, Homo sapiens
aacccuauguguccauuuc

SEQ ID NO: 9634 - RNA, 19 nt, Homo sapiens
agaccaugaucucaauagu

SEQ ID NO: 9635 - RNA, 19 nt, Homo sapiens
cauuuauuccuuccaagaa

SEQ ID NO: 9636 - RNA, 19 nt, Homo sapiens
caaacgggacaugggcuuu

SEQ ID NO: 9637 - RNA, 19 nt, Homo sapiens
uggacauacucaagacaga

SEQ ID NO: 9638 - RNA, 19 nt, Homo sapiens
agaccgugguagccauuga

SEQ ID NO: 9639 - RNA, 19 nt, Homo sapiens
cuaugaguuuguagagaug

SEQ ID NO: 9640 - RNA, 19 nt, Homo sapiens
cgucacuucucugauuaug

SEQ ID NO: 9641 - RNA, 19 nt, Homo sapiens
ggauccaucaagccugaaa

SEQ ID NO: 9642 - RNA, 19 nt, Homo sapiens
guggagcuguguaagaacu

SEQ ID NO: 9643 - RNA, 19 nt, Homo sapiens
gccuaugaguuuguagaga

SEQ ID NO: 9644 - RNA, 19 nt, Homo sapiens
ccaaauuugacuacuacau

SEQ ID NO: 9645 - RNA, 19 nt, Homo sapiens
ccaucaagccugaaaccau

SEQ ID NO: 9646 - RNA, 19 nt, Homo sapiens
caagccugaaaccaucuua

SEQ ID NO: 9647 - RNA, 19 nt, Homo sapiens
cuccuucuguggcaacuug

SEQ ID NO: 9648 - RNA, 19 nt, Homo sapiens
uaaaagaggcuguggacau

SEQ ID NO: 9649 - RNA, 19 nt, Homo sapiens
ccauuucugcacacacgua

SEQ ID NO: 9650 - RNA, 19 nt, Homo sapiens
acaugggcuuuacugaaga

SEQ ID NO: 9651 - RNA, 19 nt, Homo sapiens
gagcggcauucaccguacu

SEQ ID NO: 9652 - RNA, 19 nt, Homo sapiens
aaagagggcgugguguaug

SEQ ID NO: 9653 - RNA, 19 nt, Homo sapiens
ggaaugcccuuuauggaaa

SEQ ID NO: 9654 - RNA, 19 nt, Homo sapiens
gcgcgaagcugcugacuga

SEQ ID NO: 9655 - RNA, 19 nt, Homo sapiens
guacagggcugacaugugu

SEQ ID NO: 9656 - RNA, 19 nt, Homo sapiens
gcaccugcaugacaacgua

SEQ ID NO: 9657 - RNA, 19 nt, Homo sapiens
ggacuuacacguuuacaga

SEQ ID NO: 9658 - RNA, 19 nt, Homo sapiens
gcccaaagguugcccugaa

SEQ ID NO: 9659 - RNA, 19 nt, Homo sapiens
ucagcuaucuugucugguu

SEQ ID NO: 9660 - RNA, 19 nt, Homo sapiens
guggaaauuuggagaaguu

SEQ ID NO: 9661 - RNA, 19 nt, Homo sapiens
ccaagaaggacauguguga

SEQ ID NO: 9662 - RNA, 19 nt, Homo sapiens
ggacaagcuauaucagaaa

SEQ ID NO: 9663 - RNA, 19 nt, Homo sapiens
gcugaaagcuuuuauucuu

SEQ ID NO: 9664 - RNA, 19 nt, Homo sapiens
ggaauagucaggacagguu

SEQ ID NO: 9665 - RNA, 19 nt, Homo sapiens
cagagaagguuugcuggaa

SEQ ID NO: 9666 - RNA, 19 nt, Homo sapiens
gccaggacuuacacguuua

SEQ ID NO: 9667 - RNA, 19 nt, Homo sapiens
gagaagguuugcuggaaag

SEQ ID NO: 9668 - RNA, 19 nt, Homo sapiens
cgaguucuguagauucuug

SEQ ID NO: 9669 - RNA, 19 nt, Homo sapiens
gcuuaggaaugcccuuuau

SEQ ID NO: 9670 - RNA, 19 nt, Homo sapiens
uggacaagcuauaucagaa

SEQ ID NO: 9671 - RNA, 19 nt, Homo sapiens
ugccaggacuuacacguuu

SEQ ID NO: 9672 - RNA, 19 nt, Homo sapiens
agagaagguuugcuggaaa

SEQ ID NO: 9673 - RNA, 19 nt, Homo sapiens
ggauggcacugcguaugaa

SEQ ID NO: 9674 - RNA, 19 nt, Homo sapiens
caucacgggugucgacuuc

SEQ ID NO: 9675 - RNA, 19 nt, Homo sapiens
gcgccuguguggaaauuug

SEQ ID NO: 9676 - RNA, 19 nt, Homo sapiens
ugaccgaguucuguagauu

SEQ ID NO: 9677 - RNA, 19 nt, Homo sapiens
caucauggcaggcagcauu

SEQ ID NO: 9678 - RNA, 19 nt, Homo sapiens
guucuaaccucaguaaugc

SEQ ID NO: 9679 - RNA, 19 nt, Homo sapiens
gagcugugccgucccaaga

SEQ ID NO: 9680 - RNA, 19 nt, Homo sapiens
ugugugaccucgaggaguu

SEQ ID NO: 9681 - RNA, 19 nt, Homo sapiens
gggagagucagcuaucuug

SEQ ID NO: 9682 - RNA, 19 nt, Homo sapiens
ugacauguguggcguucug

SEQ ID NO: 9683 - RNA, 19 nt, Homo sapiens
guucaggaggccacauaua

SEQ ID NO: 9684 - RNA, 19 nt, Homo sapiens
caccaaagcaggucaucaa

SEQ ID NO: 9685 - RNA, 19 nt, Homo sapiens
gaccucagauguguguuca

SEQ ID NO: 9686 - RNA, 19 nt, Homo sapiens
gacaagcuauaucagaaac

SEQ ID NO: 9687 - RNA, 19 nt, Homo sapiens
gcaguaugaggucguguug

SEQ ID NO: 9688 - RNA, 19 nt, Homo sapiens
agagucagcuaucuugucu

SEQ ID NO: 9689 - RNA, 19 nt, Homo sapiens
guaaugcaucuaccugaga

SEQ ID NO: 9690 - RNA, 19 nt, Homo sapiens
gagaaguugcggcagagaa

SEQ ID NO: 9691 - RNA, 19 nt, Homo sapiens
caucaucgucuaccgcaaa

SEQ ID NO: 9692 - RNA, 19 nt, Homo sapiens
guucuguagauucuuguua

SEQ ID NO: 9693 - RNA, 19 nt, Homo sapiens
cagcuaucuugucugguuu

SEQ ID NO: 9694 - RNA, 19 nt, Homo sapiens
gcuguucuaaccucaguaa

SEQ ID NO: 9695 - RNA, 19 nt, Homo sapiens
caagcuauaucagaaacuc

SEQ ID NO: 9696 - RNA, 19 nt, Homo sapiens
uggcaggcaucaucgucua

SEQ ID NO: 9697 - RNA, 19 nt, Homo sapiens
gccuggagauuuggaauag

SEQ ID NO: 9698 - RNA, 19 nt, Homo sapiens
ccagcuuuguguguguuua

SEQ ID NO: 9699 - RNA, 19 nt, Homo sapiens
gaaccgcugcugcaacucu

SEQ ID NO: 9700 - RNA, 19 nt, Homo sapiens
ggccuggagauuuggaaua

SEQ ID NO: 9701 - RNA, 19 nt, Homo sapiens
uaaccucaguaaugcaucu

SEQ ID NO: 9702 - RNA, 19 nt, Homo sapiens
ccuagacccugacuuugca

SEQ ID NO: 9703 - RNA, 19 nt, Homo sapiens
ggcggcaccugcaugacaa

SEQ ID NO: 9704 - RNA, 19 nt, Homo sapiens
uaaauuauugaccgaguuc

SEQ ID NO: 9705 - RNA, 19 nt, Homo sapiens
ugaaucacguggacaagcu

SEQ ID NO: 9706 - RNA, 19 nt, Homo sapiens
aggaaugcccuuuauggaa

SEQ ID NO: 9707 - RNA, 19 nt, Homo sapiens
uuguguguguuuaagcuua

SEQ ID NO: 9708 - RNA, 19 nt, Homo sapiens
caccugcgccuguguggaa

SEQ ID NO: 9709 - RNA, 19 nt, Homo sapiens
gaagcagccgugcgucauc

SEQ ID NO: 9710 - RNA, 19 nt, Homo sapiens
gagagucagcuaucuuguc

SEQ ID NO: 9711 - RNA, 19 nt, Homo sapiens
cggaaccgcugcugcaacu

SEQ ID NO: 9712 - RNA, 19 nt, Homo sapiens
gaaucacguggacaagcua

SEQ ID NO: 9713 - RNA, 19 nt, Homo sapiens
caaugcagaguuccagaug

SEQ ID NO: 9714 - RNA, 19 nt, Homo sapiens
gaagguuugcuggaaagga

SEQ ID NO: 9715 - RNA, 19 nt, Homo sapiens
guggacaagcuauaucaga

SEQ ID NO: 9716 - RNA, 19 nt, Homo sapiens
ucacguggacaagcuauau

SEQ ID NO: 9717 - RNA, 19 nt, Homo sapiens
cguggacaaugcagaguuc

SEQ ID NO: 9718 - RNA, 19 nt, Homo sapiens
cagcuuuguguguguuuaa

SEQ ID NO: 9719 - RNA, 19 nt, Homo sapiens
gcgggugcgugugugugua

SEQ ID NO: 9720 - RNA, 19 nt, Homo sapiens
gaggauggcacugcguaug

SEQ ID NO: 9721 - RNA, 19 nt, Homo sapiens
gcugugccgucccaagaag

SEQ ID NO: 9722 - RNA, 19 nt, Homo sapiens
uaggaaugcccuuuaugga

SEQ ID NO: 9723 - RNA, 19 nt, Homo sapiens
uguuuaagcuuaggaaugc

SEQ ID NO: 9724 - RNA, 19 nt, Homo sapiens
guuuacagauccagcaacu

SEQ ID NO: 9725 - RNA, 19 nt, Homo sapiens
gccacaaccugggcaugga

SEQ ID NO: 9726 - RNA, 19 nt, Homo sapiens
gcaccaaagcaggucauca

SEQ ID NO: 9727 - RNA, 19 nt, Homo sapiens
ggccacagggcacaacuuc

SEQ ID NO: 9728 - RNA, 19 nt, Homo sapiens
cuucuccuaugacauccua

SEQ ID NO: 9729 - RNA, 19 nt, Homo sapiens
gagcucugcccucccacuu

SEQ ID NO: 9730 - RNA, 19 nt, Homo sapiens
gcagcauuggcuccaguuu

SEQ ID NO: 9731 - RNA, 19 nt, Homo sapiens
ugcuggagguggugaauca

SEQ ID NO: 9732 - RNA, 19 nt, Homo sapiens
cuggagauuuggaauaguc

SEQ ID NO: 9733 - RNA, 19 nt, Homo sapiens
uggugggccuggagauuug

SEQ ID NO: 9734 - RNA, 19 nt, Homo sapiens
ucuguagauucuuguuaga

SEQ ID NO: 9735 - RNA, 19 nt, Homo sapiens
gaccgaguucuguagauuc

SEQ ID NO: 9736 - RNA, 19 nt, Homo sapiens
ucaggaggccacauauaca

SEQ ID NO: 9737 - RNA, 19 nt, Homo sapiens
aggccuaccuggagagcuu

SEQ ID NO: 9738 - RNA, 19 nt, Homo sapiens
gggcccucauggagcagua

SEQ ID NO: 9739 - RNA, 19 nt, Homo sapiens
ggagagucagcuaucuugu

SEQ ID NO: 9740 - RNA, 19 nt, Homo sapiens
gaugaugcugccugcgauu

SEQ ID NO: 9741 - RNA, 19 nt, Homo sapiens
ccuccucgguggcucugaa

SEQ ID NO: 9742 - RNA, 19 nt, Homo sapiens
uguauguggucguggacaa

SEQ ID NO: 9743 - RNA, 19 nt, Homo sapiens
cagcauuggcuccaguuuc

SEQ ID NO: 9744 - RNA, 19 nt, Homo sapiens
uaucuugucugguuuucuu

SEQ ID NO: 9745 - RNA, 19 nt, Homo sapiens
uuaggaaugcccuuuaugg

SEQ ID NO: 9746 - RNA, 19 nt, Homo sapiens
guguuuaagcuuaggaaug

SEQ ID NO: 9747 - RNA, 19 nt, Homo sapiens
gcuggucucccgcuguguu

SEQ ID NO: 9748 - RNA, 19 nt, Homo sapiens
gaguccugcuucuccuaug

SEQ ID NO: 9749 - RNA, 19 nt, Homo sapiens
gagggugagcuacguccuu

SEQ ID NO: 9750 - RNA, 19 nt, Homo sapiens
cccaaagguugcccugaag

SEQ ID NO: 9751 - RNA, 19 nt, Homo sapiens
gguacagggcugacaugug

SEQ ID NO: 9752 - RNA, 19 nt, Homo sapiens
aguccugcuucuccuauga

SEQ ID NO: 9753 - RNA, 19 nt, Homo sapiens
gcuaauggcuggauuuauu

SEQ ID NO: 9754 - RNA, 19 nt, Homo sapiens
gcacaaagucuuagaauau

SEQ ID NO: 9755 - RNA, 19 nt, Homo sapiens
aaacuuggcucucaauaaa

SEQ ID NO: 9756 - RNA, 19 nt, Homo sapiens
gcagagagauauauuaaag

SEQ ID NO: 9757 - RNA, 19 nt, Homo sapiens
caauguacauaccuuguua

SEQ ID NO: 9758 - RNA, 19 nt, Homo sapiens
gaaauggaaugguagaaca

SEQ ID NO: 9759 - RNA, 19 nt, Homo sapiens
acagauaccucaagaagaa

SEQ ID NO: 9760 - RNA, 19 nt, Homo sapiens
ggacaaacuuaacaacaau

SEQ ID NO: 9761 - RNA, 19 nt, Homo sapiens
uggcaaagaugauaaagaa

SEQ ID NO: 9762 - RNA, 19 nt, Homo sapiens
cccaaagucucucacauua

SEQ ID NO: 9763 - RNA, 19 nt, Homo sapiens
caauauggauguuucuuug

SEQ ID NO: 9764 - RNA, 19 nt, Homo sapiens
uaacacagauaccucaaga

SEQ ID NO: 9765 - RNA, 19 nt, Homo sapiens
gggacaaacuuaacaacaa

SEQ ID NO: 9766 - RNA, 19 nt, Homo sapiens
aaacuucacuccaaagaga

SEQ ID NO: 9767 - RNA, 19 nt, Homo sapiens
cuacaaauccuuuccguuu

SEQ ID NO: 9768 - RNA, 19 nt, Homo sapiens
gaaggauuaucuuacaaug

SEQ ID NO: 9769 - RNA, 19 nt, Homo sapiens
ccaaagagaaaccuauuaa

SEQ ID NO: 9770 - RNA, 19 nt, Homo sapiens
uaucagacauuaugaagga

SEQ ID NO: 9771 - RNA, 19 nt, Homo sapiens
ggcacaaagucuuagaaua

SEQ ID NO: 9772 - RNA, 19 nt, Homo sapiens
gauauccagucauguuaaa

SEQ ID NO: 9773 - RNA, 19 nt, Homo sapiens
ggaagaaaaugcaaacuga

SEQ ID NO: 9774 - RNA, 19 nt, Homo sapiens
acuaaacccucacaaguaa

SEQ ID NO: 9775 - RNA, 19 nt, Homo sapiens
gaaucuggccaaccuauuu

SEQ ID NO: 9776 - RNA, 19 nt, Homo sapiens
gucaucaucuccaaacuaa

SEQ ID NO: 9777 - RNA, 19 nt, Homo sapiens
gcaauauggauguuucuuu

SEQ ID NO: 9778 - RNA, 19 nt, Homo sapiens
guacuucugugugcaauug

SEQ ID NO: 9779 - RNA, 19 nt, Homo sapiens
agagaaaccuauuaaguca

SEQ ID NO: 9780 - RNA, 19 nt, Homo sapiens
gaacuaugggucucaugua

SEQ ID NO: 9781 - RNA, 19 nt, Homo sapiens
aaagagcagucucacauga

SEQ ID NO: 9782 - RNA, 19 nt, Homo sapiens
caaaguugccuccuccuaa

SEQ ID NO: 9783 - RNA, 19 nt, Homo sapiens
agaacaaggugaagaaugu

SEQ ID NO: 9784 - RNA, 19 nt, Homo sapiens
caaagucucucacauuacu

SEQ ID NO: 9785 - RNA, 19 nt, Homo sapiens
aggaagcucuggaggaaua

SEQ ID NO: 9786 - RNA, 19 nt, Homo sapiens
ccaggagaaucuaagaauu

SEQ ID NO: 9787 - RNA, 19 nt, Homo sapiens
gagaaggacccuacaaauc

SEQ ID NO: 9788 - RNA, 19 nt, Homo sapiens
gcagaucauucaguauuug

SEQ ID NO: 9789 - RNA, 19 nt, Homo sapiens
uggaagacauuucaaccua

SEQ ID NO: 9790 - RNA, 19 nt, Homo sapiens
gguccaggauucuguaaug

SEQ ID NO: 9791 - RNA, 19 nt, Homo sapiens
caaacuuggcucucaauaa

SEQ ID NO: 9792 - RNA, 19 nt, Homo sapiens
guucuucguugcugcauuu

SEQ ID NO: 9793 - RNA, 19 nt, Homo sapiens
gaagaaguccuuaaacacu

SEQ ID NO: 9794 - RNA, 19 nt, Homo sapiens
aagaagaaguccuuaaaca

SEQ ID NO: 9795 - RNA, 19 nt, Homo sapiens
gcccagauauccagucaug

SEQ ID NO: 9796 - RNA, 19 nt, Homo sapiens
cagcagagagauauauuaa

SEQ ID NO: 9797 - RNA, 19 nt, Homo sapiens
gaaauugcaauauggaugu

SEQ ID NO: 9798 - RNA, 19 nt, Homo sapiens
aaaguugccuccuccuaaa

SEQ ID NO: 9799 - RNA, 19 nt, Homo sapiens
gcaagggaaggaauaugua

SEQ ID NO: 9800 - RNA, 19 nt, Homo sapiens
cagacauuaugaaggauua

SEQ ID NO: 9801 - RNA, 19 nt, Homo sapiens
cgagagaguuaucaaaugg

SEQ ID NO: 9802 - RNA, 19 nt, Homo sapiens
caggagaaucuaagaauuu

SEQ ID NO: 9803 - RNA, 19 nt, Homo sapiens
gggaauugcucugaucaug

SEQ ID NO: 9804 - RNA, 19 nt, Homo sapiens
ugagaaauauggcuuagag

SEQ ID NO: 9805 - RNA, 19 nt, Homo sapiens
ucaggaagcucuggaggaa

SEQ ID NO: 9806 - RNA, 19 nt, Homo sapiens
gaaugugauuguggcuaua

SEQ ID NO: 9807 - RNA, 19 nt, Homo sapiens
ccauuucacucugucauuu

SEQ ID NO: 9808 - RNA, 19 nt, Homo sapiens
gauggaagauuugaaggau

SEQ ID NO: 9809 - RNA, 19 nt, Homo sapiens
gaacccaauuuucuuauga

SEQ ID NO: 9810 - RNA, 19 nt, Homo sapiens
cauguaugcuguaugaaga

SEQ ID NO: 9811 - RNA, 19 nt, Homo sapiens
gcauaagaaucaauacaac

SEQ ID NO: 9812 - RNA, 19 nt, Homo sapiens
gugaaacgcauaagaauca

SEQ ID NO: 9813 - RNA, 19 nt, Homo sapiens
agaccgaacucugccauuu

SEQ ID NO: 9814 - RNA, 19 nt, Homo sapiens
guaugggaauccuuuaaau

SEQ ID NO: 9815 - RNA, 19 nt, Homo sapiens
guacccggauccucgaauu

SEQ ID NO: 9816 - RNA, 19 nt, Homo sapiens
acaaguaacaguugaagaa

SEQ ID NO: 9817 - RNA, 19 nt, Homo sapiens
caucugacccuaaaccaaa

SEQ ID NO: 9818 - RNA, 19 nt, Homo sapiens
gggaaacagugcaguccaa

SEQ ID NO: 9819 - RNA, 19 nt, Homo sapiens
ccacagacuucuccggaau

SEQ ID NO: 9820 - RNA, 19 nt, Homo sapiens
caauacaacugcugaugag

SEQ ID NO: 9821 - RNA, 19 nt, Homo sapiens
gacauguauuucuuacgua

SEQ ID NO: 9822 - RNA, 19 nt, Homo sapiens
gcagacauguauuucuuac

SEQ ID NO: 9823 - RNA, 19 nt, Homo sapiens
gcaaacuuggcucucaaua

SEQ ID NO: 9824 - RNA, 19 nt, Homo sapiens
guccagagcucuaugaaaa

SEQ ID NO: 9825 - RNA, 19 nt, Homo sapiens
ccagauauccagucauguu

SEQ ID NO: 9826 - RNA, 19 nt, Homo sapiens
gaaggaggcggaggucuga

SEQ ID NO: 9827 - RNA, 19 nt, Homo sapiens
cagguggaauuacuuaaau

SEQ ID NO: 9828 - RNA, 19 nt, Homo sapiens
gaccagguggaauuacuua

SEQ ID NO: 9829 - RNA, 19 nt, Homo sapiens
aaacuaaacccucacaagu

SEQ ID NO: 9830 - RNA, 19 nt, Homo sapiens
gaauugcucugaucaugcu

SEQ ID NO: 9831 - RNA, 19 nt, Homo sapiens
aaaccaaacuucacagacu

SEQ ID NO: 9832 - RNA, 19 nt, Homo sapiens
caagggaaggaauauguaa

SEQ ID NO: 9833 - RNA, 19 nt, Homo sapiens
acacuggaauuauuacugu

SEQ ID NO: 9834 - RNA, 19 nt, Homo sapiens
gaugacugguguagaggaa

SEQ ID NO: 9835 - RNA, 19 nt, Homo sapiens
guaauaggcauacacaagu

SEQ ID NO: 9836 - RNA, 19 nt, Homo sapiens
agaagaacaugcugcuaau

SEQ ID NO: 9837 - RNA, 19 nt, Homo sapiens
aagaagaacaugcugcuaa

SEQ ID NO: 9838 - RNA, 19 nt, Homo sapiens
aggauuaucuuacaaugug

SEQ ID NO: 9839 - RNA, 19 nt, Homo sapiens
gugcagaucauucaguauu

SEQ ID NO: 9840 - RNA, 19 nt, Homo sapiens
ccgagagaguuaucaaaug

SEQ ID NO: 9841 - RNA, 19 nt, Homo sapiens
gaaaauggcaauuacauca

SEQ ID NO: 9842 - RNA, 19 nt, Homo sapiens
cauguuaaagcgauugaua

SEQ ID NO: 9843 - RNA, 19 nt, Homo sapiens
cagauauccagucauguua

SEQ ID NO: 9844 - RNA, 19 nt, Homo sapiens
ugccauguaugcuguauga

SEQ ID NO: 9845 - RNA, 19 nt, Homo sapiens
gcacaccaggagaaucuaa

SEQ ID NO: 9846 - RNA, 19 nt, Homo sapiens
cuugucagcuuuauauuca

SEQ ID NO: 9847 - RNA, 19 nt, Homo sapiens
ccagcagagagauauauua

SEQ ID NO: 9848 - RNA, 19 nt, Homo sapiens
uggaagauuugaaggauuc

SEQ ID NO: 9849 - RNA, 19 nt, Homo sapiens
uaacagagaauggugguau

SEQ ID NO: 9850 - RNA, 19 nt, Homo sapiens
gguagaacaaggugaagaa

SEQ ID NO: 9851 - RNA, 19 nt, Homo sapiens
ucauguaccucccaaaguc

SEQ ID NO: 9852 - RNA, 19 nt, Homo sapiens
gggaggugcuucgccguuu

SEQ ID NO: 9853 - RNA, 19 nt, Homo sapiens
gcaaagaggugaacauaaa

SEQ ID NO: 9854 - RNA, 19 nt, Homo sapiens
gcagaaaccuaagaaguua

SEQ ID NO: 9855 - RNA, 19 nt, Homo sapiens
ccagaugacuugaauagua

SEQ ID NO: 9856 - RNA, 19 nt, Homo sapiens
ccauagauguugauucuua

SEQ ID NO: 9857 - RNA, 19 nt, Homo sapiens
gagaaaagcuccaaauaaa

SEQ ID NO: 9858 - RNA, 19 nt, Homo sapiens
gaacaaaggaucuuaaagu

SEQ ID NO: 9859 - RNA, 19 nt, Homo sapiens
ucaaaugccucaaauaaca

SEQ ID NO: 9860 - RNA, 19 nt, Homo sapiens
cagcauauaugauuccaaa

SEQ ID NO: 9861 - RNA, 19 nt, Homo sapiens
caucaaaugccucaaauaa

SEQ ID NO: 9862 - RNA, 19 nt, Homo sapiens
ucucaaaucugucacauug

SEQ ID NO: 9863 - RNA, 19 nt, Homo sapiens
gcaagaaaguggcaaagca

SEQ ID NO: 9864 - RNA, 19 nt, Homo sapiens
uaaaugcugugcuaauuga

SEQ ID NO: 9865 - RNA, 19 nt, Homo sapiens
gaagaaucaucccacuauu

SEQ ID NO: 9866 - RNA, 19 nt, Homo sapiens
gaaaccaccuguucauuac

SEQ ID NO: 9867 - RNA, 19 nt, Homo sapiens
ccaugaaccucgauuuaaa

SEQ ID NO: 9868 - RNA, 19 nt, Homo sapiens
gcaagaaaguggccaagca

SEQ ID NO: 9869 - RNA, 19 nt, Homo sapiens
gcgacuaucucuucaaugu

SEQ ID NO: 9870 - RNA, 19 nt, Homo sapiens
gguguaauaucucucauga

SEQ ID NO: 9871 - RNA, 19 nt, Homo sapiens
gcuauuugcugucguguga

SEQ ID NO: 9872 - RNA, 19 nt, Homo sapiens
guagagacauucacaucuu

SEQ ID NO: 9873 - RNA, 19 nt, Homo sapiens
gauuggagccugcagauaa

SEQ ID NO: 9874 - RNA, 19 nt, Homo sapiens
ggacugauaauuucauuug

SEQ ID NO: 9875 - RNA, 19 nt, Homo sapiens
ggacuacgacaucccuuua

SEQ ID NO: 9876 - RNA, 19 nt, Homo sapiens
uagcaagccuguaguauuc

SEQ ID NO: 9877 - RNA, 19 nt, Homo sapiens
ugagauaccugaacaccaa

SEQ ID NO: 9878 - RNA, 19 nt, Homo sapiens
gcgcagaccugaucuuucu

SEQ ID NO: 9879 - RNA, 19 nt, Homo sapiens
ggaugcaaaucaagagaaa

SEQ ID NO: 9880 - RNA, 19 nt, Homo sapiens
gagagaggaugcaaaucaa

SEQ ID NO: 9881 - RNA, 19 nt, Homo sapiens
caagggaaguugacuaagu

SEQ ID NO: 9882 - RNA, 19 nt, Homo sapiens
uaaaggauuuggugaaaca

SEQ ID NO: 9883 - RNA, 19 nt, Homo sapiens
cauaaaggauuuggugaaa

SEQ ID NO: 9884 - RNA, 19 nt, Homo sapiens
gaacacaggcucucacaag

SEQ ID NO: 9885 - RNA, 19 nt, Homo sapiens
gcagauggccgcagaggaa

SEQ ID NO: 9886 - RNA, 19 nt, Homo sapiens
ccacuguuaucuucacuuu

SEQ ID NO: 9887 - RNA, 19 nt, Homo sapiens
gagcuucugcccacuguua

SEQ ID NO: 9888 - RNA, 19 nt, Homo sapiens
gagccugccucucuccuuu

SEQ ID NO: 9889 - RNA, 19 nt, Homo sapiens
gggaagagcccaagcauag

SEQ ID NO: 9890 - RNA, 19 nt, Homo sapiens
gggcaugccuuggaauauu

SEQ ID NO: 9891 - RNA, 19 nt, Homo sapiens
gcacgggcaugccuuggaa

SEQ ID NO: 9892 - RNA, 19 nt, Homo sapiens
gggaaucgcuguguuaaag

SEQ ID NO: 9893 - RNA, 19 nt, Homo sapiens
ccagcugccucuucuuuaa

SEQ ID NO: 9894 - RNA, 19 nt, Homo sapiens
cagagucacuugauaacuu

SEQ ID NO: 9895 - RNA, 19 nt, Homo sapiens
gagaaagaaucagagaaga

SEQ ID NO: 9896 - RNA, 19 nt, Homo sapiens
guauucaguuucuguugua

SEQ ID NO: 9897 - RNA, 19 nt, Homo sapiens
uguaauaucucucaugaca

SEQ ID NO: 9898 - RNA, 19 nt, Homo sapiens
gaacggagaaggcacaauc

SEQ ID NO: 9899 - RNA, 19 nt, Homo sapiens
gaaagaaaucaaucgaguu

SEQ ID NO: 9900 - RNA, 19 nt, Homo sapiens
ggagaggcuucaucagguu

SEQ ID NO: 9901 - RNA, 19 nt, Homo sapiens
cagaugacuugaauaguau

SEQ ID NO: 9902 - RNA, 19 nt, Homo sapiens
cagaguuccucaccuguaa

SEQ ID NO: 9903 - RNA, 19 nt, Homo sapiens
gguauucccucagcggaua

SEQ ID NO: 9904 - RNA, 19 nt, Homo sapiens
gaaccucgauuuaaauucc

SEQ ID NO: 9905 - RNA, 19 nt, Homo sapiens
caggguauguugacuuuga

SEQ ID NO: 9906 - RNA, 19 nt, Homo sapiens
uaauaucucucaugacagu

SEQ ID NO: 9907 - RNA, 19 nt, Homo sapiens
gcaagaggccagaccagaa

SEQ ID NO: 9908 - RNA, 19 nt, Homo sapiens
cagauaaccuguaauugag

SEQ ID NO: 9909 - RNA, 19 nt, Homo sapiens
gggcaaagaggugaacaua

SEQ ID NO: 9910 - RNA, 19 nt, Homo sapiens
guaauauacccacaucaaa

SEQ ID NO: 9911 - RNA, 19 nt, Homo sapiens
cccaguaguuuccugcuua

SEQ ID NO: 9912 - RNA, 19 nt, Homo sapiens
agauauaaaugcugugcua

SEQ ID NO: 9913 - RNA, 19 nt, Homo sapiens
gaagaaagaaaucaaucga

SEQ ID NO: 9914 - RNA, 19 nt, Homo sapiens
aagcauacauagucacuga

SEQ ID NO: 9915 - RNA, 19 nt, Homo sapiens
cgaaggauaguauauuuga

SEQ ID NO: 9916 - RNA, 19 nt, Homo sapiens
gaaucgcuguguuaaagga

SEQ ID NO: 9917 - RNA, 19 nt, Homo sapiens
guuagaauaugcccaguuc

SEQ ID NO: 9918 - RNA, 19 nt, Homo sapiens
gacuaucucuucaaugugu

SEQ ID NO: 9919 - RNA, 19 nt, Homo sapiens
uaaagaaugccauagaugu

SEQ ID NO: 9920 - RNA, 19 nt, Homo sapiens
aaucaugacuuagcaagaa

SEQ ID NO: 9921 - RNA, 19 nt, Homo sapiens
ggcagaaaccuaagaaguu

SEQ ID NO: 9922 - RNA, 19 nt, Homo sapiens
cauaauuggugauacugaa

SEQ ID NO: 9923 - RNA, 19 nt, Homo sapiens
agagguaggucguagcauu

SEQ ID NO: 9924 - RNA, 19 nt, Homo sapiens
ggaauccagugacauugug

SEQ ID NO: 9925 - RNA, 19 nt, Homo sapiens
gagaugcccuccuucuaca

SEQ ID NO: 9926 - RNA, 19 nt, Homo sapiens
uaccaaggcccgagauaua

SEQ ID NO: 9927 - RNA, 19 nt, Homo sapiens
gaaacgagccgugucagau

SEQ ID NO: 9928 - RNA, 19 nt, Homo sapiens
caucugacccgugcuauuu

SEQ ID NO: 9929 - RNA, 19 nt, Homo sapiens
caccuuccaugaccagaua

SEQ ID NO: 9930 - RNA, 19 nt, Homo sapiens
uagagacauucacaucuuu

SEQ ID NO: 9931 - RNA, 19 nt, Homo sapiens
gccaagguuuccaguacua

SEQ ID NO: 9932 - RNA, 19 nt, Homo sapiens
gaggugaacauaaaggauu

SEQ ID NO: 9933 - RNA, 19 nt, Homo sapiens
ugaagaggcagaaaccuaa

SEQ ID NO: 9934 - RNA, 19 nt, Homo sapiens
gcagggaucuacugagacu

SEQ ID NO: 9935 - RNA, 19 nt, Homo sapiens
gcagaguuccucaccugua

SEQ ID NO: 9936 - RNA, 19 nt, Homo sapiens
cgagagaggaugcaaauca

SEQ ID NO: 9937 - RNA, 19 nt, Homo sapiens
cagaugauuucccuccaaa

SEQ ID NO: 9938 - RNA, 19 nt, Homo sapiens
gagcugagccugccucucu

SEQ ID NO: 9939 - RNA, 19 nt, Homo sapiens
ucagguuucucuacaguga

SEQ ID NO: 9940 - RNA, 19 nt, Homo sapiens
ccaaagacacucccucuca

SEQ ID NO: 9941 - RNA, 19 nt, Homo sapiens
caaguucguuuaccaagca

SEQ ID NO: 9942 - RNA, 19 nt, Homo sapiens
uaaccagccugaagguaug

SEQ ID NO: 9943 - RNA, 19 nt, Homo sapiens
ccaacuccauggcuucuga

SEQ ID NO: 9944 - RNA, 19 nt, Homo sapiens
gaagggcaagcuacagaaa

SEQ ID NO: 9945 - RNA, 19 nt, Homo sapiens
caaacucugugagguagaa

SEQ ID NO: 9946 - RNA, 19 nt, Homo sapiens
ccgcagggaucuacugaga

SEQ ID NO: 9947 - RNA, 19 nt, Homo sapiens
uuaagaagcucugcuccuu

SEQ ID NO: 9948 - RNA, 19 nt, Homo sapiens
gagaugggagugcauuuga

SEQ ID NO: 9949 - RNA, 19 nt, Homo sapiens
ugaaagccaugacaauucu

SEQ ID NO: 9950 - RNA, 19 nt, Homo sapiens
gcaggaugcagcuaugaaa

SEQ ID NO: 9951 - RNA, 19 nt, Homo sapiens
uauacucccuggcaaagaa

SEQ ID NO: 9952 - RNA, 19 nt, Homo sapiens
gcacaguaaaucagucuug

SEQ ID NO: 9953 - RNA, 19 nt, Homo sapiens
gcaaagaggugaacauaaa

SEQ ID NO: 9954 - RNA, 19 nt, Homo sapiens
gcagaaaccuaagaaguua

SEQ ID NO: 9955 - RNA, 19 nt, Homo sapiens
ccagaugacuugaauagua

SEQ ID NO: 9956 - RNA, 19 nt, Homo sapiens
ccauagauguugauucuua

SEQ ID NO: 9957 - RNA, 19 nt, Homo sapiens
gagaaaagcuccaaauaaa

SEQ ID NO: 9958 - RNA, 19 nt, Homo sapiens
gaacaaaggaucuuaaagu

SEQ ID NO: 9959 - RNA, 19 nt, Homo sapiens
ucaaaugccucaaauaaca

SEQ ID NO: 9960 - RNA, 19 nt, Homo sapiens
cagcauauaugauuccaaa

SEQ ID NO: 9961 - RNA, 19 nt, Homo sapiens
caucaaaugccucaaauaa

SEQ ID NO: 9962 - RNA, 19 nt, Homo sapiens
ucucaaaucugucacauug

SEQ ID NO: 9963 - RNA, 19 nt, Homo sapiens
gcaagaaaguggcaaagca

SEQ ID NO: 9964 - RNA, 19 nt, Homo sapiens
uaaaugcugugcuaauuga

SEQ ID NO: 9965 - RNA, 19 nt, Homo sapiens
gaagaaucaucccacuauu

SEQ ID NO: 9966 - RNA, 19 nt, Homo sapiens
gaaaccaccuguucauuac

SEQ ID NO: 9967 - RNA, 19 nt, Homo sapiens
ccaugaaccucgauuuaaa

SEQ ID NO: 9968 - RNA, 19 nt, Homo sapiens
gcaagaaaguggccaagca

SEQ ID NO: 9969 - RNA, 19 nt, Homo sapiens
gcgacuaucucuucaaugu

SEQ ID NO: 9970 - RNA, 19 nt, Homo sapiens
gguguaauaucucucauga

SEQ ID NO: 9971 - RNA, 19 nt, Homo sapiens
gcuauuugcugucguguga

SEQ ID NO: 9972 - RNA, 19 nt, Homo sapiens
guagagacauucacaucuu

SEQ ID NO: 9973 - RNA, 19 nt, Homo sapiens
gauuggagccugcagauaa

SEQ ID NO: 9974 - RNA, 19 nt, Homo sapiens
ggacugauaauuucauuug

SEQ ID NO: 9975 - RNA, 19 nt, Homo sapiens
ggacuacgacaucccuuua

SEQ ID NO: 9976 - RNA, 19 nt, Homo sapiens
uagcaagccuguaguauuc

SEQ ID NO: 9977 - RNA, 19 nt, Homo sapiens
ugagauaccugaacaccaa

SEQ ID NO: 9978 - RNA, 19 nt, Homo sapiens
gcgcagaccugaucuuucu

SEQ ID NO: 9979 - RNA, 19 nt, Homo sapiens
ggaugcaaaucaagagaaa

SEQ ID NO: 9980 - RNA, 19 nt, Homo sapiens
gagagaggaugcaaaucaa

SEQ ID NO: 9981 - RNA, 19 nt, Homo sapiens
caagggaaguugacuaagu

SEQ ID NO: 9982 - RNA, 19 nt, Homo sapiens
uaaaggauuuggugaaaca

SEQ ID NO: 9983 - RNA, 19 nt, Homo sapiens
cauaaaggauuuggugaaa

SEQ ID NO: 9984 - RNA, 19 nt, Homo sapiens
gaacacaggcucucacaag

SEQ ID NO: 9985 - RNA, 19 nt, Homo sapiens
gcagauggccgcagaggaa

SEQ ID NO: 9986 - RNA, 19 nt, Homo sapiens
ccacuguuaucuucacuuu

SEQ ID NO: 9987 - RNA, 19 nt, Homo sapiens
gagcuucugcccacuguua

SEQ ID NO: 9988 - RNA, 19 nt, Homo sapiens
gagccugccucucuccuuu

SEQ ID NO: 9989 - RNA, 19 nt, Homo sapiens
gggaagagcccaagcauag

SEQ ID NO: 9990 - RNA, 19 nt, Homo sapiens
gggcaugccuuggaauauu

SEQ ID NO: 9991 - RNA, 19 nt, Homo sapiens
gcacgggcaugccuuggaa

SEQ ID NO: 9992 - RNA, 19 nt, Homo sapiens
gggaaucgcuguguuaaag

SEQ ID NO: 9993 - RNA, 19 nt, Homo sapiens
ccagcugccucuucuuuaa

SEQ ID NO: 9994 - RNA, 19 nt, Homo sapiens
cagagucacuugauaacuu

SEQ ID NO: 9995 - RNA, 19 nt, Homo sapiens
gagaaagaaucagagaaga

SEQ ID NO: 9996 - RNA, 19 nt, Homo sapiens
guauucaguuucuguugua

SEQ ID NO: 9997 - RNA, 19 nt, Homo sapiens
uguaauaucucucaugaca

SEQ ID NO: 9998 - RNA, 19 nt, Homo sapiens
gaacggagaaggcacaauc

SEQ ID NO: 9999 - RNA, 19 nt, Homo sapiens
gaaagaaaucaaucgaguu

SEQ ID NO: 10000 - RNA, 19 nt, Homo sapiens
ggagaggcuucaucagguu

SEQ ID NO: 10001 - RNA, 19 nt, Homo sapiens
cagaugacuugaauaguau

SEQ ID NO: 10002 - RNA, 19 nt, Homo sapiens
cagaguuccucaccuguaa

SEQ ID NO: 10003 - RNA, 19 nt, Homo sapiens
gguauucccucagcggaua

SEQ ID NO: 10004 - RNA, 19 nt, Homo sapiens
gaaccucgauuuaaauucc

SEQ ID NO: 10005 - RNA, 19 nt, Homo sapiens
caggguauguugacuuuga

SEQ ID NO: 10006 - RNA, 19 nt, Homo sapiens
uaauaucucucaugacagu

SEQ ID NO: 10007 - RNA, 19 nt, Homo sapiens
gcaagaggccagaccagaa

SEQ ID NO: 10008 - RNA, 19 nt, Homo sapiens
cagauaaccuguaauugag

SEQ ID NO: 10009 - RNA, 19 nt, Homo sapiens
gggcaaagaggugaacaua

SEQ ID NO: 10010 - RNA, 19 nt, Homo sapiens
guaauauacccacaucaaa

SEQ ID NO: 10011 - RNA, 19 nt, Homo sapiens
cccaguaguuuccugcuua

SEQ ID NO: 10012 - RNA, 19 nt, Homo sapiens
agauauaaaugcugugcua

SEQ ID NO: 10013 - RNA, 19 nt, Homo sapiens
gaagaaagaaaucaaucga

SEQ ID NO: 10014 - RNA, 19 nt, Homo sapiens
aagcauacauagucacuga

SEQ ID NO: 10015 - RNA, 19 nt, Homo sapiens
cgaaggauaguauauuuga

SEQ ID NO: 10016 - RNA, 19 nt, Homo sapiens
gaaucgcuguguuaaagga

SEQ ID NO: 10017 - RNA, 19 nt, Homo sapiens
guuagaauaugcccaguuc

SEQ ID NO: 10018 - RNA, 19 nt, Homo sapiens
gacuaucucuucaaugugu

SEQ ID NO: 10019 - RNA, 19 nt, Homo sapiens
uaaagaaugccauagaugu

SEQ ID NO: 10020 - RNA, 19 nt, Homo sapiens
aaucaugacuuagcaagaa

SEQ ID NO: 10021 - RNA, 19 nt, Homo sapiens
ggcagaaaccuaagaaguu

SEQ ID NO: 10022 - RNA, 19 nt, Homo sapiens
cauaauuggugauacugaa

SEQ ID NO: 10023 - RNA, 19 nt, Homo sapiens
agagguaggucguagcauu

SEQ ID NO: 10024 - RNA, 19 nt, Homo sapiens
ggaauccagugacauugug

SEQ ID NO: 10025 - RNA, 19 nt, Homo sapiens
gagaugcccuccuucuaca

SEQ ID NO: 10026 - RNA, 19 nt, Homo sapiens
uaccaaggcccgagauaua

SEQ ID NO: 10027 - RNA, 19 nt, Homo sapiens
gaaacgagccgugucagau

SEQ ID NO: 10028 - RNA, 19 nt, Homo sapiens
caucugacccgugcuauuu

SEQ ID NO: 10029 - RNA, 19 nt, Homo sapiens
caccuuccaugaccagaua

SEQ ID NO: 10030 - RNA, 19 nt, Homo sapiens
uagagacauucacaucuuu

SEQ ID NO: 10031 - RNA, 19 nt, Homo sapiens
gccaagguuuccaguacua

SEQ ID NO: 10032 - RNA, 19 nt, Homo sapiens
gaggugaacauaaaggauu

SEQ ID NO: 10033 - RNA, 19 nt, Homo sapiens
ugaagaggcagaaaccuaa

SEQ ID NO: 10034 - RNA, 19 nt, Homo sapiens
gcagggaucuacugagacu

SEQ ID NO: 10035 - RNA, 19 nt, Homo sapiens
gcagaguuccucaccugua

SEQ ID NO: 10036 - RNA, 19 nt, Homo sapiens
cgagagaggaugcaaauca

SEQ ID NO: 10037 - RNA, 19 nt, Homo sapiens
cagaugauuucccuccaaa

SEQ ID NO: 10038 - RNA, 19 nt, Homo sapiens
gagcugagccugccucucu

SEQ ID NO: 10039 - RNA, 19 nt, Homo sapiens
ucagguuucucuacaguga

SEQ ID NO: 10040 - RNA, 19 nt, Homo sapiens
caaguucguuuaccaagca

SEQ ID NO: 10041 - RNA, 19 nt, Homo sapiens
uaaccagccugaagguaug

SEQ ID NO: 10042 - RNA, 19 nt, Homo sapiens
ccaacuccauggcuucuga

SEQ ID NO: 10043 - RNA, 19 nt, Homo sapiens
gaagggcaagcuacagaaa

SEQ ID NO: 10044 - RNA, 19 nt, Homo sapiens
caaacucugugagguagaa

SEQ ID NO: 10045 - RNA, 19 nt, Homo sapiens
ccgcagggaucuacugaga

SEQ ID NO: 10046 - RNA, 19 nt, Homo sapiens
uuaagaagcucugcuccuu

SEQ ID NO: 10047 - RNA, 19 nt, Homo sapiens
gagaugggagugcauuuga

SEQ ID NO: 10048 - RNA, 19 nt, Homo sapiens
ugaaagccaugacaauucu

SEQ ID NO: 10049 - RNA, 19 nt, Homo sapiens
gcaggaugcagcuaugaaa

SEQ ID NO: 10050 - RNA, 19 nt, Homo sapiens
uauacucccuggcaaagaa

SEQ ID NO: 10051 - RNA, 19 nt, Homo sapiens
gcacaguaaaucagucuug

SEQ ID NO: 10052 - RNA, 19 nt, Homo sapiens
gaaagggcagguugucuuc

SEQ ID NO: 10053 - RNA, 19 nt, Homo sapiens
gcaaagaggugaacauaaa

SEQ ID NO: 10054 - RNA, 19 nt, Homo sapiens
gcagaaaccuaagaaguua

SEQ ID NO: 10055 - RNA, 19 nt, Homo sapiens
ccagaugacuugaauagua

SEQ ID NO: 10056 - RNA, 19 nt, Homo sapiens
ccauagauguugauucuua

SEQ ID NO: 10057 - RNA, 19 nt, Homo sapiens
gagaaaagcuccaaauaaa

SEQ ID NO: 10058 - RNA, 19 nt, Homo sapiens
gaacaaaggaucuuaaagu

SEQ ID NO: 10059 - RNA, 19 nt, Homo sapiens
ucaaaugccucaaauaaca

SEQ ID NO: 10060 - RNA, 19 nt, Homo sapiens
cagcauauaugauuccaaa

SEQ ID NO: 10061 - RNA, 19 nt, Homo sapiens
caucaaaugccucaaauaa

SEQ ID NO: 10062 - RNA, 19 nt, Homo sapiens
ucucaaaucugucacauug

SEQ ID NO: 10063 - RNA, 19 nt, Homo sapiens
gcaagaaaguggcaaagca

SEQ ID NO: 10064 - RNA, 19 nt, Homo sapiens
uaaaugcugugcuaauuga

SEQ ID NO: 10065 - RNA, 19 nt, Homo sapiens
gaagaaucaucccacuauu

SEQ ID NO: 10066 - RNA, 19 nt, Homo sapiens
gaaaccaccuguucauuac

SEQ ID NO: 10067 - RNA, 19 nt, Homo sapiens
ccaugaaccucgauuuaaa

SEQ ID NO: 10068 - RNA, 19 nt, Homo sapiens
gcaagaaaguggccaagca

SEQ ID NO: 10069 - RNA, 19 nt, Homo sapiens
gcgacuaucucuucaaugu

SEQ ID NO: 10070 - RNA, 19 nt, Homo sapiens
gguguaauaucucucauga

SEQ ID NO: 10071 - RNA, 19 nt, Homo sapiens
gcuauuugcugucguguga

SEQ ID NO: 10072 - RNA, 19 nt, Homo sapiens
guagagacauucacaucuu

SEQ ID NO: 10073 - RNA, 19 nt, Homo sapiens
gauuggagccugcagauaa

SEQ ID NO: 10074 - RNA, 19 nt, Homo sapiens
ggacugauaauuucauuug

SEQ ID NO: 10075 - RNA, 19 nt, Homo sapiens
ggacuacgacaucccuuua

SEQ ID NO: 10076 - RNA, 19 nt, Homo sapiens
uagcaagccuguaguauuc

SEQ ID NO: 10077 - RNA, 19 nt, Homo sapiens
ugagauaccugaacaccaa

SEQ ID NO: 10078 - RNA, 19 nt, Homo sapiens
gcgcagaccugaucuuucu

SEQ ID NO: 10079 - RNA, 19 nt, Homo sapiens
ggaugcaaaucaagagaaa

SEQ ID NO: 10080 - RNA, 19 nt, Homo sapiens
gagagaggaugcaaaucaa

SEQ ID NO: 10081 - RNA, 19 nt, Homo sapiens
caagggaaguugacuaagu

SEQ ID NO: 10082 - RNA, 19 nt, Homo sapiens
uaaaggauuuggugaaaca

SEQ ID NO: 10083 - RNA, 19 nt, Homo sapiens
cauaaaggauuuggugaaa

SEQ ID NO: 10084 - RNA, 19 nt, Homo sapiens
gaacacaggcucucacaag

SEQ ID NO: 10085 - RNA, 19 nt, Homo sapiens
gcagauggccgcagaggaa

SEQ ID NO: 10086 - RNA, 19 nt, Homo sapiens
ccacuguuaucuucacuuu

SEQ ID NO: 10087 - RNA, 19 nt, Homo sapiens
gagcuucugcccacuguua

SEQ ID NO: 10088 - RNA, 19 nt, Homo sapiens
gagccugccucucuccuuu

SEQ ID NO: 10089 - RNA, 19 nt, Homo sapiens
gggaagagcccaagcauag

SEQ ID NO: 10090 - RNA, 19 nt, Homo sapiens
gggcaugccuuggaauauu

SEQ ID NO: 10091 - RNA, 19 nt, Homo sapiens
gcacgggcaugccuuggaa

SEQ ID NO: 10092 - RNA, 19 nt, Homo sapiens
gggaaucgcuguguuaaag

SEQ ID NO: 10093 - RNA, 19 nt, Homo sapiens
ccagcugccucuucuuuaa

SEQ ID NO: 10094 - RNA, 19 nt, Homo sapiens
gagaaagaaucagagaaga

SEQ ID NO: 10095 - RNA, 19 nt, Homo sapiens
guauucaguuucuguugua

SEQ ID NO: 10096 - RNA, 19 nt, Homo sapiens
uguaauaucucucaugaca

SEQ ID NO: 10097 - RNA, 19 nt, Homo sapiens
gaacggagaaggcacaauc

SEQ ID NO: 10098 - RNA, 19 nt, Homo sapiens
gaaagaaaucaaucgaguu

SEQ ID NO: 10099 - RNA, 19 nt, Homo sapiens
ggagaggcuucaucagguu

SEQ ID NO: 10100 - RNA, 19 nt, Homo sapiens
cagaugacuugaauaguau

SEQ ID NO: 10101 - RNA, 19 nt, Homo sapiens
cagaguuccucaccuguaa

SEQ ID NO: 10102 - RNA, 19 nt, Homo sapiens
gguauucccucagcggaua

SEQ ID NO: 10103 - RNA, 19 nt, Homo sapiens
gaaccucgauuuaaauucc

SEQ ID NO: 10104 - RNA, 19 nt, Homo sapiens
caggguauguugacuuuga

SEQ ID NO: 10105 - RNA, 19 nt, Homo sapiens
uaauaucucucaugacagu

SEQ ID NO: 10106 - RNA, 19 nt, Homo sapiens
gcaagaggccagaccagaa

SEQ ID NO: 10107 - RNA, 19 nt, Homo sapiens
cagauaaccuguaauugag

SEQ ID NO: 10108 - RNA, 19 nt, Homo sapiens
gggcaaagaggugaacaua

SEQ ID NO: 10109 - RNA, 19 nt, Homo sapiens
guaauauacccacaucaaa

SEQ ID NO: 10110 - RNA, 19 nt, Homo sapiens
cccaguaguuuccugcuua

SEQ ID NO: 10111 - RNA, 19 nt, Homo sapiens
agauauaaaugcugugcua

SEQ ID NO: 10112 - RNA, 19 nt, Homo sapiens
gaagaaagaaaucaaucga

SEQ ID NO: 10113 - RNA, 19 nt, Homo sapiens
aagcauacauagucacuga

SEQ ID NO: 10114 - RNA, 19 nt, Homo sapiens
cgaaggauaguauauuuga

SEQ ID NO: 10115 - RNA, 19 nt, Homo sapiens
gaaucgcuguguuaaagga

SEQ ID NO: 10116 - RNA, 19 nt, Homo sapiens
guuagaauaugcccaguuc

SEQ ID NO: 10117 - RNA, 19 nt, Homo sapiens
gacuaucucuucaaugugu

SEQ ID NO: 10118 - RNA, 19 nt, Homo sapiens
uaaagaaugccauagaugu

SEQ ID NO: 10119 - RNA, 19 nt, Homo sapiens
aaucaugacuuagcaagaa

SEQ ID NO: 10120 - RNA, 19 nt, Homo sapiens
ggcagaaaccuaagaaguu

SEQ ID NO: 10121 - RNA, 19 nt, Homo sapiens
cauaauuggugauacugaa

SEQ ID NO: 10122 - RNA, 19 nt, Homo sapiens
agagguaggucguagcauu

SEQ ID NO: 10123 - RNA, 19 nt, Homo sapiens
ggaauccagugacauugug

SEQ ID NO: 10124 - RNA, 19 nt, Homo sapiens
gagaugcccuccuucuaca

SEQ ID NO: 10125 - RNA, 19 nt, Homo sapiens
uaccaaggcccgagauaua

SEQ ID NO: 10126 - RNA, 19 nt, Homo sapiens
gaaacgagccgugucagau

SEQ ID NO: 10127 - RNA, 19 nt, Homo sapiens
caucugacccgugcuauuu

SEQ ID NO: 10128 - RNA, 19 nt, Homo sapiens
caccuuccaugaccagaua

SEQ ID NO: 10129 - RNA, 19 nt, Homo sapiens
uagagacauucacaucuuu

SEQ ID NO: 10130 - RNA, 19 nt, Homo sapiens
gaggugaacauaaaggauu

SEQ ID NO: 10131 - RNA, 19 nt, Homo sapiens
ugaagaggcagaaaccuaa

SEQ ID NO: 10132 - RNA, 19 nt, Homo sapiens
gcagggaucuacugagacu

SEQ ID NO: 10133 - RNA, 19 nt, Homo sapiens
gccaagguuuccaguacua

SEQ ID NO: 10134 - RNA, 19 nt, Homo sapiens
gcagaguuccucaccugua

SEQ ID NO: 10135 - RNA, 19 nt, Homo sapiens
cgagagaggaugcaaauca

SEQ ID NO: 10136 - RNA, 19 nt, Homo sapiens
cagaugauuucccuccaaa

SEQ ID NO: 10137 - RNA, 19 nt, Homo sapiens
gagcugagccugccucucu

SEQ ID NO: 10138 - RNA, 19 nt, Homo sapiens
ucagguuucucuacaguga

SEQ ID NO: 10139 - RNA, 19 nt, Homo sapiens
caaguucguuuaccaagca

SEQ ID NO: 10140 - RNA, 19 nt, Homo sapiens
ccaacuccauggcuucuga

SEQ ID NO: 10141 - RNA, 19 nt, Homo sapiens
gaagggcaagcuacagaaa

SEQ ID NO: 10142 - RNA, 19 nt, Homo sapiens
caaacucugugagguagaa

SEQ ID NO: 10143 - RNA, 19 nt, Homo sapiens
ccgcagggaucuacugaga

SEQ ID NO: 10144 - RNA, 19 nt, Homo sapiens
uuaagaagcucugcuccuu

SEQ ID NO: 10145 - RNA, 19 nt, Homo sapiens
gagaugggagugcauuuga

SEQ ID NO: 10146 - RNA, 19 nt, Homo sapiens
ugaaagccaugacaauucu

SEQ ID NO: 10147 - RNA, 19 nt, Homo sapiens
gcaggaugcagcuaugaaa

SEQ ID NO: 10148 - RNA, 19 nt, Homo sapiens
uauacucccuggcaaagaa

SEQ ID NO: 10149 - RNA, 19 nt, Homo sapiens
gcacaguaaaucagucuug

SEQ ID NO: 10150 - RNA, 19 nt, Homo sapiens
gaaagggcagguugucuuc

SEQ ID NO: 10151 - RNA, 19 nt, Homo sapiens
cauuuauccugcuuucuuu

SEQ ID NO: 10152 - RNA, 19 nt, Homo sapiens
uagcauuccucaucacaug

SEQ ID NO: 10153 - RNA, 19 nt, Homo sapiens
gauaauacauggccaguaa

SEQ ID NO: 10154 - RNA, 19 nt, Homo sapiens
uuacuacgcuccaagauua

SEQ ID NO: 10155 - RNA, 19 nt, Homo sapiens
gaaggagaauguccaguuu

SEQ ID NO: 10156 - RNA, 19 nt, Homo sapiens
auacacaacuugagcuuua

SEQ ID NO: 10157 - RNA, 19 nt, Homo sapiens
cuaggaaugugguuuauaa

SEQ ID NO: 10158 - RNA, 19 nt, Homo sapiens
acacgucugucuaaacuua

SEQ ID NO: 10159 - RNA, 19 nt, Homo sapiens
gcccaggacucaaguauga

SEQ ID NO: 10160 - RNA, 19 nt, Homo sapiens
gaaguagaaugauuucagu

SEQ ID NO: 10161 - RNA, 19 nt, Homo sapiens
gaucagagcagacauaaag

SEQ ID NO: 10162 - RNA, 19 nt, Homo sapiens
caaucucgguuuacguuua

SEQ ID NO: 10163 - RNA, 19 nt, Homo sapiens
ggagauccuugcucagauu

SEQ ID NO: 10164 - RNA, 19 nt, Homo sapiens
gcaauggccacuccaagua

SEQ ID NO: 10165 - RNA, 19 nt, Homo sapiens
ggauauagaagaugaagaa

SEQ ID NO: 10166 - RNA, 19 nt, Homo sapiens
gaguagggcuuccuuaagu

SEQ ID NO: 10167 - RNA, 19 nt, Homo sapiens
gauagacacccaaaucgua

SEQ ID NO: 10168 - RNA, 19 nt, Homo sapiens
gagcagacauaaagcuaga

SEQ ID NO: 10169 - RNA, 19 nt, Homo sapiens
ggauggaaguagaaugauu

SEQ ID NO: 10170 - RNA, 19 nt, Homo sapiens
ggaagaaccagcagauaga

SEQ ID NO: 10171 - RNA, 19 nt, Homo sapiens
gcucucagcucuccaaugg

SEQ ID NO: 10172 - RNA, 19 nt, Homo sapiens
gagaaggccuugaggucuu

SEQ ID NO: 10173 - RNA, 19 nt, Homo sapiens
gagcuaggaaugugguuua

SEQ ID NO: 10174 - RNA, 19 nt, Homo sapiens
gcucagauuucuuuauaca

SEQ ID NO: 10175 - RNA, 19 nt, Homo sapiens
ggaagaaucccgugaugau

SEQ ID NO: 10176 - RNA, 19 nt, Homo sapiens
cagcggaucuccaacauag

SEQ ID NO: 10177 - RNA, 19 nt, Homo sapiens
caacuugagcuuuacuuaa

SEQ ID NO: 10178 - RNA, 19 nt, Homo sapiens
gaucguggccuugcauuaa

SEQ ID NO: 10179 - RNA, 19 nt, Homo sapiens
gccaagagcuucgucaugu

SEQ ID NO: 10180 - RNA, 19 nt, Homo sapiens
gaccucagcuugucugcuu

SEQ ID NO: 10181 - RNA, 19 nt, Homo sapiens
gcacugaugugaaggaaaa

SEQ ID NO: 10182 - RNA, 19 nt, Homo sapiens
guagaaugauuucaguaga

SEQ ID NO: 10183 - RNA, 19 nt, Homo sapiens
gcagauagacacccaaauc

SEQ ID NO: 10184 - RNA, 19 nt, Homo sapiens
gaaauaguagccuaaagga

SEQ ID NO: 10185 - RNA, 19 nt, Homo sapiens
caacaagccuuugcucagu

SEQ ID NO: 10186 - RNA, 19 nt, Homo sapiens
caagaaacccucaaaagua

SEQ ID NO: 10187 - RNA, 19 nt, Homo sapiens
gauggaaguagaaugauuu

SEQ ID NO: 10188 - RNA, 19 nt, Homo sapiens
caagguucccucccacuua

SEQ ID NO: 10189 - RNA, 19 nt, Homo sapiens
ggaggugaauggccagguu

SEQ ID NO: 10190 - RNA, 19 nt, Homo sapiens
gguuuaggcugaaggagaa

SEQ ID NO: 10191 - RNA, 19 nt, Homo sapiens
ggucguggauggucaguuc

SEQ ID NO: 10192 - RNA, 19 nt, Homo sapiens
gaacugcgcccaggacuca

SEQ ID NO: 10193 - RNA, 19 nt, Homo sapiens
ggaggacccugucugucaa

SEQ ID NO: 10194 - RNA, 19 nt, Homo sapiens
aauaguagccuaaaggaaa

SEQ ID NO: 10195 - RNA, 19 nt, Homo sapiens
ggaaauaguagccuaaagg

SEQ ID NO: 10196 - RNA, 19 nt, Homo sapiens
gaaaauagagguaggaaau

SEQ ID NO: 10197 - RNA, 19 nt, Homo sapiens
ggugauaaguguuucuaca

SEQ ID NO: 10198 - RNA, 19 nt, Homo sapiens
ccaaguaccgccugaagaa

SEQ ID NO: 10199 - RNA, 19 nt, Homo sapiens
cacaauacauggccuaagu

SEQ ID NO: 10200 - RNA, 19 nt, Homo sapiens
ccacacgucugucuaaacu

SEQ ID NO: 10201 - RNA, 19 nt, Homo sapiens
gacacgcucuucaaugguu

SEQ ID NO: 10202 - RNA, 19 nt, Homo sapiens
acacggacuucacaucuga

SEQ ID NO: 10203 - RNA, 19 nt, Homo sapiens
cagcagcacugaugugaag

SEQ ID NO: 10204 - RNA, 19 nt, Homo sapiens
ccauggauauagaagauga

SEQ ID NO: 10205 - RNA, 19 nt, Homo sapiens
cgguuuacguuuagaaauu

SEQ ID NO: 10206 - RNA, 19 nt, Homo sapiens
gcggaguucugcuuacuuc

SEQ ID NO: 10207 - RNA, 19 nt, Homo sapiens
gcucuggucccacaaagaa

SEQ ID NO: 10208 - RNA, 19 nt, Homo sapiens
aaauagagguaggaaauag

SEQ ID NO: 10209 - RNA, 19 nt, Homo sapiens
ggaggagggugggaaaaua

SEQ ID NO: 10210 - RNA, 19 nt, Homo sapiens
gagaauguccaguuucauc

SEQ ID NO: 10211 - RNA, 19 nt, Homo sapiens
gcagacauaaagcuagaaa

SEQ ID NO: 10212 - RNA, 19 nt, Homo sapiens
gaaaucgccacacgucugu

SEQ ID NO: 10213 - RNA, 19 nt, Homo sapiens
guaggcgacuccgcuauug

SEQ ID NO: 10214 - RNA, 19 nt, Homo sapiens
caucagcaaugcagaagca

SEQ ID NO: 10215 - RNA, 19 nt, Homo sapiens
gauggucaguucuuugaag

SEQ ID NO: 10216 - RNA, 19 nt, Homo sapiens
gaaccucacaucugaacug

SEQ ID NO: 10217 - RNA, 19 nt, Homo sapiens
gaggacagcuacggaccaa

SEQ ID NO: 10218 - RNA, 19 nt, Homo sapiens
uaaagaugccaaggugaua

SEQ ID NO: 10219 - RNA, 19 nt, Homo sapiens
gggaggacccugucuguca

SEQ ID NO: 10220 - RNA, 19 nt, Homo sapiens
ggaaguagaaugauuucag

SEQ ID NO: 10221 - RNA, 19 nt, Homo sapiens
caggauggaaguagaauga

SEQ ID NO: 10222 - RNA, 19 nt, Homo sapiens
aggcacagauguuaaagau

SEQ ID NO: 10223 - RNA, 19 nt, Homo sapiens
ugaugcagcugaaugagau

SEQ ID NO: 10224 - RNA, 19 nt, Homo sapiens
ggccuaaguucccucuguu

SEQ ID NO: 10225 - RNA, 19 nt, Homo sapiens
cgagggcuacugcacaaua

SEQ ID NO: 10226 - RNA, 19 nt, Homo sapiens
gguuuacguuuagaaauug

SEQ ID NO: 10227 - RNA, 19 nt, Homo sapiens
uuaccaagcccaacgugua

SEQ ID NO: 10228 - RNA, 19 nt, Homo sapiens
ugaaggagaauguccaguu

SEQ ID NO: 10229 - RNA, 19 nt, Homo sapiens
uaaguucccucuguuccuu

SEQ ID NO: 10230 - RNA, 19 nt, Homo sapiens
aaauugaguucuacugagu

SEQ ID NO: 10231 - RNA, 19 nt, Homo sapiens
guucacagccuucaucaag

SEQ ID NO: 10232 - RNA, 19 nt, Homo sapiens
ucacuuuuaugccacauua

SEQ ID NO: 10233 - RNA, 19 nt, Homo sapiens
guagggcuuccuuaaguuu

SEQ ID NO: 10234 - RNA, 19 nt, Homo sapiens
aguccaagcuggcggcaaa

SEQ ID NO: 10235 - RNA, 19 nt, Homo sapiens
caacacggacuucacaucu

SEQ ID NO: 10236 - RNA, 19 nt, Homo sapiens
ccaccgagcaggaccaguu

SEQ ID NO: 10237 - RNA, 19 nt, Homo sapiens
gccaaggugauaaguguuu

SEQ ID NO: 10238 - RNA, 19 nt, Homo sapiens
cacacuagguuguaacagu

SEQ ID NO: 10239 - RNA, 19 nt, Homo sapiens
gcaagguucccucccacuu

SEQ ID NO: 10240 - RNA, 19 nt, Homo sapiens
guccugcagugacaagauu

SEQ ID NO: 10241 - RNA, 19 nt, Homo sapiens
gaagaaucccgugaugauc

SEQ ID NO: 10242 - RNA, 19 nt, Homo sapiens
gcacgcgccuuuguuuguc

SEQ ID NO: 10243 - RNA, 19 nt, Homo sapiens
cccagcaucucacaucaga

SEQ ID NO: 10244 - RNA, 19 nt, Homo sapiens
aaacuuaggucucuuuucu

SEQ ID NO: 10245 - RNA, 19 nt, Homo sapiens
gguaggcgacuccgcuauu

SEQ ID NO: 10246 - RNA, 19 nt, Homo sapiens
uaaagcaagaggacagcua

SEQ ID NO: 10247 - RNA, 19 nt, Homo sapiens
aggagaauguccaguuuca

SEQ ID NO: 10248 - RNA, 19 nt, Homo sapiens
acaacuugagcuuuacuua

SEQ ID NO: 10249 - RNA, 19 nt, Homo sapiens
gagggcuacugcacaauac

SEQ ID NO: 10250 - RNA, 19 nt, Homo sapiens
gcuaggaaugugguuuaua

SEQ ID NO: 10251 - RNA, 19 nt, Homo sapiens
uguguaagcacgcguugua

SEQ ID NO: 10252 - RNA, 19 nt, Homo sapiens
gauccuugcucagauuucu

SEQ ID NO: 10253 - RNA, 19 nt, Homo sapiens
gauaauacauggccaguaa

SEQ ID NO: 10254 - RNA, 19 nt, Homo sapiens
uuacuacgcuccaagauua

SEQ ID NO: 10255 - RNA, 19 nt, Homo sapiens
gaaggagaauguccaguuu

SEQ ID NO: 10256 - RNA, 19 nt, Homo sapiens
auacacaacuugagcuuua

SEQ ID NO: 10257 - RNA, 19 nt, Homo sapiens
gaccaugacuuaguuguaa

SEQ ID NO: 10258 - RNA, 19 nt, Homo sapiens
cuaggaaugugguuuauaa

SEQ ID NO: 10259 - RNA, 19 nt, Homo sapiens
ccaccaagcucagagauuu

SEQ ID NO: 10260 - RNA, 19 nt, Homo sapiens
acacgucugucuaaacuua

SEQ ID NO: 10261 - RNA, 19 nt, Homo sapiens
gcccaggacucaaguauga

SEQ ID NO: 10262 - RNA, 19 nt, Homo sapiens
gaaguagaaugauuucagu

SEQ ID NO: 10263 - RNA, 19 nt, Homo sapiens
gaucagagcagacauaaag

SEQ ID NO: 10264 - RNA, 19 nt, Homo sapiens
aacaugaacugaacgguua

SEQ ID NO: 10265 - RNA, 19 nt, Homo sapiens
gggaauagaauuagagaaa

SEQ ID NO: 10266 - RNA, 19 nt, Homo sapiens
caaucucgguuuacguuua

SEQ ID NO: 10267 - RNA, 19 nt, Homo sapiens
ggagauccuugcucagauu

SEQ ID NO: 10268 - RNA, 19 nt, Homo sapiens
gcaauggccacuccaagua

SEQ ID NO: 10269 - RNA, 19 nt, Homo sapiens
ggauauagaagaugaagaa

SEQ ID NO: 10270 - RNA, 19 nt, Homo sapiens
gaguagggcuuccuuaagu

SEQ ID NO: 10271 - RNA, 19 nt, Homo sapiens
gauagacacccaaaucgua

SEQ ID NO: 10272 - RNA, 19 nt, Homo sapiens
gagcagacauaaagcuaga

SEQ ID NO: 10273 - RNA, 19 nt, Homo sapiens
ggauggaaguagaaugauu

SEQ ID NO: 10274 - RNA, 19 nt, Homo sapiens
guaagggugugucggcuuu

SEQ ID NO: 10275 - RNA, 19 nt, Homo sapiens
gcucucagcucuccaaugg

SEQ ID NO: 10276 - RNA, 19 nt, Homo sapiens
caugagacgcugucaaaua

SEQ ID NO: 10277 - RNA, 19 nt, Homo sapiens
uuuagaaucuggacacuuu

SEQ ID NO: 10278 - RNA, 19 nt, Homo sapiens
gagaaggccuugaggucuu

SEQ ID NO: 10279 - RNA, 19 nt, Homo sapiens
gagcuaggaaugugguuua

SEQ ID NO: 10280 - RNA, 19 nt, Homo sapiens
gcucagauuucuuuauaca

SEQ ID NO: 10281 - RNA, 19 nt, Homo sapiens
ggaagaaucccgugaugau

SEQ ID NO: 10282 - RNA, 19 nt, Homo sapiens
ccacaaggaacacuucuuu

SEQ ID NO: 10283 - RNA, 19 nt, Homo sapiens
ugucugcacuuucuuguuu

SEQ ID NO: 10284 - RNA, 19 nt, Homo sapiens
cagcggaucuccaacauag

SEQ ID NO: 10285 - RNA, 19 nt, Homo sapiens
caacuugagcuuuacuuaa

SEQ ID NO: 10286 - RNA, 19 nt, Homo sapiens
gaucguggccuugcauuaa

SEQ ID NO: 10287 - RNA, 19 nt, Homo sapiens
gccaagagcuucgucaugu

SEQ ID NO: 10288 - RNA, 19 nt, Homo sapiens
gaccucagcuugucugcuu

SEQ ID NO: 10289 - RNA, 19 nt, Homo sapiens
gcacugaugugaaggaaaa

SEQ ID NO: 10290 - RNA, 19 nt, Homo sapiens
gaaacauguugcugagaug

SEQ ID NO: 10291 - RNA, 19 nt, Homo sapiens
guagaaugauuucaguaga

SEQ ID NO: 10292 - RNA, 19 nt, Homo sapiens
gcagauagacacccaaauc

SEQ ID NO: 10293 - RNA, 19 nt, Homo sapiens
gaaauaguagccuaaagga

SEQ ID NO: 10294 - RNA, 19 nt, Homo sapiens
caacaagccuuugcucagu

SEQ ID NO: 10295 - RNA, 19 nt, Homo sapiens
ggaagggucucgcucuuac

SEQ ID NO: 10296 - RNA, 19 nt, Homo sapiens
caagaaacccucaaaagua

SEQ ID NO: 10297 - RNA, 19 nt, Homo sapiens
gagaugcaauccucagugu

SEQ ID NO: 10298 - RNA, 19 nt, Homo sapiens
gauggaaguagaaugauuu

SEQ ID NO: 10299 - RNA, 19 nt, Homo sapiens
caagguucccucccacuua

SEQ ID NO: 10300 - RNA, 19 nt, Homo sapiens
ggaggugaauggccagguu

SEQ ID NO: 10301 - RNA, 19 nt, Homo sapiens
gguuuaggcugaaggagaa

SEQ ID NO: 10302 - RNA, 19 nt, Homo sapiens
ggucguggauggucaguuc

SEQ ID NO: 10303 - RNA, 19 nt, Homo sapiens
gaacugcgcccaggacuca

SEQ ID NO: 10304 - RNA, 19 nt, Homo sapiens
ggaggacccugucugucaa

SEQ ID NO: 10305 - RNA, 19 nt, Homo sapiens
aauaguagccuaaaggaaa

SEQ ID NO: 10306 - RNA, 19 nt, Homo sapiens
ggaaauaguagccuaaagg

SEQ ID NO: 10307 - RNA, 19 nt, Homo sapiens
gaaaauagagguaggaaau

SEQ ID NO: 10308 - RNA, 19 nt, Homo sapiens
ggugauaaguguuucuaca

SEQ ID NO: 10309 - RNA, 19 nt, Homo sapiens
ccaaguaccgccugaagaa

SEQ ID NO: 10310 - RNA, 19 nt, Homo sapiens
gcacuuucuuguuuacugu

SEQ ID NO: 10311 - RNA, 19 nt, Homo sapiens
cacaauacauggccuaagu

SEQ ID NO: 10312 - RNA, 19 nt, Homo sapiens
ccacacgucugucuaaacu

SEQ ID NO: 10313 - RNA, 19 nt, Homo sapiens
gacacgcucuucaaugguu

SEQ ID NO: 10314 - RNA, 19 nt, Homo sapiens
acacggacuucacaucuga

SEQ ID NO: 10315 - RNA, 19 nt, Homo sapiens
cagcagcacugaugugaag

SEQ ID NO: 10316 - RNA, 19 nt, Homo sapiens
ccauggauauagaagauga

SEQ ID NO: 10317 - RNA, 19 nt, Homo sapiens
guaauucggcugagaaaca

SEQ ID NO: 10318 - RNA, 19 nt, Homo sapiens
ucuagaggguguucaggua

SEQ ID NO: 10319 - RNA, 19 nt, Homo sapiens
gcucagagauuugcaacca

SEQ ID NO: 10320 - RNA, 19 nt, Homo sapiens
cgguuuacguuuagaaauu

SEQ ID NO: 10321 - RNA, 19 nt, Homo sapiens
ccaaggagcugggacuaca

SEQ ID NO: 10322 - RNA, 19 nt, Homo sapiens
gcggaguucugcuuacuuc

SEQ ID NO: 10323 - RNA, 19 nt, Homo sapiens
ugaaagaggagcugagaga

SEQ ID NO: 10324 - RNA, 19 nt, Homo sapiens
gcucuggucccacaaagaa

SEQ ID NO: 10325 - RNA, 19 nt, Homo sapiens
gaaagaggagcugagagaa

SEQ ID NO: 10326 - RNA, 19 nt, Homo sapiens
aaauagagguaggaaauag

SEQ ID NO: 10327 - RNA, 19 nt, Homo sapiens
ggaggagggugggaaaaua

SEQ ID NO: 10328 - RNA, 19 nt, Homo sapiens
agaaacauguugcugagau

SEQ ID NO: 10329 - RNA, 19 nt, Homo sapiens
gagaauguccaguuucauc

SEQ ID NO: 10330 - RNA, 19 nt, Homo sapiens
gaaaucgccacacgucugu

SEQ ID NO: 10331 - RNA, 19 nt, Homo sapiens
gcagacauaaagcuagaaa

SEQ ID NO: 10332 - RNA, 19 nt, Homo sapiens
guaggcgacuccgcuauug

SEQ ID NO: 10333 - RNA, 19 nt, Homo sapiens
caucagcaaugcagaagca

SEQ ID NO: 10334 - RNA, 19 nt, Homo sapiens
gauggucaguucuuugaag

SEQ ID NO: 10335 - RNA, 19 nt, Homo sapiens
caaauacagacaaaggauu

SEQ ID NO: 10336 - RNA, 19 nt, Homo sapiens
gaugcaauccucaguguuc

SEQ ID NO: 10337 - RNA, 19 nt, Homo sapiens
gaaccucacaucugaacug

SEQ ID NO: 10338 - RNA, 19 nt, Homo sapiens
gaggacagcuacggaccaa

SEQ ID NO: 10339 - RNA, 19 nt, Homo sapiens
uaaagaugccaaggugaua

SEQ ID NO: 10340 - RNA, 19 nt, Homo sapiens
gggaggacccugucuguca

SEQ ID NO: 10341 - RNA, 19 nt, Homo sapiens
gcauaaagaaggaaaauug

SEQ ID NO: 10342 - RNA, 19 nt, Homo sapiens
ggaaguagaaugauuucag

SEQ ID NO: 10343 - RNA, 19 nt, Homo sapiens
caggauggaaguagaauga

SEQ ID NO: 10344 - RNA, 19 nt, Homo sapiens
aggcacagauguuaaagau

SEQ ID NO: 10345 - RNA, 19 nt, Homo sapiens
ugaugcagcugaaugagau

SEQ ID NO: 10346 - RNA, 19 nt, Homo sapiens
ggccuaaguucccucuguu

SEQ ID NO: 10347 - RNA, 19 nt, Homo sapiens
cgagggcuacugcacaaua

SEQ ID NO: 10348 - RNA, 19 nt, Homo sapiens
gguuuacguuuagaaauug

SEQ ID NO: 10349 - RNA, 19 nt, Homo sapiens
uuaccaagcccaacgugua

SEQ ID NO: 10350 - RNA, 19 nt, Homo sapiens
ugaaggagaauguccaguu

SEQ ID NO: 10351 - RNA, 19 nt, Homo sapiens
ucaguguucucuguaugua

SEQ ID NO: 10352 - RNA, 19 nt, Homo sapiens
auaagcugaugguauguaa

SEQ ID NO: 10353 - RNA, 19 nt, Homo sapiens
uuacuacgcuccaagauua

SEQ ID NO: 10354 - RNA, 19 nt, Homo sapiens
gaaggagaauguccaguuu

SEQ ID NO: 10355 - RNA, 19 nt, Homo sapiens
auacacaacuugagcuuua

SEQ ID NO: 10356 - RNA, 19 nt, Homo sapiens
gaccaugacuuaguuguaa

SEQ ID NO: 10357 - RNA, 19 nt, Homo sapiens
gcccaggacucaaguauga

SEQ ID NO: 10358 - RNA, 19 nt, Homo sapiens
gaucagagcagacauaaag

SEQ ID NO: 10359 - RNA, 19 nt, Homo sapiens
aacaugaacugaacgguua

SEQ ID NO: 10360 - RNA, 19 nt, Homo sapiens
gggaauagaauuagagaaa

SEQ ID NO: 10361 - RNA, 19 nt, Homo sapiens
ggagauccuugcucagauu

SEQ ID NO: 10362 - RNA, 19 nt, Homo sapiens
gcaauggccacuccaagua

SEQ ID NO: 10363 - RNA, 19 nt, Homo sapiens
ggauauagaagaugaagaa

SEQ ID NO: 10364 - RNA, 19 nt, Homo sapiens
gauagacacccaaaucgua

SEQ ID NO: 10365 - RNA, 19 nt, Homo sapiens
gagcagacauaaagcuaga

SEQ ID NO: 10366 - RNA, 19 nt, Homo sapiens
guaagggugugucggcuuu

SEQ ID NO: 10367 - RNA, 19 nt, Homo sapiens
gcucucagcucuccaaugg

SEQ ID NO: 10368 - RNA, 19 nt, Homo sapiens
caugagacgcugucaaaua

SEQ ID NO: 10369 - RNA, 19 nt, Homo sapiens
uuuagaaucuggacacuuu

SEQ ID NO: 10370 - RNA, 19 nt, Homo sapiens
gagaaggccuugaggucuu

SEQ ID NO: 10371 - RNA, 19 nt, Homo sapiens
gcucagauuucuuuauaca

SEQ ID NO: 10372 - RNA, 19 nt, Homo sapiens
ggaagaaucccgugaugau

SEQ ID NO: 10373 - RNA, 19 nt, Homo sapiens
ccacaaggaacacuucuuu

SEQ ID NO: 10374 - RNA, 19 nt, Homo sapiens
ugucugcacuuucuuguuu

SEQ ID NO: 10375 - RNA, 19 nt, Homo sapiens
cagcggaucuccaacauag

SEQ ID NO: 10376 - RNA, 19 nt, Homo sapiens
caacuugagcuuuacuuaa

SEQ ID NO: 10377 - RNA, 19 nt, Homo sapiens
gaucguggccuugcauuaa

SEQ ID NO: 10378 - RNA, 19 nt, Homo sapiens
gccaagagcuucgucaugu

SEQ ID NO: 10379 - RNA, 19 nt, Homo sapiens
gaccucagcuugucugcuu

SEQ ID NO: 10380 - RNA, 19 nt, Homo sapiens
gcacugaugugaaggaaaa

SEQ ID NO: 10381 - RNA, 19 nt, Homo sapiens
gaaacauguugcugagaug

SEQ ID NO: 10382 - RNA, 19 nt, Homo sapiens
gcagauagacacccaaauc

SEQ ID NO: 10383 - RNA, 19 nt, Homo sapiens
caacaagccuuugcucagu

SEQ ID NO: 10384 - RNA, 19 nt, Homo sapiens
ggaagggucucgcucuuac

SEQ ID NO: 10385 - RNA, 19 nt, Homo sapiens
caagaaacccucaaaagua

SEQ ID NO: 10386 - RNA, 19 nt, Homo sapiens
gagaugcaauccucagugu

SEQ ID NO: 10387 - RNA, 19 nt, Homo sapiens
caagguucccucccacuua

SEQ ID NO: 10388 - RNA, 19 nt, Homo sapiens
ggaggugaauggccagguu

SEQ ID NO: 10389 - RNA, 19 nt, Homo sapiens
gguuuaggcugaaggagaa

SEQ ID NO: 10390 - RNA, 19 nt, Homo sapiens
ggucguggauggucaguuc

SEQ ID NO: 10391 - RNA, 19 nt, Homo sapiens
gaacugcgcccaggacuca

SEQ ID NO: 10392 - RNA, 19 nt, Homo sapiens
ggaggacccugucugucaa

SEQ ID NO: 10393 - RNA, 19 nt, Homo sapiens
ggugauaaguguuucuaca

SEQ ID NO: 10394 - RNA, 19 nt, Homo sapiens
ccaaguaccgccugaagaa

SEQ ID NO: 10395 - RNA, 19 nt, Homo sapiens
gcacuuucuuguuuacugu

SEQ ID NO: 10396 - RNA, 19 nt, Homo sapiens
gacacgcucuucaaugguu

SEQ ID NO: 10397 - RNA, 19 nt, Homo sapiens
acacggacuucacaucuga

SEQ ID NO: 10398 - RNA, 19 nt, Homo sapiens
cagcagcacugaugugaag

SEQ ID NO: 10399 - RNA, 19 nt, Homo sapiens
ccauggauauagaagauga

SEQ ID NO: 10400 - RNA, 19 nt, Homo sapiens
guaauucggcugagaaaca

SEQ ID NO: 10401 - RNA, 19 nt, Homo sapiens
ccaaggagcugggacuaca

SEQ ID NO: 10402 - RNA, 19 nt, Homo sapiens
gcggaguucugcuuacuuc

SEQ ID NO: 10403 - RNA, 19 nt, Homo sapiens
gcucuggucccacaaagaa

SEQ ID NO: 10404 - RNA, 19 nt, Homo sapiens
agaaacauguugcugagau

SEQ ID NO: 10405 - RNA, 19 nt, Homo sapiens
gagaauguccaguuucauc

SEQ ID NO: 10406 - RNA, 19 nt, Homo sapiens
guaggcgacuccgcuauug

SEQ ID NO: 10407 - RNA, 19 nt, Homo sapiens
caucagcaaugcagaagca

SEQ ID NO: 10408 - RNA, 19 nt, Homo sapiens
gauggucaguucuuugaag

SEQ ID NO: 10409 - RNA, 19 nt, Homo sapiens
gcagacauaaagcuagaaa

SEQ ID NO: 10410 - RNA, 19 nt, Homo sapiens
caaauacagacaaaggauu

SEQ ID NO: 10411 - RNA, 19 nt, Homo sapiens
gaugcaauccucaguguuc

SEQ ID NO: 10412 - RNA, 19 nt, Homo sapiens
gaggacagcuacggaccaa

SEQ ID NO: 10413 - RNA, 19 nt, Homo sapiens
uaaagaugccaaggugaua

SEQ ID NO: 10414 - RNA, 19 nt, Homo sapiens
gggaggacccugucuguca

SEQ ID NO: 10415 - RNA, 19 nt, Homo sapiens
gcauaaagaaggaaaauug

SEQ ID NO: 10416 - RNA, 19 nt, Homo sapiens
aggcacagauguuaaagau

SEQ ID NO: 10417 - RNA, 19 nt, Homo sapiens
ugaugcagcugaaugagau

SEQ ID NO: 10418 - RNA, 19 nt, Homo sapiens
uuaccaagcccaacgugua

SEQ ID NO: 10419 - RNA, 19 nt, Homo sapiens
ugaaggagaauguccaguu

SEQ ID NO: 10420 - RNA, 19 nt, Homo sapiens
ucaguguucucuguaugua

SEQ ID NO: 10421 - RNA, 19 nt, Homo sapiens
auaagcugaugguauguaa

SEQ ID NO: 10422 - RNA, 19 nt, Homo sapiens
gcccaugucucaaaacaaa

SEQ ID NO: 10423 - RNA, 19 nt, Homo sapiens
cuacagaaccagcagauag

SEQ ID NO: 10424 - RNA, 19 nt, Homo sapiens
ucuggacacuuucuaugaa

SEQ ID NO: 10425 - RNA, 19 nt, Homo sapiens
gaaucuggacacuuucuau

SEQ ID NO: 10426 - RNA, 19 nt, Homo sapiens
cgugugaguucuaguguuc

SEQ ID NO: 10427 - RNA, 19 nt, Homo sapiens
aguccaagcuggcggcaaa

SEQ ID NO: 10428 - RNA, 19 nt, Homo sapiens
caacacggacuucacaucu

SEQ ID NO: 10429 - RNA, 19 nt, Homo sapiens
ccgacucgaccaugacuua

SEQ ID NO: 10430 - RNA, 19 nt, Homo sapiens
gccaaggugauaaguguuu

SEQ ID NO: 10431 - RNA, 19 nt, Homo sapiens
ggacacuuucuaugaaugu

SEQ ID NO: 10432 - RNA, 19 nt, Homo sapiens
cauuaaacaugaacugaac

SEQ ID NO: 10433 - RNA, 19 nt, Homo sapiens
gaccugcccaugucucaaa

SEQ ID NO: 10434 - RNA, 19 nt, Homo sapiens
gcaagguucccucccacuu

SEQ ID NO: 10435 - RNA, 19 nt, Homo sapiens
guccugcagugacaagauu

SEQ ID NO: 10436 - RNA, 19 nt, Homo sapiens
gaagaaucccgugaugauc

SEQ ID NO: 10437 - RNA, 19 nt, Homo sapiens
gcacgcgccuuuguuuguc

SEQ ID NO: 10438 - RNA, 19 nt, Homo sapiens
aguguucucuguauguaaa

SEQ ID NO: 10439 - RNA, 19 nt, Homo sapiens
cgaccaugacuuaguugua

SEQ ID NO: 10440 - RNA, 19 nt, Homo sapiens
ggcauuguguuccgugugu

SEQ ID NO: 10441 - RNA, 19 nt, Homo sapiens
gguaggcgacuccgcuauu

SEQ ID NO: 10442 - RNA, 19 nt, Homo sapiens
uaaagcaagaggacagcua

SEQ ID NO: 10443 - RNA, 19 nt, Homo sapiens
aggagaauguccaguuuca

SEQ ID NO: 10444 - RNA, 19 nt, Homo sapiens
acaacuugagcuuuacuua

SEQ ID NO: 10445 - RNA, 19 nt, Homo sapiens
gacacuuucuaugaaugua

SEQ ID NO: 10446 - RNA, 19 nt, Homo sapiens
uguguaagcacgcguugua

SEQ ID NO: 10447 - RNA, 19 nt, Homo sapiens
gauccuugcucagauuucu

SEQ ID NO: 10448 - RNA, 19 nt, Homo sapiens
gccagccuauucccaguga

SEQ ID NO: 10449 - RNA, 19 nt, Homo sapiens
gggaucagagcagacauaa

SEQ ID NO: 10450 - RNA, 19 nt, Homo sapiens
ugaggucuuucguucaguu

SEQ ID NO: 10451 - RNA, 19 nt, Homo sapiens
ccauuaaacaugaacugaa

SEQ ID NO: 10452 - RNA, 19 nt, Homo sapiens
acucgaccaugacuuaguu

SEQ ID NO: 10453 - RNA, 19 nt, Homo sapiens
gagcaugacuuauuuagua

SEQ ID NO: 10454 - RNA, 19 nt, Homo sapiens
gcaaaucagucucacaaua

SEQ ID NO: 10455 - RNA, 19 nt, Homo sapiens
gaagagauuugaagaagaa

SEQ ID NO: 10456 - RNA, 19 nt, Homo sapiens
ggucaaagcuccuuaaagu

SEQ ID NO: 10457 - RNA, 19 nt, Homo sapiens
ggacaugugugaagccaua

SEQ ID NO: 10458 - RNA, 19 nt, Homo sapiens
guagagcaaucguguauaa

SEQ ID NO: 10459 - RNA, 19 nt, Homo sapiens
ugaaugagcucuuuggaaa

SEQ ID NO: 10460 - RNA, 19 nt, Homo sapiens
ggagggagauggugacauu

SEQ ID NO: 10461 - RNA, 19 nt, Homo sapiens
gaauggcgcuuauaaagug

SEQ ID NO: 10462 - RNA, 19 nt, Homo sapiens
ggaaagaccugaagaccau

SEQ ID NO: 10463 - RNA, 19 nt, Homo sapiens
gaacuuggguuugcgcuaa

SEQ ID NO: 10464 - RNA, 19 nt, Homo sapiens
gaaggaggacccugaauuu

SEQ ID NO: 10465 - RNA, 19 nt, Homo sapiens
gcaagcauguugaauguau

SEQ ID NO: 10466 - RNA, 19 nt, Homo sapiens
caacuucugucccuuguuu

SEQ ID NO: 10467 - RNA, 19 nt, Homo sapiens
gcacauguguucagaguuc

SEQ ID NO: 10468 - RNA, 19 nt, Homo sapiens
gaggagagaggaucacuua

SEQ ID NO: 10469 - RNA, 19 nt, Homo sapiens
gagaaugaaugcaugagaa

SEQ ID NO: 10470 - RNA, 19 nt, Homo sapiens
gugguuugcuccagaauua

SEQ ID NO: 10471 - RNA, 19 nt, Homo sapiens
gaacugugcucucccaaag

SEQ ID NO: 10472 - RNA, 19 nt, Homo sapiens
cagaaggccuugaagaauu

SEQ ID NO: 10473 - RNA, 19 nt, Homo sapiens
ggaacucgcucuucagcaa

SEQ ID NO: 10474 - RNA, 19 nt, Homo sapiens
guagugagccuugauuaua

SEQ ID NO: 10475 - RNA, 19 nt, Homo sapiens
ggaagccucucauagaaau

SEQ ID NO: 10476 - RNA, 19 nt, Homo sapiens
agaaagagcucuccagaag

SEQ ID NO: 10477 - RNA, 19 nt, Homo sapiens
gcaagagaauuauuacaag

SEQ ID NO: 10478 - RNA, 19 nt, Homo sapiens
ugugauagcuggugugauu

SEQ ID NO: 10479 - RNA, 19 nt, Homo sapiens
ggaaucagcuaugcaaauc

SEQ ID NO: 10480 - RNA, 19 nt, Homo sapiens
gcacguggcugagcacuuc

SEQ ID NO: 10481 - RNA, 19 nt, Homo sapiens
caccacagccaucauauua

SEQ ID NO: 10482 - RNA, 19 nt, Homo sapiens
guucagaguuccacaguug

SEQ ID NO: 10483 - RNA, 19 nt, Homo sapiens
gaauauuacuguagguuag

SEQ ID NO: 10484 - RNA, 19 nt, Homo sapiens
gcacuugaauggcgcuuau

SEQ ID NO: 10485 - RNA, 19 nt, Homo sapiens
gcaaucguguauaagcuaa

SEQ ID NO: 10486 - RNA, 19 nt, Homo sapiens
uaacagacauagacugcaa

SEQ ID NO: 10487 - RNA, 19 nt, Homo sapiens
ccacagccaucauauuaau

SEQ ID NO: 10488 - RNA, 19 nt, Homo sapiens
caggaagccucucauagaa

SEQ ID NO: 10489 - RNA, 19 nt, Homo sapiens
cauguggcguuucuaauaa

SEQ ID NO: 10490 - RNA, 19 nt, Homo sapiens
gaguagagcaugacuuauu

SEQ ID NO: 10491 - RNA, 19 nt, Homo sapiens
gcaggcaucuguaagaagu

SEQ ID NO: 10492 - RNA, 19 nt, Homo sapiens
ugacacaguuguuucagaa

SEQ ID NO: 10493 - RNA, 19 nt, Homo sapiens
gaaacaaucccuccaacug

SEQ ID NO: 10494 - RNA, 19 nt, Homo sapiens
aaacacacacacauucuua

SEQ ID NO: 10495 - RNA, 19 nt, Homo sapiens
gcagcaaccauucaucuuu

SEQ ID NO: 10496 - RNA, 19 nt, Homo sapiens
gggcaacacugucaaugug

SEQ ID NO: 10497 - RNA, 19 nt, Homo sapiens
ugccagcguucaaguauua

SEQ ID NO: 10498 - RNA, 19 nt, Homo sapiens
gugaguagagcaugacuua

SEQ ID NO: 10499 - RNA, 19 nt, Homo sapiens
gaaaggaugauucaagcaa

SEQ ID NO: 10500 - RNA, 19 nt, Homo sapiens
gcacaacugcuguuuagug

SEQ ID NO: 10501 - RNA, 19 nt, Homo sapiens
caacucagcauuggccuua

SEQ ID NO: 10502 - RNA, 19 nt, Homo sapiens
gaagguaucacacacuuuc

SEQ ID NO: 10503 - RNA, 19 nt, Homo sapiens
acuaugagcugaagauguu

SEQ ID NO: 10504 - RNA, 19 nt, Homo sapiens
agaaggccuugaagaauuu

SEQ ID NO: 10505 - RNA, 19 nt, Homo sapiens
uuacucagcucccuggaaa

SEQ ID NO: 10506 - RNA, 19 nt, Homo sapiens
gagcucagaagccacaaua

SEQ ID NO: 10507 - RNA, 19 nt, Homo sapiens
cugaagauguugaucauga

SEQ ID NO: 10508 - RNA, 19 nt, Homo sapiens
gacagaaggccuugaagaa

SEQ ID NO: 10509 - RNA, 19 nt, Homo sapiens
gcucacccauugucucauu

SEQ ID NO: 10510 - RNA, 19 nt, Homo sapiens
caucugauauucaaacaca

SEQ ID NO: 10511 - RNA, 19 nt, Homo sapiens
ccauguggcguuucuaaua

SEQ ID NO: 10512 - RNA, 19 nt, Homo sapiens
caaacugccuguuaagucu

SEQ ID NO: 10513 - RNA, 19 nt, Homo sapiens
ucaaagcuccuuaaaguuc

SEQ ID NO: 10514 - RNA, 19 nt, Homo sapiens
caaacuggccuugguguaa

SEQ ID NO: 10515 - RNA, 19 nt, Homo sapiens
cugaagacguacuuuguaa

SEQ ID NO: 10516 - RNA, 19 nt, Homo sapiens
cauuagggacccauauuua

SEQ ID NO: 10517 - RNA, 19 nt, Homo sapiens
ggaggacccugaauuugag

SEQ ID NO: 10518 - RNA, 19 nt, Homo sapiens
cagcauuggccuuaauaua

SEQ ID NO: 10519 - RNA, 19 nt, Homo sapiens
caacugcccuggcgauuuu

SEQ ID NO: 10520 - RNA, 19 nt, Homo sapiens
caaaucagucucacaauag

SEQ ID NO: 10521 - RNA, 19 nt, Homo sapiens
caacguggcauccugaaga

SEQ ID NO: 10522 - RNA, 19 nt, Homo sapiens
gugcaccugucgaggaaua

SEQ ID NO: 10523 - RNA, 19 nt, Homo sapiens
gagagaggaucacuuaagc

SEQ ID NO: 10524 - RNA, 19 nt, Homo sapiens
cacaacugcuguuuaguga

SEQ ID NO: 10525 - RNA, 19 nt, Homo sapiens
aguagagcaugacuuauuu

SEQ ID NO: 10526 - RNA, 19 nt, Homo sapiens
gauauucaaacacacagua

SEQ ID NO: 10527 - RNA, 19 nt, Homo sapiens
aagccaauauugagaugua

SEQ ID NO: 10528 - RNA, 19 nt, Homo sapiens
caagaagacuguauuuuca

SEQ ID NO: 10529 - RNA, 19 nt, Homo sapiens
gaccaggcauuuggaaaga

SEQ ID NO: 10530 - RNA, 19 nt, Homo sapiens
gagauuugaagaagaauug

SEQ ID NO: 10531 - RNA, 19 nt, Homo sapiens
ggagagaggaucacuuaag

SEQ ID NO: 10532 - RNA, 19 nt, Homo sapiens
ucaccagucuuaccaaaca

SEQ ID NO: 10533 - RNA, 19 nt, Homo sapiens
aaacuggccuugguguaaa

SEQ ID NO: 10534 - RNA, 19 nt, Homo sapiens
aagcacaaguuccugguuu

SEQ ID NO: 10535 - RNA, 19 nt, Homo sapiens
gcuccugucuccaagaaug

SEQ ID NO: 10536 - RNA, 19 nt, Homo sapiens
gcucagaagccacaauaug

SEQ ID NO: 10537 - RNA, 19 nt, Homo sapiens
gguuagacuucuuauggaa

SEQ ID NO: 10538 - RNA, 19 nt, Homo sapiens
gauauccuguuccguguuc

SEQ ID NO: 10539 - RNA, 19 nt, Homo sapiens
agcaauggcucaagucuga

SEQ ID NO: 10540 - RNA, 19 nt, Homo sapiens
cagcaaccauucaucuuuc

SEQ ID NO: 10541 - RNA, 19 nt, Homo sapiens
caacugcuguuuagugaac

SEQ ID NO: 10542 - RNA, 19 nt, Homo sapiens
aaacagagucccucccauu

SEQ ID NO: 10543 - RNA, 19 nt, Homo sapiens
guacuaagacccacaaacu

SEQ ID NO: 10544 - RNA, 19 nt, Homo sapiens
gaaacacacacacauucuu

SEQ ID NO: 10545 - RNA, 19 nt, Homo sapiens
gcaucgagucuguguuuaa

SEQ ID NO: 10546 - RNA, 19 nt, Homo sapiens
cuuauacgcugacaucguu

SEQ ID NO: 10547 - RNA, 19 nt, Homo sapiens
ggagaacacaaauaacuuc

SEQ ID NO: 10548 - RNA, 19 nt, Homo sapiens
cgugggaacucgaacuuga

SEQ ID NO: 10549 - RNA, 19 nt, Homo sapiens
uaaucaacgugaaaggaaa

SEQ ID NO: 10550 - RNA, 19 nt, Homo sapiens
gaggaauaaucaacgugaa

SEQ ID NO: 10551 - RNA, 19 nt, Homo sapiens
ccaccaaguucucauaaac

SEQ ID NO: 10552 - RNA, 19 nt, Homo sapiens
uaacugagagaaguacuaa

SEQ ID NO: 10553 - RNA, 19 nt, Homo sapiens
gaacagaaagugcaauauu

SEQ ID NO: 10554 - RNA, 19 nt, Homo sapiens
ugaaagacaugaagaaaga

SEQ ID NO: 10555 - RNA, 19 nt, Homo sapiens
gcacguggcugacgagaug

SEQ ID NO: 10556 - RNA, 19 nt, Homo sapiens
gaagagaaggguauugaaa

SEQ ID NO: 10557 - RNA, 19 nt, Homo sapiens
gagaaacaccuuccucuug

SEQ ID NO: 10558 - RNA, 19 nt, Homo sapiens
gaauuggacugguguugga

SEQ ID NO: 10559 - RNA, 19 nt, Homo sapiens
caacuuugcugacuucuac

SEQ ID NO: 10560 - RNA, 19 nt, Homo sapiens
gaaggaacgugucuaugag

SEQ ID NO: 10561 - RNA, 19 nt, Homo sapiens
gagcacgacuuaccuaugg

SEQ ID NO: 10562 - RNA, 19 nt, Homo sapiens
gagaacagaaagugcaaua

SEQ ID NO: 10563 - RNA, 19 nt, Homo sapiens
gggauaagcuagccaccuu

SEQ ID NO: 10564 - RNA, 19 nt, Homo sapiens
gaggagagcaucaacaaug

SEQ ID NO: 10565 - RNA, 19 nt, Homo sapiens
gaacgucagcauccucuuu

SEQ ID NO: 10566 - RNA, 19 nt, Homo sapiens
gugauuaccuagaagagaa

SEQ ID NO: 10567 - RNA, 19 nt, Homo sapiens
caucaacaauggugguauu

SEQ ID NO: 10568 - RNA, 19 nt, Homo sapiens
gaguacggcuuccgcuuug

SEQ ID NO: 10569 - RNA, 19 nt, Homo sapiens
ccagacguaugaugagauu

SEQ ID NO: 10570 - RNA, 19 nt, Homo sapiens
gagaugaggagcuguauag

SEQ ID NO: 10571 - RNA, 19 nt, Homo sapiens
agaaacaccuuccucuugu

SEQ ID NO: 10572 - RNA, 19 nt, Homo sapiens
caggagaaccucaugcuuu

SEQ ID NO: 10573 - RNA, 19 nt, Homo sapiens
agaaggaacgugucuauga

SEQ ID NO: 10574 - RNA, 19 nt, Homo sapiens
gcacacucauggacuuuag

SEQ ID NO: 10575 - RNA, 19 nt, Homo sapiens
gcgagaguccgcccaagua

SEQ ID NO: 10576 - RNA, 19 nt, Homo sapiens
agaaggguauugaaaccua

SEQ ID NO: 10577 - RNA, 19 nt, Homo sapiens
ggacugguguuggacauca

SEQ ID NO: 10578 - RNA, 19 nt, Homo sapiens
ucagcugucuccaguacua

SEQ ID NO: 10579 - RNA, 19 nt, Homo sapiens
caaacuaugugaccuucau

SEQ ID NO: 10580 - RNA, 19 nt, Homo sapiens
gauauugccuugccuuuug

SEQ ID NO: 10581 - RNA, 19 nt, Homo sapiens
ccagagcccucguuccaau

SEQ ID NO: 10582 - RNA, 19 nt, Homo sapiens
cucauggacuuuagguuua

SEQ ID NO: 10583 - RNA, 19 nt, Homo sapiens
gcauaggcaugaacaaagg

SEQ ID NO: 10584 - RNA, 19 nt, Homo sapiens
uagagcagaugcaaggauu

SEQ ID NO: 10585 - RNA, 19 nt, Homo sapiens
gugaugguguuccucauga

SEQ ID NO: 10586 - RNA, 19 nt, Homo sapiens
ucaaccagcugcucaacga

SEQ ID NO: 10587 - RNA, 19 nt, Homo sapiens
gcucauaaccgcccagauc

SEQ ID NO: 10588 - RNA, 19 nt, Homo sapiens
cugcugaccuucuucuuga

SEQ ID NO: 10589 - RNA, 19 nt, Homo sapiens
gaaaccuaccucaucauug

SEQ ID NO: 10590 - RNA, 19 nt, Homo sapiens
aaaccuaccucaucauugc

SEQ ID NO: 10591 - RNA, 19 nt, Homo sapiens
guggacaacuccugaaugg

SEQ ID NO: 10592 - RNA, 19 nt, Homo sapiens
gcuacucgguggagaagga

SEQ ID NO: 10593 - RNA, 19 nt, Homo sapiens
gcuggcaggucuucuuugu

SEQ ID NO: 10594 - RNA, 19 nt, Homo sapiens
gggcaacauucagguggua

SEQ ID NO: 10595 - RNA, 19 nt, Homo sapiens
gagauuggagucauguuug

SEQ ID NO: 10596 - RNA, 19 nt, Homo sapiens
gaaacaccuuccucuuguc

SEQ ID NO: 10597 - RNA, 19 nt, Homo sapiens
aaacuggcacggacacuuu

SEQ ID NO: 10598 - RNA, 19 nt, Homo sapiens
gcucagcugucuccaguac

SEQ ID NO: 10599 - RNA, 19 nt, Homo sapiens
gcaccagcuuccucaaagu

SEQ ID NO: 10600 - RNA, 19 nt, Homo sapiens
cugaucaucuugaaagguu

SEQ ID NO: 10601 - RNA, 19 nt, Homo sapiens
gcgcauaggcaugaacaaa

SEQ ID NO: 10602 - RNA, 19 nt, Homo sapiens
aacaaccaguccuucaaua

SEQ ID NO: 10603 - RNA, 19 nt, Homo sapiens
caacaaccaguccuucaau

SEQ ID NO: 10604 - RNA, 19 nt, Homo sapiens
gagcaccagcuuccucaaa

SEQ ID NO: 10605 - RNA, 19 nt, Homo sapiens
gaaaacagccacccagaau

SEQ ID NO: 10606 - RNA, 19 nt, Homo sapiens
cgccuuugcuacugcuuua

SEQ ID NO: 10607 - RNA, 19 nt, Homo sapiens
cggaagggagaauuuauuu

SEQ ID NO: 10608 - RNA, 19 nt, Homo sapiens
gaaaccacacuacgacauc

SEQ ID NO: 10609 - RNA, 19 nt, Homo sapiens
cugacgagaugcugaaaga

SEQ ID NO: 10610 - RNA, 19 nt, Homo sapiens
ggucuuugcagcccucuuu

SEQ ID NO: 10611 - RNA, 19 nt, Homo sapiens
ggaagacaaguccgagaga

SEQ ID NO: 10612 - RNA, 19 nt, Homo sapiens
cuacuucucccgccacgua

SEQ ID NO: 10613 - RNA, 19 nt, Homo sapiens
ccgcugugauuaccuagaa

SEQ ID NO: 10614 - RNA, 19 nt, Homo sapiens
gcugaaagacaugaagaaa

SEQ ID NO: 10615 - RNA, 19 nt, Homo sapiens
agaagaaacccaagucauc

SEQ ID NO: 10616 - RNA, 19 nt, Homo sapiens
gcgcuggccaugaaggaua

SEQ ID NO: 10617 - RNA, 19 nt, Homo sapiens
gcagacaccagccaguaug

SEQ ID NO: 10618 - RNA, 19 nt, Homo sapiens
ccaaguauuacaacuaugu

SEQ ID NO: 10619 - RNA, 19 nt, Homo sapiens
uaaagaagagaaacaccuu

SEQ ID NO: 10620 - RNA, 19 nt, Homo sapiens
acaaccaguccuucaauaa

SEQ ID NO: 10621 - RNA, 19 nt, Homo sapiens
ccagaaggaacgugucuau

SEQ ID NO: 10622 - RNA, 19 nt, Homo sapiens
agaguccgcccaaguagua

SEQ ID NO: 10623 - RNA, 19 nt, Homo sapiens
ugaaaccuaccucaucauu

SEQ ID NO: 10624 - RNA, 19 nt, Homo sapiens
uggcagagcugggacaaag

SEQ ID NO: 10625 - RNA, 19 nt, Homo sapiens
gcccaacuuugcugacuuc

SEQ ID NO: 10626 - RNA, 19 nt, Homo sapiens
aggagaaccucaugcuuuc

SEQ ID NO: 10627 - RNA, 19 nt, Homo sapiens
acauucaggugguagaaga

SEQ ID NO: 10628 - RNA, 19 nt, Homo sapiens
cagaggagagcaucaacaa

SEQ ID NO: 10629 - RNA, 19 nt, Homo sapiens
caccauggacugccugaaa

SEQ ID NO: 10630 - RNA, 19 nt, Homo sapiens
gaaagacgagagccagaag

SEQ ID NO: 10631 - RNA, 19 nt, Homo sapiens
uggcaggucuucuuugucu

SEQ ID NO: 10632 - RNA, 19 nt, Homo sapiens
cuaccagaccuacuucaaa

SEQ ID NO: 10633 - RNA, 19 nt, Homo sapiens
ccucagccuucauuuguuc

SEQ ID NO: 10634 - RNA, 19 nt, Homo sapiens
gucccgaccuuccuggauu

SEQ ID NO: 10635 - RNA, 19 nt, Homo sapiens
gggagcugcugaccuucuu

SEQ ID NO: 10636 - RNA, 19 nt, Homo sapiens
ucaccaacaucaacaacca

SEQ ID NO: 10637 - RNA, 19 nt, Homo sapiens
ugagauuggagucauguuu

SEQ ID NO: 10638 - RNA, 19 nt, Homo sapiens
uagaagagaaggguauuga

SEQ ID NO: 10639 - RNA, 19 nt, Homo sapiens
ugauaaagaacaagacugu

SEQ ID NO: 10640 - RNA, 19 nt, Homo sapiens
gcuacugcuuuaagagaau

SEQ ID NO: 10641 - RNA, 19 nt, Homo sapiens
acucauggacuuuagguuu

SEQ ID NO: 10642 - RNA, 19 nt, Homo sapiens
aaaccggaagggagaauuu

SEQ ID NO: 10643 - RNA, 19 nt, Homo sapiens
uggcugaccuggccgacuu

SEQ ID NO: 10644 - RNA, 19 nt, Homo sapiens
uggagaaccccaaguauua

SEQ ID NO: 10645 - RNA, 19 nt, Homo sapiens
guggaugccucugaagaug

SEQ ID NO: 10646 - RNA, 19 nt, Homo sapiens
gaagaugaaccuggaagag

SEQ ID NO: 10647 - RNA, 19 nt, Homo sapiens
gauccuggccaacgucuuc

SEQ ID NO: 10648 - RNA, 19 nt, Homo sapiens
uugaaagguucuucuggaa

SEQ ID NO: 10649 - RNA, 19 nt, Homo sapiens
caagucauccuccgagagu

SEQ ID NO: 10650 - RNA, 19 nt, Homo sapiens
ggaaaccacacuacgacau

SEQ ID NO: 10651 - RNA, 19 nt, Homo sapiens
guauugagugucugcguuu

SEQ ID NO: 10652 - RNA, 19 nt, Homo sapiens
gcaggucuucuuugucuuc

SEQ ID NO: 10653 - RNA, 19 nt, Homo sapiens
ggacagaggcugaggaauu

SEQ ID NO: 10654 - RNA, 19 nt, Homo sapiens
gacagaggcugaggaauuu

SEQ ID NO: 10655 - RNA, 19 nt, Homo sapiens
guagagagaugcccagguu

SEQ ID NO: 10656 - RNA, 19 nt, Homo sapiens
gugaaugucucuagucgua

SEQ ID NO: 10657 - RNA, 19 nt, Homo sapiens
uaaaguggaugaacggaaa

SEQ ID NO: 10658 - RNA, 19 nt, Homo sapiens
ggagaaaggugacccugau

SEQ ID NO: 10659 - RNA, 19 nt, Homo sapiens
gccaucagguacuucauua

SEQ ID NO: 10660 - RNA, 19 nt, Homo sapiens
gagaaggguuuccagaguu

SEQ ID NO: 10661 - RNA, 19 nt, Homo sapiens
gcacauagcaccgcaguug

SEQ ID NO: 10662 - RNA, 19 nt, Homo sapiens
ggaaauggcaguucgaugu

SEQ ID NO: 10663 - RNA, 19 nt, Homo sapiens
ggagaaggguuuccagagu

SEQ ID NO: 10664 - RNA, 19 nt, Homo sapiens
ggaccaaggugggcauuga

SEQ ID NO: 10665 - RNA, 19 nt, Homo sapiens
gagcacuccuucaacaauu

SEQ ID NO: 10666 - RNA, 19 nt, Homo sapiens
aagaagacaucaacacaaa

SEQ ID NO: 10667 - RNA, 19 nt, Homo sapiens
gaaagaagacaucaacaca

SEQ ID NO: 10668 - RNA, 19 nt, Homo sapiens
gaagaggaaccuuaaacuu

SEQ ID NO: 10669 - RNA, 19 nt, Homo sapiens
ccucuucuguugccaaaua

SEQ ID NO: 10670 - RNA, 19 nt, Homo sapiens
gaaguuggccaugaucuuu

SEQ ID NO: 10671 - RNA, 19 nt, Homo sapiens
gcagaaggguuaggagguu

SEQ ID NO: 10672 - RNA, 19 nt, Homo sapiens
cacaagaucuacauacaga

SEQ ID NO: 10673 - RNA, 19 nt, Homo sapiens
guuaggagguugaacucua

SEQ ID NO: 10674 - RNA, 19 nt, Homo sapiens
gagcaucucuuccucuucu

SEQ ID NO: 10675 - RNA, 19 nt, Homo sapiens
ccauggagaugaaagaaga

SEQ ID NO: 10676 - RNA, 19 nt, Homo sapiens
gggaagugcuuagguaaug

SEQ ID NO: 10677 - RNA, 19 nt, Homo sapiens
guguguggcuguuauguuu

SEQ ID NO: 10678 - RNA, 19 nt, Homo sapiens
gagagaggaucuugagaag

SEQ ID NO: 10679 - RNA, 19 nt, Homo sapiens
gcaaugaugaacucuacua

SEQ ID NO: 10680 - RNA, 19 nt, Homo sapiens
uggaggagcuacaggcaua

SEQ ID NO: 10681 - RNA, 19 nt, Homo sapiens
gaaugucucuagucguaug

SEQ ID NO: 10682 - RNA, 19 nt, Homo sapiens
ucacugcccuggcugacua

SEQ ID NO: 10683 - RNA, 19 nt, Homo sapiens
gaugaacucuacuaucagu

SEQ ID NO: 10684 - RNA, 19 nt, Homo sapiens
uggauggucucuaauacua

SEQ ID NO: 10685 - RNA, 19 nt, Homo sapiens
gugcuuagguaaugagcua

SEQ ID NO: 10686 - RNA, 19 nt, Homo sapiens
gggcuaccauugucccuuu

SEQ ID NO: 10687 - RNA, 19 nt, Homo sapiens
ggguggcccucaaauauau

SEQ ID NO: 10688 - RNA, 19 nt, Homo sapiens
gccaacauguucaccugua

SEQ ID NO: 10689 - RNA, 19 nt, Homo sapiens
ggaagugcuuagguaauga

SEQ ID NO: 10690 - RNA, 19 nt, Homo sapiens
ggaacaugcugcugagucu

SEQ ID NO: 10691 - RNA, 19 nt, Homo sapiens
ugacaggugugaaugugaa

SEQ ID NO: 10692 - RNA, 19 nt, Homo sapiens
gauaggaagagacuacuug

SEQ ID NO: 10693 - RNA, 19 nt, Homo sapiens
gaaaagaucaagacgauug

SEQ ID NO: 10694 - RNA, 19 nt, Homo sapiens
ugacaacuaugaccuacug

SEQ ID NO: 10695 - RNA, 19 nt, Homo sapiens
gugguucucuguucccuaa

SEQ ID NO: 10696 - RNA, 19 nt, Homo sapiens
ucacaaagugcugggauua

SEQ ID NO: 10697 - RNA, 19 nt, Homo sapiens
caacuuaaccguggugaug

SEQ ID NO: 10698 - RNA, 19 nt, Homo sapiens
gcagggucuugcuguauug

SEQ ID NO: 10699 - RNA, 19 nt, Homo sapiens
gucaggagcuggaaguuca

SEQ ID NO: 10700 - RNA, 19 nt, Homo sapiens
ccaacauguucaccuguaa

SEQ ID NO: 10701 - RNA, 19 nt, Homo sapiens
ccuacuggauggucucuaa

SEQ ID NO: 10702 - RNA, 19 nt, Homo sapiens
ggagaugaccaccuacuuc

SEQ ID NO: 10703 - RNA, 19 nt, Homo sapiens
gaugugugguccaaugaug

SEQ ID NO: 10704 - RNA, 19 nt, Homo sapiens
ggcagggucuugcuguauu

SEQ ID NO: 10705 - RNA, 19 nt, Homo sapiens
gaggcagggucuugcugua

SEQ ID NO: 10706 - RNA, 19 nt, Homo sapiens
ggaacaaagggaccucuga

SEQ ID NO: 10707 - RNA, 19 nt, Homo sapiens
ucaacaauuuccagaugaa

SEQ ID NO: 10708 - RNA, 19 nt, Homo sapiens
aagaggaaccuuaaacuug

SEQ ID NO: 10709 - RNA, 19 nt, Homo sapiens
ucagguacuucauuaguca

SEQ ID NO: 10710 - RNA, 19 nt, Homo sapiens
gaauuuugcuugaagauca

SEQ ID NO: 10711 - RNA, 19 nt, Homo sapiens
gcuguucccucuccaaucu

SEQ ID NO: 10712 - RNA, 19 nt, Homo sapiens
ucaaugagcacuccuucaa

SEQ ID NO: 10713 - RNA, 19 nt, Homo sapiens
ggaggcugcugcauaacau

SEQ ID NO: 10714 - RNA, 19 nt, Homo sapiens
gcccggaugcugaauuuaa

SEQ ID NO: 10715 - RNA, 19 nt, Homo sapiens
ccacaucacucgggcaaca

SEQ ID NO: 10716 - RNA, 19 nt, Homo sapiens
caccgcaguuggcaucuuu

SEQ ID NO: 10717 - RNA, 19 nt, Homo sapiens
gcagcucggugccaaugug

SEQ ID NO: 10718 - RNA, 19 nt, Homo sapiens
caccacaccaggcuaauuu

SEQ ID NO: 10719 - RNA, 19 nt, Homo sapiens
gauggucucuaauacuauc

SEQ ID NO: 10720 - RNA, 19 nt, Homo sapiens
gagaggauuaugcaaguga

SEQ ID NO: 10721 - RNA, 19 nt, Homo sapiens
gccagggccuuccaaagug

SEQ ID NO: 10722 - RNA, 19 nt, Homo sapiens
gaaauggcaguucgaugug

SEQ ID NO: 10723 - RNA, 19 nt, Homo sapiens
guccuuggcuugcggaaau

SEQ ID NO: 10724 - RNA, 19 nt, Homo sapiens
ccauguggguggugagcua

SEQ ID NO: 10725 - RNA, 19 nt, Homo sapiens
aaagcaggguuuccuacuu

SEQ ID NO: 10726 - RNA, 19 nt, Homo sapiens
ugacuuucuuucuuacuug

SEQ ID NO: 10727 - RNA, 19 nt, Homo sapiens
caccaucuuugacaacuau

SEQ ID NO: 10728 - RNA, 19 nt, Homo sapiens
aggaugagguggaugaguu

SEQ ID NO: 10729 - RNA, 19 nt, Homo sapiens
gaucuuggccuggcaacuu

SEQ ID NO: 10730 - RNA, 19 nt, Homo sapiens
gaaccauguauuucaguga

SEQ ID NO: 10731 - RNA, 19 nt, Homo sapiens
gcuugaagaucacuuuguc

SEQ ID NO: 10732 - RNA, 19 nt, Homo sapiens
cuaccuaccgagaggauua

SEQ ID NO: 10733 - RNA, 19 nt, Homo sapiens
gugcugaucugugcugugu

SEQ ID NO: 10734 - RNA, 19 nt, Homo sapiens
guucucaccuguugauugg

SEQ ID NO: 10735 - RNA, 19 nt, Homo sapiens
gaaccuuaaacuuggcuuu

SEQ ID NO: 10736 - RNA, 19 nt, Homo sapiens
ggaagaggaaccuuaaacu

SEQ ID NO: 10737 - RNA, 19 nt, Homo sapiens
caagcuggcugcggagaau

SEQ ID NO: 10738 - RNA, 19 nt, Homo sapiens
agaaggguuuccagaguug

SEQ ID NO: 10739 - RNA, 19 nt, Homo sapiens
ggagguugaacucuagauu

SEQ ID NO: 10740 - RNA, 19 nt, Homo sapiens
aagcaggguuuccuacuuc

SEQ ID NO: 10741 - RNA, 19 nt, Homo sapiens
agggaccucugacagcuua

SEQ ID NO: 10742 - RNA, 19 nt, Homo sapiens
ccaccuacuuccucaaugg

SEQ ID NO: 10743 - RNA, 19 nt, Homo sapiens
gaacacagugaaugucucu

SEQ ID NO: 10744 - RNA, 19 nt, Homo sapiens
cuucaacaauuuccagaug

SEQ ID NO: 10745 - RNA, 19 nt, Homo sapiens
cgagaucaucgcugacuuu

SEQ ID NO: 10746 - RNA, 19 nt, Homo sapiens
ggaaguuggccaugaucuu

SEQ ID NO: 10747 - RNA, 19 nt, Homo sapiens
cuccugaccuugugaucua

SEQ ID NO: 10748 - RNA, 19 nt, Homo sapiens
gcuguguacuccugugguu

SEQ ID NO: 10749 - RNA, 19 nt, Homo sapiens
uaacagggcccagccacaa

SEQ ID NO: 10750 - RNA, 19 nt, Homo sapiens
gcugaucugugcuguguac

SEQ ID NO: 10751 - RNA, 19 nt, Homo sapiens
gggcaacacugcaguaccu

SEQ ID NO: 10752 - RNA, 19 nt, Homo sapiens
gacccugaaugagcucuuu

SEQ ID NO: 10753 - RNA, 19 nt, Homo sapiens
ggacagaggcugaggaauu

SEQ ID NO: 10754 - RNA, 19 nt, Homo sapiens
gacagaggcugaggaauuu

SEQ ID NO: 10755 - RNA, 19 nt, Homo sapiens
guagagagaugcccagguu

SEQ ID NO: 10756 - RNA, 19 nt, Homo sapiens
gugaaugucucuagucgua

SEQ ID NO: 10757 - RNA, 19 nt, Homo sapiens
uaaaguggaugaacggaaa

SEQ ID NO: 10758 - RNA, 19 nt, Homo sapiens
ggagaaaggugacccugau

SEQ ID NO: 10759 - RNA, 19 nt, Homo sapiens
gccaucagguacuucauua

SEQ ID NO: 10760 - RNA, 19 nt, Homo sapiens
gagaaggguuuccagaguu

SEQ ID NO: 10761 - RNA, 19 nt, Homo sapiens
gcacauagcaccgcaguug

SEQ ID NO: 10762 - RNA, 19 nt, Homo sapiens
ggaaauggcaguucgaugu

SEQ ID NO: 10763 - RNA, 19 nt, Homo sapiens
ggagaaggguuuccagagu

SEQ ID NO: 10764 - RNA, 19 nt, Homo sapiens
ggaccaaggugggcauuga

SEQ ID NO: 10765 - RNA, 19 nt, Homo sapiens
gagcacuccuucaacaauu

SEQ ID NO: 10766 - RNA, 19 nt, Homo sapiens
aagaagacaucaacacaaa

SEQ ID NO: 10767 - RNA, 19 nt, Homo sapiens
gaaagaagacaucaacaca

SEQ ID NO: 10768 - RNA, 19 nt, Homo sapiens
gaagaggaaccuuaaacuu

SEQ ID NO: 10769 - RNA, 19 nt, Homo sapiens
ccucuucuguugccaaaua

SEQ ID NO: 10770 - RNA, 19 nt, Homo sapiens
gaaguuggccaugaucuuu

SEQ ID NO: 10771 - RNA, 19 nt, Homo sapiens
gcagaaggguuaggagguu

SEQ ID NO: 10772 - RNA, 19 nt, Homo sapiens
cacaagaucuacauacaga

SEQ ID NO: 10773 - RNA, 19 nt, Homo sapiens
guuaggagguugaacucua

SEQ ID NO: 10774 - RNA, 19 nt, Homo sapiens
gagcaucucuuccucuucu

SEQ ID NO: 10775 - RNA, 19 nt, Homo sapiens
ccauggagaugaaagaaga

SEQ ID NO: 10776 - RNA, 19 nt, Homo sapiens
guguguggcuguuauguuu

SEQ ID NO: 10777 - RNA, 19 nt, Homo sapiens
gagagaggaucuugagaag

SEQ ID NO: 10778 - RNA, 19 nt, Homo sapiens
gcaaugaugaacucuacua

SEQ ID NO: 10779 - RNA, 19 nt, Homo sapiens
uggaggagcuacaggcaua

SEQ ID NO: 10780 - RNA, 19 nt, Homo sapiens
gaaugucucuagucguaug

SEQ ID NO: 10781 - RNA, 19 nt, Homo sapiens
ucacugcccuggcugacua

SEQ ID NO: 10782 - RNA, 19 nt, Homo sapiens
gaugaacucuacuaucagu

SEQ ID NO: 10783 - RNA, 19 nt, Homo sapiens
gggcuaccauugucccuuu

SEQ ID NO: 10784 - RNA, 19 nt, Homo sapiens
ggguggcccucaaauauau

SEQ ID NO: 10785 - RNA, 19 nt, Homo sapiens
ggaacaugcugcugagucu

SEQ ID NO: 10786 - RNA, 19 nt, Homo sapiens
ugacaggugugaaugugaa

SEQ ID NO: 10787 - RNA, 19 nt, Homo sapiens
gauaggaagagacuacuug

SEQ ID NO: 10788 - RNA, 19 nt, Homo sapiens
gaaaagaucaagacgauug

SEQ ID NO: 10789 - RNA, 19 nt, Homo sapiens
ugacaacuaugaccuacug

SEQ ID NO: 10790 - RNA, 19 nt, Homo sapiens
gugguucucuguucccuaa

SEQ ID NO: 10791 - RNA, 19 nt, Homo sapiens
caacuuaaccguggugaug

SEQ ID NO: 10792 - RNA, 19 nt, Homo sapiens
gucaggagcuggaaguuca

SEQ ID NO: 10793 - RNA, 19 nt, Homo sapiens
ggagaugaccaccuacuuc

SEQ ID NO: 10794 - RNA, 19 nt, Homo sapiens
gaugugugguccaaugaug

SEQ ID NO: 10795 - RNA, 19 nt, Homo sapiens
ggaacaaagggaccucuga

SEQ ID NO: 10796 - RNA, 19 nt, Homo sapiens
ucaacaauuuccagaugaa

SEQ ID NO: 10797 - RNA, 19 nt, Homo sapiens
aagaggaaccuuaaacuug

SEQ ID NO: 10798 - RNA, 19 nt, Homo sapiens
ucagguacuucauuaguca

SEQ ID NO: 10799 - RNA, 19 nt, Homo sapiens
gaauuuugcuugaagauca

SEQ ID NO: 10800 - RNA, 19 nt, Homo sapiens
gcuguucccucuccaaucu

SEQ ID NO: 10801 - RNA, 19 nt, Homo sapiens
ucaaugagcacuccuucaa

SEQ ID NO: 10802 - RNA, 19 nt, Homo sapiens
ggaggcugcugcauaacau

SEQ ID NO: 10803 - RNA, 19 nt, Homo sapiens
ccacaucacucgggcaaca

SEQ ID NO: 10804 - RNA, 19 nt, Homo sapiens
caccgcaguuggcaucuuu

SEQ ID NO: 10805 - RNA, 19 nt, Homo sapiens
gcagcucggugccaaugug

SEQ ID NO: 10806 - RNA, 19 nt, Homo sapiens
gagaggauuaugcaaguga

SEQ ID NO: 10807 - RNA, 19 nt, Homo sapiens
gaaauggcaguucgaugug

SEQ ID NO: 10808 - RNA, 19 nt, Homo sapiens
guccuuggcuugcggaaau

SEQ ID NO: 10809 - RNA, 19 nt, Homo sapiens
ccauguggguggugagcua

SEQ ID NO: 10810 - RNA, 19 nt, Homo sapiens
aaagcaggguuuccuacuu

SEQ ID NO: 10811 - RNA, 19 nt, Homo sapiens
ugacuuucuuucuuacuug

SEQ ID NO: 10812 - RNA, 19 nt, Homo sapiens
caccaucuuugacaacuau

SEQ ID NO: 10813 - RNA, 19 nt, Homo sapiens
aggaugagguggaugaguu

SEQ ID NO: 10814 - RNA, 19 nt, Homo sapiens
gaucuuggccuggcaacuu

SEQ ID NO: 10815 - RNA, 19 nt, Homo sapiens
gaaccauguauuucaguga

SEQ ID NO: 10816 - RNA, 19 nt, Homo sapiens
gcuugaagaucacuuuguc

SEQ ID NO: 10817 - RNA, 19 nt, Homo sapiens
cuaccuaccgagaggauua

SEQ ID NO: 10818 - RNA, 19 nt, Homo sapiens
gugcugaucugugcugugu

SEQ ID NO: 10819 - RNA, 19 nt, Homo sapiens
gaaccuuaaacuuggcuuu

SEQ ID NO: 10820 - RNA, 19 nt, Homo sapiens
ggaagaggaaccuuaaacu

SEQ ID NO: 10821 - RNA, 19 nt, Homo sapiens
caagcuggcugcggagaau

SEQ ID NO: 10822 - RNA, 19 nt, Homo sapiens
agaaggguuuccagaguug

SEQ ID NO: 10823 - RNA, 19 nt, Homo sapiens
ggagguugaacucuagauu

SEQ ID NO: 10824 - RNA, 19 nt, Homo sapiens
aagcaggguuuccuacuuc

SEQ ID NO: 10825 - RNA, 19 nt, Homo sapiens
agggaccucugacagcuua

SEQ ID NO: 10826 - RNA, 19 nt, Homo sapiens
ccaccuacuuccucaaugg

SEQ ID NO: 10827 - RNA, 19 nt, Homo sapiens
gaacacagugaaugucucu

SEQ ID NO: 10828 - RNA, 19 nt, Homo sapiens
cuucaacaauuuccagaug

SEQ ID NO: 10829 - RNA, 19 nt, Homo sapiens
cgagaucaucgcugacuuu

SEQ ID NO: 10830 - RNA, 19 nt, Homo sapiens
ggaaguuggccaugaucuu

SEQ ID NO: 10831 - RNA, 19 nt, Homo sapiens
gcuguguacuccugugguu

SEQ ID NO: 10832 - RNA, 19 nt, Homo sapiens
uaacagggcccagccacaa

SEQ ID NO: 10833 - RNA, 19 nt, Homo sapiens
gcugaucugugcuguguac

SEQ ID NO: 10834 - RNA, 19 nt, Homo sapiens
gggcaacacugcaguaccu

SEQ ID NO: 10835 - RNA, 19 nt, Homo sapiens
gacccugaaugagcucuuu

SEQ ID NO: 10836 - RNA, 19 nt, Homo sapiens
uacagaagcaugacaaugu

SEQ ID NO: 10837 - RNA, 19 nt, Homo sapiens
uagauucccuuccugucuu

SEQ ID NO: 10838 - RNA, 19 nt, Homo sapiens
gccugagucuagcauguuu

SEQ ID NO: 10839 - RNA, 19 nt, Homo sapiens
ucugacagcuuagauuuag

SEQ ID NO: 10840 - RNA, 19 nt, Homo sapiens
gugacuuucuuucuuacuu

SEQ ID NO: 10841 - RNA, 19 nt, Homo sapiens
aaugagcacuccuucaaca

SEQ ID NO: 10842 - RNA, 19 nt, Homo sapiens
uuccagaguugcuagguuu

SEQ ID NO: 10843 - RNA, 19 nt, Homo sapiens
acucuggccugaauuuguu

SEQ ID NO: 10844 - RNA, 19 nt, Homo sapiens
guaacugugugugcauguu

SEQ ID NO: 10845 - RNA, 19 nt, Homo sapiens
ccaaaucuuagucccauga

SEQ ID NO: 10846 - RNA, 19 nt, Homo sapiens
gcaugaggagugccuauuc

SEQ ID NO: 10847 - RNA, 19 nt, Homo sapiens
gugaguguguggcuguuau

SEQ ID NO: 10848 - RNA, 19 nt, Homo sapiens
caacuaugaccuacugcuu

SEQ ID NO: 10849 - RNA, 19 nt, Homo sapiens
ccaccaucuuugacaacua

SEQ ID NO: 10850 - RNA, 19 nt, Homo sapiens
gcccucagccugccuaugu

SEQ ID NO: 10851 - RNA, 19 nt, Homo sapiens
agagagaggaucuugagaa

SEQ ID NO: 10852 - RNA, 19 nt, Homo sapiens
ggugacaggugugaaugug

SEQ ID NO: 10853 - RNA, 19 nt, Homo sapiens
ccagacagauugacuauua

SEQ ID NO: 10854 - RNA, 19 nt, Homo sapiens
ggagagaggugcuuugaaa

SEQ ID NO: 10855 - RNA, 19 nt, Homo sapiens
ggaaagcacuggagaacuu

SEQ ID NO: 10856 - RNA, 19 nt, Homo sapiens
uagaagaacuugcuguaua

SEQ ID NO: 10857 - RNA, 19 nt, Homo sapiens
gcacauaaguggaaucagu

SEQ ID NO: 10858 - RNA, 19 nt, Homo sapiens
gcaaguaacuaggguuuau

SEQ ID NO: 10859 - RNA, 19 nt, Homo sapiens
guugggaguuuaacaaaua

SEQ ID NO: 10860 - RNA, 19 nt, Homo sapiens
gcagguguauucuaauuug

SEQ ID NO: 10861 - RNA, 19 nt, Homo sapiens
ggaagaagaaguucaagaa

SEQ ID NO: 10862 - RNA, 19 nt, Homo sapiens
ugaagaccaugaccaauuu

SEQ ID NO: 10863 - RNA, 19 nt, Homo sapiens
agaagaacuugcuguauaa

SEQ ID NO: 10864 - RNA, 19 nt, Homo sapiens
caaccuaacuguaacaaca

SEQ ID NO: 10865 - RNA, 19 nt, Homo sapiens
gcagauggcugugcauguu

SEQ ID NO: 10866 - RNA, 19 nt, Homo sapiens
gaccugcacuggaggauuu

SEQ ID NO: 10867 - RNA, 19 nt, Homo sapiens
ggaaggaccugaagaccau

SEQ ID NO: 10868 - RNA, 19 nt, Homo sapiens
gaaagucaaccuaacugua

SEQ ID NO: 10869 - RNA, 19 nt, Homo sapiens
ggacuacugucuagcauca

SEQ ID NO: 10870 - RNA, 19 nt, Homo sapiens
uacaauuucuccugaguua

SEQ ID NO: 10871 - RNA, 19 nt, Homo sapiens
ucaaacagguagagagaaa

SEQ ID NO: 10872 - RNA, 19 nt, Homo sapiens
cagcauauuuguacucuug

SEQ ID NO: 10873 - RNA, 19 nt, Homo sapiens
cagaagagaagaucauuaa

SEQ ID NO: 10874 - RNA, 19 nt, Homo sapiens
gggcagguguauucuaauu

SEQ ID NO: 10875 - RNA, 19 nt, Homo sapiens
gaagguuucuguugcuaau

SEQ ID NO: 10876 - RNA, 19 nt, Homo sapiens
ggacuuacuuugucuguac

SEQ ID NO: 10877 - RNA, 19 nt, Homo sapiens
gggaaacacugucaaugug

SEQ ID NO: 10878 - RNA, 19 nt, Homo sapiens
gcacaagugaggucuguuu

SEQ ID NO: 10879 - RNA, 19 nt, Homo sapiens
gaagaucauuaaccacugu

SEQ ID NO: 10880 - RNA, 19 nt, Homo sapiens
acacguaucuaacaaacaa

SEQ ID NO: 10881 - RNA, 19 nt, Homo sapiens
gcaccuaccuggucaucga

SEQ ID NO: 10882 - RNA, 19 nt, Homo sapiens
gugcugugcucagauaaua

SEQ ID NO: 10883 - RNA, 19 nt, Homo sapiens
guaaaguucuacacaaagu

SEQ ID NO: 10884 - RNA, 19 nt, Homo sapiens
ggagggcccugaccaagau

SEQ ID NO: 10885 - RNA, 19 nt, Homo sapiens
ggaauuucauggcaacaau

SEQ ID NO: 10886 - RNA, 19 nt, Homo sapiens
gcacucaguuucccuacau

SEQ ID NO: 10887 - RNA, 19 nt, Homo sapiens
ggaauggagucuguuuaga

SEQ ID NO: 10888 - RNA, 19 nt, Homo sapiens
agaagaaguucaagaagga

SEQ ID NO: 10889 - RNA, 19 nt, Homo sapiens
guguucagguuauagaaua

SEQ ID NO: 10890 - RNA, 19 nt, Homo sapiens
ggaaucaguaugaauagaa

SEQ ID NO: 10891 - RNA, 19 nt, Homo sapiens
caaauuaagaguacagcua

SEQ ID NO: 10892 - RNA, 19 nt, Homo sapiens
gcagagccuugccuuugaa

SEQ ID NO: 10893 - RNA, 19 nt, Homo sapiens
ggaugagccuggagccaaa

SEQ ID NO: 10894 - RNA, 19 nt, Homo sapiens
aaagucaaccuaacuguaa

SEQ ID NO: 10895 - RNA, 19 nt, Homo sapiens
gugagugcaucucuucuuu

SEQ ID NO: 10896 - RNA, 19 nt, Homo sapiens
gaucauuaaccacuguaua

SEQ ID NO: 10897 - RNA, 19 nt, Homo sapiens
gcaauuagccucgcuuaag

SEQ ID NO: 10898 - RNA, 19 nt, Homo sapiens
gugcaucucuucuuuccuu

SEQ ID NO: 10899 - RNA, 19 nt, Homo sapiens
gcaggcaacuuuagcacau

SEQ ID NO: 10900 - RNA, 19 nt, Homo sapiens
caauuagccucgcuuaagu

SEQ ID NO: 10901 - RNA, 19 nt, Homo sapiens
cuuuaucggugacaaguua

SEQ ID NO: 10902 - RNA, 19 nt, Homo sapiens
ccugaugccuuuccaaguu

SEQ ID NO: 10903 - RNA, 19 nt, Homo sapiens
guaacuaggguuuauucua

SEQ ID NO: 10904 - RNA, 19 nt, Homo sapiens
gagccuugccuuugaauga

SEQ ID NO: 10905 - RNA, 19 nt, Homo sapiens
guacggacacugccaaguu

SEQ ID NO: 10906 - RNA, 19 nt, Homo sapiens
aagaugcgcucuacgagaa

SEQ ID NO: 10907 - RNA, 19 nt, Homo sapiens
agagugcgaugucaacaaa

SEQ ID NO: 10908 - RNA, 19 nt, Homo sapiens
ccaaacugcccgugacuuu

SEQ ID NO: 10909 - RNA, 19 nt, Homo sapiens
ggugagaaaugaccaaacu

SEQ ID NO: 10910 - RNA, 19 nt, Homo sapiens
caacuuggacaaccuguga

SEQ ID NO: 10911 - RNA, 19 nt, Homo sapiens
uuuaaccacugacauguaa

SEQ ID NO: 10912 - RNA, 19 nt, Homo sapiens
ugacagcauuucucacaga

SEQ ID NO: 10913 - RNA, 19 nt, Homo sapiens
gagcugaggacuuacuuug

SEQ ID NO: 10914 - RNA, 19 nt, Homo sapiens
aaggcgagcugaggacuua

SEQ ID NO: 10915 - RNA, 19 nt, Homo sapiens
gcacggcccuuugcacauc

SEQ ID NO: 10916 - RNA, 19 nt, Homo sapiens
gacagacacacguaucuaa

SEQ ID NO: 10917 - RNA, 19 nt, Homo sapiens
aagggcagguguauucuaa

SEQ ID NO: 10918 - RNA, 19 nt, Homo sapiens
ccguaaaguucuacacaaa

SEQ ID NO: 10919 - RNA, 19 nt, Homo sapiens
agaaaggaauggagucugu

SEQ ID NO: 10920 - RNA, 19 nt, Homo sapiens
ugaaaucugugcucucaag

SEQ ID NO: 10921 - RNA, 19 nt, Homo sapiens
gaacuugcuguauaaagga

SEQ ID NO: 10922 - RNA, 19 nt, Homo sapiens
gaaucaguaugaauagaag

SEQ ID NO: 10923 - RNA, 19 nt, Homo sapiens
gcugaggacuuacuuuguc

SEQ ID NO: 10924 - RNA, 19 nt, Homo sapiens
gaagcuggccaucaucgaa

SEQ ID NO: 10925 - RNA, 19 nt, Homo sapiens
ucacaugaauacuauacug

SEQ ID NO: 10926 - RNA, 19 nt, Homo sapiens
ucacaugaauacuauacug

SEQ ID NO: 10927 - RNA, 19 nt, Homo sapiens
ugacugaccagacuuguug

SEQ ID NO: 10928 - RNA, 19 nt, Homo sapiens
gaacgugaaccgccuucuu

SEQ ID NO: 10929 - RNA, 19 nt, Homo sapiens
ggucggaggaugacucgua

SEQ ID NO: 10930 - RNA, 19 nt, Homo sapiens
uauacaggguugcagauug

SEQ ID NO: 10931 - RNA, 19 nt, Homo sapiens
ugugauugcuggagugauu

SEQ ID NO: 10932 - RNA, 19 nt, Homo sapiens
gaaggagcacgaggaguuu

SEQ ID NO: 10933 - RNA, 19 nt, Homo sapiens
gaagaagaaguucaagaag

SEQ ID NO: 10934 - RNA, 19 nt, Homo sapiens
caaacaaacaaacagaaga

SEQ ID NO: 10935 - RNA, 19 nt, Homo sapiens
agacacacguaucuaacaa

SEQ ID NO: 10936 - RNA, 19 nt, Homo sapiens
gaagggcagguguauucua

SEQ ID NO: 10937 - RNA, 19 nt, Homo sapiens
ugaaugaggcagcuuguga

SEQ ID NO: 10938 - RNA, 19 nt, Homo sapiens
gauggaggcagccggagua

SEQ ID NO: 10939 - RNA, 19 nt, Homo sapiens
aagagaagaucauuaacca

SEQ ID NO: 10940 - RNA, 19 nt, Homo sapiens
gggcugacuuugagaucuu

SEQ ID NO: 10941 - RNA, 19 nt, Homo sapiens
ggacuuccuuacaauuucu

SEQ ID NO: 10942 - RNA, 19 nt, Homo sapiens
gcuaugugcugguguucga

SEQ ID NO: 10943 - RNA, 19 nt, Homo sapiens
acaggagccuuuacaagau

SEQ ID NO: 10944 - RNA, 19 nt, Homo sapiens
acaacagggugagaaauga

SEQ ID NO: 10945 - RNA, 19 nt, Homo sapiens
gaauggagucuguuuagag

SEQ ID NO: 10946 - RNA, 19 nt, Homo sapiens
cagcagagccuugccuuug

SEQ ID NO: 10947 - RNA, 19 nt, Homo sapiens
ucucuucccuccaguguau

SEQ ID NO: 10948 - RNA, 19 nt, Homo sapiens
caggccagcuggagaaugu

SEQ ID NO: 10949 - RNA, 19 nt, Homo sapiens
uacggacacugccaaguuu

SEQ ID NO: 10950 - RNA, 19 nt, Homo sapiens
gggagcaggugcccuucuu

SEQ ID NO: 10951 - RNA, 19 nt, Homo sapiens
gaagaacuugcuguauaaa

SEQ ID NO: 10952 - RNA, 19 nt, Homo sapiens
uaaguggaaucaguaugaa

SEQ ID NO: 10953 - RNA, 19 nt, Homo sapiens
gaacacagcuggaaucuuc

SEQ ID NO: 10954 - RNA, 19 nt, Homo sapiens
gaacugcccuuugauaaua

SEQ ID NO: 10955 - RNA, 19 nt, Homo sapiens
gcacaaguauucucaaaug

SEQ ID NO: 10956 - RNA, 19 nt, Homo sapiens
gagcaucacugccuucgua

SEQ ID NO: 10957 - RNA, 19 nt, Homo sapiens
caauaaaucugcuuccaaa

SEQ ID NO: 10958 - RNA, 19 nt, Homo sapiens
guaaagagaggaaugaauu

SEQ ID NO: 10959 - RNA, 19 nt, Homo sapiens
gaagaccgauuucaagaca

SEQ ID NO: 10960 - RNA, 19 nt, Homo sapiens
gaaacugacugccucuaug

SEQ ID NO: 10961 - RNA, 19 nt, Homo sapiens
ccaaagaggagaucaauga

SEQ ID NO: 10962 - RNA, 19 nt, Homo sapiens
gagcacaaguauucucaaa

SEQ ID NO: 10963 - RNA, 19 nt, Homo sapiens
gcguugaccucgucuuaua

SEQ ID NO: 10964 - RNA, 19 nt, Homo sapiens
ggacgcggcucaucuguca

SEQ ID NO: 10965 - RNA, 19 nt, Homo sapiens
agaagcagcuacucaauga

SEQ ID NO: 10966 - RNA, 19 nt, Homo sapiens
gaucauugcugacuucgau

SEQ ID NO: 10967 - RNA, 19 nt, Homo sapiens
gcagugcuauucaugugua

SEQ ID NO: 10968 - RNA, 19 nt, Homo sapiens
ugacaggucuccaaauuuc

SEQ ID NO: 10969 - RNA, 19 nt, Homo sapiens
gaucaugauugccaucuau

SEQ ID NO: 10970 - RNA, 19 nt, Homo sapiens
gcuggaaucuucaucaguu

SEQ ID NO: 10971 - RNA, 19 nt, Homo sapiens
gaaaugggucucagcauga

SEQ ID NO: 10972 - RNA, 19 nt, Homo sapiens
gacaagagccaaugccuaa

SEQ ID NO: 10973 - RNA, 19 nt, Homo sapiens
gagaacaugcuccggaaua

SEQ ID NO: 10974 - RNA, 19 nt, Homo sapiens
caucacugccuucguauua

SEQ ID NO: 10975 - RNA, 19 nt, Homo sapiens
gcccugaacugcccuuuga

SEQ ID NO: 10976 - RNA, 19 nt, Homo sapiens
ucucggagcucuuggcuuu

SEQ ID NO: 10977 - RNA, 19 nt, Homo sapiens
gagagcauaucaagccauu

SEQ ID NO: 10978 - RNA, 19 nt, Homo sapiens
gagcaaaggcugcgccaaa

SEQ ID NO: 10979 - RNA, 19 nt, Homo sapiens
ggauuaaugagaccuauuu

SEQ ID NO: 10980 - RNA, 19 nt, Homo sapiens
ccacugcuguguugaaaug

SEQ ID NO: 10981 - RNA, 19 nt, Homo sapiens
gaaaugaucaacgacauga

SEQ ID NO: 10982 - RNA, 19 nt, Homo sapiens
caacaagcauucauucaac

SEQ ID NO: 10983 - RNA, 19 nt, Homo sapiens
caacucggauuucuuucuu

SEQ ID NO: 10984 - RNA, 19 nt, Homo sapiens
gcagaggauuauaaauguu

SEQ ID NO: 10985 - RNA, 19 nt, Homo sapiens
ggaaguggcaguuugaugu

SEQ ID NO: 10986 - RNA, 19 nt, Homo sapiens
ugaccaauguggaagauga

SEQ ID NO: 10987 - RNA, 19 nt, Homo sapiens
gaccagggcuuugccuuug

SEQ ID NO: 10988 - RNA, 19 nt, Homo sapiens
ccacagcagaggauuauaa

SEQ ID NO: 10989 - RNA, 19 nt, Homo sapiens
gcauuuaucguucuucuau

SEQ ID NO: 10990 - RNA, 19 nt, Homo sapiens
ucacggcaauacaaaguuu

SEQ ID NO: 10991 - RNA, 19 nt, Homo sapiens
gaggaagcauaauaucgaa

SEQ ID NO: 10992 - RNA, 19 nt, Homo sapiens
ggaagagggccaugguaaa

SEQ ID NO: 10993 - RNA, 19 nt, Homo sapiens
cuaagaaaccacaguauga

SEQ ID NO: 10994 - RNA, 19 nt, Homo sapiens
gaaccugacuuucaauucc

SEQ ID NO: 10995 - RNA, 19 nt, Homo sapiens
cagcagaggauuauaaaug

SEQ ID NO: 10996 - RNA, 19 nt, Homo sapiens
aaaguuugcuuccuucuuc

SEQ ID NO: 10997 - RNA, 19 nt, Homo sapiens
ggacuuccuuuggcgagua

SEQ ID NO: 10998 - RNA, 19 nt, Homo sapiens
uaaauauccugugguguga

SEQ ID NO: 10999 - RNA, 19 nt, Homo sapiens
gaauagaacauaccaucga

SEQ ID NO: 11000 - RNA, 19 nt, Homo sapiens
ucugacaggucuccaaauu

SEQ ID NO: 11001 - RNA, 19 nt, Homo sapiens
gaacaacaacacaggaauc

SEQ ID NO: 11002 - RNA, 19 nt, Homo sapiens
gaaaccacaguaugacauu

SEQ ID NO: 11003 - RNA, 19 nt, Homo sapiens
ugaaggagcugagggaaca

SEQ ID NO: 11004 - RNA, 19 nt, Homo sapiens
gagaagagagcauaucaag

SEQ ID NO: 11005 - RNA, 19 nt, Homo sapiens
gcgaggaacucuacaccau

SEQ ID NO: 11006 - RNA, 19 nt, Homo sapiens
gaccucgucuuauagauca

SEQ ID NO: 11007 - RNA, 19 nt, Homo sapiens
ggaccagggcuuugccuuu

SEQ ID NO: 11008 - RNA, 19 nt, Homo sapiens
aaaacuugcuguuggauua

SEQ ID NO: 11009 - RNA, 19 nt, Homo sapiens
cuacggaaguggcaguuug

SEQ ID NO: 11010 - RNA, 19 nt, Homo sapiens
ucacugccuucguauuaaa

SEQ ID NO: 11011 - RNA, 19 nt, Homo sapiens
caacaacacaggaaucauc

SEQ ID NO: 11012 - RNA, 19 nt, Homo sapiens
agaccuaucucauccugaa

SEQ ID NO: 11013 - RNA, 19 nt, Homo sapiens
caucaucuuugcauccauu

SEQ ID NO: 11014 - RNA, 19 nt, Homo sapiens
aaacuuggucugugcauuu

SEQ ID NO: 11015 - RNA, 19 nt, Homo sapiens
cauucucacugauguuuaa

SEQ ID NO: 11016 - RNA, 19 nt, Homo sapiens
gcguuuagcccgaaaguug

SEQ ID NO: 11017 - RNA, 19 nt, Homo sapiens
gaggagcuguauucucaau

SEQ ID NO: 11018 - RNA, 19 nt, Homo sapiens
ggaacacaaugagaacaug

SEQ ID NO: 11019 - RNA, 19 nt, Homo sapiens
ggagaucaaugagaugaag

SEQ ID NO: 11020 - RNA, 19 nt, Homo sapiens
ggaaacugacugccucuau

SEQ ID NO: 11021 - RNA, 19 nt, Homo sapiens
gcuaugagaacgucaguau

SEQ ID NO: 11022 - RNA, 19 nt, Homo sapiens
ggagacagagaaccaaaga

SEQ ID NO: 11023 - RNA, 19 nt, Homo sapiens
uagcaacucggauuucuuu

SEQ ID NO: 11024 - RNA, 19 nt, Homo sapiens
gaugugcgcugccuuacag

SEQ ID NO: 11025 - RNA, 19 nt, Homo sapiens
caucaagggucauuacaac

SEQ ID NO: 11026 - RNA, 19 nt, Homo sapiens
ucacugauguuuaaagacu

SEQ ID NO: 11027 - RNA, 19 nt, Homo sapiens
cugaagauaucgucaagga

SEQ ID NO: 11028 - RNA, 19 nt, Homo sapiens
gaagagggccaugguaaag

SEQ ID NO: 11029 - RNA, 19 nt, Homo sapiens
ugaccaaacucacucucuu

SEQ ID NO: 11030 - RNA, 19 nt, Homo sapiens
gcuaagaaaccacaguaug

SEQ ID NO: 11031 - RNA, 19 nt, Homo sapiens
gaucaacaagcauucauuc

SEQ ID NO: 11032 - RNA, 19 nt, Homo sapiens
aagaggagaucaaugagau

SEQ ID NO: 11033 - RNA, 19 nt, Homo sapiens
gcauugagguagugaucug

SEQ ID NO: 11034 - RNA, 19 nt, Homo sapiens
agacugaaaugaauaacca

SEQ ID NO: 11035 - RNA, 19 nt, Homo sapiens
gcuguauucucaauccuau

SEQ ID NO: 11036 - RNA, 19 nt, Homo sapiens
ucuaugcccugcucacuga

SEQ ID NO: 11037 - RNA, 19 nt, Homo sapiens
gcgauaaauugagaagaga

SEQ ID NO: 11038 - RNA, 19 nt, Homo sapiens
uugcagauguuaaaggauu

SEQ ID NO: 11039 - RNA, 19 nt, Homo sapiens
gcgcaacuccuucaaaucu

SEQ ID NO: 11040 - RNA, 19 nt, Homo sapiens
gagaacaacaacacaggaa

SEQ ID NO: 11041 - RNA, 19 nt, Homo sapiens
agaccgauuucaagacauu

SEQ ID NO: 11042 - RNA, 19 nt, Homo sapiens
cacaaguauucucaaauga

SEQ ID NO: 11043 - RNA, 19 nt, Homo sapiens
ggcgauaaauugagaagag

SEQ ID NO: 11044 - RNA, 19 nt, Homo sapiens
gaguggcgauaaauugaga

SEQ ID NO: 11045 - RNA, 19 nt, Homo sapiens
uaaaucugcuuccaaacca

SEQ ID NO: 11046 - RNA, 19 nt, Homo sapiens
aaucggaaguggugaugaa

SEQ ID NO: 11047 - RNA, 19 nt, Homo sapiens
gaaccuggcaagccgaaug

SEQ ID NO: 11048 - RNA, 19 nt, Homo sapiens
gcgcuaagaaaccacagua

SEQ ID NO: 11049 - RNA, 19 nt, Homo sapiens
gcauacaggagaucaacaa

SEQ ID NO: 11050 - RNA, 19 nt, Homo sapiens
aaugagggaugaaguguuc

SEQ ID NO: 11051 - RNA, 19 nt, Homo sapiens
uaugagaacgucaguauuc

SEQ ID NO: 11052 - RNA, 19 nt, Homo sapiens
ucggauuucuuucuuaaug

SEQ ID NO: 11053 - RNA, 19 nt, Homo sapiens
gcaaagccauagagaaaga

SEQ ID NO: 11054 - RNA, 19 nt, Homo sapiens
gaucauggcuuuggguauu

SEQ ID NO: 11055 - RNA, 19 nt, Homo sapiens
gagaggaacccgugcaaua

SEQ ID NO: 11056 - RNA, 19 nt, Homo sapiens
ggcgacagcuccaaccuua

SEQ ID NO: 11057 - RNA, 19 nt, Homo sapiens
ugaaagguuugaagacaua

SEQ ID NO: 11058 - RNA, 19 nt, Homo sapiens
gaaagacgacugugacgaa

SEQ ID NO: 11059 - RNA, 19 nt, Homo sapiens
gaagacagccugaugaaag

SEQ ID NO: 11060 - RNA, 19 nt, Homo sapiens
gauauaaagugccaguaau

SEQ ID NO: 11061 - RNA, 19 nt, Homo sapiens
gacccgaccucucuaugua

SEQ ID NO: 11062 - RNA, 19 nt, Homo sapiens
gcccacagauacuugcuua

SEQ ID NO: 11063 - RNA, 19 nt, Homo sapiens
aggaagaggucauaaagaa

SEQ ID NO: 11064 - RNA, 19 nt, Homo sapiens
agagggaaauaccaaauaa

SEQ ID NO: 11065 - RNA, 19 nt, Homo sapiens
ccaagcagcuguccuccaa

SEQ ID NO: 11066 - RNA, 19 nt, Homo sapiens
ccaccaagcugcuguacga

SEQ ID NO: 11067 - RNA, 19 nt, Homo sapiens
gcaaaguucacauuucuga

SEQ ID NO: 11068 - RNA, 19 nt, Homo sapiens
caaauaaacauccgagguu

SEQ ID NO: 11069 - RNA, 19 nt, Homo sapiens
cacaugagauccagacuga

SEQ ID NO: 11070 - RNA, 19 nt, Homo sapiens
gagagggaaauaccaaaua

SEQ ID NO: 11071 - RNA, 19 nt, Homo sapiens
ucaccaagcucaacguuuc

SEQ ID NO: 11072 - RNA, 19 nt, Homo sapiens
gguaugcgcucuucuacau

SEQ ID NO: 11073 - RNA, 19 nt, Homo sapiens
gaacaaaagcugugguuaa

SEQ ID NO: 11074 - RNA, 19 nt, Homo sapiens
gcaccaagauccagagcau

SEQ ID NO: 11075 - RNA, 19 nt, Homo sapiens
guauuuggcuguugugcuu

SEQ ID NO: 11076 - RNA, 19 nt, Homo sapiens
gguguuauguggucauuuc

SEQ ID NO: 11077 - RNA, 19 nt, Homo sapiens
ggaggugguucucgucuuc

SEQ ID NO: 11078 - RNA, 19 nt, Homo sapiens
gaaccuggccaaucucaug

SEQ ID NO: 11079 - RNA, 19 nt, Homo sapiens
ugaggagguuuaaauuuga

SEQ ID NO: 11080 - RNA, 19 nt, Homo sapiens
gaucgaagaagucaguauu

SEQ ID NO: 11081 - RNA, 19 nt, Homo sapiens
ggaaggagcccgucaaagc

SEQ ID NO: 11082 - RNA, 19 nt, Homo sapiens
agacaucucuggguucuga

SEQ ID NO: 11083 - RNA, 19 nt, Homo sapiens
ugacgaaacaggaauagaa

SEQ ID NO: 11084 - RNA, 19 nt, Homo sapiens
agaccuaccuguacccaaa

SEQ ID NO: 11085 - RNA, 19 nt, Homo sapiens
gaagaugggaaaguuauug

SEQ ID NO: 11086 - RNA, 19 nt, Homo sapiens
caguggagaucauggcuuu

SEQ ID NO: 11087 - RNA, 19 nt, Homo sapiens
gcucaacguuucaaagagu

SEQ ID NO: 11088 - RNA, 19 nt, Homo sapiens
caagaugggcuaugacuuc

SEQ ID NO: 11089 - RNA, 19 nt, Homo sapiens
guuccugaaucgcgaauuu

SEQ ID NO: 11090 - RNA, 19 nt, Homo sapiens
caaagaagacagccugaug

SEQ ID NO: 11091 - RNA, 19 nt, Homo sapiens
agaaggagauggugaacau

SEQ ID NO: 11092 - RNA, 19 nt, Homo sapiens
caagaugagugccaacaag

SEQ ID NO: 11093 - RNA, 19 nt, Homo sapiens
cauagccgaugacuuaaug

SEQ ID NO: 11094 - RNA, 19 nt, Homo sapiens
gcaugaggagguuuaaauu

SEQ ID NO: 11095 - RNA, 19 nt, Homo sapiens
ucaaagagaggaugauuca

SEQ ID NO: 11096 - RNA, 19 nt, Homo sapiens
cgaaacacaguaauauuug

SEQ ID NO: 11097 - RNA, 19 nt, Homo sapiens
gcagggagaugaggagagu

SEQ ID NO: 11098 - RNA, 19 nt, Homo sapiens
cagacuggcugcugaggaa

SEQ ID NO: 11099 - RNA, 19 nt, Homo sapiens
gggaaaggccagaugaaga

SEQ ID NO: 11100 - RNA, 19 nt, Homo sapiens
ugagcaagaugggcuauga

SEQ ID NO: 11101 - RNA, 19 nt, Homo sapiens
gaagaggucauaaagaacu

SEQ ID NO: 11102 - RNA, 19 nt, Homo sapiens
cgaaauggaagaugggaaa

SEQ ID NO: 11103 - RNA, 19 nt, Homo sapiens
cgaaacaggaauagaagaa

SEQ ID NO: 11104 - RNA, 19 nt, Homo sapiens
augaggagguuuaaauuug

SEQ ID NO: 11105 - RNA, 19 nt, Homo sapiens
gaagaaaggggucgauuug

SEQ ID NO: 11106 - RNA, 19 nt, Homo sapiens
gaaaacggacgcccacuuu

SEQ ID NO: 11107 - RNA, 19 nt, Homo sapiens
caugaggagguuuaaauuu

SEQ ID NO: 11108 - RNA, 19 nt, Homo sapiens
gagaugggccugggcauga

SEQ ID NO: 11109 - RNA, 19 nt, Homo sapiens
gugaggagaccaaguguga

SEQ ID NO: 11110 - RNA, 19 nt, Homo sapiens
gcacacaugcgcacacaca

SEQ ID NO: 11111 - RNA, 19 nt, Homo sapiens
acaacaacaugcugugguu

SEQ ID NO: 11112 - RNA, 19 nt, Homo sapiens
ucaagaacauccgggagaa

SEQ ID NO: 11113 - RNA, 19 nt, Homo sapiens
cggcaaaguucacauuucu

SEQ ID NO: 11114 - RNA, 19 nt, Homo sapiens
ucaaggccaucgagcaguu

SEQ ID NO: 11115 - RNA, 19 nt, Homo sapiens
ugauauaaagugccaguaa

SEQ ID NO: 11116 - RNA, 19 nt, Homo sapiens
acacacacuugcauucaug

SEQ ID NO: 11117 - RNA, 19 nt, Homo sapiens
ccaacgaacucaccaagcu

SEQ ID NO: 11118 - RNA, 19 nt, Homo sapiens
aaagaagacagccugauga

SEQ ID NO: 11119 - RNA, 19 nt, Homo sapiens
guugaaagguuugaagaca

SEQ ID NO: 11120 - RNA, 19 nt, Homo sapiens
gcacacacacuugcauuca

SEQ ID NO: 11121 - RNA, 19 nt, Homo sapiens
caaaagcugugguuaagau

SEQ ID NO: 11122 - RNA, 19 nt, Homo sapiens
cgucaaagccgaagaaagg

SEQ ID NO: 11123 - RNA, 19 nt, Homo sapiens
aagacagccugaugaaaga

SEQ ID NO: 11124 - RNA, 19 nt, Homo sapiens
gaugaagaccuaccuguac

SEQ ID NO: 11125 - RNA, 19 nt, Homo sapiens
uggaggaccuaaucccaaa

SEQ ID NO: 11126 - RNA, 19 nt, Homo sapiens
gugggcuucuuucuguuua

SEQ ID NO: 11127 - RNA, 19 nt, Homo sapiens
caucagggaaugucaguga

SEQ ID NO: 11128 - RNA, 19 nt, Homo sapiens
gcugaccaguugaaagguu

SEQ ID NO: 11129 - RNA, 19 nt, Homo sapiens
aaagacgacugugacgaaa

SEQ ID NO: 11130 - RNA, 19 nt, Homo sapiens
caagacaucucuggguucu

SEQ ID NO: 11131 - RNA, 19 nt, Homo sapiens
ggaaaggccagaugaagac

SEQ ID NO: 11132 - RNA, 19 nt, Homo sapiens
acagccugaugaaagauua

SEQ ID NO: 11133 - RNA, 19 nt, Homo sapiens
ggaagaugggaaaguuauu

SEQ ID NO: 11134 - RNA, 19 nt, Homo sapiens
aauggaagaugggaaaguu

SEQ ID NO: 11135 - RNA, 19 nt, Homo sapiens
gaggagaccaagugugaga

SEQ ID NO: 11136 - RNA, 19 nt, Homo sapiens
gcagaucgaagaagucagu

SEQ ID NO: 11137 - RNA, 19 nt, Homo sapiens
gucaugcacuuaccuuugu

SEQ ID NO: 11138 - RNA, 19 nt, Homo sapiens
gagggaaauaccaaauaaa

SEQ ID NO: 11139 - RNA, 19 nt, Homo sapiens
ggagagggaaauaccaaau

SEQ ID NO: 11140 - RNA, 19 nt, Homo sapiens
agacgacugugacgaaaca

SEQ ID NO: 11141 - RNA, 19 nt, Homo sapiens
gaggagaagcucaccaaca

SEQ ID NO: 11142 - RNA, 19 nt, Homo sapiens
ggagaccaagugugagaaa

SEQ ID NO: 11143 - RNA, 19 nt, Homo sapiens
ugugugggcuucuuucugu

SEQ ID NO: 11144 - RNA, 19 nt, Homo sapiens
uugaagacauaccugauau

SEQ ID NO: 11145 - RNA, 19 nt, Homo sapiens
gcagauaucgugggcuuca

SEQ ID NO: 11146 - RNA, 19 nt, Homo sapiens
ccaugucaccuccgaauau

SEQ ID NO: 11147 - RNA, 19 nt, Homo sapiens
gugaagacguuugcuaguc

SEQ ID NO: 11148 - RNA, 19 nt, Homo sapiens
ggcaugaggagguuuaaau

SEQ ID NO: 11149 - RNA, 19 nt, Homo sapiens
cgaagaagucaguauuuua

SEQ ID NO: 11150 - RNA, 19 nt, Homo sapiens
gagaugaggagagugagaa

SEQ ID NO: 11151 - RNA, 19 nt, Homo sapiens
gggaaauaccaaauaaaca

SEQ ID NO: 11152 - RNA, 19 nt, Homo sapiens
gaauagaagaagccaacga

SEQ ID NO: 11153 - RNA, 19 nt, Homo sapiens
guaaagauauggagaauug

SEQ ID NO: 11154 - RNA, 19 nt, Homo sapiens
gaaauggacugguuugaga

SEQ ID NO: 11155 - RNA, 19 nt, Homo sapiens
acaaauggcugucaagaaa

SEQ ID NO: 11156 - RNA, 19 nt, Homo sapiens
gggaagagguauaaacaaa

SEQ ID NO: 11157 - RNA, 19 nt, Homo sapiens
ggaaauggaugcaaaguac

SEQ ID NO: 11158 - RNA, 19 nt, Homo sapiens
ugacaggccugaagauauu

SEQ ID NO: 11159 - RNA, 19 nt, Homo sapiens
ggacgacccuggaaaugga

SEQ ID NO: 11160 - RNA, 19 nt, Homo sapiens
gcacaaggauugaaaauuc

SEQ ID NO: 11161 - RNA, 19 nt, Homo sapiens
aaacaaaggacgccgaaua

SEQ ID NO: 11162 - RNA, 19 nt, Homo sapiens
gaacaaagugaaggacaua

SEQ ID NO: 11163 - RNA, 19 nt, Homo sapiens
agagagaaguucauacaaa

SEQ ID NO: 11164 - RNA, 19 nt, Homo sapiens
ggaaacaaauggcugucaa

SEQ ID NO: 11165 - RNA, 19 nt, Homo sapiens
guaguugucucucuucaga

SEQ ID NO: 11166 - RNA, 19 nt, Homo sapiens
gagagaaguucauacaaag

SEQ ID NO: 11167 - RNA, 19 nt, Homo sapiens
gaaacccgcugccagacuu

SEQ ID NO: 11168 - RNA, 19 nt, Homo sapiens
ugaaggacauagagguaua

SEQ ID NO: 11169 - RNA, 19 nt, Homo sapiens
gaagagguauaaacaaagg

SEQ ID NO: 11170 - RNA, 19 nt, Homo sapiens
aaauggcugucaagaaaua

SEQ ID NO: 11171 - RNA, 19 nt, Homo sapiens
ggacauagagguauauugg

SEQ ID NO: 11172 - RNA, 19 nt, Homo sapiens
caacagcucgauccaaauu

SEQ ID NO: 11173 - RNA, 19 nt, Homo sapiens
gguggcaauuccaauauuu

SEQ ID NO: 11174 - RNA, 19 nt, Homo sapiens
ucacuucucuuaaacuugu

SEQ ID NO: 11175 - RNA, 19 nt, Homo sapiens
ggaacaaagugaaggacau

SEQ ID NO: 11176 - RNA, 19 nt, Homo sapiens
cuacaaagcacuagagaau

SEQ ID NO: 11177 - RNA, 19 nt, Homo sapiens
uaacgaggccuaccgcaaa

SEQ ID NO: 11178 - RNA, 19 nt, Homo sapiens
aacaacagcucgauccaaa

SEQ ID NO: 11179 - RNA, 19 nt, Homo sapiens
uugaggaacuguacagaaa

SEQ ID NO: 11180 - RNA, 19 nt, Homo sapiens
cacuaaauaugaacccuuu

SEQ ID NO: 11181 - RNA, 19 nt, Homo sapiens
gcaggcacuuauuguaaau

SEQ ID NO: 11182 - RNA, 19 nt, Homo sapiens
acauagagguauauuggaa

SEQ ID NO: 11183 - RNA, 19 nt, Homo sapiens
gcaauuggaacaaagugaa

SEQ ID NO: 11184 - RNA, 19 nt, Homo sapiens
uaacucaacugggcucugu

SEQ ID NO: 11185 - RNA, 19 nt, Homo sapiens
cuucucaucuugugaaaug

SEQ ID NO: 11186 - RNA, 19 nt, Homo sapiens
agucaucgcucguguguuc

SEQ ID NO: 11187 - RNA, 19 nt, Homo sapiens
gaugcaggcacuuauugua

SEQ ID NO: 11188 - RNA, 19 nt, Homo sapiens
cuccugcacuguuuaagua

SEQ ID NO: 11189 - RNA, 19 nt, Homo sapiens
ccagggagauuuugaggua

SEQ ID NO: 11190 - RNA, 19 nt, Homo sapiens
acuagagaaugcacagaua

SEQ ID NO: 11191 - RNA, 19 nt, Homo sapiens
auacagcccugacgcaaug

SEQ ID NO: 11192 - RNA, 19 nt, Homo sapiens
gcucguguguucuauccaa

SEQ ID NO: 11193 - RNA, 19 nt, Homo sapiens
gaugcaaaguacaaugugu

SEQ ID NO: 11194 - RNA, 19 nt, Homo sapiens
gaaugcacagauauacuuu

SEQ ID NO: 11195 - RNA, 19 nt, Homo sapiens
gggcauucuuucccaguga

SEQ ID NO: 11196 - RNA, 19 nt, Homo sapiens
uagagaaugcacagauaua

SEQ ID NO: 11197 - RNA, 19 nt, Homo sapiens
acaaagcacuagagaaugc

SEQ ID NO: 11198 - RNA, 19 nt, Homo sapiens
cgcccgagcuguuuauguu

SEQ ID NO: 11199 - RNA, 19 nt, Homo sapiens
guauagagagaaguucaua

SEQ ID NO: 11200 - RNA, 19 nt, Homo sapiens
ggaggacgacccuggaaau

SEQ ID NO: 11201 - RNA, 19 nt, Homo sapiens
ggguggcaauuccaauauu

SEQ ID NO: 11202 - RNA, 19 nt, Homo sapiens
uguagccacuaguaaguaa

SEQ ID NO: 11203 - RNA, 19 nt, Homo sapiens
gagcuacccuuuuccuuug

SEQ ID NO: 11204 - RNA, 19 nt, Homo sapiens
ggcagagccugagguggua

SEQ ID NO: 11205 - RNA, 19 nt, Homo sapiens
gagguaaagauauggagaa

SEQ ID NO: 11206 - RNA, 19 nt, Homo sapiens
uuugaaaccugcucuguag

SEQ ID NO: 11207 - RNA, 19 nt, Homo sapiens
uauuggaaauggaugcaaa

SEQ ID NO: 11208 - RNA, 19 nt, Homo sapiens
caugacaggccugaagaua

SEQ ID NO: 11209 - RNA, 19 nt, Homo sapiens
ggaagagguauaaacaaag

SEQ ID NO: 11210 - RNA, 19 nt, Homo sapiens
ugcaggcacuuauuguaaa

SEQ ID NO: 11211 - RNA, 19 nt, Homo sapiens
guccaugcuucucaucuug

SEQ ID NO: 11212 - RNA, 19 nt, Homo sapiens
ggaaauggacugguuugag

SEQ ID NO: 11213 - RNA, 19 nt, Homo sapiens
uacaaagcgugcacaagga

SEQ ID NO: 11214 - RNA, 19 nt, Homo sapiens
gauauacuuuguggaccaa

SEQ ID NO: 11215 - RNA, 19 nt, Homo sapiens
gguauaaacaaaggguuaa

SEQ ID NO: 11216 - RNA, 19 nt, Homo sapiens
uaugaacccuuuguuucuu

SEQ ID NO: 11217 - RNA, 19 nt, Homo sapiens
aauaugaacccuuuguuuc

SEQ ID NO: 11218 - RNA, 19 nt, Homo sapiens
aaaggacgccgaauagcuu

SEQ ID NO: 11219 - RNA, 19 nt, Homo sapiens
ccacuaguaaguaauuaug

SEQ ID NO: 11220 - RNA, 19 nt, Homo sapiens
ucccagugguccugacuuu

SEQ ID NO: 11221 - RNA, 19 nt, Homo sapiens
gaaacaaauggcugucaag

SEQ ID NO: 11222 - RNA, 19 nt, Homo sapiens
guuaccagcuacccugugu

SEQ ID NO: 11223 - RNA, 19 nt, Homo sapiens
aaacaaauggcugucaaga

SEQ ID NO: 11224 - RNA, 19 nt, Homo sapiens
gaaggacauagagguauau

SEQ ID NO: 11225 - RNA, 19 nt, Homo sapiens
cuacccuccugcacuguuu

SEQ ID NO: 11226 - RNA, 19 nt, Homo sapiens
gaaauggaugcaaaguaca

SEQ ID NO: 11227 - RNA, 19 nt, Homo sapiens
agaaugcacagauauacuu

SEQ ID NO: 11228 - RNA, 19 nt, Homo sapiens
cagcuacccuguguauaca

SEQ ID NO: 11229 - RNA, 19 nt, Homo sapiens
acagcucgauccaaauugu

SEQ ID NO: 11230 - RNA, 19 nt, Homo sapiens
ccagcuacccuguguauac

SEQ ID NO: 11231 - RNA, 19 nt, Homo sapiens
caaaggacgccgaauagcu

SEQ ID NO: 11232 - RNA, 19 nt, Homo sapiens
ggagcuacccuuuuccuuu

SEQ ID NO: 11233 - RNA, 19 nt, Homo sapiens
auagagguauauuggaaga

SEQ ID NO: 11234 - RNA, 19 nt, Homo sapiens
cauuugcuacuguacauaa

SEQ ID NO: 11235 - RNA, 19 nt, Homo sapiens
auacuuuguggaccaauua

SEQ ID NO: 11236 - RNA, 19 nt, Homo sapiens
uauacuuuguggaccaauu

SEQ ID NO: 11237 - RNA, 19 nt, Homo sapiens
uggaaauggaugcaaagua

SEQ ID NO: 11238 - RNA, 19 nt, Homo sapiens
cuaaauaugaacccuuugu

SEQ ID NO: 11239 - RNA, 19 nt, Homo sapiens
caaauggcugucaagaaau

SEQ ID NO: 11240 - RNA, 19 nt, Homo sapiens
cugggaagcugagggcaaa

SEQ ID NO: 11241 - RNA, 19 nt, Homo sapiens
gcuggucuaugggauaauc

SEQ ID NO: 11242 - RNA, 19 nt, Homo sapiens
caaagugaaggacauagag

SEQ ID NO: 11243 - RNA, 19 nt, Homo sapiens
acccuuuguuucuuguuua

SEQ ID NO: 11244 - RNA, 19 nt, Homo sapiens
ugaaaccugcucuguagga

SEQ ID NO: 11245 - RNA, 19 nt, Homo sapiens
gaggacgacccuggaaaug

SEQ ID NO: 11246 - RNA, 19 nt, Homo sapiens
ggaucaggccagaggaaga

SEQ ID NO: 11247 - RNA, 19 nt, Homo sapiens
uuagggcaauuggaacaaa

SEQ ID NO: 11248 - RNA, 19 nt, Homo sapiens
cuacagccgcuaccggaaa

SEQ ID NO: 11249 - RNA, 19 nt, Homo sapiens
uuuccaaacugacucaaca

SEQ ID NO: 11250 - RNA, 19 nt, Homo sapiens
cugcuggucuaugggauaa

SEQ ID NO: 11251 - RNA, 19 nt, Homo sapiens
gaagauauuacuacuuacc

SEQ ID NO: 11252 - RNA, 19 nt, Homo sapiens
cuagagaaugcacagauau

SEQ ID NO: 11253 - RNA, 19 nt, Homo sapiens
ggagauacuucuacuggua

SEQ ID NO: 11254 - RNA, 19 nt, Homo sapiens
gcuggaaggugaaccguua

SEQ ID NO: 11255 - RNA, 19 nt, Homo sapiens
gggaaagacucguguuuga

SEQ ID NO: 11256 - RNA, 19 nt, Homo sapiens
ggaauccacuacacaguau

SEQ ID NO: 11257 - RNA, 19 nt, Homo sapiens
gaaaggagauacuucuacu

SEQ ID NO: 11258 - RNA, 19 nt, Homo sapiens
gacaguaacuccuuagauc

SEQ ID NO: 11259 - RNA, 19 nt, Homo sapiens
gaucaaaggcccugugguu

SEQ ID NO: 11260 - RNA, 19 nt, Homo sapiens
gacacaggcugcugggaua

SEQ ID NO: 11261 - RNA, 19 nt, Homo sapiens
ggaccaggauuauuacuac

SEQ ID NO: 11262 - RNA, 19 nt, Homo sapiens
gcccugagcucuuccgaau

SEQ ID NO: 11263 - RNA, 19 nt, Homo sapiens
cugaugggcuucaaugauu

SEQ ID NO: 11264 - RNA, 19 nt, Homo sapiens
aagcggagaucaagcgaaa

SEQ ID NO: 11265 - RNA, 19 nt, Homo sapiens
gcaaugaguccagcaucua

SEQ ID NO: 11266 - RNA, 19 nt, Homo sapiens
gggcuacgcugagacucua

SEQ ID NO: 11267 - RNA, 19 nt, Homo sapiens
ccuguggguuugaugaaua

SEQ ID NO: 11268 - RNA, 19 nt, Homo sapiens
gcacugcacacgcaacuuc

SEQ ID NO: 11269 - RNA, 19 nt, Homo sapiens
gagaccuucuucccugaaa

SEQ ID NO: 11270 - RNA, 19 nt, Homo sapiens
uggcuguucucuacuguuu

SEQ ID NO: 11271 - RNA, 19 nt, Homo sapiens
gcucuaucaugguuaacuu

SEQ ID NO: 11272 - RNA, 19 nt, Homo sapiens
uuacuucgcuguggacuuc

SEQ ID NO: 11273 - RNA, 19 nt, Homo sapiens
gaucuccgucuucaucaaa

SEQ ID NO: 11274 - RNA, 19 nt, Homo sapiens
acccuucccucauuacuuu

SEQ ID NO: 11275 - RNA, 19 nt, Homo sapiens
ccaugugccuggagaagau

SEQ ID NO: 11276 - RNA, 19 nt, Homo sapiens
ucaaagacuggauucugua

SEQ ID NO: 11277 - RNA, 19 nt, Homo sapiens
gagcugaugggcuucaaug

SEQ ID NO: 11278 - RNA, 19 nt, Homo sapiens
ccugagcucuuccgaaucu

SEQ ID NO: 11279 - RNA, 19 nt, Homo sapiens
gcacccagcucuccauccu

SEQ ID NO: 11280 - RNA, 19 nt, Homo sapiens
uaucaugguuaacuuugug

SEQ ID NO: 11281 - RNA, 19 nt, Homo sapiens
cggaauccacuacacagua

SEQ ID NO: 11282 - RNA, 19 nt, Homo sapiens
caguggugcuggccaagaa

SEQ ID NO: 11283 - RNA, 19 nt, Homo sapiens
gggaccaggauuauuacua

SEQ ID NO: 11284 - RNA, 19 nt, Homo sapiens
ggcaaugaguccagcaucu

SEQ ID NO: 11285 - RNA, 19 nt, Homo sapiens
gguuggcucuaucaugguu

SEQ ID NO: 11286 - RNA, 19 nt, Homo sapiens
guaaggccgucaugguuuu

SEQ ID NO: 11287 - RNA, 19 nt, Homo sapiens
caaagacuggauucuguau

SEQ ID NO: 11288 - RNA, 19 nt, Homo sapiens
ccuuagaucucucagacau

SEQ ID NO: 11289 - RNA, 19 nt, Homo sapiens
gcauuaucgucauccuugu

SEQ ID NO: 11290 - RNA, 19 nt, Homo sapiens
cgaaaccauuggagagucu

SEQ ID NO: 11291 - RNA, 19 nt, Homo sapiens
gcugaugggcuucaaugau

SEQ ID NO: 11292 - RNA, 19 nt, Homo sapiens
cugagacucuacuuugaug

SEQ ID NO: 11293 - RNA, 19 nt, Homo sapiens
gccuguaccucuucacucu

SEQ ID NO: 11294 - RNA, 19 nt, Homo sapiens
ugugguggcuguucucuac

SEQ ID NO: 11295 - RNA, 19 nt, Homo sapiens
ggaaagacucguguuugag

SEQ ID NO: 11296 - RNA, 19 nt, Homo sapiens
cgucauccuugugcagaaa

SEQ ID NO: 11297 - RNA, 19 nt, Homo sapiens
gcuggugucgugcacguuu

SEQ ID NO: 11298 - RNA, 19 nt, Homo sapiens
gcugcugggauaugaauga

SEQ ID NO: 11299 - RNA, 19 nt, Homo sapiens
acaggcugcugggauauga

SEQ ID NO: 11300 - RNA, 19 nt, Homo sapiens
uguaaggccgucaugguuu

SEQ ID NO: 11301 - RNA, 19 nt, Homo sapiens
ugagggcgaucuccgucuu

SEQ ID NO: 11302 - RNA, 19 nt, Homo sapiens
cccagagaaugucagcaaa

SEQ ID NO: 11303 - RNA, 19 nt, Homo sapiens
augguuaacuuugugcuuu

SEQ ID NO: 11304 - RNA, 19 nt, Homo sapiens
gcucuguggugggugauca

SEQ ID NO: 11305 - RNA, 19 nt, Homo sapiens
ggaauguaaggccgucaug

SEQ ID NO: 11306 - RNA, 19 nt, Homo sapiens
caucaaagacuggauucug

SEQ ID NO: 11307 - RNA, 19 nt, Homo sapiens
uggguuugaugaauaugaa

SEQ ID NO: 11308 - RNA, 19 nt, Homo sapiens
cgcugagacucuacuuuga

SEQ ID NO: 11309 - RNA, 19 nt, Homo sapiens
ugacaguaacuccuuagau

SEQ ID NO: 11310 - RNA, 19 nt, Homo sapiens
gaaaauggcgaagcuggaa

SEQ ID NO: 11311 - RNA, 19 nt, Homo sapiens
gcugagacucuacuuugau

SEQ ID NO: 11312 - RNA, 19 nt, Homo sapiens
ggauuauuacuaccuguca

SEQ ID NO: 11313 - RNA, 19 nt, Homo sapiens
ccaacuacuucuggcuguu

SEQ ID NO: 11314 - RNA, 19 nt, Homo sapiens
aucaaagacuggauucugu

SEQ ID NO: 11315 - RNA, 19 nt, Homo sapiens
ccauuggagagucugauuu

SEQ ID NO: 11316 - RNA, 19 nt, Homo sapiens
ggaaggugaaccguuacuu

SEQ ID NO: 11317 - RNA, 19 nt, Homo sapiens
ugaugggcuucaaugauuc

SEQ ID NO: 11318 - RNA, 19 nt, Homo sapiens
agaaggagcaagccaugug

SEQ ID NO: 11319 - RNA, 19 nt, Homo sapiens
acgcugagacucuacuuug

SEQ ID NO: 11320 - RNA, 19 nt, Homo sapiens
ugaaaggagauacuucuac

SEQ ID NO: 11321 - RNA, 19 nt, Homo sapiens
aagacuggauucuguaugc

SEQ ID NO: 11322 - RNA, 19 nt, Homo sapiens
auuacuaccugucagugaa

SEQ ID NO: 11323 - RNA, 19 nt, Homo sapiens
ggagaccuucuucccugaa

SEQ ID NO: 11324 - RNA, 19 nt, Homo sapiens
cauucugacugcaucuuca

SEQ ID NO: 11325 - RNA, 19 nt, Homo sapiens
uggugacaguaacuccuua

SEQ ID NO: 11326 - RNA, 19 nt, Homo sapiens
aagggaaagacucguguuu

SEQ ID NO: 11327 - RNA, 19 nt, Homo sapiens
ggagaccgaaaccauugga

SEQ ID NO: 11328 - RNA, 19 nt, Homo sapiens
gagggccaaugagcugaug

SEQ ID NO: 11329 - RNA, 19 nt, Homo sapiens
gcccugugguuggcucuau

SEQ ID NO: 11330 - RNA, 19 nt, Homo sapiens
gagcucuuccgaaucuuca

SEQ ID NO: 11331 - RNA, 19 nt, Homo sapiens
uggccucccugcugacaau

SEQ ID NO: 11332 - RNA, 19 nt, Homo sapiens
aauccacuacacaguauuu

SEQ ID NO: 11333 - RNA, 19 nt, Homo sapiens
caacuacuucuggcuguuc

SEQ ID NO: 11334 - RNA, 19 nt, Homo sapiens
ggcgaucuccgucuucauc

SEQ ID NO: 11335 - RNA, 19 nt, Homo sapiens
gguccacccugcugcucau

SEQ ID NO: 11336 - RNA, 19 nt, Homo sapiens
gcauucugacugcaucuuc

SEQ ID NO: 11337 - RNA, 19 nt, Homo sapiens
cgaucuccgucuucaucaa

SEQ ID NO: 11338 - RNA, 19 nt, Homo sapiens
gacaugggaggcaaugagu

SEQ ID NO: 11339 - RNA, 19 nt, Homo sapiens
ugaaccuguuugugucguu

SEQ ID NO: 11340 - RNA, 19 nt, Homo sapiens
gaagaggccuuucuagaau

SEQ ID NO: 11341 - RNA, 19 nt, Homo sapiens
cagcuuaucuacaaucaua

SEQ ID NO: 11342 - RNA, 19 nt, Homo sapiens
ccagaaagaugcccuaguu

SEQ ID NO: 11343 - RNA, 19 nt, Homo sapiens
ggaagaggccuuucuagaa

SEQ ID NO: 11344 - RNA, 19 nt, Homo sapiens
gcacucggcuucccaaugu

SEQ ID NO: 11345 - RNA, 19 nt, Homo sapiens
ggucucagcuuaucuacaa

SEQ ID NO: 11346 - RNA, 19 nt, Homo sapiens
gcagggagguggagaggaa

SEQ ID NO: 11347 - RNA, 19 nt, Homo sapiens
uaaagaggauggacauaga

SEQ ID NO: 11348 - RNA, 19 nt, Homo sapiens
guagagcacuuuucacuua

SEQ ID NO: 11349 - RNA, 19 nt, Homo sapiens
caaaggagagaaguuauua

SEQ ID NO: 11350 - RNA, 19 nt, Homo sapiens
gaacauggcaccagaccuu

SEQ ID NO: 11351 - RNA, 19 nt, Homo sapiens
gagaaguuauuacggugua

SEQ ID NO: 11352 - RNA, 19 nt, Homo sapiens
ccacauaugcaaugacuuu

SEQ ID NO: 11353 - RNA, 19 nt, Homo sapiens
ugaggaaccuagaaagauu

SEQ ID NO: 11354 - RNA, 19 nt, Homo sapiens
ugacaaaggagagaaguua

SEQ ID NO: 11355 - RNA, 19 nt, Homo sapiens
ugagcagguuuacaauuua

SEQ ID NO: 11356 - RNA, 19 nt, Homo sapiens
gaggaggccuucuauuaca

SEQ ID NO: 11357 - RNA, 19 nt, Homo sapiens
gaacaacccagaguacuug

SEQ ID NO: 11358 - RNA, 19 nt, Homo sapiens
ccacgaauguaccaaaugu

SEQ ID NO: 11359 - RNA, 19 nt, Homo sapiens
ccacaggccuauuggcauu

SEQ ID NO: 11360 - RNA, 19 nt, Homo sapiens
gaaagaugcccuaguugug

SEQ ID NO: 11361 - RNA, 19 nt, Homo sapiens
ucacuugggucucuggauu

SEQ ID NO: 11362 - RNA, 19 nt, Homo sapiens
gcucuguccuuguguaaug

SEQ ID NO: 11363 - RNA, 19 nt, Homo sapiens
ggacgaggcuagagaacag

SEQ ID NO: 11364 - RNA, 19 nt, Homo sapiens
ugucacagguuacuccuuu

SEQ ID NO: 11365 - RNA, 19 nt, Homo sapiens
gagaaguggcuuaucauga

SEQ ID NO: 11366 - RNA, 19 nt, Homo sapiens
aaacaugagucuugguaug

SEQ ID NO: 11367 - RNA, 19 nt, Homo sapiens
gaagaggguguccaugauu

SEQ ID NO: 11368 - RNA, 19 nt, Homo sapiens
uugagcagguuuacaauuu

SEQ ID NO: 11369 - RNA, 19 nt, Homo sapiens
gacgaucccucgaccagaa

SEQ ID NO: 11370 - RNA, 19 nt, Homo sapiens
acaaggagauauaguagau

SEQ ID NO: 11371 - RNA, 19 nt, Homo sapiens
uacagcagauugcagauuu

SEQ ID NO: 11372 - RNA, 19 nt, Homo sapiens
ccaucaagcuggaggaaga

SEQ ID NO: 11373 - RNA, 19 nt, Homo sapiens
gauccgagagcagaauuua

SEQ ID NO: 11374 - RNA, 19 nt, Homo sapiens
ugaagaagagcaagaagaa

SEQ ID NO: 11375 - RNA, 19 nt, Homo sapiens
uugaggaggccuucuauua

SEQ ID NO: 11376 - RNA, 19 nt, Homo sapiens
aaugaaauguggccucuug

SEQ ID NO: 11377 - RNA, 19 nt, Homo sapiens
ggacuguucucaccuuaac

SEQ ID NO: 11378 - RNA, 19 nt, Homo sapiens
gagcagguuuacaauuuag

SEQ ID NO: 11379 - RNA, 19 nt, Homo sapiens
gggaagaggccuuucuaga

SEQ ID NO: 11380 - RNA, 19 nt, Homo sapiens
gcagauuggugagcaggaa

SEQ ID NO: 11381 - RNA, 19 nt, Homo sapiens
cgccaggacuucaacauga

SEQ ID NO: 11382 - RNA, 19 nt, Homo sapiens
gcucagauccugggcauga

SEQ ID NO: 11383 - RNA, 19 nt, Homo sapiens
uaacucagccagaaagaug

SEQ ID NO: 11384 - RNA, 19 nt, Homo sapiens
caaaagagguccaggagau

SEQ ID NO: 11385 - RNA, 19 nt, Homo sapiens
uaaccuguuuguuccauug

SEQ ID NO: 11386 - RNA, 19 nt, Homo sapiens
gaagcagucccaagucgaa

SEQ ID NO: 11387 - RNA, 19 nt, Homo sapiens
ggcagaugcuguuguuguu

SEQ ID NO: 11388 - RNA, 19 nt, Homo sapiens
uagacuagcagaucucuuu

SEQ ID NO: 11389 - RNA, 19 nt, Homo sapiens
ugaaagcccugcgcuaaca

SEQ ID NO: 11390 - RNA, 19 nt, Homo sapiens
gcagaugcuguuguuguua

SEQ ID NO: 11391 - RNA, 19 nt, Homo sapiens
gaacgugaauaggcugcuu

SEQ ID NO: 11392 - RNA, 19 nt, Homo sapiens
aaagcaagguucuuauucu

SEQ ID NO: 11393 - RNA, 19 nt, Homo sapiens
gaccacgaauguaccaaau

SEQ ID NO: 11394 - RNA, 19 nt, Homo sapiens
cugauucuauugcguauga

SEQ ID NO: 11395 - RNA, 19 nt, Homo sapiens
acgauucgcuucugaggaa

SEQ ID NO: 11396 - RNA, 19 nt, Homo sapiens
uaaguggacuaaagaggau

SEQ ID NO: 11397 - RNA, 19 nt, Homo sapiens
gaaccuagaaagauuguac

SEQ ID NO: 11398 - RNA, 19 nt, Homo sapiens
cugcuagugucacagguua

SEQ ID NO: 11399 - RNA, 19 nt, Homo sapiens
caccuuaacucagccagaa

SEQ ID NO: 11400 - RNA, 19 nt, Homo sapiens
ucaugcggaugcucgauaa

SEQ ID NO: 11401 - RNA, 19 nt, Homo sapiens
gcauucugguugaugaaga

SEQ ID NO: 11402 - RNA, 19 nt, Homo sapiens
ggagaaguggcuuaucaug

SEQ ID NO: 11403 - RNA, 19 nt, Homo sapiens
ccaguuugguuaagaucaa

SEQ ID NO: 11404 - RNA, 19 nt, Homo sapiens
gaggauggacauagaacuu

SEQ ID NO: 11405 - RNA, 19 nt, Homo sapiens
gggcugcggucucugcaau

SEQ ID NO: 11406 - RNA, 19 nt, Homo sapiens
ucucuggauuccugucaua

SEQ ID NO: 11407 - RNA, 19 nt, Homo sapiens
ugaaaucaccacauucugu

SEQ ID NO: 11408 - RNA, 19 nt, Homo sapiens
accgugagcuggaggagua

SEQ ID NO: 11409 - RNA, 19 nt, Homo sapiens
gaauuuacaggacauuaag

SEQ ID NO: 11410 - RNA, 19 nt, Homo sapiens
aggaggaccagacaacuua

SEQ ID NO: 11411 - RNA, 19 nt, Homo sapiens
agaaguggcuuaucaugac

SEQ ID NO: 11412 - RNA, 19 nt, Homo sapiens
ugauacaggagcaauuuaa

SEQ ID NO: 11413 - RNA, 19 nt, Homo sapiens
ccucggaucccacugauug

SEQ ID NO: 11414 - RNA, 19 nt, Homo sapiens
agaggccuuucuagaauuu

SEQ ID NO: 11415 - RNA, 19 nt, Homo sapiens
aagaagaggguguccauga

SEQ ID NO: 11416 - RNA, 19 nt, Homo sapiens
agaagaggguguccaugau

SEQ ID NO: 11417 - RNA, 19 nt, Homo sapiens
acagguuacuccuuugcua

SEQ ID NO: 11418 - RNA, 19 nt, Homo sapiens
gaucguggaagcacuaauc

SEQ ID NO: 11419 - RNA, 19 nt, Homo sapiens
aaagaugcccuaguuguga

SEQ ID NO: 11420 - RNA, 19 nt, Homo sapiens
aagaagagcaagaagaaga

SEQ ID NO: 11421 - RNA, 19 nt, Homo sapiens
cagugaugcugccaccuuu

SEQ ID NO: 11422 - RNA, 19 nt, Homo sapiens
ucgauacccugcucugaga

SEQ ID NO: 11423 - RNA, 19 nt, Homo sapiens
ggaauuugaagcccucaug

SEQ ID NO: 11424 - RNA, 19 nt, Homo sapiens
caacuuaguccugcugaau

SEQ ID NO: 11425 - RNA, 19 nt, Homo sapiens
gcugcggucucugcaauga

SEQ ID NO: 11426 - RNA, 19 nt, Homo sapiens
gaauguaccaaaugucuac

SEQ ID NO: 11427 - RNA, 19 nt, Homo sapiens
gcacccaacgugaugcuau

SEQ ID NO: 11428 - RNA, 19 nt, Homo sapiens
agacuaaguggacuaaaga

SEQ ID NO: 11429 - RNA, 19 nt, Homo sapiens
gaggaagggcagaauggaa

SEQ ID NO: 11430 - RNA, 19 nt, Homo sapiens
cuuacacucugcaauuuau

SEQ ID NO: 11431 - RNA, 19 nt, Homo sapiens
gcauccaguuugguuaaga

SEQ ID NO: 11432 - RNA, 19 nt, Homo sapiens
ggaggaggaagcccauaga

SEQ ID NO: 11433 - RNA, 19 nt, Homo sapiens
uuggagaaguggcuuauca

SEQ ID NO: 11434 - RNA, 19 nt, Homo sapiens
ucuacaaggagauauagua

SEQ ID NO: 11435 - RNA, 19 nt, Homo sapiens
uuaaacaugagucuuggua

SEQ ID NO: 11436 - RNA, 19 nt, Homo sapiens
uguccuuucuccaguguaa

SEQ ID NO: 11437 - RNA, 19 nt, Homo sapiens
cauucucucugcucaguga

SEQ ID NO: 11438 - RNA, 19 nt, Homo sapiens
ccugaaagcccugcgcuaa

SEQ ID NO: 11439 - RNA, 19 nt, Homo sapiens
gcuagagaacagaaagaaa

SEQ ID NO: 11440 - RNA, 19 nt, Homo sapiens
gaagaggccuuucuagaau

SEQ ID NO: 11441 - RNA, 19 nt, Homo sapiens
cagcuuaucuacaaucaua

SEQ ID NO: 11442 - RNA, 19 nt, Homo sapiens
ccagaaagaugcccuaguu

SEQ ID NO: 11443 - RNA, 19 nt, Homo sapiens
ggaagaggccuuucuagaa

SEQ ID NO: 11444 - RNA, 19 nt, Homo sapiens
gcacucggcuucccaaugu

SEQ ID NO: 11445 - RNA, 19 nt, Homo sapiens
ggucucagcuuaucuacaa

SEQ ID NO: 11446 - RNA, 19 nt, Homo sapiens
gcagggagguggagaggaa

SEQ ID NO: 11447 - RNA, 19 nt, Homo sapiens
uaaagaggauggacauaga

SEQ ID NO: 11448 - RNA, 19 nt, Homo sapiens
guagagcacuuuucacuua

SEQ ID NO: 11449 - RNA, 19 nt, Homo sapiens
caaaggagagaaguuauua

SEQ ID NO: 11450 - RNA, 19 nt, Homo sapiens
gaacauggcaccagaccuu

SEQ ID NO: 11451 - RNA, 19 nt, Homo sapiens
gagaaguuauuacggugua

SEQ ID NO: 11452 - RNA, 19 nt, Homo sapiens
ccacauaugcaaugacuuu

SEQ ID NO: 11453 - RNA, 19 nt, Homo sapiens
ugaggaaccuagaaagauu

SEQ ID NO: 11454 - RNA, 19 nt, Homo sapiens
ugacaaaggagagaaguua

SEQ ID NO: 11455 - RNA, 19 nt, Homo sapiens
ugagcagguuuacaauuua

SEQ ID NO: 11456 - RNA, 19 nt, Homo sapiens
gaggaggccuucuauuaca

SEQ ID NO: 11457 - RNA, 19 nt, Homo sapiens
gaacaacccagaguacuug

SEQ ID NO: 11458 - RNA, 19 nt, Homo sapiens
ccacgaauguaccaaaugu

SEQ ID NO: 11459 - RNA, 19 nt, Homo sapiens
ccacaggccuauuggcauu

SEQ ID NO: 11460 - RNA, 19 nt, Homo sapiens
gaaagaugcccuaguugug

SEQ ID NO: 11461 - RNA, 19 nt, Homo sapiens
ucacuugggucucuggauu

SEQ ID NO: 11462 - RNA, 19 nt, Homo sapiens
gcucuguccuuguguaaug

SEQ ID NO: 11463 - RNA, 19 nt, Homo sapiens
ggacgaggcuagagaacag

SEQ ID NO: 11464 - RNA, 19 nt, Homo sapiens
ugucacagguuacuccuuu

SEQ ID NO: 11465 - RNA, 19 nt, Homo sapiens
gagaaguggcuuaucauga

SEQ ID NO: 11466 - RNA, 19 nt, Homo sapiens
aaacaugagucuugguaug

SEQ ID NO: 11467 - RNA, 19 nt, Homo sapiens
gaagaggguguccaugauu

SEQ ID NO: 11468 - RNA, 19 nt, Homo sapiens
uugagcagguuuacaauuu

SEQ ID NO: 11469 - RNA, 19 nt, Homo sapiens
gacgaucccucgaccagaa

SEQ ID NO: 11470 - RNA, 19 nt, Homo sapiens
acaaggagauauaguagau

SEQ ID NO: 11471 - RNA, 19 nt, Homo sapiens
uacagcagauugcagauuu

SEQ ID NO: 11472 - RNA, 19 nt, Homo sapiens
ccaucaagcuggaggaaga

SEQ ID NO: 11473 - RNA, 19 nt, Homo sapiens
gauccgagagcagaauuua

SEQ ID NO: 11474 - RNA, 19 nt, Homo sapiens
ugaagaagagcaagaagaa

SEQ ID NO: 11475 - RNA, 19 nt, Homo sapiens
uugaggaggccuucuauua

SEQ ID NO: 11476 - RNA, 19 nt, Homo sapiens
aaugaaauguggccucuug

SEQ ID NO: 11477 - RNA, 19 nt, Homo sapiens
ggacuguucucaccuuaac

SEQ ID NO: 11478 - RNA, 19 nt, Homo sapiens
gagcagguuuacaauuuag

SEQ ID NO: 11479 - RNA, 19 nt, Homo sapiens
gggaagaggccuuucuaga

SEQ ID NO: 11480 - RNA, 19 nt, Homo sapiens
gcagauuggugagcaggaa

SEQ ID NO: 11481 - RNA, 19 nt, Homo sapiens
cgccaggacuucaacauga

SEQ ID NO: 11482 - RNA, 19 nt, Homo sapiens
gcucagauccugggcauga

SEQ ID NO: 11483 - RNA, 19 nt, Homo sapiens
uaacucagccagaaagaug

SEQ ID NO: 11484 - RNA, 19 nt, Homo sapiens
caaaagagguccaggagau

SEQ ID NO: 11485 - RNA, 19 nt, Homo sapiens
uaaccuguuuguuccauug

SEQ ID NO: 11486 - RNA, 19 nt, Homo sapiens
gaagcagucccaagucgaa

SEQ ID NO: 11487 - RNA, 19 nt, Homo sapiens
ggcagaugcuguuguuguu

SEQ ID NO: 11488 - RNA, 19 nt, Homo sapiens
uagacuagcagaucucuuu

SEQ ID NO: 11489 - RNA, 19 nt, Homo sapiens
ugaaagcccugcgcuaaca

SEQ ID NO: 11490 - RNA, 19 nt, Homo sapiens
agacuaagguguggacgaa

SEQ ID NO: 11491 - RNA, 19 nt, Homo sapiens
gcagaugcuguuguuguua

SEQ ID NO: 11492 - RNA, 19 nt, Homo sapiens
gaacgugaauaggcugcuu

SEQ ID NO: 11493 - RNA, 19 nt, Homo sapiens
aaagcaagguucuuauucu

SEQ ID NO: 11494 - RNA, 19 nt, Homo sapiens
gaccacgaauguaccaaau

SEQ ID NO: 11495 - RNA, 19 nt, Homo sapiens
gugccaagcuguauuacca

SEQ ID NO: 11496 - RNA, 19 nt, Homo sapiens
cugauucuauugcguauga

SEQ ID NO: 11497 - RNA, 19 nt, Homo sapiens
acgauucgcuucugaggaa

SEQ ID NO: 11498 - RNA, 19 nt, Homo sapiens
gaaccuagaaagauuguac

SEQ ID NO: 11499 - RNA, 19 nt, Homo sapiens
cugcuagugucacagguua

SEQ ID NO: 11500 - RNA, 19 nt, Homo sapiens
caccuuaacucagccagaa

SEQ ID NO: 11501 - RNA, 19 nt, Homo sapiens
ucaugcggaugcucgauaa

SEQ ID NO: 11502 - RNA, 19 nt, Homo sapiens
gcauucugguugaugaaga

SEQ ID NO: 11503 - RNA, 19 nt, Homo sapiens
ggagaaguggcuuaucaug

SEQ ID NO: 11504 - RNA, 19 nt, Homo sapiens
ccaguuugguuaagaucaa

SEQ ID NO: 11505 - RNA, 19 nt, Homo sapiens
gaggauggacauagaacuu

SEQ ID NO: 11506 - RNA, 19 nt, Homo sapiens
gggcugcggucucugcaau

SEQ ID NO: 11507 - RNA, 19 nt, Homo sapiens
ucucuggauuccugucaua

SEQ ID NO: 11508 - RNA, 19 nt, Homo sapiens
ugaaaucaccacauucugu

SEQ ID NO: 11509 - RNA, 19 nt, Homo sapiens
accgugagcuggaggagua

SEQ ID NO: 11510 - RNA, 19 nt, Homo sapiens
gaauuuacaggacauuaag

SEQ ID NO: 11511 - RNA, 19 nt, Homo sapiens
caagcuguauuaccaacug

SEQ ID NO: 11512 - RNA, 19 nt, Homo sapiens
aggaggaccagacaacuua

SEQ ID NO: 11513 - RNA, 19 nt, Homo sapiens
agaaguggcuuaucaugac

SEQ ID NO: 11514 - RNA, 19 nt, Homo sapiens
ugauacaggagcaauuuaa

SEQ ID NO: 11515 - RNA, 19 nt, Homo sapiens
ccucggaucccacugauug

SEQ ID NO: 11516 - RNA, 19 nt, Homo sapiens
agaggccuuucuagaauuu

SEQ ID NO: 11517 - RNA, 19 nt, Homo sapiens
aagaagaggguguccauga

SEQ ID NO: 11518 - RNA, 19 nt, Homo sapiens
agaagaggguguccaugau

SEQ ID NO: 11519 - RNA, 19 nt, Homo sapiens
acagguuacuccuuugcua

SEQ ID NO: 11520 - RNA, 19 nt, Homo sapiens
gaucguggaagcacuaauc

SEQ ID NO: 11521 - RNA, 19 nt, Homo sapiens
aaagaugcccuaguuguga

SEQ ID NO: 11522 - RNA, 19 nt, Homo sapiens
aagaagagcaagaagaaga

SEQ ID NO: 11523 - RNA, 19 nt, Homo sapiens
cagugaugcugccaccuuu

SEQ ID NO: 11524 - RNA, 19 nt, Homo sapiens
ucgauacccugcucugaga

SEQ ID NO: 11525 - RNA, 19 nt, Homo sapiens
ggaauuugaagcccucaug

SEQ ID NO: 11526 - RNA, 19 nt, Homo sapiens
caacuuaguccugcugaau

SEQ ID NO: 11527 - RNA, 19 nt, Homo sapiens
gcugcggucucugcaauga

SEQ ID NO: 11528 - RNA, 19 nt, Homo sapiens
gaauguaccaaaugucuac

SEQ ID NO: 11529 - RNA, 19 nt, Homo sapiens
gcacccaacgugaugcuau

SEQ ID NO: 11530 - RNA, 19 nt, Homo sapiens
gaggaagggcagaauggaa

SEQ ID NO: 11531 - RNA, 19 nt, Homo sapiens
cuuacacucugcaauuuau

SEQ ID NO: 11532 - RNA, 19 nt, Homo sapiens
gcauccaguuugguuaaga

SEQ ID NO: 11533 - RNA, 19 nt, Homo sapiens
ggaggaggaagcccauaga

SEQ ID NO: 11534 - RNA, 19 nt, Homo sapiens
uuggagaaguggcuuauca

SEQ ID NO: 11535 - RNA, 19 nt, Homo sapiens
ucuacaaggagauauagua

SEQ ID NO: 11536 - RNA, 19 nt, Homo sapiens
uuaaacaugagucuuggua

SEQ ID NO: 11537 - RNA, 19 nt, Homo sapiens
uguccuuucuccaguguaa

SEQ ID NO: 11538 - RNA, 19 nt, Homo sapiens
uacaggagcaauuuaagaa

SEQ ID NO: 11539 - RNA, 19 nt, Homo sapiens
cauucucucugcucaguga

SEQ ID NO: 11540 - RNA, 19 nt, Homo sapiens
gaagaggccuuucuagaau

SEQ ID NO: 11541 - RNA, 19 nt, Homo sapiens
cagcuuaucuacaaucaua

SEQ ID NO: 11542 - RNA, 19 nt, Homo sapiens
ccagaaagaugcccuaguu

SEQ ID NO: 11543 - RNA, 19 nt, Homo sapiens
ggaagaggccuuucuagaa

SEQ ID NO: 11544 - RNA, 19 nt, Homo sapiens
gcacucggcuucccaaugu

SEQ ID NO: 11545 - RNA, 19 nt, Homo sapiens
ggucucagcuuaucuacaa

SEQ ID NO: 11546 - RNA, 19 nt, Homo sapiens
gcagggagguggagaggaa

SEQ ID NO: 11547 - RNA, 19 nt, Homo sapiens
uaaagaggauggacauaga

SEQ ID NO: 11548 - RNA, 19 nt, Homo sapiens
guagagcacuuuucacuua

SEQ ID NO: 11549 - RNA, 19 nt, Homo sapiens
caaaggagagaaguuauua

SEQ ID NO: 11550 - RNA, 19 nt, Homo sapiens
gaacauggcaccagaccuu

SEQ ID NO: 11551 - RNA, 19 nt, Homo sapiens
gagaaguuauuacggugua

SEQ ID NO: 11552 - RNA, 19 nt, Homo sapiens
ccacauaugcaaugacuuu

SEQ ID NO: 11553 - RNA, 19 nt, Homo sapiens
ugaggaaccuagaaagauu

SEQ ID NO: 11554 - RNA, 19 nt, Homo sapiens
ugacaaaggagagaaguua

SEQ ID NO: 11555 - RNA, 19 nt, Homo sapiens
ugagcagguuuacaauuua

SEQ ID NO: 11556 - RNA, 19 nt, Homo sapiens
gaggaggccuucuauuaca

SEQ ID NO: 11557 - RNA, 19 nt, Homo sapiens
gaacaacccagaguacuug

SEQ ID NO: 11558 - RNA, 19 nt, Homo sapiens
ccacgaauguaccaaaugu

SEQ ID NO: 11559 - RNA, 19 nt, Homo sapiens
ccacaggccuauuggcauu

SEQ ID NO: 11560 - RNA, 19 nt, Homo sapiens
gaaagaugcccuaguugug

SEQ ID NO: 11561 - RNA, 19 nt, Homo sapiens
ucacuugggucucuggauu

SEQ ID NO: 11562 - RNA, 19 nt, Homo sapiens
gcucuguccuuguguaaug

SEQ ID NO: 11563 - RNA, 19 nt, Homo sapiens
ggacgaggcuagagaacag

SEQ ID NO: 11564 - RNA, 19 nt, Homo sapiens
ugucacagguuacuccuuu

SEQ ID NO: 11565 - RNA, 19 nt, Homo sapiens
gagaaguggcuuaucauga

SEQ ID NO: 11566 - RNA, 19 nt, Homo sapiens
aaacaugagucuugguaug

SEQ ID NO: 11567 - RNA, 19 nt, Homo sapiens
gaagaggguguccaugauu

SEQ ID NO: 11568 - RNA, 19 nt, Homo sapiens
uugagcagguuuacaauuu

SEQ ID NO: 11569 - RNA, 19 nt, Homo sapiens
gacgaucccucgaccagaa

SEQ ID NO: 11570 - RNA, 19 nt, Homo sapiens
acaaggagauauaguagau

SEQ ID NO: 11571 - RNA, 19 nt, Homo sapiens
uacagcagauugcagauuu

SEQ ID NO: 11572 - RNA, 19 nt, Homo sapiens
gauccgagagcagaauuua

SEQ ID NO: 11573 - RNA, 19 nt, Homo sapiens
ugaagaagagcaagaagaa

SEQ ID NO: 11574 - RNA, 19 nt, Homo sapiens
uugaggaggccuucuauua

SEQ ID NO: 11575 - RNA, 19 nt, Homo sapiens
aaugaaauguggccucuug

SEQ ID NO: 11576 - RNA, 19 nt, Homo sapiens
ggacuguucucaccuuaac

SEQ ID NO: 11577 - RNA, 19 nt, Homo sapiens
gagcagguuuacaauuuag

SEQ ID NO: 11578 - RNA, 19 nt, Homo sapiens
gggaagaggccuuucuaga

SEQ ID NO: 11579 - RNA, 19 nt, Homo sapiens
gcagauuggugagcaggaa

SEQ ID NO: 11580 - RNA, 19 nt, Homo sapiens
cgccaggacuucaacauga

SEQ ID NO: 11581 - RNA, 19 nt, Homo sapiens
gcucagauccugggcauga

SEQ ID NO: 11582 - RNA, 19 nt, Homo sapiens
uaacucagccagaaagaug

SEQ ID NO: 11583 - RNA, 19 nt, Homo sapiens
caaaagagguccaggagau

SEQ ID NO: 11584 - RNA, 19 nt, Homo sapiens
uaaccuguuuguuccauug

SEQ ID NO: 11585 - RNA, 19 nt, Homo sapiens
gaagcagucccaagucgaa

SEQ ID NO: 11586 - RNA, 19 nt, Homo sapiens
ggcagaugcuguuguuguu

SEQ ID NO: 11587 - RNA, 19 nt, Homo sapiens
uagacuagcagaucucuuu

SEQ ID NO: 11588 - RNA, 19 nt, Homo sapiens
ugaaagcccugcgcuaaca

SEQ ID NO: 11589 - RNA, 19 nt, Homo sapiens
gcagaugcuguuguuguua

SEQ ID NO: 11590 - RNA, 19 nt, Homo sapiens
gaacgugaauaggcugcuu

SEQ ID NO: 11591 - RNA, 19 nt, Homo sapiens
aaagcaagguucuuauucu

SEQ ID NO: 11592 - RNA, 19 nt, Homo sapiens
gaccacgaauguaccaaau

SEQ ID NO: 11593 - RNA, 19 nt, Homo sapiens
cugauucuauugcguauga

SEQ ID NO: 11594 - RNA, 19 nt, Homo sapiens
acgauucgcuucugaggaa

SEQ ID NO: 11595 - RNA, 19 nt, Homo sapiens
uaaguggacuaaagaggau

SEQ ID NO: 11596 - RNA, 19 nt, Homo sapiens
gaaccuagaaagauuguac

SEQ ID NO: 11597 - RNA, 19 nt, Homo sapiens
cugcuagugucacagguua

SEQ ID NO: 11598 - RNA, 19 nt, Homo sapiens
caccuuaacucagccagaa

SEQ ID NO: 11599 - RNA, 19 nt, Homo sapiens
ucaugcggaugcucgauaa

SEQ ID NO: 11600 - RNA, 19 nt, Homo sapiens
gcauucugguugaugaaga

SEQ ID NO: 11601 - RNA, 19 nt, Homo sapiens
ggagaaguggcuuaucaug

SEQ ID NO: 11602 - RNA, 19 nt, Homo sapiens
ccaguuugguuaagaucaa

SEQ ID NO: 11603 - RNA, 19 nt, Homo sapiens
gaggauggacauagaacuu

SEQ ID NO: 11604 - RNA, 19 nt, Homo sapiens
gggcugcggucucugcaau

SEQ ID NO: 11605 - RNA, 19 nt, Homo sapiens
ucucuggauuccugucaua

SEQ ID NO: 11606 - RNA, 19 nt, Homo sapiens
ugaaaucaccacauucugu

SEQ ID NO: 11607 - RNA, 19 nt, Homo sapiens
accgugagcuggaggagua

SEQ ID NO: 11608 - RNA, 19 nt, Homo sapiens
gaauuuacaggacauuaag

SEQ ID NO: 11609 - RNA, 19 nt, Homo sapiens
aggaggaccagacaacuua

SEQ ID NO: 11610 - RNA, 19 nt, Homo sapiens
agaaguggcuuaucaugac

SEQ ID NO: 11611 - RNA, 19 nt, Homo sapiens
ugauacaggagcaauuuaa

SEQ ID NO: 11612 - RNA, 19 nt, Homo sapiens
ccucggaucccacugauug

SEQ ID NO: 11613 - RNA, 19 nt, Homo sapiens
agaggccuuucuagaauuu

SEQ ID NO: 11614 - RNA, 19 nt, Homo sapiens
aagaagaggguguccauga

SEQ ID NO: 11615 - RNA, 19 nt, Homo sapiens
agaagaggguguccaugau

SEQ ID NO: 11616 - RNA, 19 nt, Homo sapiens
acagguuacuccuuugcua

SEQ ID NO: 11617 - RNA, 19 nt, Homo sapiens
gaucguggaagcacuaauc

SEQ ID NO: 11618 - RNA, 19 nt, Homo sapiens
aaagaugcccuaguuguga

SEQ ID NO: 11619 - RNA, 19 nt, Homo sapiens
aagaagagcaagaagaaga

SEQ ID NO: 11620 - RNA, 19 nt, Homo sapiens
cagugaugcugccaccuuu

SEQ ID NO: 11621 - RNA, 19 nt, Homo sapiens
ucgauacccugcucugaga

SEQ ID NO: 11622 - RNA, 19 nt, Homo sapiens
ggaauuugaagcccucaug

SEQ ID NO: 11623 - RNA, 19 nt, Homo sapiens
caacuuaguccugcugaau

SEQ ID NO: 11624 - RNA, 19 nt, Homo sapiens
gcugcggucucugcaauga

SEQ ID NO: 11625 - RNA, 19 nt, Homo sapiens
gaauguaccaaaugucuac

SEQ ID NO: 11626 - RNA, 19 nt, Homo sapiens
gcacccaacgugaugcuau

SEQ ID NO: 11627 - RNA, 19 nt, Homo sapiens
agacuaaguggacuaaaga

SEQ ID NO: 11628 - RNA, 19 nt, Homo sapiens
gaggaagggcagaauggaa

SEQ ID NO: 11629 - RNA, 19 nt, Homo sapiens
cuuacacucugcaauuuau

SEQ ID NO: 11630 - RNA, 19 nt, Homo sapiens
gcauccaguuugguuaaga

SEQ ID NO: 11631 - RNA, 19 nt, Homo sapiens
ggaggaggaagcccauaga

SEQ ID NO: 11632 - RNA, 19 nt, Homo sapiens
uuggagaaguggcuuauca

SEQ ID NO: 11633 - RNA, 19 nt, Homo sapiens
ucuacaaggagauauagua

SEQ ID NO: 11634 - RNA, 19 nt, Homo sapiens
uuaaacaugagucuuggua

SEQ ID NO: 11635 - RNA, 19 nt, Homo sapiens
uguccuuucuccaguguaa

SEQ ID NO: 11636 - RNA, 19 nt, Homo sapiens
cauucucucugcucaguga

SEQ ID NO: 11637 - RNA, 19 nt, Homo sapiens
ccugaaagcccugcgcuaa

SEQ ID NO: 11638 - RNA, 19 nt, Homo sapiens
ggagacggaugcgcuagag

SEQ ID NO: 11639 - RNA, 19 nt, Homo sapiens
gcuagagaacagaaagaaa

SEQ ID NO: 11640 - RNA, 19 nt, Homo sapiens
ggagcuaucucuacauuua

SEQ ID NO: 11641 - RNA, 19 nt, Homo sapiens
gaccgaaacuggcaucuua

SEQ ID NO: 11642 - RNA, 19 nt, Homo sapiens
ggaaauggcuuuaauucug

SEQ ID NO: 11643 - RNA, 19 nt, Homo sapiens
gaaauccucuguuggcuuu

SEQ ID NO: 11644 - RNA, 19 nt, Homo sapiens
ggaagaaacuagaacuuga

SEQ ID NO: 11645 - RNA, 19 nt, Homo sapiens
gaaauggcuuuaauucuga

SEQ ID NO: 11646 - RNA, 19 nt, Homo sapiens
gaacaagauucgagaacaa

SEQ ID NO: 11647 - RNA, 19 nt, Homo sapiens
caaagugacuagccaaauu

SEQ ID NO: 11648 - RNA, 19 nt, Homo sapiens
gaaaugagcccuucaggau

SEQ ID NO: 11649 - RNA, 19 nt, Homo sapiens
cagaggaaaugcugacuuu

SEQ ID NO: 11650 - RNA, 19 nt, Homo sapiens
ggucacagccuucguguuu

SEQ ID NO: 11651 - RNA, 19 nt, Homo sapiens
gaacaacuccuccaacauc

SEQ ID NO: 11652 - RNA, 19 nt, Homo sapiens
uuuguuggcuccuaaauua

SEQ ID NO: 11653 - RNA, 19 nt, Homo sapiens
aaugagcccuucaggauua

SEQ ID NO: 11654 - RNA, 19 nt, Homo sapiens
gaaagaaacugccccagaa

SEQ ID NO: 11655 - RNA, 19 nt, Homo sapiens
agaaagagguggagaggaa

SEQ ID NO: 11656 - RNA, 19 nt, Homo sapiens
gcugauggcuuagcuugua

SEQ ID NO: 11657 - RNA, 19 nt, Homo sapiens
gcagaaauuugggaaguug

SEQ ID NO: 11658 - RNA, 19 nt, Homo sapiens
cccaagggcugauggcuua

SEQ ID NO: 11659 - RNA, 19 nt, Homo sapiens
cagaacagguuacacguau

SEQ ID NO: 11660 - RNA, 19 nt, Homo sapiens
gaacaaaaccgacaagaug

SEQ ID NO: 11661 - RNA, 19 nt, Homo sapiens
cagauuagcuggguggauu

SEQ ID NO: 11662 - RNA, 19 nt, Homo sapiens
ucucuucucuuuccacuuu

SEQ ID NO: 11663 - RNA, 19 nt, Homo sapiens
gaaaguggaguccugauuc

SEQ ID NO: 11664 - RNA, 19 nt, Homo sapiens
ggaacaagauucgagaaca

SEQ ID NO: 11665 - RNA, 19 nt, Homo sapiens
ggaucaaccugcagaagug

SEQ ID NO: 11666 - RNA, 19 nt, Homo sapiens
gggaacaacuccuccaaca

SEQ ID NO: 11667 - RNA, 19 nt, Homo sapiens
gguaauggccacaguuauu

SEQ ID NO: 11668 - RNA, 19 nt, Homo sapiens
gcaaaggccugagccagau

SEQ ID NO: 11669 - RNA, 19 nt, Homo sapiens
gaaacuagaacuugaugga

SEQ ID NO: 11670 - RNA, 19 nt, Homo sapiens
gcaaggagcaggaccacuu

SEQ ID NO: 11671 - RNA, 19 nt, Homo sapiens
ucagagaaaugcuggguau

SEQ ID NO: 11672 - RNA, 19 nt, Homo sapiens
ggauggagcuaucucuaca

SEQ ID NO: 11673 - RNA, 19 nt, Homo sapiens
ugaguaagguccauuucuu

SEQ ID NO: 11674 - RNA, 19 nt, Homo sapiens
gaagacagaaacaagcaaa

SEQ ID NO: 11675 - RNA, 19 nt, Homo sapiens
ggacauggccuauuaugac

SEQ ID NO: 11676 - RNA, 19 nt, Homo sapiens
gaccggagauagcuaagau

SEQ ID NO: 11677 - RNA, 19 nt, Homo sapiens
caacauaagaggccaggaa

SEQ ID NO: 11678 - RNA, 19 nt, Homo sapiens
ccaagucucccucaaagaa

SEQ ID NO: 11679 - RNA, 19 nt, Homo sapiens
ucacagccuucguguuuga

SEQ ID NO: 11680 - RNA, 19 nt, Homo sapiens
caugacaccuggagcaaug

SEQ ID NO: 11681 - RNA, 19 nt, Homo sapiens
ucaauacgcccaacaccua

SEQ ID NO: 11682 - RNA, 19 nt, Homo sapiens
gaaacuggcaucuuacucu

SEQ ID NO: 11683 - RNA, 19 nt, Homo sapiens
ccacagagcccgaaacaac

SEQ ID NO: 11684 - RNA, 19 nt, Homo sapiens
gcaaagccgccaccacaga

SEQ ID NO: 11685 - RNA, 19 nt, Homo sapiens
cagaaacacuugcuuacag

SEQ ID NO: 11686 - RNA, 19 nt, Homo sapiens
gcaagaaggccagaaaugg

SEQ ID NO: 11687 - RNA, 19 nt, Homo sapiens
guugugggcugccuuuguu

SEQ ID NO: 11688 - RNA, 19 nt, Homo sapiens
cgaaggaggcagagacaaa

SEQ ID NO: 11689 - RNA, 19 nt, Homo sapiens
gaagaaacuagaacuugau

SEQ ID NO: 11690 - RNA, 19 nt, Homo sapiens
gcaagauccuggugcuaag

SEQ ID NO: 11691 - RNA, 19 nt, Homo sapiens
ccaacucagucauucuuug

SEQ ID NO: 11692 - RNA, 19 nt, Homo sapiens
agaaacacuugcuuacaga

SEQ ID NO: 11693 - RNA, 19 nt, Homo sapiens
guggaguccugauucauga

SEQ ID NO: 11694 - RNA, 19 nt, Homo sapiens
gagacgaggauaccaaaga

SEQ ID NO: 11695 - RNA, 19 nt, Homo sapiens
cauggaaccacuugaauga

SEQ ID NO: 11696 - RNA, 19 nt, Homo sapiens
gggcagaaauuugggaagu

SEQ ID NO: 11697 - RNA, 19 nt, Homo sapiens
aagacccgcuggcucaaua

SEQ ID NO: 11698 - RNA, 19 nt, Homo sapiens
augaaugucuccaugauga

SEQ ID NO: 11699 - RNA, 19 nt, Homo sapiens
ccaacacugucuucucaug

SEQ ID NO: 11700 - RNA, 19 nt, Homo sapiens
cagaggagaaucagaaaug

SEQ ID NO: 11701 - RNA, 19 nt, Homo sapiens
cagcagaggagaaucagaa

SEQ ID NO: 11702 - RNA, 19 nt, Homo sapiens
agagaaaucaggugacuug

SEQ ID NO: 11703 - RNA, 19 nt, Homo sapiens
gggcucaccuuccaagucu

SEQ ID NO: 11704 - RNA, 19 nt, Homo sapiens
gggaguuucuugcagugaa

SEQ ID NO: 11705 - RNA, 19 nt, Homo sapiens
guaauggccacaguuauug

SEQ ID NO: 11706 - RNA, 19 nt, Homo sapiens
ggauggaagagcuauaaga

SEQ ID NO: 11707 - RNA, 19 nt, Homo sapiens
acccugagcuuucuucaug

SEQ ID NO: 11708 - RNA, 19 nt, Homo sapiens
gcuaaggagggauagagua

SEQ ID NO: 11709 - RNA, 19 nt, Homo sapiens
ccagagggcucaccuucca

SEQ ID NO: 11710 - RNA, 19 nt, Homo sapiens
gagaugaggaacaagauuc

SEQ ID NO: 11711 - RNA, 19 nt, Homo sapiens
ugggagaggugguggagaa

SEQ ID NO: 11712 - RNA, 19 nt, Homo sapiens
gcagggcugugagggacua

SEQ ID NO: 11713 - RNA, 19 nt, Homo sapiens
cauguaagcugaggauugg

SEQ ID NO: 11714 - RNA, 19 nt, Homo sapiens
caagagaaaucaggugacu

SEQ ID NO: 11715 - RNA, 19 nt, Homo sapiens
aaaguggaguccugauuca

SEQ ID NO: 11716 - RNA, 19 nt, Homo sapiens
ggagaggaagaaacuagaa

SEQ ID NO: 11717 - RNA, 19 nt, Homo sapiens
aaacuggcaucuuacucuu

SEQ ID NO: 11718 - RNA, 19 nt, Homo sapiens
uggaaccacuugaaugaug

SEQ ID NO: 11719 - RNA, 19 nt, Homo sapiens
gagcuaucucuacauuuaa

SEQ ID NO: 11720 - RNA, 19 nt, Homo sapiens
ucucacaggcucagacuaa

SEQ ID NO: 11721 - RNA, 19 nt, Homo sapiens
agaacuugauggagagaaa

SEQ ID NO: 11722 - RNA, 19 nt, Homo sapiens
ggagaugaggaacaagauu

SEQ ID NO: 11723 - RNA, 19 nt, Homo sapiens
caauuugugccucucuaua

SEQ ID NO: 11724 - RNA, 19 nt, Homo sapiens
gaaguugaaauccucuguu

SEQ ID NO: 11725 - RNA, 19 nt, Homo sapiens
agaggagaaucagaaauga

SEQ ID NO: 11726 - RNA, 19 nt, Homo sapiens
gaaauuugggaaguugaaa

SEQ ID NO: 11727 - RNA, 19 nt, Homo sapiens
uaagaggccaggaacuuga

SEQ ID NO: 11728 - RNA, 19 nt, Homo sapiens
cgaccaacccuucguuuua

SEQ ID NO: 11729 - RNA, 19 nt, Homo sapiens
ggaagguacuaagaagaca

SEQ ID NO: 11730 - RNA, 19 nt, Homo sapiens
cgaagcccgucuacagaga

SEQ ID NO: 11731 - RNA, 19 nt, Homo sapiens
ggccacaguuauuguuuua

SEQ ID NO: 11732 - RNA, 19 nt, Homo sapiens
gcucagggcagaaauuugg

SEQ ID NO: 11733 - RNA, 19 nt, Homo sapiens
gaacuugaccccuuugaau

SEQ ID NO: 11734 - RNA, 19 nt, Homo sapiens
guaggacccuggaccacau

SEQ ID NO: 11735 - RNA, 19 nt, Homo sapiens
guacuaagaagacagaaac

SEQ ID NO: 11736 - RNA, 19 nt, Homo sapiens
ugccaacacugucuucuca

SEQ ID NO: 11737 - RNA, 19 nt, Homo sapiens
gcuuuggguuguauaagga

SEQ ID NO: 11738 - RNA, 19 nt, Homo sapiens
ggcagaaauuugggaaguu

SEQ ID NO: 11739 - RNA, 19 nt, Homo sapiens
cauaagaggccaggaacuu

SEQ ID NO: 11740 - RNA, 19 nt, Homo sapiens
ggaaauggcuuuaauucug

SEQ ID NO: 11741 - RNA, 19 nt, Homo sapiens
gaaauggcuuuaauucuga

SEQ ID NO: 11742 - RNA, 19 nt, Homo sapiens
gaacaagauucgagaacaa

SEQ ID NO: 11743 - RNA, 19 nt, Homo sapiens
ggucacagccuucguguuu

SEQ ID NO: 11744 - RNA, 19 nt, Homo sapiens
gaacaacuccuccaacauc

SEQ ID NO: 11745 - RNA, 19 nt, Homo sapiens
ggaaauacaggaaauguuc

SEQ ID NO: 11746 - RNA, 19 nt, Homo sapiens
cagaacagguuacacguau

SEQ ID NO: 11747 - RNA, 19 nt, Homo sapiens
cuggaaagaugaucaugua

SEQ ID NO: 11748 - RNA, 19 nt, Homo sapiens
gaacaaaaccgacaagaug

SEQ ID NO: 11749 - RNA, 19 nt, Homo sapiens
cagauuagcuggguggauu

SEQ ID NO: 11750 - RNA, 19 nt, Homo sapiens
ggaacaagauucgagaaca

SEQ ID NO: 11751 - RNA, 19 nt, Homo sapiens
ggaucaaccugcagaagug

SEQ ID NO: 11752 - RNA, 19 nt, Homo sapiens
gggaacaacuccuccaaca

SEQ ID NO: 11753 - RNA, 19 nt, Homo sapiens
gcaaggagcaggaccacuu

SEQ ID NO: 11754 - RNA, 19 nt, Homo sapiens
gcacugggcuggagaacac

SEQ ID NO: 11755 - RNA, 19 nt, Homo sapiens
ggacauggccuauuaugac

SEQ ID NO: 11756 - RNA, 19 nt, Homo sapiens
gaccggagauagcuaagau

SEQ ID NO: 11757 - RNA, 19 nt, Homo sapiens
ucacagccuucguguuuga

SEQ ID NO: 11758 - RNA, 19 nt, Homo sapiens
gaucauguacccauagaga

SEQ ID NO: 11759 - RNA, 19 nt, Homo sapiens
ucaauacgcccaacaccua

SEQ ID NO: 11760 - RNA, 19 nt, Homo sapiens
ccacacaaacccacauuga

SEQ ID NO: 11761 - RNA, 19 nt, Homo sapiens
gcaagauccuggugcuaag

SEQ ID NO: 11762 - RNA, 19 nt, Homo sapiens
cacauugaguuagaaagua

SEQ ID NO: 11763 - RNA, 19 nt, Homo sapiens
aaacccacauugaguuaga

SEQ ID NO: 11764 - RNA, 19 nt, Homo sapiens
aagacccgcuggcucaaua

SEQ ID NO: 11765 - RNA, 19 nt, Homo sapiens
augaaugucuccaugauga

SEQ ID NO: 11766 - RNA, 19 nt, Homo sapiens
gggaguuucuugcagugaa

SEQ ID NO: 11767 - RNA, 19 nt, Homo sapiens
gagaugaggaacaagauuc

SEQ ID NO: 11768 - RNA, 19 nt, Homo sapiens
ugggagaggugguggagaa

SEQ ID NO: 11769 - RNA, 19 nt, Homo sapiens
gaugggaagggacaauauu

SEQ ID NO: 11770 - RNA, 19 nt, Homo sapiens
gcagggcugugagggacua

SEQ ID NO: 11771 - RNA, 19 nt, Homo sapiens
ggacaauauuacccacaca

SEQ ID NO: 11772 - RNA, 19 nt, Homo sapiens
ggagaugaggaacaagauu

SEQ ID NO: 11773 - RNA, 19 nt, Homo sapiens
caauuugugccucucuaua

SEQ ID NO: 11774 - RNA, 19 nt, Homo sapiens
acaaacccacauugaguua

SEQ ID NO: 11775 - RNA, 19 nt, Homo sapiens
gaucuugggugccuuugcu

SEQ ID NO: 11776 - RNA, 19 nt, Homo sapiens
ggaccagggaggacaaugu

SEQ ID NO: 11777 - RNA, 19 nt, Homo sapiens
acgcugaccugcagauuag

SEQ ID NO: 11778 - RNA, 19 nt, Homo sapiens
aagaagcgcgucaccauga

SEQ ID NO: 11779 - RNA, 19 nt, Homo sapiens
ccucuagccugguaugaca

SEQ ID NO: 11780 - RNA, 19 nt, Homo sapiens
gagaaaaccaaacacaaaa

SEQ ID NO: 11781 - RNA, 19 nt, Homo sapiens
gaacagguuacacguaucg

SEQ ID NO: 11782 - RNA, 19 nt, Homo sapiens
ggacaaccugggcuacaga

SEQ ID NO: 11783 - RNA, 19 nt, Homo sapiens
gggaaauacaggaaauguu

SEQ ID NO: 11784 - RNA, 19 nt, Homo sapiens
gggucaauguggccgauga

SEQ ID NO: 11785 - RNA, 19 nt, Homo sapiens
uggcauguguuugaaauca

SEQ ID NO: 11786 - RNA, 19 nt, Homo sapiens
ccacauugaguuagaaagu

SEQ ID NO: 11787 - RNA, 19 nt, Homo sapiens
acacaaacccacauugagu

SEQ ID NO: 11788 - RNA, 19 nt, Homo sapiens
gagcgucauugccgagaag

SEQ ID NO: 11789 - RNA, 19 nt, Homo sapiens
agaagcagcagaaggagaa

SEQ ID NO: 11790 - RNA, 19 nt, Homo sapiens
aaagugagguggagauucc

SEQ ID NO: 11791 - RNA, 19 nt, Homo sapiens
gacauggccuauuaugacu

SEQ ID NO: 11792 - RNA, 19 nt, Homo sapiens
agaauucuggcauguguuu

SEQ ID NO: 11793 - RNA, 19 nt, Homo sapiens
ggaugggaagggacaauau

SEQ ID NO: 11794 - RNA, 19 nt, Homo sapiens
gcaguggcaugccgauucg

SEQ ID NO: 11795 - RNA, 19 nt, Homo sapiens
gaggaggcauuuuacaaga

SEQ ID NO: 11796 - RNA, 19 nt, Homo sapiens
gggacauggccuauuauga

SEQ ID NO: 11797 - RNA, 19 nt, Homo sapiens
cccgacaucuuccaugaau

SEQ ID NO: 11798 - RNA, 19 nt, Homo sapiens
gcgggaaauggcuuuaauu

SEQ ID NO: 11799 - RNA, 19 nt, Homo sapiens
uguuugagguuguguagau

SEQ ID NO: 11800 - RNA, 19 nt, Homo sapiens
ucaugaggaugcuggacaa

SEQ ID NO: 11801 - RNA, 19 nt, Homo sapiens
ggugcaagaucagcagugu

SEQ ID NO: 11802 - RNA, 19 nt, Homo sapiens
gagaagggguauauagaca

SEQ ID NO: 11803 - RNA, 19 nt, Homo sapiens
caaccugggcuacagaaca

SEQ ID NO: 11804 - RNA, 19 nt, Homo sapiens
ggccuauuaugacuucaau

SEQ ID NO: 11805 - RNA, 19 nt, Homo sapiens
ugaucaaggugaacauucu

SEQ ID NO: 11806 - RNA, 19 nt, Homo sapiens
uaugucacguugagaguca

SEQ ID NO: 11807 - RNA, 19 nt, Homo sapiens
acagaucgcggacuucaug

SEQ ID NO: 11808 - RNA, 19 nt, Homo sapiens
gacaauauuacccacacaa

SEQ ID NO: 11809 - RNA, 19 nt, Homo sapiens
ccgacaagaugugaaguca

SEQ ID NO: 11810 - RNA, 19 nt, Homo sapiens
gggaaauggcuuuaauucu

SEQ ID NO: 11811 - RNA, 19 nt, Homo sapiens
cgaaaacccaaaccaauuu

SEQ ID NO: 11812 - RNA, 19 nt, Homo sapiens
cugacgagguggagaaauc

SEQ ID NO: 11813 - RNA, 19 nt, Homo sapiens
ggaguuucuugcagugaag

SEQ ID NO: 11814 - RNA, 19 nt, Homo sapiens
ccagcugagugacaccuau

SEQ ID NO: 11815 - RNA, 19 nt, Homo sapiens
ggaacaacuccuccaacau

SEQ ID NO: 11816 - RNA, 19 nt, Homo sapiens
gcauguguuugaaaucacu

SEQ ID NO: 11817 - RNA, 19 nt, Homo sapiens
cccaagaccacguggauga

SEQ ID NO: 11818 - RNA, 19 nt, Homo sapiens
cauggccuauuaugacuuc

SEQ ID NO: 11819 - RNA, 19 nt, Homo sapiens
gcacucggccaucuaugca

SEQ ID NO: 11820 - RNA, 19 nt, Homo sapiens
cacaaacccacauugaguu

SEQ ID NO: 11821 - RNA, 19 nt, Homo sapiens
agaugaucauguacccaua

SEQ ID NO: 11822 - RNA, 19 nt, Homo sapiens
cgggaaauggcuuuaauuc

SEQ ID NO: 11823 - RNA, 19 nt, Homo sapiens
acagaacagguuacacgua

SEQ ID NO: 11824 - RNA, 19 nt, Homo sapiens
cgacagaucgcggacuuca

SEQ ID NO: 11825 - RNA, 19 nt, Homo sapiens
uccaggagcagaugaagaa

SEQ ID NO: 11826 - RNA, 19 nt, Homo sapiens
gcauuuuccuuagcaguaa

SEQ ID NO: 11827 - RNA, 19 nt, Homo sapiens
acaauauuacccacacaaa

SEQ ID NO: 11828 - RNA, 19 nt, Homo sapiens
gaggaacaagauucgagaa

SEQ ID NO: 11829 - RNA, 19 nt, Homo sapiens
gaugacgccuaucaaugac

SEQ ID NO: 11830 - RNA, 19 nt, Homo sapiens
ucaaccugauggagcagaa

SEQ ID NO: 11831 - RNA, 19 nt, Homo sapiens
gaagacccgcuggcucaau

SEQ ID NO: 11832 - RNA, 19 nt, Homo sapiens
acaccuaugucacguugag

SEQ ID NO: 11833 - RNA, 19 nt, Homo sapiens
agaagaagcgcgucaccau

SEQ ID NO: 11834 - RNA, 19 nt, Homo sapiens
ucuggcauguguuugaaau

SEQ ID NO: 11835 - RNA, 19 nt, Homo sapiens
gaugaucauguacccauag

SEQ ID NO: 11836 - RNA, 19 nt, Homo sapiens
gacccaagaccacguggau

SEQ ID NO: 11837 - RNA, 19 nt, Homo sapiens
cccagaagcagcagaagga

SEQ ID NO: 11838 - RNA, 19 nt, Homo sapiens
ugcaagauccuggugcuaa

SEQ ID NO: 11839 - RNA, 19 nt, Homo sapiens
caagaucagcagugucuac

SEQ ID NO: 11840 - RNA, 19 nt, Homo sapiens
ggagcuaucucuacauuua

SEQ ID NO: 11841 - RNA, 19 nt, Homo sapiens
gaccgaaacuggcaucuua

SEQ ID NO: 11842 - RNA, 19 nt, Homo sapiens
ggaaauggcuuuaauucug

SEQ ID NO: 11843 - RNA, 19 nt, Homo sapiens
gaaauccucuguuggcuuu

SEQ ID NO: 11844 - RNA, 19 nt, Homo sapiens
ggaagaaacuagaacuuga

SEQ ID NO: 11845 - RNA, 19 nt, Homo sapiens
gaaauggcuuuaauucuga

SEQ ID NO: 11846 - RNA, 19 nt, Homo sapiens
gaacaagauucgagaacaa

SEQ ID NO: 11847 - RNA, 19 nt, Homo sapiens
caaagugacuagccaaauu

SEQ ID NO: 11848 - RNA, 19 nt, Homo sapiens
gaaaugagcccuucaggau

SEQ ID NO: 11849 - RNA, 19 nt, Homo sapiens
cagaggaaaugcugacuuu

SEQ ID NO: 11850 - RNA, 19 nt, Homo sapiens
gaacaacuccuccaacauc

SEQ ID NO: 11851 - RNA, 19 nt, Homo sapiens
uuuguuggcuccuaaauua

SEQ ID NO: 11852 - RNA, 19 nt, Homo sapiens
aaugagcccuucaggauua

SEQ ID NO: 11853 - RNA, 19 nt, Homo sapiens
gaaagaaacugccccagaa

SEQ ID NO: 11854 - RNA, 19 nt, Homo sapiens
agaaagagguggagaggaa

SEQ ID NO: 11855 - RNA, 19 nt, Homo sapiens
gcugauggcuuagcuugua

SEQ ID NO: 11856 - RNA, 19 nt, Homo sapiens
gcagaaauuugggaaguug

SEQ ID NO: 11857 - RNA, 19 nt, Homo sapiens
cccaagggcugauggcuua

SEQ ID NO: 11858 - RNA, 19 nt, Homo sapiens
gaacaaaaccgacaagaug

SEQ ID NO: 11859 - RNA, 19 nt, Homo sapiens
cagauuagcuggguggauu

SEQ ID NO: 11860 - RNA, 19 nt, Homo sapiens
ucucuucucuuuccacuuu

SEQ ID NO: 11861 - RNA, 19 nt, Homo sapiens
gaaaguggaguccugauuc

SEQ ID NO: 11862 - RNA, 19 nt, Homo sapiens
ggaacaagauucgagaaca

SEQ ID NO: 11863 - RNA, 19 nt, Homo sapiens
gggaacaacuccuccaaca

SEQ ID NO: 11864 - RNA, 19 nt, Homo sapiens
gguaauggccacaguuauu

SEQ ID NO: 11865 - RNA, 19 nt, Homo sapiens
gcaaaggccugagccagau

SEQ ID NO: 11866 - RNA, 19 nt, Homo sapiens
gaaacuagaacuugaugga

SEQ ID NO: 11867 - RNA, 19 nt, Homo sapiens
gcaaggagcaggaccacuu

SEQ ID NO: 11868 - RNA, 19 nt, Homo sapiens
ucagagaaaugcuggguau

SEQ ID NO: 11869 - RNA, 19 nt, Homo sapiens
ggauggagcuaucucuaca

SEQ ID NO: 11870 - RNA, 19 nt, Homo sapiens
ugaguaagguccauuucuu

SEQ ID NO: 11871 - RNA, 19 nt, Homo sapiens
gaagacagaaacaagcaaa

SEQ ID NO: 11872 - RNA, 19 nt, Homo sapiens
gaccggagauagcuaagau

SEQ ID NO: 11873 - RNA, 19 nt, Homo sapiens
caacauaagaggccaggaa

SEQ ID NO: 11874 - RNA, 19 nt, Homo sapiens
ccaagucucccucaaagaa

SEQ ID NO: 11875 - RNA, 19 nt, Homo sapiens
caugacaccuggagcaaug

SEQ ID NO: 11876 - RNA, 19 nt, Homo sapiens
gaaacuggcaucuuacucu

SEQ ID NO: 11877 - RNA, 19 nt, Homo sapiens
ccacagagcccgaaacaac

SEQ ID NO: 11878 - RNA, 19 nt, Homo sapiens
gcaaagccgccaccacaga

SEQ ID NO: 11879 - RNA, 19 nt, Homo sapiens
cagaaacacuugcuuacag

SEQ ID NO: 11880 - RNA, 19 nt, Homo sapiens
gcaagaaggccagaaaugg

SEQ ID NO: 11881 - RNA, 19 nt, Homo sapiens
guugugggcugccuuuguu

SEQ ID NO: 11882 - RNA, 19 nt, Homo sapiens
cgaaggaggcagagacaaa

SEQ ID NO: 11883 - RNA, 19 nt, Homo sapiens
gaagaaacuagaacuugau

SEQ ID NO: 11884 - RNA, 19 nt, Homo sapiens
ccaacucagucauucuuug

SEQ ID NO: 11885 - RNA, 19 nt, Homo sapiens
agaaacacuugcuuacaga

SEQ ID NO: 11886 - RNA, 19 nt, Homo sapiens
guggaguccugauucauga

SEQ ID NO: 11887 - RNA, 19 nt, Homo sapiens
gagacgaggauaccaaaga

SEQ ID NO: 11888 - RNA, 19 nt, Homo sapiens
cauggaaccacuugaauga

SEQ ID NO: 11889 - RNA, 19 nt, Homo sapiens
gggcagaaauuugggaagu

SEQ ID NO: 11890 - RNA, 19 nt, Homo sapiens
augaaugucuccaugauga

SEQ ID NO: 11891 - RNA, 19 nt, Homo sapiens
ccaacacugucuucucaug

SEQ ID NO: 11892 - RNA, 19 nt, Homo sapiens
cagaggagaaucagaaaug

SEQ ID NO: 11893 - RNA, 19 nt, Homo sapiens
cagcagaggagaaucagaa

SEQ ID NO: 11894 - RNA, 19 nt, Homo sapiens
agagaaaucaggugacuug

SEQ ID NO: 11895 - RNA, 19 nt, Homo sapiens
gggcucaccuuccaagucu

SEQ ID NO: 11896 - RNA, 19 nt, Homo sapiens
gggaguuucuugcagugaa

SEQ ID NO: 11897 - RNA, 19 nt, Homo sapiens
guaauggccacaguuauug

SEQ ID NO: 11898 - RNA, 19 nt, Homo sapiens
ggauggaagagcuauaaga

SEQ ID NO: 11899 - RNA, 19 nt, Homo sapiens
acccugagcuuucuucaug

SEQ ID NO: 11900 - RNA, 19 nt, Homo sapiens
gcuaaggagggauagagua

SEQ ID NO: 11901 - RNA, 19 nt, Homo sapiens
ccagagggcucaccuucca

SEQ ID NO: 11902 - RNA, 19 nt, Homo sapiens
gagaugaggaacaagauuc

SEQ ID NO: 11903 - RNA, 19 nt, Homo sapiens
cauguaagcugaggauugg

SEQ ID NO: 11904 - RNA, 19 nt, Homo sapiens
caagagaaaucaggugacu

SEQ ID NO: 11905 - RNA, 19 nt, Homo sapiens
aaaguggaguccugauuca

SEQ ID NO: 11906 - RNA, 19 nt, Homo sapiens
gcagggcugugagggacua

SEQ ID NO: 11907 - RNA, 19 nt, Homo sapiens
ggagaggaagaaacuagaa

SEQ ID NO: 11908 - RNA, 19 nt, Homo sapiens
aaacuggcaucuuacucuu

SEQ ID NO: 11909 - RNA, 19 nt, Homo sapiens
uggaaccacuugaaugaug

SEQ ID NO: 11910 - RNA, 19 nt, Homo sapiens
gagcuaucucuacauuuaa

SEQ ID NO: 11911 - RNA, 19 nt, Homo sapiens
ucucacaggcucagacuaa

SEQ ID NO: 11912 - RNA, 19 nt, Homo sapiens
agaacuugauggagagaaa

SEQ ID NO: 11913 - RNA, 19 nt, Homo sapiens
ggagaugaggaacaagauu

SEQ ID NO: 11914 - RNA, 19 nt, Homo sapiens
gaaguugaaauccucuguu

SEQ ID NO: 11915 - RNA, 19 nt, Homo sapiens
ucaaggaaguacuggagau

SEQ ID NO: 11916 - RNA, 19 nt, Homo sapiens
agaggagaaucagaaauga

SEQ ID NO: 11917 - RNA, 19 nt, Homo sapiens
gaaauuugggaaguugaaa

SEQ ID NO: 11918 - RNA, 19 nt, Homo sapiens
uaagaggccaggaacuuga

SEQ ID NO: 11919 - RNA, 19 nt, Homo sapiens
cgaccaacccuucguuuua

SEQ ID NO: 11920 - RNA, 19 nt, Homo sapiens
ggaagguacuaagaagaca

SEQ ID NO: 11921 - RNA, 19 nt, Homo sapiens
cgaagcccgucuacagaga

SEQ ID NO: 11922 - RNA, 19 nt, Homo sapiens
ggccacaguuauuguuuua

SEQ ID NO: 11923 - RNA, 19 nt, Homo sapiens
gcucagggcagaaauuugg

SEQ ID NO: 11924 - RNA, 19 nt, Homo sapiens
gaacuugaccccuuugaau

SEQ ID NO: 11925 - RNA, 19 nt, Homo sapiens
guaggacccuggaccacau

SEQ ID NO: 11926 - RNA, 19 nt, Homo sapiens
guacuaagaagacagaaac

SEQ ID NO: 11927 - RNA, 19 nt, Homo sapiens
ugccaacacugucuucuca

SEQ ID NO: 11928 - RNA, 19 nt, Homo sapiens
acgcugaccugcagauuag

SEQ ID NO: 11929 - RNA, 19 nt, Homo sapiens
gcuuuggguuguauaagga

SEQ ID NO: 11930 - RNA, 19 nt, Homo sapiens
ggcagaaauuugggaaguu

SEQ ID NO: 11931 - RNA, 19 nt, Homo sapiens
cauaagaggccaggaacuu

SEQ ID NO: 11932 - RNA, 19 nt, Homo sapiens
gcaagcacagggcuaagga

SEQ ID NO: 11933 - RNA, 19 nt, Homo sapiens
aagaagcgcgucaccauga

SEQ ID NO: 11934 - RNA, 19 nt, Homo sapiens
aaguugaaauccucuguug

SEQ ID NO: 11935 - RNA, 19 nt, Homo sapiens
gauggaagagcuauaagag

SEQ ID NO: 11936 - RNA, 19 nt, Homo sapiens
gaggaagaaacuagaacuu

SEQ ID NO: 11937 - RNA, 19 nt, Homo sapiens
acagagagccagcugaugu

SEQ ID NO: 11938 - RNA, 19 nt, Homo sapiens
caacucagucauucuuugu

SEQ ID NO: 11939 - RNA, 19 nt, Homo sapiens
ggcaagaaggccagaaaug

SEQ ID NO: 11940 - RNA, 19 nt, Homo sapiens
ggaaauggcuuuaauucug

SEQ ID NO: 11941 - RNA, 19 nt, Homo sapiens
gaaauggcuuuaauucuga

SEQ ID NO: 11942 - RNA, 19 nt, Homo sapiens
gaacaagauucgagaacaa

SEQ ID NO: 11943 - RNA, 19 nt, Homo sapiens
gaacaacuccuccaacauc

SEQ ID NO: 11944 - RNA, 19 nt, Homo sapiens
ggaaauacaggaaauguuc

SEQ ID NO: 11945 - RNA, 19 nt, Homo sapiens
cuggaaagaugaucaugua

SEQ ID NO: 11946 - RNA, 19 nt, Homo sapiens
gaacaaaaccgacaagaug

SEQ ID NO: 11947 - RNA, 19 nt, Homo sapiens
cagauuagcuggguggauu

SEQ ID NO: 11948 - RNA, 19 nt, Homo sapiens
ggaacaagauucgagaaca

SEQ ID NO: 11949 - RNA, 19 nt, Homo sapiens
gggaacaacuccuccaaca

SEQ ID NO: 11950 - RNA, 19 nt, Homo sapiens
gcaaggagcaggaccacuu

SEQ ID NO: 11951 - RNA, 19 nt, Homo sapiens
gcacugggcuggagaacac

SEQ ID NO: 11952 - RNA, 19 nt, Homo sapiens
gaccggagauagcuaagau

SEQ ID NO: 11953 - RNA, 19 nt, Homo sapiens
gaucauguacccauagaga

SEQ ID NO: 11954 - RNA, 19 nt, Homo sapiens
ccacacaaacccacauuga

SEQ ID NO: 11955 - RNA, 19 nt, Homo sapiens
cacauugaguuagaaagua

SEQ ID NO: 11956 - RNA, 19 nt, Homo sapiens
aaacccacauugaguuaga

SEQ ID NO: 11957 - RNA, 19 nt, Homo sapiens
augaaugucuccaugauga

SEQ ID NO: 11958 - RNA, 19 nt, Homo sapiens
gggaguuucuugcagugaa

SEQ ID NO: 11959 - RNA, 19 nt, Homo sapiens
gagaugaggaacaagauuc

SEQ ID NO: 11960 - RNA, 19 nt, Homo sapiens
gaugggaagggacaauauu

SEQ ID NO: 11961 - RNA, 19 nt, Homo sapiens
gcagggcugugagggacua

SEQ ID NO: 11962 - RNA, 19 nt, Homo sapiens
ggacaauauuacccacaca

SEQ ID NO: 11963 - RNA, 19 nt, Homo sapiens
ggagaugaggaacaagauu

SEQ ID NO: 11964 - RNA, 19 nt, Homo sapiens
acaaacccacauugaguua

SEQ ID NO: 11965 - RNA, 19 nt, Homo sapiens
ucaaggaaguacuggagau

SEQ ID NO: 11966 - RNA, 19 nt, Homo sapiens
gaucuugggugccuuugcu

SEQ ID NO: 11967 - RNA, 19 nt, Homo sapiens
ggaccagggaggacaaugu

SEQ ID NO: 11968 - RNA, 19 nt, Homo sapiens
aagaagcgcgucaccauga

SEQ ID NO: 11969 - RNA, 19 nt, Homo sapiens
acgcugaccugcagauuag

SEQ ID NO: 11970 - RNA, 19 nt, Homo sapiens
ccucuagccugguaugaca

SEQ ID NO: 11971 - RNA, 19 nt, Homo sapiens
gggaaauacaggaaauguu

SEQ ID NO: 11972 - RNA, 19 nt, Homo sapiens
uggcauguguuugaaauca

SEQ ID NO: 11973 - RNA, 19 nt, Homo sapiens
ccacauugaguuagaaagu

SEQ ID NO: 11974 - RNA, 19 nt, Homo sapiens
acacaaacccacauugagu

SEQ ID NO: 11975 - RNA, 19 nt, Homo sapiens
gagcgucauugccgagaag

SEQ ID NO: 11976 - RNA, 19 nt, Homo sapiens
agaauucuggcauguguuu

SEQ ID NO: 11977 - RNA, 19 nt, Homo sapiens
ggaugggaagggacaauau

SEQ ID NO: 11978 - RNA, 19 nt, Homo sapiens
cccgacaucuuccaugaau

SEQ ID NO: 11979 - RNA, 19 nt, Homo sapiens
gcgggaaauggcuuuaauu

SEQ ID NO: 11980 - RNA, 19 nt, Homo sapiens
cguccagccugaucaagga

SEQ ID NO: 11981 - RNA, 19 nt, Homo sapiens
ggugcaagaucagcagugu

SEQ ID NO: 11982 - RNA, 19 nt, Homo sapiens
uguuugagguuguguagau

SEQ ID NO: 11983 - RNA, 19 nt, Homo sapiens
gagaagggguauauagaca

SEQ ID NO: 11984 - RNA, 19 nt, Homo sapiens
uaugucacguugagaguca

SEQ ID NO: 11985 - RNA, 19 nt, Homo sapiens
acagaucgcggacuucaug

SEQ ID NO: 11986 - RNA, 19 nt, Homo sapiens
gacaauauuacccacacaa

SEQ ID NO: 11987 - RNA, 19 nt, Homo sapiens
ccgacaagaugugaaguca

SEQ ID NO: 11988 - RNA, 19 nt, Homo sapiens
ggaguuucuugcagugaag

SEQ ID NO: 11989 - RNA, 19 nt, Homo sapiens
ccagcugagugacaccuau

SEQ ID NO: 11990 - RNA, 19 nt, Homo sapiens
ggaacaacuccuccaacau

SEQ ID NO: 11991 - RNA, 19 nt, Homo sapiens
gggaaauggcuuuaauucu

SEQ ID NO: 11992 - RNA, 19 nt, Homo sapiens
gcauguguuugaaaucacu

SEQ ID NO: 11993 - RNA, 19 nt, Homo sapiens
cacaaacccacauugaguu

SEQ ID NO: 11994 - RNA, 19 nt, Homo sapiens
agaugaucauguacccaua

SEQ ID NO: 11995 - RNA, 19 nt, Homo sapiens
cgggaaauggcuuuaauuc

SEQ ID NO: 11996 - RNA, 19 nt, Homo sapiens
cgacagaucgcggacuuca

SEQ ID NO: 11997 - RNA, 19 nt, Homo sapiens
uccaggagcagaugaagaa

SEQ ID NO: 11998 - RNA, 19 nt, Homo sapiens
gcauuuuccuuagcaguaa

SEQ ID NO: 11999 - RNA, 19 nt, Homo sapiens
acaauauuacccacacaaa

SEQ ID NO: 12000 - RNA, 19 nt, Homo sapiens
gaggaacaagauucgagaa

SEQ ID NO: 12001 - RNA, 19 nt, Homo sapiens
gaugacgccuaucaaugac

SEQ ID NO: 12002 - RNA, 19 nt, Homo sapiens
ucaaccugauggagcagaa

SEQ ID NO: 12003 - RNA, 19 nt, Homo sapiens
acaccuaugucacguugag

SEQ ID NO: 12004 - RNA, 19 nt, Homo sapiens
agaagaagcgcgucaccau

SEQ ID NO: 12005 - RNA, 19 nt, Homo sapiens
ucuggcauguguuugaaau

SEQ ID NO: 12006 - RNA, 19 nt, Homo sapiens
gaugaucauguacccauag

SEQ ID NO: 12007 - RNA, 19 nt, Homo sapiens
caagaucagcagugucuac

SEQ ID NO: 12008 - RNA, 19 nt, Homo sapiens
augggaagggacaauauua

SEQ ID NO: 12009 - RNA, 19 nt, Homo sapiens
ccccaaacccauaaaauaa

SEQ ID NO: 12010 - RNA, 19 nt, Homo sapiens
guacuggagaugaggaaca

SEQ ID NO: 12011 - RNA, 19 nt, Homo sapiens
caaggaaguacuggagaug

SEQ ID NO: 12012 - RNA, 19 nt, Homo sapiens
gauguuugagguuguguag

SEQ ID NO: 12013 - RNA, 19 nt, Homo sapiens
caauauuacccacacaaac

SEQ ID NO: 12014 - RNA, 19 nt, Homo sapiens
cugagccucuagccuggua

SEQ ID NO: 12015 - RNA, 19 nt, Homo sapiens
caaggagcaggaccacuuc

SEQ ID NO: 12016 - RNA, 19 nt, Homo sapiens
gaaaucacugcugcuccuu

SEQ ID NO: 12017 - RNA, 19 nt, Homo sapiens
cucaugcggugcaagauca

SEQ ID NO: 12018 - RNA, 19 nt, Homo sapiens
gcagucuucccgacaucuu

SEQ ID NO: 12019 - RNA, 19 nt, Homo sapiens
gggcaugcauuuuccuuag

SEQ ID NO: 12020 - RNA, 19 nt, Homo sapiens
ucacugcugcuccuugcaa

SEQ ID NO: 12021 - RNA, 19 nt, Homo sapiens
ccaaacccauaaaauaaca

SEQ ID NO: 12022 - RNA, 19 nt, Homo sapiens
aacgcugaccugcagauua

SEQ ID NO: 12023 - RNA, 19 nt, Homo sapiens
cgagcgucauugccgagaa

SEQ ID NO: 12024 - RNA, 19 nt, Homo sapiens
ugcgggaaauggcuuuaau

SEQ ID NO: 12025 - RNA, 19 nt, Homo sapiens
gcucaugcggugcaagauc

SEQ ID NO: 12026 - RNA, 19 nt, Homo sapiens
gcaccucccacgcagucuu

SEQ ID NO: 12027 - RNA, 19 nt, Homo sapiens
uaucaaugaccuccacaca

SEQ ID NO: 12028 - RNA, 19 nt, Homo sapiens
ggauguuugagguugugua

SEQ ID NO: 12029 - RNA, 19 nt, Homo sapiens
ggagcuaucucuacauuua

SEQ ID NO: 12030 - RNA, 19 nt, Homo sapiens
gaccgaaacuggcaucuua

SEQ ID NO: 12031 - RNA, 19 nt, Homo sapiens
ggaaauggcuuuaauucug

SEQ ID NO: 12032 - RNA, 19 nt, Homo sapiens
gaaauccucuguuggcuuu

SEQ ID NO: 12033 - RNA, 19 nt, Homo sapiens
ggaagaaacuagaacuuga

SEQ ID NO: 12034 - RNA, 19 nt, Homo sapiens
gaaauggcuuuaauucuga

SEQ ID NO: 12035 - RNA, 19 nt, Homo sapiens
gaacaagauucgagaacaa

SEQ ID NO: 12036 - RNA, 19 nt, Homo sapiens
caaagugacuagccaaauu

SEQ ID NO: 12037 - RNA, 19 nt, Homo sapiens
gaaaugagcccuucaggau

SEQ ID NO: 12038 - RNA, 19 nt, Homo sapiens
cagaggaaaugcugacuuu

SEQ ID NO: 12039 - RNA, 19 nt, Homo sapiens
ggucacagccuucguguuu

SEQ ID NO: 12040 - RNA, 19 nt, Homo sapiens
uuuguuggcuccuaaauua

SEQ ID NO: 12041 - RNA, 19 nt, Homo sapiens
aaugagcccuucaggauua

SEQ ID NO: 12042 - RNA, 19 nt, Homo sapiens
gaaagaaacugccccagaa

SEQ ID NO: 12043 - RNA, 19 nt, Homo sapiens
agaaagagguggagaggaa

SEQ ID NO: 12044 - RNA, 19 nt, Homo sapiens
gcugauggcuuagcuugua

SEQ ID NO: 12045 - RNA, 19 nt, Homo sapiens
gcagaaauuugggaaguug

SEQ ID NO: 12046 - RNA, 19 nt, Homo sapiens
cccaagggcugauggcuua

SEQ ID NO: 12047 - RNA, 19 nt, Homo sapiens
cagaacagguuacacguau

SEQ ID NO: 12048 - RNA, 19 nt, Homo sapiens
gaacaaaaccgacaagaug

SEQ ID NO: 12049 - RNA, 19 nt, Homo sapiens
cagauuagcuggguggauu

SEQ ID NO: 12050 - RNA, 19 nt, Homo sapiens
ucucuucucuuuccacuuu

SEQ ID NO: 12051 - RNA, 19 nt, Homo sapiens
gaaaguggaguccugauuc

SEQ ID NO: 12052 - RNA, 19 nt, Homo sapiens
ggaacaagauucgagaaca

SEQ ID NO: 12053 - RNA, 19 nt, Homo sapiens
gguaauggccacaguuauu

SEQ ID NO: 12054 - RNA, 19 nt, Homo sapiens
gcaaaggccugagccagau

SEQ ID NO: 12055 - RNA, 19 nt, Homo sapiens
gaaacuagaacuugaugga

SEQ ID NO: 12056 - RNA, 19 nt, Homo sapiens
ucagagaaaugcuggguau

SEQ ID NO: 12057 - RNA, 19 nt, Homo sapiens
ggauggagcuaucucuaca

SEQ ID NO: 12058 - RNA, 19 nt, Homo sapiens
ugaguaagguccauuucuu

SEQ ID NO: 12059 - RNA, 19 nt, Homo sapiens
gaagacagaaacaagcaaa

SEQ ID NO: 12060 - RNA, 19 nt, Homo sapiens
gaccggagauagcuaagau

SEQ ID NO: 12061 - RNA, 19 nt, Homo sapiens
caacauaagaggccaggaa

SEQ ID NO: 12062 - RNA, 19 nt, Homo sapiens
ccaagucucccucaaagaa

SEQ ID NO: 12063 - RNA, 19 nt, Homo sapiens
ucacagccuucguguuuga

SEQ ID NO: 12064 - RNA, 19 nt, Homo sapiens
caugacaccuggagcaaug

SEQ ID NO: 12065 - RNA, 19 nt, Homo sapiens
ucaauacgcccaacaccua

SEQ ID NO: 12066 - RNA, 19 nt, Homo sapiens
gaaacuggcaucuuacucu

SEQ ID NO: 12067 - RNA, 19 nt, Homo sapiens
ccacagagcccgaaacaac

SEQ ID NO: 12068 - RNA, 19 nt, Homo sapiens
gcaaagccgccaccacaga

SEQ ID NO: 12069 - RNA, 19 nt, Homo sapiens
cagaaacacuugcuuacag

SEQ ID NO: 12070 - RNA, 19 nt, Homo sapiens
gcaagaaggccagaaaugg

SEQ ID NO: 12071 - RNA, 19 nt, Homo sapiens
guugugggcugccuuuguu

SEQ ID NO: 12072 - RNA, 19 nt, Homo sapiens
cgaaggaggcagagacaaa

SEQ ID NO: 12073 - RNA, 19 nt, Homo sapiens
gaagaaacuagaacuugau

SEQ ID NO: 12074 - RNA, 19 nt, Homo sapiens
ccaacucagucauucuuug

SEQ ID NO: 12075 - RNA, 19 nt, Homo sapiens
agaaacacuugcuuacaga

SEQ ID NO: 12076 - RNA, 19 nt, Homo sapiens
guggaguccugauucauga

SEQ ID NO: 12077 - RNA, 19 nt, Homo sapiens
gagacgaggauaccaaaga

SEQ ID NO: 12078 - RNA, 19 nt, Homo sapiens
cauggaaccacuugaauga

SEQ ID NO: 12079 - RNA, 19 nt, Homo sapiens
gggcagaaauuugggaagu

SEQ ID NO: 12080 - RNA, 19 nt, Homo sapiens
aagacccgcuggcucaaua

SEQ ID NO: 12081 - RNA, 19 nt, Homo sapiens
ccaacacugucuucucaug

SEQ ID NO: 12082 - RNA, 19 nt, Homo sapiens
cagaggagaaucagaaaug

SEQ ID NO: 12083 - RNA, 19 nt, Homo sapiens
cagcagaggagaaucagaa

SEQ ID NO: 12084 - RNA, 19 nt, Homo sapiens
agagaaaucaggugacuug

SEQ ID NO: 12085 - RNA, 19 nt, Homo sapiens
gggcucaccuuccaagucu

SEQ ID NO: 12086 - RNA, 19 nt, Homo sapiens
guaauggccacaguuauug

SEQ ID NO: 12087 - RNA, 19 nt, Homo sapiens
ggauggaagagcuauaaga

SEQ ID NO: 12088 - RNA, 19 nt, Homo sapiens
acccugagcuuucuucaug

SEQ ID NO: 12089 - RNA, 19 nt, Homo sapiens
gcuaaggagggauagagua

SEQ ID NO: 12090 - RNA, 19 nt, Homo sapiens
ccagagggcucaccuucca

SEQ ID NO: 12091 - RNA, 19 nt, Homo sapiens
gagaugaggaacaagauuc

SEQ ID NO: 12092 - RNA, 19 nt, Homo sapiens
cauguaagcugaggauugg

SEQ ID NO: 12093 - RNA, 19 nt, Homo sapiens
caagagaaaucaggugacu

SEQ ID NO: 12094 - RNA, 19 nt, Homo sapiens
aaaguggaguccugauuca

SEQ ID NO: 12095 - RNA, 19 nt, Homo sapiens
gcagggcugugagggacua

SEQ ID NO: 12096 - RNA, 19 nt, Homo sapiens
ggagaggaagaaacuagaa

SEQ ID NO: 12097 - RNA, 19 nt, Homo sapiens
aaacuggcaucuuacucuu

SEQ ID NO: 12098 - RNA, 19 nt, Homo sapiens
uggaaccacuugaaugaug

SEQ ID NO: 12099 - RNA, 19 nt, Homo sapiens
gagcuaucucuacauuuaa

SEQ ID NO: 12100 - RNA, 19 nt, Homo sapiens
ucucacaggcucagacuaa

SEQ ID NO: 12101 - RNA, 19 nt, Homo sapiens
agaacuugauggagagaaa

SEQ ID NO: 12102 - RNA, 19 nt, Homo sapiens
ggagaugaggaacaagauu

SEQ ID NO: 12103 - RNA, 19 nt, Homo sapiens
caauuugugccucucuaua

SEQ ID NO: 12104 - RNA, 19 nt, Homo sapiens
gaaguugaaauccucuguu

SEQ ID NO: 12105 - RNA, 19 nt, Homo sapiens
agaggagaaucagaaauga

SEQ ID NO: 12106 - RNA, 19 nt, Homo sapiens
gaaauuugggaaguugaaa

SEQ ID NO: 12107 - RNA, 19 nt, Homo sapiens
uaagaggccaggaacuuga

SEQ ID NO: 12108 - RNA, 19 nt, Homo sapiens
cgaccaacccuucguuuua

SEQ ID NO: 12109 - RNA, 19 nt, Homo sapiens
ggaagguacuaagaagaca

SEQ ID NO: 12110 - RNA, 19 nt, Homo sapiens
cgaagcccgucuacagaga

SEQ ID NO: 12111 - RNA, 19 nt, Homo sapiens
ggccacaguuauuguuuua

SEQ ID NO: 12112 - RNA, 19 nt, Homo sapiens
gcucagggcagaaauuugg

SEQ ID NO: 12113 - RNA, 19 nt, Homo sapiens
gaacuugaccccuuugaau

SEQ ID NO: 12114 - RNA, 19 nt, Homo sapiens
guaggacccuggaccacau

SEQ ID NO: 12115 - RNA, 19 nt, Homo sapiens
guacuaagaagacagaaac

SEQ ID NO: 12116 - RNA, 19 nt, Homo sapiens
ugccaacacugucuucuca

SEQ ID NO: 12117 - RNA, 19 nt, Homo sapiens
gcuuuggguuguauaagga

SEQ ID NO: 12118 - RNA, 19 nt, Homo sapiens
ggcagaaauuugggaaguu

SEQ ID NO: 12119 - RNA, 19 nt, Homo sapiens
cauaagaggccaggaacuu

SEQ ID NO: 12120 - RNA, 19 nt, Homo sapiens
acgcugaccugcagauuag

SEQ ID NO: 12121 - RNA, 19 nt, Homo sapiens
gcaagcacagggcuaagga

SEQ ID NO: 12122 - RNA, 19 nt, Homo sapiens
aagaagcgcgucaccauga

SEQ ID NO: 12123 - RNA, 19 nt, Homo sapiens
aaguugaaauccucuguug

SEQ ID NO: 12124 - RNA, 19 nt, Homo sapiens
gauggaagagcuauaagag

SEQ ID NO: 12125 - RNA, 19 nt, Homo sapiens
gaggaagaaacuagaacuu

SEQ ID NO: 12126 - RNA, 19 nt, Homo sapiens
acagagagccagcugaugu

SEQ ID NO: 12127 - RNA, 19 nt, Homo sapiens
gagaaaaccaaacacaaaa

SEQ ID NO: 12128 - RNA, 19 nt, Homo sapiens
gaacagguuacacguaucg

SEQ ID NO: 12129 - RNA, 19 nt, Homo sapiens
ggagcuaucucuacauuua

SEQ ID NO: 12130 - RNA, 19 nt, Homo sapiens
gaccgaaacuggcaucuua

SEQ ID NO: 12131 - RNA, 19 nt, Homo sapiens
ggaaauggcuuuaauucug

SEQ ID NO: 12132 - RNA, 19 nt, Homo sapiens
gaaauccucuguuggcuuu

SEQ ID NO: 12133 - RNA, 19 nt, Homo sapiens
ggaagaaacuagaacuuga

SEQ ID NO: 12134 - RNA, 19 nt, Homo sapiens
gaaauggcuuuaauucuga

SEQ ID NO: 12135 - RNA, 19 nt, Homo sapiens
gaacaagauucgagaacaa

SEQ ID NO: 12136 - RNA, 19 nt, Homo sapiens
caaagugacuagccaaauu

SEQ ID NO: 12137 - RNA, 19 nt, Homo sapiens
gaaaugagcccuucaggau

SEQ ID NO: 12138 - RNA, 19 nt, Homo sapiens
cagaggaaaugcugacuuu

SEQ ID NO: 12139 - RNA, 19 nt, Homo sapiens
ggucacagccuucguguuu

SEQ ID NO: 12140 - RNA, 19 nt, Homo sapiens
uuuguuggcuccuaaauua

SEQ ID NO: 12141 - RNA, 19 nt, Homo sapiens
aaugagcccuucaggauua

SEQ ID NO: 12142 - RNA, 19 nt, Homo sapiens
gaaagaaacugccccagaa

SEQ ID NO: 12143 - RNA, 19 nt, Homo sapiens
agaaagagguggagaggaa

SEQ ID NO: 12144 - RNA, 19 nt, Homo sapiens
gcugauggcuuagcuugua

SEQ ID NO: 12145 - RNA, 19 nt, Homo sapiens
gcagaaauuugggaaguug

SEQ ID NO: 12146 - RNA, 19 nt, Homo sapiens
cccaagggcugauggcuua

SEQ ID NO: 12147 - RNA, 19 nt, Homo sapiens
cagaacagguuacacguau

SEQ ID NO: 12148 - RNA, 19 nt, Homo sapiens
gaacaaaaccgacaagaug

SEQ ID NO: 12149 - RNA, 19 nt, Homo sapiens
cagauuagcuggguggauu

SEQ ID NO: 12150 - RNA, 19 nt, Homo sapiens
ucucuucucuuuccacuuu

SEQ ID NO: 12151 - RNA, 19 nt, Homo sapiens
gaaaguggaguccugauuc

SEQ ID NO: 12152 - RNA, 19 nt, Homo sapiens
ggaacaagauucgagaaca

SEQ ID NO: 12153 - RNA, 19 nt, Homo sapiens
gguaauggccacaguuauu

SEQ ID NO: 12154 - RNA, 19 nt, Homo sapiens
gcaaaggccugagccagau

SEQ ID NO: 12155 - RNA, 19 nt, Homo sapiens
gaaacuagaacuugaugga

SEQ ID NO: 12156 - RNA, 19 nt, Homo sapiens
ucagagaaaugcuggguau

SEQ ID NO: 12157 - RNA, 19 nt, Homo sapiens
ggauggagcuaucucuaca

SEQ ID NO: 12158 - RNA, 19 nt, Homo sapiens
ugaguaagguccauuucuu

SEQ ID NO: 12159 - RNA, 19 nt, Homo sapiens
gaagacagaaacaagcaaa

SEQ ID NO: 12160 - RNA, 19 nt, Homo sapiens
gaccggagauagcuaagau

SEQ ID NO: 12161 - RNA, 19 nt, Homo sapiens
caacauaagaggccaggaa

SEQ ID NO: 12162 - RNA, 19 nt, Homo sapiens
ccaagucucccucaaagaa

SEQ ID NO: 12163 - RNA, 19 nt, Homo sapiens
ucacagccuucguguuuga

SEQ ID NO: 12164 - RNA, 19 nt, Homo sapiens
caugacaccuggagcaaug

SEQ ID NO: 12165 - RNA, 19 nt, Homo sapiens
ucaauacgcccaacaccua

SEQ ID NO: 12166 - RNA, 19 nt, Homo sapiens
gaaacuggcaucuuacucu

SEQ ID NO: 12167 - RNA, 19 nt, Homo sapiens
ccacagagcccgaaacaac

SEQ ID NO: 12168 - RNA, 19 nt, Homo sapiens
gcaaagccgccaccacaga

SEQ ID NO: 12169 - RNA, 19 nt, Homo sapiens
cagaaacacuugcuuacag

SEQ ID NO: 12170 - RNA, 19 nt, Homo sapiens
gcaagaaggccagaaaugg

SEQ ID NO: 12171 - RNA, 19 nt, Homo sapiens
guugugggcugccuuuguu

SEQ ID NO: 12172 - RNA, 19 nt, Homo sapiens
cgaaggaggcagagacaaa

SEQ ID NO: 12173 - RNA, 19 nt, Homo sapiens
gaagaaacuagaacuugau

SEQ ID NO: 12174 - RNA, 19 nt, Homo sapiens
ccaacucagucauucuuug

SEQ ID NO: 12175 - RNA, 19 nt, Homo sapiens
agaaacacuugcuuacaga

SEQ ID NO: 12176 - RNA, 19 nt, Homo sapiens
guggaguccugauucauga

SEQ ID NO: 12177 - RNA, 19 nt, Homo sapiens
gagacgaggauaccaaaga

SEQ ID NO: 12178 - RNA, 19 nt, Homo sapiens
cauggaaccacuugaauga

SEQ ID NO: 12179 - RNA, 19 nt, Homo sapiens
gggcagaaauuugggaagu

SEQ ID NO: 12180 - RNA, 19 nt, Homo sapiens
aagacccgcuggcucaaua

SEQ ID NO: 12181 - RNA, 19 nt, Homo sapiens
ccaacacugucuucucaug

SEQ ID NO: 12182 - RNA, 19 nt, Homo sapiens
cagaggagaaucagaaaug

SEQ ID NO: 12183 - RNA, 19 nt, Homo sapiens
cagcagaggagaaucagaa

SEQ ID NO: 12184 - RNA, 19 nt, Homo sapiens
agagaaaucaggugacuug

SEQ ID NO: 12185 - RNA, 19 nt, Homo sapiens
gggcucaccuuccaagucu

SEQ ID NO: 12186 - RNA, 19 nt, Homo sapiens
guaauggccacaguuauug

SEQ ID NO: 12187 - RNA, 19 nt, Homo sapiens
ggauggaagagcuauaaga

SEQ ID NO: 12188 - RNA, 19 nt, Homo sapiens
acccugagcuuucuucaug

SEQ ID NO: 12189 - RNA, 19 nt, Homo sapiens
gcuaaggagggauagagua

SEQ ID NO: 12190 - RNA, 19 nt, Homo sapiens
ccagagggcucaccuucca

SEQ ID NO: 12191 - RNA, 19 nt, Homo sapiens
gagaugaggaacaagauuc

SEQ ID NO: 12192 - RNA, 19 nt, Homo sapiens
cauguaagcugaggauugg

SEQ ID NO: 12193 - RNA, 19 nt, Homo sapiens
caagagaaaucaggugacu

SEQ ID NO: 12194 - RNA, 19 nt, Homo sapiens
aaaguggaguccugauuca

SEQ ID NO: 12195 - RNA, 19 nt, Homo sapiens
gcagggcugugagggacua

SEQ ID NO: 12196 - RNA, 19 nt, Homo sapiens
ggagaggaagaaacuagaa

SEQ ID NO: 12197 - RNA, 19 nt, Homo sapiens
aaacuggcaucuuacucuu

SEQ ID NO: 12198 - RNA, 19 nt, Homo sapiens
uggaaccacuugaaugaug

SEQ ID NO: 12199 - RNA, 19 nt, Homo sapiens
gagcuaucucuacauuuaa

SEQ ID NO: 12200 - RNA, 19 nt, Homo sapiens
ucucacaggcucagacuaa

SEQ ID NO: 12201 - RNA, 19 nt, Homo sapiens
agaacuugauggagagaaa

SEQ ID NO: 12202 - RNA, 19 nt, Homo sapiens
ggagaugaggaacaagauu

SEQ ID NO: 12203 - RNA, 19 nt, Homo sapiens
caauuugugccucucuaua

SEQ ID NO: 12204 - RNA, 19 nt, Homo sapiens
gcagagucccggcuacaga

SEQ ID NO: 12205 - RNA, 19 nt, Homo sapiens
gaaguugaaauccucuguu

SEQ ID NO: 12206 - RNA, 19 nt, Homo sapiens
agaggagaaucagaaauga

SEQ ID NO: 12207 - RNA, 19 nt, Homo sapiens
gaaauuugggaaguugaaa

SEQ ID NO: 12208 - RNA, 19 nt, Homo sapiens
uaagaggccaggaacuuga

SEQ ID NO: 12209 - RNA, 19 nt, Homo sapiens
cgaccaacccuucguuuua

SEQ ID NO: 12210 - RNA, 19 nt, Homo sapiens
ggaagguacuaagaagaca

SEQ ID NO: 12211 - RNA, 19 nt, Homo sapiens
cgaagcccgucuacagaga

SEQ ID NO: 12212 - RNA, 19 nt, Homo sapiens
ggccacaguuauuguuuua

SEQ ID NO: 12213 - RNA, 19 nt, Homo sapiens
gcucagggcagaaauuugg

SEQ ID NO: 12214 - RNA, 19 nt, Homo sapiens
gaacuugaccccuuugaau

SEQ ID NO: 12215 - RNA, 19 nt, Homo sapiens
guaggacccuggaccacau

SEQ ID NO: 12216 - RNA, 19 nt, Homo sapiens
guacuaagaagacagaaac

SEQ ID NO: 12217 - RNA, 19 nt, Homo sapiens
ugccaacacugucuucuca

SEQ ID NO: 12218 - RNA, 19 nt, Homo sapiens
gcuuuggguuguauaagga

SEQ ID NO: 12219 - RNA, 19 nt, Homo sapiens
ggcagaaauuugggaaguu

SEQ ID NO: 12220 - RNA, 19 nt, Homo sapiens
cauaagaggccaggaacuu

SEQ ID NO: 12221 - RNA, 19 nt, Homo sapiens
acgcugaccugcagauuag

SEQ ID NO: 12222 - RNA, 19 nt, Homo sapiens
gcaagcacagggcuaagga

SEQ ID NO: 12223 - RNA, 19 nt, Homo sapiens
aagaagcgcgucaccauga

SEQ ID NO: 12224 - RNA, 19 nt, Homo sapiens
aaguugaaauccucuguug

SEQ ID NO: 12225 - RNA, 19 nt, Homo sapiens
gauggaagagcuauaagag

SEQ ID NO: 12226 - RNA, 19 nt, Homo sapiens
gaggaagaaacuagaacuu

SEQ ID NO: 12227 - RNA, 19 nt, Homo sapiens
acagagagccagcugaugu

SEQ ID NO: 12228 - RNA, 19 nt, Homo sapiens
gagaaaaccaaacacaaaa

SEQ ID NO: 12229 - RNA, 19 nt, Homo sapiens
ggaaauggcuuuaauucug

SEQ ID NO: 12230 - RNA, 19 nt, Homo sapiens
gaaauggcuuuaauucuga

SEQ ID NO: 12231 - RNA, 19 nt, Homo sapiens
gaacaagauucgagaacaa

SEQ ID NO: 12232 - RNA, 19 nt, Homo sapiens
ggucacagccuucguguuu

SEQ ID NO: 12233 - RNA, 19 nt, Homo sapiens
ggaaauacaggaaauguuc

SEQ ID NO: 12234 - RNA, 19 nt, Homo sapiens
cagaacagguuacacguau

SEQ ID NO: 12235 - RNA, 19 nt, Homo sapiens
cuggaaagaugaucaugua

SEQ ID NO: 12236 - RNA, 19 nt, Homo sapiens
gaacaaaaccgacaagaug

SEQ ID NO: 12237 - RNA, 19 nt, Homo sapiens
cagauuagcuggguggauu

SEQ ID NO: 12238 - RNA, 19 nt, Homo sapiens
ggaacaagauucgagaaca

SEQ ID NO: 12239 - RNA, 19 nt, Homo sapiens
gcacugggcuggagaacac

SEQ ID NO: 12240 - RNA, 19 nt, Homo sapiens
gaccggagauagcuaagau

SEQ ID NO: 12241 - RNA, 19 nt, Homo sapiens
ucacagccuucguguuuga

SEQ ID NO: 12242 - RNA, 19 nt, Homo sapiens
gaucauguacccauagaga

SEQ ID NO: 12243 - RNA, 19 nt, Homo sapiens
ucaauacgcccaacaccua

SEQ ID NO: 12244 - RNA, 19 nt, Homo sapiens
ccacacaaacccacauuga

SEQ ID NO: 12245 - RNA, 19 nt, Homo sapiens
cacauugaguuagaaagua

SEQ ID NO: 12246 - RNA, 19 nt, Homo sapiens
aaacccacauugaguuaga

SEQ ID NO: 12247 - RNA, 19 nt, Homo sapiens
aagacccgcuggcucaaua

SEQ ID NO: 12248 - RNA, 19 nt, Homo sapiens
gagaugaggaacaagauuc

SEQ ID NO: 12249 - RNA, 19 nt, Homo sapiens
gaugggaagggacaauauu

SEQ ID NO: 12250 - RNA, 19 nt, Homo sapiens
gcagggcugugagggacua

SEQ ID NO: 12251 - RNA, 19 nt, Homo sapiens
ggacaauauuacccacaca

SEQ ID NO: 12252 - RNA, 19 nt, Homo sapiens
ggagaugaggaacaagauu

SEQ ID NO: 12253 - RNA, 19 nt, Homo sapiens
caauuugugccucucuaua

SEQ ID NO: 12254 - RNA, 19 nt, Homo sapiens
gcagagucccggcuacaga

SEQ ID NO: 12255 - RNA, 19 nt, Homo sapiens
acaaacccacauugaguua

SEQ ID NO: 12256 - RNA, 19 nt, Homo sapiens
gaucuugggugccuuugcu

SEQ ID NO: 12257 - RNA, 19 nt, Homo sapiens
ggaccagggaggacaaugu

SEQ ID NO: 12258 - RNA, 19 nt, Homo sapiens
acgcugaccugcagauuag

SEQ ID NO: 12259 - RNA, 19 nt, Homo sapiens
aagaagcgcgucaccauga

SEQ ID NO: 12260 - RNA, 19 nt, Homo sapiens
ccucuagccugguaugaca

SEQ ID NO: 12261 - RNA, 19 nt, Homo sapiens
gagaaaaccaaacacaaaa

SEQ ID NO: 12262 - RNA, 19 nt, Homo sapiens
gaacagguuacacguaucg

SEQ ID NO: 12263 - RNA, 19 nt, Homo sapiens
gggaaauacaggaaauguu

SEQ ID NO: 12264 - RNA, 19 nt, Homo sapiens
gggucaauguggccgauga

SEQ ID NO: 12265 - RNA, 19 nt, Homo sapiens
uggcauguguuugaaauca

SEQ ID NO: 12266 - RNA, 19 nt, Homo sapiens
ccacauugaguuagaaagu

SEQ ID NO: 12267 - RNA, 19 nt, Homo sapiens
acacaaacccacauugagu

SEQ ID NO: 12268 - RNA, 19 nt, Homo sapiens
gagcgucauugccgagaag

SEQ ID NO: 12269 - RNA, 19 nt, Homo sapiens
agaagcagcagaaggagaa

SEQ ID NO: 12270 - RNA, 19 nt, Homo sapiens
aaagugagguggagauucc

SEQ ID NO: 12271 - RNA, 19 nt, Homo sapiens
agaauucuggcauguguuu

SEQ ID NO: 12272 - RNA, 19 nt, Homo sapiens
ggaugggaagggacaauau

SEQ ID NO: 12273 - RNA, 19 nt, Homo sapiens
gcaguggcaugccgauucg

SEQ ID NO: 12274 - RNA, 19 nt, Homo sapiens
gcgggaaauggcuuuaauu

SEQ ID NO: 12275 - RNA, 19 nt, Homo sapiens
uguuugagguuguguagau

SEQ ID NO: 12276 - RNA, 19 nt, Homo sapiens
gagaagggguauauagaca

SEQ ID NO: 12277 - RNA, 19 nt, Homo sapiens
gacaauauuacccacacaa

SEQ ID NO: 12278 - RNA, 19 nt, Homo sapiens
ccgacaagaugugaaguca

SEQ ID NO: 12279 - RNA, 19 nt, Homo sapiens
gggaaauggcuuuaauucu

SEQ ID NO: 12280 - RNA, 19 nt, Homo sapiens
cgaaaacccaaaccaauuu

SEQ ID NO: 12281 - RNA, 19 nt, Homo sapiens
cugacgagguggagaaauc

SEQ ID NO: 12282 - RNA, 19 nt, Homo sapiens
gcauguguuugaaaucacu

SEQ ID NO: 12283 - RNA, 19 nt, Homo sapiens
cccaagaccacguggauga

SEQ ID NO: 12284 - RNA, 19 nt, Homo sapiens
cacaaacccacauugaguu

SEQ ID NO: 12285 - RNA, 19 nt, Homo sapiens
agaugaucauguacccaua

SEQ ID NO: 12286 - RNA, 19 nt, Homo sapiens
cgggaaauggcuuuaauuc

SEQ ID NO: 12287 - RNA, 19 nt, Homo sapiens
acagaacagguuacacgua

SEQ ID NO: 12288 - RNA, 19 nt, Homo sapiens
gcauuuuccuuagcaguaa

SEQ ID NO: 12289 - RNA, 19 nt, Homo sapiens
acaauauuacccacacaaa

SEQ ID NO: 12290 - RNA, 19 nt, Homo sapiens
gaggaacaagauucgagaa

SEQ ID NO: 12291 - RNA, 19 nt, Homo sapiens
ucaaccugauggagcagaa

SEQ ID NO: 12292 - RNA, 19 nt, Homo sapiens
gaagacccgcuggcucaau

SEQ ID NO: 12293 - RNA, 19 nt, Homo sapiens
agaagaagcgcgucaccau

SEQ ID NO: 12294 - RNA, 19 nt, Homo sapiens
ucuggcauguguuugaaau

SEQ ID NO: 12295 - RNA, 19 nt, Homo sapiens
gaugaucauguacccauag

SEQ ID NO: 12296 - RNA, 19 nt, Homo sapiens
gacccaagaccacguggau

SEQ ID NO: 12297 - RNA, 19 nt, Homo sapiens
cccagaagcagcagaagga

SEQ ID NO: 12298 - RNA, 19 nt, Homo sapiens
cagagucccggcuacagaa

SEQ ID NO: 12299 - RNA, 19 nt, Homo sapiens
augggaagggacaauauua

SEQ ID NO: 12300 - RNA, 19 nt, Homo sapiens
guacuggagaugaggaaca

SEQ ID NO: 12301 - RNA, 19 nt, Homo sapiens
ccccaaacccauaaaauaa

SEQ ID NO: 12302 - RNA, 19 nt, Homo sapiens
gcgacagcaugcccagaag

SEQ ID NO: 12303 - RNA, 19 nt, Homo sapiens
gaaaaccaaacacaaaagu

SEQ ID NO: 12304 - RNA, 19 nt, Homo sapiens
caauauuacccacacaaac

SEQ ID NO: 12305 - RNA, 19 nt, Homo sapiens
cugagccucuagccuggua

SEQ ID NO: 12306 - RNA, 19 nt, Homo sapiens
ccaauuugugccucucuau

SEQ ID NO: 12307 - RNA, 19 nt, Homo sapiens
gauguuugagguuguguag

SEQ ID NO: 12308 - RNA, 19 nt, Homo sapiens
gaaaucacugcugcuccuu

SEQ ID NO: 12309 - RNA, 19 nt, Homo sapiens
gggcaugcauuuuccuuag

SEQ ID NO: 12310 - RNA, 19 nt, Homo sapiens
ucacugcugcuccuugcaa

SEQ ID NO: 12311 - RNA, 19 nt, Homo sapiens
ccaaacccauaaaauaaca

SEQ ID NO: 12312 - RNA, 19 nt, Homo sapiens
ugcgggaaauggcuuuaau

SEQ ID NO: 12313 - RNA, 19 nt, Homo sapiens
aacgcugaccugcagauua

SEQ ID NO: 12314 - RNA, 19 nt, Homo sapiens
cgagcgucauugccgagaa

SEQ ID NO: 12315 - RNA, 19 nt, Homo sapiens
caggaaguacuggagauga

SEQ ID NO: 12316 - RNA, 19 nt, Homo sapiens
acaccuaccugcgggucaa

SEQ ID NO: 12317 - RNA, 19 nt, Homo sapiens
aaaccaaacacaaaaguga

SEQ ID NO: 12318 - RNA, 19 nt, Homo sapiens
agagaaaaccaaacacaaa

SEQ ID NO: 12319 - RNA, 19 nt, Homo sapiens
ggauguuugagguugugua

SEQ ID NO: 12320 - RNA, 19 nt, Homo sapiens
ccaagaccacguggaugaa

SEQ ID NO: 12321 - RNA, 19 nt, Homo sapiens
ggagcuaucucuacauuua

SEQ ID NO: 12322 - RNA, 19 nt, Homo sapiens
gaccgaaacuggcaucuua

SEQ ID NO: 12323 - RNA, 19 nt, Homo sapiens
ggaaauggcuuuaauucug

SEQ ID NO: 12324 - RNA, 19 nt, Homo sapiens
gaaauccucuguuggcuuu

SEQ ID NO: 12325 - RNA, 19 nt, Homo sapiens
ggaagaaacuagaacuuga

SEQ ID NO: 12326 - RNA, 19 nt, Homo sapiens
gaaauggcuuuaauucuga

SEQ ID NO: 12327 - RNA, 19 nt, Homo sapiens
gaacaagauucgagaacaa

SEQ ID NO: 12328 - RNA, 19 nt, Homo sapiens
caaagugacuagccaaauu

SEQ ID NO: 12329 - RNA, 19 nt, Homo sapiens
gaaaugagcccuucaggau

SEQ ID NO: 12330 - RNA, 19 nt, Homo sapiens
cagaggaaaugcugacuuu

SEQ ID NO: 12331 - RNA, 19 nt, Homo sapiens
ggucacagccuucguguuu

SEQ ID NO: 12332 - RNA, 19 nt, Homo sapiens
gaacaacuccuccaacauc

SEQ ID NO: 12333 - RNA, 19 nt, Homo sapiens
uuuguuggcuccuaaauua

SEQ ID NO: 12334 - RNA, 19 nt, Homo sapiens
aaugagcccuucaggauua

SEQ ID NO: 12335 - RNA, 19 nt, Homo sapiens
gaaagaaacugccccagaa

SEQ ID NO: 12336 - RNA, 19 nt, Homo sapiens
agaaagagguggagaggaa

SEQ ID NO: 12337 - RNA, 19 nt, Homo sapiens
gcugauggcuuagcuugua

SEQ ID NO: 12338 - RNA, 19 nt, Homo sapiens
gcagaaauuugggaaguug

SEQ ID NO: 12339 - RNA, 19 nt, Homo sapiens
cccaagggcugauggcuua

SEQ ID NO: 12340 - RNA, 19 nt, Homo sapiens
cagaacagguuacacguau

SEQ ID NO: 12341 - RNA, 19 nt, Homo sapiens
gaacaaaaccgacaagaug

SEQ ID NO: 12342 - RNA, 19 nt, Homo sapiens
cagauuagcuggguggauu

SEQ ID NO: 12343 - RNA, 19 nt, Homo sapiens
ucucuucucuuuccacuuu

SEQ ID NO: 12344 - RNA, 19 nt, Homo sapiens
gaaaguggaguccugauuc

SEQ ID NO: 12345 - RNA, 19 nt, Homo sapiens
ggaacaagauucgagaaca

SEQ ID NO: 12346 - RNA, 19 nt, Homo sapiens
ggaucaaccugcagaagug

SEQ ID NO: 12347 - RNA, 19 nt, Homo sapiens
gggaacaacuccuccaaca

SEQ ID NO: 12348 - RNA, 19 nt, Homo sapiens
gguaauggccacaguuauu

SEQ ID NO: 12349 - RNA, 19 nt, Homo sapiens
gcaaaggccugagccagau

SEQ ID NO: 12350 - RNA, 19 nt, Homo sapiens
gcaaggagcaggaccacuu

SEQ ID NO: 12351 - RNA, 19 nt, Homo sapiens
ucagagaaaugcuggguau

SEQ ID NO: 12352 - RNA, 19 nt, Homo sapiens
ggauggagcuaucucuaca

SEQ ID NO: 12353 - RNA, 19 nt, Homo sapiens
ugaguaagguccauuucuu

SEQ ID NO: 12354 - RNA, 19 nt, Homo sapiens
gaagacagaaacaagcaaa

SEQ ID NO: 12355 - RNA, 19 nt, Homo sapiens
ggacauggccuauuaugac

SEQ ID NO: 12356 - RNA, 19 nt, Homo sapiens
gaccggagauagcuaagau

SEQ ID NO: 12357 - RNA, 19 nt, Homo sapiens
caacauaagaggccaggaa

SEQ ID NO: 12358 - RNA, 19 nt, Homo sapiens
ccaagucucccucaaagaa

SEQ ID NO: 12359 - RNA, 19 nt, Homo sapiens
caucuggaguaacauauug

SEQ ID NO: 12360 - RNA, 19 nt, Homo sapiens
ucacagccuucguguuuga

SEQ ID NO: 12361 - RNA, 19 nt, Homo sapiens
caugacaccuggagcaaug

SEQ ID NO: 12362 - RNA, 19 nt, Homo sapiens
ucaauacgcccaacaccua

SEQ ID NO: 12363 - RNA, 19 nt, Homo sapiens
gaaacuggcaucuuacucu

SEQ ID NO: 12364 - RNA, 19 nt, Homo sapiens
ccacagagcccgaaacaac

SEQ ID NO: 12365 - RNA, 19 nt, Homo sapiens
gcaaagccgccaccacaga

SEQ ID NO: 12366 - RNA, 19 nt, Homo sapiens
cagaaacacuugcuuacag

SEQ ID NO: 12367 - RNA, 19 nt, Homo sapiens
gcaagaaggccagaaaugg

SEQ ID NO: 12368 - RNA, 19 nt, Homo sapiens
guugugggcugccuuuguu

SEQ ID NO: 12369 - RNA, 19 nt, Homo sapiens
cgaaggaggcagagacaaa

SEQ ID NO: 12370 - RNA, 19 nt, Homo sapiens
gaagaaacuagaacuugau

SEQ ID NO: 12371 - RNA, 19 nt, Homo sapiens
gcaagauccuggugcuaag

SEQ ID NO: 12372 - RNA, 19 nt, Homo sapiens
ccaacucagucauucuuug

SEQ ID NO: 12373 - RNA, 19 nt, Homo sapiens
agaaacacuugcuuacaga

SEQ ID NO: 12374 - RNA, 19 nt, Homo sapiens
guggaguccugauucauga

SEQ ID NO: 12375 - RNA, 19 nt, Homo sapiens
gaaacuagaacuugaugag

SEQ ID NO: 12376 - RNA, 19 nt, Homo sapiens
gagacgaggauaccaaaga

SEQ ID NO: 12377 - RNA, 19 nt, Homo sapiens
cauggaaccacuugaauga

SEQ ID NO: 12378 - RNA, 19 nt, Homo sapiens
gggcagaaauuugggaagu

SEQ ID NO: 12379 - RNA, 19 nt, Homo sapiens
ccacaucuggaguaacaua

SEQ ID NO: 12380 - RNA, 19 nt, Homo sapiens
aagacccgcuggcucaaua

SEQ ID NO: 12381 - RNA, 19 nt, Homo sapiens
augaaugucuccaugauga

SEQ ID NO: 12382 - RNA, 19 nt, Homo sapiens
ccaacacugucuucucaug

SEQ ID NO: 12383 - RNA, 19 nt, Homo sapiens
cagaggagaaucagaaaug

SEQ ID NO: 12384 - RNA, 19 nt, Homo sapiens
cagcagaggagaaucagaa

SEQ ID NO: 12385 - RNA, 19 nt, Homo sapiens
agagaaaucaggugacuug

SEQ ID NO: 12386 - RNA, 19 nt, Homo sapiens
gggcucaccuuccaagucu

SEQ ID NO: 12387 - RNA, 19 nt, Homo sapiens
gggaguuucuugcagugaa

SEQ ID NO: 12388 - RNA, 19 nt, Homo sapiens
guaauggccacaguuauug

SEQ ID NO: 12389 - RNA, 19 nt, Homo sapiens
ggauggaagagcuauaaga

SEQ ID NO: 12390 - RNA, 19 nt, Homo sapiens
acccugagcuuucuucaug

SEQ ID NO: 12391 - RNA, 19 nt, Homo sapiens
gcuaaggagggauagagua

SEQ ID NO: 12392 - RNA, 19 nt, Homo sapiens
ccagagggcucaccuucca

SEQ ID NO: 12393 - RNA, 19 nt, Homo sapiens
guaacauauuggagagaaa

SEQ ID NO: 12394 - RNA, 19 nt, Homo sapiens
gagaugaggaacaagauuc

SEQ ID NO: 12395 - RNA, 19 nt, Homo sapiens
ugggagaggugguggagaa

SEQ ID NO: 12396 - RNA, 19 nt, Homo sapiens
gcagggcugugagggacua

SEQ ID NO: 12397 - RNA, 19 nt, Homo sapiens
cauguaagcugaggauugg

SEQ ID NO: 12398 - RNA, 19 nt, Homo sapiens
caagagaaaucaggugacu

SEQ ID NO: 12399 - RNA, 19 nt, Homo sapiens
aaaguggaguccugauuca

SEQ ID NO: 12400 - RNA, 19 nt, Homo sapiens
ggagaggaagaaacuagaa

SEQ ID NO: 12401 - RNA, 19 nt, Homo sapiens
aaacuggcaucuuacucuu

SEQ ID NO: 12402 - RNA, 19 nt, Homo sapiens
uggaaccacuugaaugaug

SEQ ID NO: 12403 - RNA, 19 nt, Homo sapiens
gagcuaucucuacauuuaa

SEQ ID NO: 12404 - RNA, 19 nt, Homo sapiens
ucucacaggcucagacuaa

SEQ ID NO: 12405 - RNA, 19 nt, Homo sapiens
ggagaugaggaacaagauu

SEQ ID NO: 12406 - RNA, 19 nt, Homo sapiens
caauuugugccucucuaua

SEQ ID NO: 12407 - RNA, 19 nt, Homo sapiens
gaaguugaaauccucuguu

SEQ ID NO: 12408 - RNA, 19 nt, Homo sapiens
agaggagaaucagaaauga

SEQ ID NO: 12409 - RNA, 19 nt, Homo sapiens
gaaauuugggaaguugaaa

SEQ ID NO: 12410 - RNA, 19 nt, Homo sapiens
uaagaggccaggaacuuga

SEQ ID NO: 12411 - RNA, 19 nt, Homo sapiens
cgaccaacccuucguuuua

SEQ ID NO: 12412 - RNA, 19 nt, Homo sapiens
ggaagguacuaagaagaca

SEQ ID NO: 12413 - RNA, 19 nt, Homo sapiens
cgaagcccgucuacagaga

SEQ ID NO: 12414 - RNA, 19 nt, Homo sapiens
ggccacaguuauuguuuua

SEQ ID NO: 12415 - RNA, 19 nt, Homo sapiens
gcucagggcagaaauuugg

SEQ ID NO: 12416 - RNA, 19 nt, Homo sapiens
gaacuugaccccuuugaau

SEQ ID NO: 12417 - RNA, 19 nt, Homo sapiens
guaggacccuggaccacau

SEQ ID NO: 12418 - RNA, 19 nt, Homo sapiens
guacuaagaagacagaaac

SEQ ID NO: 12419 - RNA, 19 nt, Homo sapiens
ugccaacacugucuucuca

SEQ ID NO: 12420 - RNA, 19 nt, Homo sapiens
gcuuuggguuguauaagga

SEQ ID NO: 12421 - RNA, 19 nt, Homo sapiens
gaacaugucuccugaucua

SEQ ID NO: 12422 - RNA, 19 nt, Homo sapiens
ggaagugccugucauggua

SEQ ID NO: 12423 - RNA, 19 nt, Homo sapiens
gaagacucaucuaaaguua

SEQ ID NO: 12424 - RNA, 19 nt, Homo sapiens
cgacaagacuucaacauga

SEQ ID NO: 12425 - RNA, 19 nt, Homo sapiens
gcagauacauccucauaug

SEQ ID NO: 12426 - RNA, 19 nt, Homo sapiens
guagcaaacuggacuuuaa

SEQ ID NO: 12427 - RNA, 19 nt, Homo sapiens
gaaauaagauucgggaaca

SEQ ID NO: 12428 - RNA, 19 nt, Homo sapiens
gcagaagacucaucuaaag

SEQ ID NO: 12429 - RNA, 19 nt, Homo sapiens
gcucugcccucaugaagua

SEQ ID NO: 12430 - RNA, 19 nt, Homo sapiens
gaaaguugaggccuaaaua

SEQ ID NO: 12431 - RNA, 19 nt, Homo sapiens
uggcugaacucaccaaaua

SEQ ID NO: 12432 - RNA, 19 nt, Homo sapiens
gcaacuagccugugagauu

SEQ ID NO: 12433 - RNA, 19 nt, Homo sapiens
caacccaacuggauuacua

SEQ ID NO: 12434 - RNA, 19 nt, Homo sapiens
gagcaagaccacauuauaa

SEQ ID NO: 12435 - RNA, 19 nt, Homo sapiens
agaaagaaauugccaguga

SEQ ID NO: 12436 - RNA, 19 nt, Homo sapiens
ggagaaaguugaggccuaa

SEQ ID NO: 12437 - RNA, 19 nt, Homo sapiens
ugggagauguugccuauua

SEQ ID NO: 12438 - RNA, 19 nt, Homo sapiens
gcaagaccacauuauaaua

SEQ ID NO: 12439 - RNA, 19 nt, Homo sapiens
gagcagaggaaacgaguua

SEQ ID NO: 12440 - RNA, 19 nt, Homo sapiens
guauaaagcuuucacuuac

SEQ ID NO: 12441 - RNA, 19 nt, Homo sapiens
ggagcaagaccacauuaua

SEQ ID NO: 12442 - RNA, 19 nt, Homo sapiens
aaggagaacuugaagagua

SEQ ID NO: 12443 - RNA, 19 nt, Homo sapiens
uacagcagauugcagauua

SEQ ID NO: 12444 - RNA, 19 nt, Homo sapiens
gaugaaagcagaagacuca

SEQ ID NO: 12445 - RNA, 19 nt, Homo sapiens
gaauucaacugcagaaggu

SEQ ID NO: 12446 - RNA, 19 nt, Homo sapiens
gcaaggaugauaugcauga

SEQ ID NO: 12447 - RNA, 19 nt, Homo sapiens
gauaagccaccuucuacua

SEQ ID NO: 12448 - RNA, 19 nt, Homo sapiens
gggcacaccuggcaaauac

SEQ ID NO: 12449 - RNA, 19 nt, Homo sapiens
caacuagccugugagauuc

SEQ ID NO: 12450 - RNA, 19 nt, Homo sapiens
ccacaacccaacuggauua

SEQ ID NO: 12451 - RNA, 19 nt, Homo sapiens
cuucaggccuucuccauaa

SEQ ID NO: 12452 - RNA, 19 nt, Homo sapiens
guaaauggcaaggaugaua

SEQ ID NO: 12453 - RNA, 19 nt, Homo sapiens
caacaaggccuagaagaug

SEQ ID NO: 12454 - RNA, 19 nt, Homo sapiens
gugaguagguuaagcacaa

SEQ ID NO: 12455 - RNA, 19 nt, Homo sapiens
gaacuugaagaguauaaga

SEQ ID NO: 12456 - RNA, 19 nt, Homo sapiens
gcagcuguauccuccauga

SEQ ID NO: 12457 - RNA, 19 nt, Homo sapiens
gauugcagauuacaucaug

SEQ ID NO: 12458 - RNA, 19 nt, Homo sapiens
ccaauucuuucucggguuu

SEQ ID NO: 12459 - RNA, 19 nt, Homo sapiens
agaguaauccacagacuua

SEQ ID NO: 12460 - RNA, 19 nt, Homo sapiens
aguauacacuggcacauaa

SEQ ID NO: 12461 - RNA, 19 nt, Homo sapiens
gguaguaaauggcaaggau

SEQ ID NO: 12462 - RNA, 19 nt, Homo sapiens
caaauucagucucaaacuc

SEQ ID NO: 12463 - RNA, 19 nt, Homo sapiens
gaacaggaggagagaauuc

SEQ ID NO: 12464 - RNA, 19 nt, Homo sapiens
caaacucagucaccgcaaa

SEQ ID NO: 12465 - RNA, 19 nt, Homo sapiens
uuacaggcauccucucauu

SEQ ID NO: 12466 - RNA, 19 nt, Homo sapiens
gacaagacuucaacaugau

SEQ ID NO: 12467 - RNA, 19 nt, Homo sapiens
gacauugcacaucuaaaua

SEQ ID NO: 12468 - RNA, 19 nt, Homo sapiens
ccaaauacuuacaugaaag

SEQ ID NO: 12469 - RNA, 19 nt, Homo sapiens
ugaacucaccaaauacuua

SEQ ID NO: 12470 - RNA, 19 nt, Homo sapiens
ccagggaaguaccaauuug

SEQ ID NO: 12471 - RNA, 19 nt, Homo sapiens
guccagaaauggcuuugaa

SEQ ID NO: 12472 - RNA, 19 nt, Homo sapiens
gcacaaguacaaccauaga

SEQ ID NO: 12473 - RNA, 19 nt, Homo sapiens
aaacuggacuuuaagaacu

SEQ ID NO: 12474 - RNA, 19 nt, Homo sapiens
cagcaugccucacaaagag

SEQ ID NO: 12475 - RNA, 19 nt, Homo sapiens
ccagaaauggcuuugaauu

SEQ ID NO: 12476 - RNA, 19 nt, Homo sapiens
gcaaacuggacuuuaagaa

SEQ ID NO: 12477 - RNA, 19 nt, Homo sapiens
gaaagcagaagacucaucu

SEQ ID NO: 12478 - RNA, 19 nt, Homo sapiens
ugaggacucuggacaacuu

SEQ ID NO: 12479 - RNA, 19 nt, Homo sapiens
gugcagauacauccucaua

SEQ ID NO: 12480 - RNA, 19 nt, Homo sapiens
caacuggauuacuagcauu

SEQ ID NO: 12481 - RNA, 19 nt, Homo sapiens
gacaagaaucuauagcauu

SEQ ID NO: 12482 - RNA, 19 nt, Homo sapiens
gaaaacaucgagauuacua

SEQ ID NO: 12483 - RNA, 19 nt, Homo sapiens
gaaaucccagcaacuguga

SEQ ID NO: 12484 - RNA, 19 nt, Homo sapiens
gagauguugccuauuauga

SEQ ID NO: 12485 - RNA, 19 nt, Homo sapiens
gaagcuacagccuccaauu

SEQ ID NO: 12486 - RNA, 19 nt, Homo sapiens
caagagugauguggaaauc

SEQ ID NO: 12487 - RNA, 19 nt, Homo sapiens
gagagaagccuaggcacaa

SEQ ID NO: 12488 - RNA, 19 nt, Homo sapiens
ugacauugcacaucuaaau

SEQ ID NO: 12489 - RNA, 19 nt, Homo sapiens
gaaguccugucaccugaag

SEQ ID NO: 12490 - RNA, 19 nt, Homo sapiens
aagcacaaguacaaccaua

SEQ ID NO: 12491 - RNA, 19 nt, Homo sapiens
ugauaugcaugauguugaa

SEQ ID NO: 12492 - RNA, 19 nt, Homo sapiens
cgaaugagguacuagaaaa

SEQ ID NO: 12493 - RNA, 19 nt, Homo sapiens
gccacucucuccucucaaa

SEQ ID NO: 12494 - RNA, 19 nt, Homo sapiens
gaauaaguaaggagcaaga

SEQ ID NO: 12495 - RNA, 19 nt, Homo sapiens
ugugggauccuuccaauuu

SEQ ID NO: 12496 - RNA, 19 nt, Homo sapiens
uauaauaggagaagugguu

SEQ ID NO: 12497 - RNA, 19 nt, Homo sapiens
gcagauugcagauuacauc

SEQ ID NO: 12498 - RNA, 19 nt, Homo sapiens
aggaauuacucucagauga

SEQ ID NO: 12499 - RNA, 19 nt, Homo sapiens
gacaaucgaacguaaacaa

SEQ ID NO: 12500 - RNA, 19 nt, Homo sapiens
agaggacaaucgaacguaa

SEQ ID NO: 12501 - RNA, 19 nt, Homo sapiens
uaagccaccuucuacuaug

SEQ ID NO: 12502 - RNA, 19 nt, Homo sapiens
gggagauguugccuauuau

SEQ ID NO: 12503 - RNA, 19 nt, Homo sapiens
gaccagggaaguaccaauu

SEQ ID NO: 12504 - RNA, 19 nt, Homo sapiens
aagaacagaugaagaaagg

SEQ ID NO: 12505 - RNA, 19 nt, Homo sapiens
guugaggccuaaauaaagu

SEQ ID NO: 12506 - RNA, 19 nt, Homo sapiens
aaaguugaggccuaaauaa

SEQ ID NO: 12507 - RNA, 19 nt, Homo sapiens
ugcaugauguugaagauga

SEQ ID NO: 12508 - RNA, 19 nt, Homo sapiens
ucacaaauucagucucaaa

SEQ ID NO: 12509 - RNA, 19 nt, Homo sapiens
gauguuaagugugucauac

SEQ ID NO: 12510 - RNA, 19 nt, Homo sapiens
caccaaauacuuacaugaa

SEQ ID NO: 12511 - RNA, 19 nt, Homo sapiens
gaggaggcuuuucauuaua

SEQ ID NO: 12512 - RNA, 19 nt, Homo sapiens
gggaaguaccaauuugaaa

SEQ ID NO: 12513 - RNA, 19 nt, Homo sapiens
agacaagaaucuauagcau

SEQ ID NO: 12514 - RNA, 19 nt, Homo sapiens
ggagucccauuguuucagu

SEQ ID NO: 12515 - RNA, 19 nt, Homo sapiens
caaaaucgccauccaagaa

SEQ ID NO: 12516 - RNA, 19 nt, Homo sapiens
cuucuacuaugcaauuuga

SEQ ID NO: 12517 - RNA, 19 nt, Homo sapiens
gaaaacagcaggaccacaa

SEQ ID NO: 12518 - RNA, 19 nt, Homo sapiens
uaaaguuagugguggaaca

SEQ ID NO: 12519 - RNA, 19 nt, Homo sapiens
aagcagaagacucaucuaa

SEQ ID NO: 12520 - RNA, 19 nt, Homo sapiens
gaaugugccugaggagucu

SEQ ID NO: 12521 - RNA, 19 nt, Homo sapiens
gaacaugucuccugaucua

SEQ ID NO: 12522 - RNA, 19 nt, Homo sapiens
ggaagugccugucauggua

SEQ ID NO: 12523 - RNA, 19 nt, Homo sapiens
gaagacucaucuaaaguua

SEQ ID NO: 12524 - RNA, 19 nt, Homo sapiens
cgacaagacuucaacauga

SEQ ID NO: 12525 - RNA, 19 nt, Homo sapiens
gcagauacauccucauaug

SEQ ID NO: 12526 - RNA, 19 nt, Homo sapiens
guagcaaacuggacuuuaa

SEQ ID NO: 12527 - RNA, 19 nt, Homo sapiens
gaaauaagauucgggaaca

SEQ ID NO: 12528 - RNA, 19 nt, Homo sapiens
gcagaagacucaucuaaag

SEQ ID NO: 12529 - RNA, 19 nt, Homo sapiens
gcucugcccucaugaagua

SEQ ID NO: 12530 - RNA, 19 nt, Homo sapiens
gaaaguugaggccuaaaua

SEQ ID NO: 12531 - RNA, 19 nt, Homo sapiens
uggcugaacucaccaaaua

SEQ ID NO: 12532 - RNA, 19 nt, Homo sapiens
gcaacuagccugugagauu

SEQ ID NO: 12533 - RNA, 19 nt, Homo sapiens
caacccaacuggauuacua

SEQ ID NO: 12534 - RNA, 19 nt, Homo sapiens
gagcaagaccacauuauaa

SEQ ID NO: 12535 - RNA, 19 nt, Homo sapiens
agaaagaaauugccaguga

SEQ ID NO: 12536 - RNA, 19 nt, Homo sapiens
ggagaaaguugaggccuaa

SEQ ID NO: 12537 - RNA, 19 nt, Homo sapiens
ugggagauguugccuauua

SEQ ID NO: 12538 - RNA, 19 nt, Homo sapiens
gcaagaccacauuauaaua

SEQ ID NO: 12539 - RNA, 19 nt, Homo sapiens
gagcagaggaaacgaguua

SEQ ID NO: 12540 - RNA, 19 nt, Homo sapiens
guauaaagcuuucacuuac

SEQ ID NO: 12541 - RNA, 19 nt, Homo sapiens
ggagcaagaccacauuaua

SEQ ID NO: 12542 - RNA, 19 nt, Homo sapiens
aaggagaacuugaagagua

SEQ ID NO: 12543 - RNA, 19 nt, Homo sapiens
caacaaggccuagaagaaa

SEQ ID NO: 12544 - RNA, 19 nt, Homo sapiens
uacagcagauugcagauua

SEQ ID NO: 12545 - RNA, 19 nt, Homo sapiens
gaugaaagcagaagacuca

SEQ ID NO: 12546 - RNA, 19 nt, Homo sapiens
gaauucaacugcagaaggu

SEQ ID NO: 12547 - RNA, 19 nt, Homo sapiens
gcaaggaugauaugcauga

SEQ ID NO: 12548 - RNA, 19 nt, Homo sapiens
gauaagccaccuucuacua

SEQ ID NO: 12549 - RNA, 19 nt, Homo sapiens
gggcacaccuggcaaauac

SEQ ID NO: 12550 - RNA, 19 nt, Homo sapiens
caacuagccugugagauuc

SEQ ID NO: 12551 - RNA, 19 nt, Homo sapiens
ccacaacccaacuggauua

SEQ ID NO: 12552 - RNA, 19 nt, Homo sapiens
cuucaggccuucuccauaa

SEQ ID NO: 12553 - RNA, 19 nt, Homo sapiens
guaaauggcaaggaugaua

SEQ ID NO: 12554 - RNA, 19 nt, Homo sapiens
gugaguagguuaagcacaa

SEQ ID NO: 12555 - RNA, 19 nt, Homo sapiens
gaacuugaagaguauaaga

SEQ ID NO: 12556 - RNA, 19 nt, Homo sapiens
gcagcuguauccuccauga

SEQ ID NO: 12557 - RNA, 19 nt, Homo sapiens
gauugcagauuacaucaug

SEQ ID NO: 12558 - RNA, 19 nt, Homo sapiens
ccaauucuuucucggguuu

SEQ ID NO: 12559 - RNA, 19 nt, Homo sapiens
agaguaauccacagacuua

SEQ ID NO: 12560 - RNA, 19 nt, Homo sapiens
aguauacacuggcacauaa

SEQ ID NO: 12561 - RNA, 19 nt, Homo sapiens
gguaguaaauggcaaggau

SEQ ID NO: 12562 - RNA, 19 nt, Homo sapiens
gaacaggaggagagaauuc

SEQ ID NO: 12563 - RNA, 19 nt, Homo sapiens
uuacaggcauccucucauu

SEQ ID NO: 12564 - RNA, 19 nt, Homo sapiens
gacaagacuucaacaugau

SEQ ID NO: 12565 - RNA, 19 nt, Homo sapiens
gacauugcacaucuaaaua

SEQ ID NO: 12566 - RNA, 19 nt, Homo sapiens
ccaaauacuuacaugaaag

SEQ ID NO: 12567 - RNA, 19 nt, Homo sapiens
ugaacucaccaaauacuua

SEQ ID NO: 12568 - RNA, 19 nt, Homo sapiens
ccagggaaguaccaauuug

SEQ ID NO: 12569 - RNA, 19 nt, Homo sapiens
guccagaaauggcuuugaa

SEQ ID NO: 12570 - RNA, 19 nt, Homo sapiens
gcacaaguacaaccauaga

SEQ ID NO: 12571 - RNA, 19 nt, Homo sapiens
aaacuggacuuuaagaacu

SEQ ID NO: 12572 - RNA, 19 nt, Homo sapiens
cagcaugccucacaaagag

SEQ ID NO: 12573 - RNA, 19 nt, Homo sapiens
ccagaaauggcuuugaauu

SEQ ID NO: 12574 - RNA, 19 nt, Homo sapiens
gcaaacuggacuuuaagaa

SEQ ID NO: 12575 - RNA, 19 nt, Homo sapiens
gaaagcagaagacucaucu

SEQ ID NO: 12576 - RNA, 19 nt, Homo sapiens
ugaggacucuggacaacuu

SEQ ID NO: 12577 - RNA, 19 nt, Homo sapiens
gugcagauacauccucaua

SEQ ID NO: 12578 - RNA, 19 nt, Homo sapiens
caacuggauuacuagcauu

SEQ ID NO: 12579 - RNA, 19 nt, Homo sapiens
gacaagaaucuauagcauu

SEQ ID NO: 12580 - RNA, 19 nt, Homo sapiens
gaaaacaucgagauuacua

SEQ ID NO: 12581 - RNA, 19 nt, Homo sapiens
gaaaucccagcaacuguga

SEQ ID NO: 12582 - RNA, 19 nt, Homo sapiens
gagauguugccuauuauga

SEQ ID NO: 12583 - RNA, 19 nt, Homo sapiens
gaagcuacagccuccaauu

SEQ ID NO: 12584 - RNA, 19 nt, Homo sapiens
caagagugauguggaaauc

SEQ ID NO: 12585 - RNA, 19 nt, Homo sapiens
gagagaagccuaggcacaa

SEQ ID NO: 12586 - RNA, 19 nt, Homo sapiens
ugacauugcacaucuaaau

SEQ ID NO: 12587 - RNA, 19 nt, Homo sapiens
gaaguccugucaccugaag

SEQ ID NO: 12588 - RNA, 19 nt, Homo sapiens
aagcacaaguacaaccaua

SEQ ID NO: 12589 - RNA, 19 nt, Homo sapiens
ugauaugcaugauguugaa

SEQ ID NO: 12590 - RNA, 19 nt, Homo sapiens
cgaaugagguacuagaaaa

SEQ ID NO: 12591 - RNA, 19 nt, Homo sapiens
gccacucucuccucucaaa

SEQ ID NO: 12592 - RNA, 19 nt, Homo sapiens
gaauaaguaaggagcaaga

SEQ ID NO: 12593 - RNA, 19 nt, Homo sapiens
ugugggauccuuccaauuu

SEQ ID NO: 12594 - RNA, 19 nt, Homo sapiens
uauaauaggagaagugguu

SEQ ID NO: 12595 - RNA, 19 nt, Homo sapiens
gcagauugcagauuacauc

SEQ ID NO: 12596 - RNA, 19 nt, Homo sapiens
gacaaucgaacguaaacaa

SEQ ID NO: 12597 - RNA, 19 nt, Homo sapiens
agaggacaaucgaacguaa

SEQ ID NO: 12598 - RNA, 19 nt, Homo sapiens
uaagccaccuucuacuaug

SEQ ID NO: 12599 - RNA, 19 nt, Homo sapiens
gggagauguugccuauuau

SEQ ID NO: 12600 - RNA, 19 nt, Homo sapiens
gaccagggaaguaccaauu

SEQ ID NO: 12601 - RNA, 19 nt, Homo sapiens
aagaacagaugaagaaagg

SEQ ID NO: 12602 - RNA, 19 nt, Homo sapiens
guugaggccuaaauaaagu

SEQ ID NO: 12603 - RNA, 19 nt, Homo sapiens
aaaguugaggccuaaauaa

SEQ ID NO: 12604 - RNA, 19 nt, Homo sapiens
ugcaugauguugaagauga

SEQ ID NO: 12605 - RNA, 19 nt, Homo sapiens
gauguuaagugugucauac

SEQ ID NO: 12606 - RNA, 19 nt, Homo sapiens
caccaaauacuuacaugaa

SEQ ID NO: 12607 - RNA, 19 nt, Homo sapiens
gaggaggcuuuucauuaua

SEQ ID NO: 12608 - RNA, 19 nt, Homo sapiens
gggaaguaccaauuugaaa

SEQ ID NO: 12609 - RNA, 19 nt, Homo sapiens
agacaagaaucuauagcau

SEQ ID NO: 12610 - RNA, 19 nt, Homo sapiens
ggagucccauuguuucagu

SEQ ID NO: 12611 - RNA, 19 nt, Homo sapiens
caaaaucgccauccaagaa

SEQ ID NO: 12612 - RNA, 19 nt, Homo sapiens
acaacaaggccuagaagaa

SEQ ID NO: 12613 - RNA, 19 nt, Homo sapiens
cuucuacuaugcaauuuga

SEQ ID NO: 12614 - RNA, 19 nt, Homo sapiens
gaaaacagcaggaccacaa

SEQ ID NO: 12615 - RNA, 19 nt, Homo sapiens
uaaaguuagugguggaaca

SEQ ID NO: 12616 - RNA, 19 nt, Homo sapiens
aagcagaagacucaucuaa

SEQ ID NO: 12617 - RNA, 19 nt, Homo sapiens
gaaugugccugaggagucu

SEQ ID NO: 12618 - RNA, 19 nt, Homo sapiens
gcuguauccuccaugaaau

SEQ ID NO: 12619 - RNA, 19 nt, Homo sapiens
cucaauaccugcuucacuu

SEQ ID NO: 12620 - RNA, 19 nt, Homo sapiens
cgagauuacuauuaagucu

SEQ ID NO: 12621 - RNA, 19 nt, Homo sapiens
uagaugacgugauggauua

SEQ ID NO: 12622 - RNA, 19 nt, Homo sapiens
ggaccaaggugcagagaug

SEQ ID NO: 12623 - RNA, 19 nt, Homo sapiens
gaagccaaguuauuauguu

SEQ ID NO: 12624 - RNA, 19 nt, Homo sapiens
aaucagagcuguugguaga

SEQ ID NO: 12625 - RNA, 19 nt, Homo sapiens
gcaaugcugccuccuuuaa

SEQ ID NO: 12626 - RNA, 19 nt, Homo sapiens
gaggagagacugccuauuc

SEQ ID NO: 12627 - RNA, 19 nt, Homo sapiens
gaacaguaccucccucuca

SEQ ID NO: 12628 - RNA, 19 nt, Homo sapiens
gauaugaugauacugauga

SEQ ID NO: 12629 - RNA, 19 nt, Homo sapiens
gugcagagauggacaagag

SEQ ID NO: 12630 - RNA, 19 nt, Homo sapiens
gugauggauuaucuuguua

SEQ ID NO: 12631 - RNA, 19 nt, Homo sapiens
ugaaggauuugaucugguu

SEQ ID NO: 12632 - RNA, 19 nt, Homo sapiens
ccgcaaugcugccuccuuu

SEQ ID NO: 12633 - RNA, 19 nt, Homo sapiens
cagccuaucucaguacaaa

SEQ ID NO: 12634 - RNA, 19 nt, Homo sapiens
cgugauggauuaucuuguu

SEQ ID NO: 12635 - RNA, 19 nt, Homo sapiens
guucagaagccaaguuauu

SEQ ID NO: 12636 - RNA, 19 nt, Homo sapiens
gccaauaccuaugccugua

SEQ ID NO: 12637 - RNA, 19 nt, Homo sapiens
ccagcgaucugagcauaaa

SEQ ID NO: 12638 - RNA, 19 nt, Homo sapiens
gaagcuagagccgcaaauu

SEQ ID NO: 12639 - RNA, 19 nt, Homo sapiens
ccacagaacauccaagauc

SEQ ID NO: 12640 - RNA, 19 nt, Homo sapiens
gagagacugccuauucuga

SEQ ID NO: 12641 - RNA, 19 nt, Homo sapiens
aaaggagcauuggauauga

SEQ ID NO: 12642 - RNA, 19 nt, Homo sapiens
gauaagcucuaccucucau

SEQ ID NO: 12643 - RNA, 19 nt, Homo sapiens
gcagagaacggugugaaga

SEQ ID NO: 12644 - RNA, 19 nt, Homo sapiens
cacagaacauccaagauca

SEQ ID NO: 12645 - RNA, 19 nt, Homo sapiens
gccaaguuauuauguuaga

SEQ ID NO: 12646 - RNA, 19 nt, Homo sapiens
gaauguguauagugccaau

SEQ ID NO: 12647 - RNA, 19 nt, Homo sapiens
gaauuugccaggaagaaug

SEQ ID NO: 12648 - RNA, 19 nt, Homo sapiens
caaaucagagcuguuggua

SEQ ID NO: 12649 - RNA, 19 nt, Homo sapiens
cgacaucuacucaguguuc

SEQ ID NO: 12650 - RNA, 19 nt, Homo sapiens
ggaaaaggagcauuggaua

SEQ ID NO: 12651 - RNA, 19 nt, Homo sapiens
ccaggaagaauguguauag

SEQ ID NO: 12652 - RNA, 19 nt, Homo sapiens
aaucagccaucaacucaga

SEQ ID NO: 12653 - RNA, 19 nt, Homo sapiens
ugugugagauggcagagaa

SEQ ID NO: 12654 - RNA, 19 nt, Homo sapiens
guauagugccaaucagaaa

SEQ ID NO: 12655 - RNA, 19 nt, Homo sapiens
gccaucaacucagauuguu

SEQ ID NO: 12656 - RNA, 19 nt, Homo sapiens
ugaaucagccaucaacuca

SEQ ID NO: 12657 - RNA, 19 nt, Homo sapiens
guacaaaggaccaguaucc

SEQ ID NO: 12658 - RNA, 19 nt, Homo sapiens
gccaacagaccauuucuca

SEQ ID NO: 12659 - RNA, 19 nt, Homo sapiens
gaaaaugcacucaccaaau

SEQ ID NO: 12660 - RNA, 19 nt, Homo sapiens
ucucauggguagaguggaa

SEQ ID NO: 12661 - RNA, 19 nt, Homo sapiens
ugauugaauuugccaggaa

SEQ ID NO: 12662 - RNA, 19 nt, Homo sapiens
cgugagcaguggcguagaa

SEQ ID NO: 12663 - RNA, 19 nt, Homo sapiens
ggcgacaucuacucagugu

SEQ ID NO: 12664 - RNA, 19 nt, Homo sapiens
ucagaaugcucaggaccaa

SEQ ID NO: 12665 - RNA, 19 nt, Homo sapiens
gaaaaggagcauuggauau

SEQ ID NO: 12666 - RNA, 19 nt, Homo sapiens
aaaaugcacucaccaaauc

SEQ ID NO: 12667 - RNA, 19 nt, Homo sapiens
gcugguaggucccuuuuau

SEQ ID NO: 12668 - RNA, 19 nt, Homo sapiens
uucagaagccaaguuauua

SEQ ID NO: 12669 - RNA, 19 nt, Homo sapiens
ccaauaccuaugccuguaa

SEQ ID NO: 12670 - RNA, 19 nt, Homo sapiens
ccagugcucugcccaucau

SEQ ID NO: 12671 - RNA, 19 nt, Homo sapiens
caaugcugccuccuuuaaa

SEQ ID NO: 12672 - RNA, 19 nt, Homo sapiens
gguuaaagaagcuaagcaa

SEQ ID NO: 12673 - RNA, 19 nt, Homo sapiens
gacagccuccucacuucua

SEQ ID NO: 12674 - RNA, 19 nt, Homo sapiens
ucacguacucuugcaauug

SEQ ID NO: 12675 - RNA, 19 nt, Homo sapiens
gagcauuggauaugaugau

SEQ ID NO: 12676 - RNA, 19 nt, Homo sapiens
uuucucagcuccauucuac

SEQ ID NO: 12677 - RNA, 19 nt, Homo sapiens
guuaaagaagcuaagcaaa

SEQ ID NO: 12678 - RNA, 19 nt, Homo sapiens
ugggaucccugucuaccaa

SEQ ID NO: 12679 - RNA, 19 nt, Homo sapiens
ucagaagccaaguuauuau

SEQ ID NO: 12680 - RNA, 19 nt, Homo sapiens
gauggauuaucuuguuaac

SEQ ID NO: 12681 - RNA, 19 nt, Homo sapiens
uuggugagcuccacguaug

SEQ ID NO: 12682 - RNA, 19 nt, Homo sapiens
ggauaagcucuaccucuca

SEQ ID NO: 12683 - RNA, 19 nt, Homo sapiens
ccucauguccucagccuau

SEQ ID NO: 12684 - RNA, 19 nt, Homo sapiens
gcugugacgacuacuguga

SEQ ID NO: 12685 - RNA, 19 nt, Homo sapiens
cagaagccaaguuauuaug

SEQ ID NO: 12686 - RNA, 19 nt, Homo sapiens
gucacguacucuugcaauu

SEQ ID NO: 12687 - RNA, 19 nt, Homo sapiens
caccaaaucagagcuguug

SEQ ID NO: 12688 - RNA, 19 nt, Homo sapiens
caauaccuaugccuguaag

SEQ ID NO: 12689 - RNA, 19 nt, Homo sapiens
caagguguaccacagaaca

SEQ ID NO: 12690 - RNA, 19 nt, Homo sapiens
caacauccaagguguacca

SEQ ID NO: 12691 - RNA, 19 nt, Homo sapiens
gcaguugccaauaccuaug

SEQ ID NO: 12692 - RNA, 19 nt, Homo sapiens
gccacacccuccuguccaa

SEQ ID NO: 12693 - RNA, 19 nt, Homo sapiens
agacaggauugaggagaga

SEQ ID NO: 12694 - RNA, 19 nt, Homo sapiens
uuagaugacgugauggauu

SEQ ID NO: 12695 - RNA, 19 nt, Homo sapiens
ugaagucugugugugagau

SEQ ID NO: 12696 - RNA, 19 nt, Homo sapiens
guggucaguggcagcauua

SEQ ID NO: 12697 - RNA, 19 nt, Homo sapiens
ggagagacugccuauucug

SEQ ID NO: 12698 - RNA, 19 nt, Homo sapiens
cauuggauaugaugauacu

SEQ ID NO: 12699 - RNA, 19 nt, Homo sapiens
caguaucccuaccugaagu

SEQ ID NO: 12700 - RNA, 19 nt, Homo sapiens
guaaggggcuagacaggau

SEQ ID NO: 12701 - RNA, 19 nt, Homo sapiens
caggaagaauguguauagu

SEQ ID NO: 12702 - RNA, 19 nt, Homo sapiens
ucaguacaaaggaccagua

SEQ ID NO: 12703 - RNA, 19 nt, Homo sapiens
cagcuccauucuacuguuc

SEQ ID NO: 12704 - RNA, 19 nt, Homo sapiens
ucagcuccauucuacuguu

SEQ ID NO: 12705 - RNA, 19 nt, Homo sapiens
gaccauuucucagcuccau

SEQ ID NO: 12706 - RNA, 19 nt, Homo sapiens
ucacugaggaagaacuaga

SEQ ID NO: 12707 - RNA, 19 nt, Homo sapiens
aagcuagagccgcaaauug

SEQ ID NO: 12708 - RNA, 19 nt, Homo sapiens
acccagcgaucugagcaua

SEQ ID NO: 12709 - RNA, 19 nt, Homo sapiens
gacgugauggauuaucuug

SEQ ID NO: 12710 - RNA, 19 nt, Homo sapiens
agcauuggauaugaugaua

SEQ ID NO: 12711 - RNA, 19 nt, Homo sapiens
cuacuguucaccugauuga

SEQ ID NO: 12712 - RNA, 19 nt, Homo sapiens
gcaaggggcagcugcagaa

SEQ ID NO: 12713 - RNA, 19 nt, Homo sapiens
aaugcugccuccuuuaaag

SEQ ID NO: 12714 - RNA, 19 nt, Homo sapiens
caggcgacaucuacucagu

SEQ ID NO: 12715 - RNA, 19 nt, Homo sapiens
gagcaauuugagucacgua

SEQ ID NO: 12716 - RNA, 19 nt, Homo sapiens
cagcaggguuaaagaagcu

SEQ ID NO: 12717 - RNA, 19 nt, Homo sapiens
ucaggaugcucaggauaag

SEQ ID NO: 12718 - RNA, 19 nt, Homo sapiens
gcaggguuaaagaagcuaa

SEQ ID NO: 12719 - RNA, 19 nt, Homo sapiens
gcucucagcaggguuaaag

SEQ ID NO: 12720 - RNA, 19 nt, Homo sapiens
aggagagacugccuauucu

SEQ ID NO: 12721 - RNA, 19 nt, Homo sapiens
caauaaaccuuccuucuua

SEQ ID NO: 12722 - RNA, 19 nt, Homo sapiens
ccaaagaaauggaaauuga

SEQ ID NO: 12723 - RNA, 19 nt, Homo sapiens
caugauggcuucccuguua

SEQ ID NO: 12724 - RNA, 19 nt, Homo sapiens
gaagggagcuauucuuggu

SEQ ID NO: 12725 - RNA, 19 nt, Homo sapiens
gaagacagaaucaacauga

SEQ ID NO: 12726 - RNA, 19 nt, Homo sapiens
gggaagaaauccacaagga

SEQ ID NO: 12727 - RNA, 19 nt, Homo sapiens
gaugguggcuguaggaauc

SEQ ID NO: 12728 - RNA, 19 nt, Homo sapiens
gagcaacagcugggaaaua

SEQ ID NO: 12729 - RNA, 19 nt, Homo sapiens
caaaccaggugauaaaguc

SEQ ID NO: 12730 - RNA, 19 nt, Homo sapiens
gcauuaauaacccauguuu

SEQ ID NO: 12731 - RNA, 19 nt, Homo sapiens
gcccaugaaguucguauua

SEQ ID NO: 12732 - RNA, 19 nt, Homo sapiens
ccaauaaaccuuccuucuu

SEQ ID NO: 12733 - RNA, 19 nt, Homo sapiens
caucaacccucaagacuac

SEQ ID NO: 12734 - RNA, 19 nt, Homo sapiens
caucaacaaggacaaauuu

SEQ ID NO: 12735 - RNA, 19 nt, Homo sapiens
caacagcugggaaauauca

SEQ ID NO: 12736 - RNA, 19 nt, Homo sapiens
uaaagaaugugucccaaaa

SEQ ID NO: 12737 - RNA, 19 nt, Homo sapiens
uggcacaagugucaucgua

SEQ ID NO: 12738 - RNA, 19 nt, Homo sapiens
gcugggaaauaucauuaau

SEQ ID NO: 12739 - RNA, 19 nt, Homo sapiens
guaaagaaugugucccaaa

SEQ ID NO: 12740 - RNA, 19 nt, Homo sapiens
uggcuucccuguuauguug

SEQ ID NO: 12741 - RNA, 19 nt, Homo sapiens
gcaucaacccucaagacua

SEQ ID NO: 12742 - RNA, 19 nt, Homo sapiens
cggccuaucugcuauuaug

SEQ ID NO: 12743 - RNA, 19 nt, Homo sapiens
ggaagcccauccaccacuu

SEQ ID NO: 12744 - RNA, 19 nt, Homo sapiens
gcuaugggaguuaaagaaa

SEQ ID NO: 12745 - RNA, 19 nt, Homo sapiens
gagcacagcaggaaaagua

SEQ ID NO: 12746 - RNA, 19 nt, Homo sapiens
cagcugggaaauaucauua

SEQ ID NO: 12747 - RNA, 19 nt, Homo sapiens
ugaaggauuugaccugcuu

SEQ ID NO: 12748 - RNA, 19 nt, Homo sapiens
ggacaucaacaaggacaaa

SEQ ID NO: 12749 - RNA, 19 nt, Homo sapiens
uacaugaucuggagcaaca

SEQ ID NO: 12750 - RNA, 19 nt, Homo sapiens
caacaaggacaaauuugca

SEQ ID NO: 12751 - RNA, 19 nt, Homo sapiens
ccaugaaguucguauuaag

SEQ ID NO: 12752 - RNA, 19 nt, Homo sapiens
cccaugaaguucguauuaa

SEQ ID NO: 12753 - RNA, 19 nt, Homo sapiens
gaugcagccucgccucuag

SEQ ID NO: 12754 - RNA, 19 nt, Homo sapiens
agcaacagcugggaaauau

SEQ ID NO: 12755 - RNA, 19 nt, Homo sapiens
caaaacuuguggcugauuu

SEQ ID NO: 12756 - RNA, 19 nt, Homo sapiens
uccaggaggugcuaaagga

SEQ ID NO: 12757 - RNA, 19 nt, Homo sapiens
agucaaaccaggugauaaa

SEQ ID NO: 12758 - RNA, 19 nt, Homo sapiens
gcugugcuaugggaguuaa

SEQ ID NO: 12759 - RNA, 19 nt, Homo sapiens
gagaagacagaaucaacau

SEQ ID NO: 12760 - RNA, 19 nt, Homo sapiens
gcuaagaaguuuucauugg

SEQ ID NO: 12761 - RNA, 19 nt, Homo sapiens
ugaaguucguauuaagaug

SEQ ID NO: 12762 - RNA, 19 nt, Homo sapiens
gcagagaagacagaaucaa

SEQ ID NO: 12763 - RNA, 19 nt, Homo sapiens
agaguugggugccacugaa

SEQ ID NO: 12764 - RNA, 19 nt, Homo sapiens
gcuauuaugggcuguaaag

SEQ ID NO: 12765 - RNA, 19 nt, Homo sapiens
gagaaggggugacuacagu

SEQ ID NO: 12766 - RNA, 19 nt, Homo sapiens
gguuaugggucugcaguca

SEQ ID NO: 12767 - RNA, 19 nt, Homo sapiens
caugaaguucguauuaaga

SEQ ID NO: 12768 - RNA, 19 nt, Homo sapiens
uaacccauguuuuaccuuu

SEQ ID NO: 12769 - RNA, 19 nt, Homo sapiens
gaaugugucccaaaacuug

SEQ ID NO: 12770 - RNA, 19 nt, Homo sapiens
ccucaagacuacaagaaac

SEQ ID NO: 12771 - RNA, 19 nt, Homo sapiens
ucauugcgguggacaucaa

SEQ ID NO: 12772 - RNA, 19 nt, Homo sapiens
ucucauuggcuguggauuu

SEQ ID NO: 12773 - RNA, 19 nt, Homo sapiens
ucagcaccuucucacagua

SEQ ID NO: 12774 - RNA, 19 nt, Homo sapiens
gcacuugagcagggaagaa

SEQ ID NO: 12775 - RNA, 19 nt, Homo sapiens
cagccucgccucuagagaa

SEQ ID NO: 12776 - RNA, 19 nt, Homo sapiens
aaaccuuccuucuuaacca

SEQ ID NO: 12777 - RNA, 19 nt, Homo sapiens
guaccauucugauguuuug

SEQ ID NO: 12778 - RNA, 19 nt, Homo sapiens
caggaaaaguaaucaaaug

SEQ ID NO: 12779 - RNA, 19 nt, Homo sapiens
ugacuggacguaccuggaa

SEQ ID NO: 12780 - RNA, 19 nt, Homo sapiens
cuaaaggaaaugacugaug

SEQ ID NO: 12781 - RNA, 19 nt, Homo sapiens
uugcaaaggccaaagaguu

SEQ ID NO: 12782 - RNA, 19 nt, Homo sapiens
uaagaugguggcuguagga

SEQ ID NO: 12783 - RNA, 19 nt, Homo sapiens
gaacaucagcuggggaauu

SEQ ID NO: 12784 - RNA, 19 nt, Homo sapiens
cccaaaaccucucaaugaa

SEQ ID NO: 12785 - RNA, 19 nt, Homo sapiens
gucggccuaucugcuauua

SEQ ID NO: 12786 - RNA, 19 nt, Homo sapiens
uuaugggucugcagucaau

SEQ ID NO: 12787 - RNA, 19 nt, Homo sapiens
aaaaguauccguaccauuc

SEQ ID NO: 12788 - RNA, 19 nt, Homo sapiens
gaaaaugcaguagccaaaa

SEQ ID NO: 12789 - RNA, 19 nt, Homo sapiens
gcagggaagaaauccacaa

SEQ ID NO: 12790 - RNA, 19 nt, Homo sapiens
cuaagaaguuuucauugga

SEQ ID NO: 12791 - RNA, 19 nt, Homo sapiens
uggaagggagcuauucuug

SEQ ID NO: 12792 - RNA, 19 nt, Homo sapiens
caggaggugcuaaaggaaa

SEQ ID NO: 12793 - RNA, 19 nt, Homo sapiens
cgguggacaucaacaagga

SEQ ID NO: 12794 - RNA, 19 nt, Homo sapiens
acacagugguggaugaaaa

SEQ ID NO: 12795 - RNA, 19 nt, Homo sapiens
cguggagaguguuggagaa

SEQ ID NO: 12796 - RNA, 19 nt, Homo sapiens
ccucuacccuacaugaucu

SEQ ID NO: 12797 - RNA, 19 nt, Homo sapiens
cagcugugcuaugggaguu

SEQ ID NO: 12798 - RNA, 19 nt, Homo sapiens
aaugaacccuaugcugcua

SEQ ID NO: 12799 - RNA, 19 nt, Homo sapiens
ugcaaaggccaaagaguug

SEQ ID NO: 12800 - RNA, 19 nt, Homo sapiens
guacacagugguggaugaa

SEQ ID NO: 12801 - RNA, 19 nt, Homo sapiens
gccaauaaaccuuccuucu

SEQ ID NO: 12802 - RNA, 19 nt, Homo sapiens
ggauuugaccugcuucacu

SEQ ID NO: 12803 - RNA, 19 nt, Homo sapiens
ccuguuauguugucaugag

SEQ ID NO: 12804 - RNA, 19 nt, Homo sapiens
acaaggacaaauuugcaaa

SEQ ID NO: 12805 - RNA, 19 nt, Homo sapiens
agagaagacagaaucaaca

SEQ ID NO: 12806 - RNA, 19 nt, Homo sapiens
gaaugcaucaacccucaag

SEQ ID NO: 12807 - RNA, 19 nt, Homo sapiens
caaggacaaauuugcaaag

SEQ ID NO: 12808 - RNA, 19 nt, Homo sapiens
gaaaaguauccguaccauu

SEQ ID NO: 12809 - RNA, 19 nt, Homo sapiens
uauucuugguggcuuuaaa

SEQ ID NO: 12810 - RNA, 19 nt, Homo sapiens
gcuauucuugguggcuuua

SEQ ID NO: 12811 - RNA, 19 nt, Homo sapiens
aguacacagugguggauga

SEQ ID NO: 12812 - RNA, 19 nt, Homo sapiens
cagagaagacagaaucaac

SEQ ID NO: 12813 - RNA, 19 nt, Homo sapiens
aggaggugcuaaaggaaau

SEQ ID NO: 12814 - RNA, 19 nt, Homo sapiens
ccucgccucuagagaaagu

SEQ ID NO: 12815 - RNA, 19 nt, Homo sapiens
aaaaugcaguagccaaaau

SEQ ID NO: 12816 - RNA, 19 nt, Homo sapiens
gauggcaccagcagguuca

SEQ ID NO: 12817 - RNA, 19 nt, Homo sapiens
ucaaaccaggugauaaagu

SEQ ID NO: 12818 - RNA, 19 nt, Homo sapiens
acagucaaaccaggugaua

SEQ ID NO: 12819 - RNA, 19 nt, Homo sapiens
ucauuaauucugcucauca

SEQ ID NO: 12820 - RNA, 19 nt, Homo sapiens
gcaggaaaaguaaucaaau

SEQ ID NO: 12821 - RNA, 19 nt, Homo sapiens
caacaaaccuuccuucuua

SEQ ID NO: 12822 - RNA, 19 nt, Homo sapiens
gcagauuucuugcuucaua

SEQ ID NO: 12823 - RNA, 19 nt, Homo sapiens
gagaagaaauccacaaaga

SEQ ID NO: 12824 - RNA, 19 nt, Homo sapiens
ccaaagaaauggaaauuga

SEQ ID NO: 12825 - RNA, 19 nt, Homo sapiens
caugauggcuucccuguua

SEQ ID NO: 12826 - RNA, 19 nt, Homo sapiens
acaaacaccuuaagcaaua

SEQ ID NO: 12827 - RNA, 19 nt, Homo sapiens
ugaaagaccuuagacauaa

SEQ ID NO: 12828 - RNA, 19 nt, Homo sapiens
gagaaagucugccucauug

SEQ ID NO: 12829 - RNA, 19 nt, Homo sapiens
gacaaagccucaauuacua

SEQ ID NO: 12830 - RNA, 19 nt, Homo sapiens
gaucgaaagugcuucauug

SEQ ID NO: 12831 - RNA, 19 nt, Homo sapiens
gaaagugcuucauugacua

SEQ ID NO: 12832 - RNA, 19 nt, Homo sapiens
gaaagaccuuagacauaaa

SEQ ID NO: 12833 - RNA, 19 nt, Homo sapiens
caaagauuauuccugguaa

SEQ ID NO: 12834 - RNA, 19 nt, Homo sapiens
gcaaagauuauuccuggua

SEQ ID NO: 12835 - RNA, 19 nt, Homo sapiens
agacucacauuuacaagua

SEQ ID NO: 12836 - RNA, 19 nt, Homo sapiens
uaugguggcuuuaagagua

SEQ ID NO: 12837 - RNA, 19 nt, Homo sapiens
ggagaaagucugccucauu

SEQ ID NO: 12838 - RNA, 19 nt, Homo sapiens
gcacaaacaccuuaagcaa

SEQ ID NO: 12839 - RNA, 19 nt, Homo sapiens
aaggauagacucacauuua

SEQ ID NO: 12840 - RNA, 19 nt, Homo sapiens
gaccuuagacauaaaguaa

SEQ ID NO: 12841 - RNA, 19 nt, Homo sapiens
gguccaagaguucuaaaua

SEQ ID NO: 12842 - RNA, 19 nt, Homo sapiens
gaugguggcuguaggaauc

SEQ ID NO: 12843 - RNA, 19 nt, Homo sapiens
gagcaacagcuaggaaaua

SEQ ID NO: 12844 - RNA, 19 nt, Homo sapiens
gguuaugggucugcaguua

SEQ ID NO: 12845 - RNA, 19 nt, Homo sapiens
uaugguggcuuuaagugua

SEQ ID NO: 12846 - RNA, 19 nt, Homo sapiens
cuucagagauguuaucaau

SEQ ID NO: 12847 - RNA, 19 nt, Homo sapiens
caaaccaggugauaaaguc

SEQ ID NO: 12848 - RNA, 19 nt, Homo sapiens
gaagaaauccacaaagacu

SEQ ID NO: 12849 - RNA, 19 nt, Homo sapiens
guaaagaagguaucccaaa

SEQ ID NO: 12850 - RNA, 19 nt, Homo sapiens
cccagaaccucucaauaaa

SEQ ID NO: 12851 - RNA, 19 nt, Homo sapiens
gagaugggauggcaaaugc

SEQ ID NO: 12852 - RNA, 19 nt, Homo sapiens
caagaaacccauccaggaa

SEQ ID NO: 12853 - RNA, 19 nt, Homo sapiens
cgaaagugcuucauugacu

SEQ ID NO: 12854 - RNA, 19 nt, Homo sapiens
ggaaauuucuuaggaacuc

SEQ ID NO: 12855 - RNA, 19 nt, Homo sapiens
caacagcuaggaaauauca

SEQ ID NO: 12856 - RNA, 19 nt, Homo sapiens
ggaaggauuugcauuuuga

SEQ ID NO: 12857 - RNA, 19 nt, Homo sapiens
gguaaaggauagacucaca

SEQ ID NO: 12858 - RNA, 19 nt, Homo sapiens
caucaacccucaagacuac

SEQ ID NO: 12859 - RNA, 19 nt, Homo sapiens
caucaacaaggacaaauuu

SEQ ID NO: 12860 - RNA, 19 nt, Homo sapiens
ccucgaaacuggagaaagu

SEQ ID NO: 12861 - RNA, 19 nt, Homo sapiens
ugacaaagccucaauuacu

SEQ ID NO: 12862 - RNA, 19 nt, Homo sapiens
ucccagaaccucucaauaa

SEQ ID NO: 12863 - RNA, 19 nt, Homo sapiens
gauagacucacauuuacaa

SEQ ID NO: 12864 - RNA, 19 nt, Homo sapiens
gaagguaucccaaaacuug

SEQ ID NO: 12865 - RNA, 19 nt, Homo sapiens
gauggcaaaugcugugaau

SEQ ID NO: 12866 - RNA, 19 nt, Homo sapiens
guaauaugguggcuuuaag

SEQ ID NO: 12867 - RNA, 19 nt, Homo sapiens
uauggucgauauacaauug

SEQ ID NO: 12868 - RNA, 19 nt, Homo sapiens
uaaagaagguaucccaaaa

SEQ ID NO: 12869 - RNA, 19 nt, Homo sapiens
uaugacaaagccucaauua

SEQ ID NO: 12870 - RNA, 19 nt, Homo sapiens
ggaagcccauucaccacuu

SEQ ID NO: 12871 - RNA, 19 nt, Homo sapiens
cagcuaggaaauaucauua

SEQ ID NO: 12872 - RNA, 19 nt, Homo sapiens
uacaggaaauuucuuagga

SEQ ID NO: 12873 - RNA, 19 nt, Homo sapiens
gcugggccauugugauuga

SEQ ID NO: 12874 - RNA, 19 nt, Homo sapiens
gcacucaagcagagaagaa

SEQ ID NO: 12875 - RNA, 19 nt, Homo sapiens
uggcuucccuguuauguug

SEQ ID NO: 12876 - RNA, 19 nt, Homo sapiens
gcaucaacccucaagacua

SEQ ID NO: 12877 - RNA, 19 nt, Homo sapiens
gcucuuuacuccucagugu

SEQ ID NO: 12878 - RNA, 19 nt, Homo sapiens
gagcacagcaggaaaagua

SEQ ID NO: 12879 - RNA, 19 nt, Homo sapiens
ccugugacuucuugcauuu

SEQ ID NO: 12880 - RNA, 19 nt, Homo sapiens
gaagacagaaacgacauga

SEQ ID NO: 12881 - RNA, 19 nt, Homo sapiens
gaaauggcacaaacaccuu

SEQ ID NO: 12882 - RNA, 19 nt, Homo sapiens
acaggaaauuucuuaggaa

SEQ ID NO: 12883 - RNA, 19 nt, Homo sapiens
gcuuaugaaguucgcauua

SEQ ID NO: 12884 - RNA, 19 nt, Homo sapiens
gaagguccaagaguucuaa

SEQ ID NO: 12885 - RNA, 19 nt, Homo sapiens
ugaaggauuugaccugcuu

SEQ ID NO: 12886 - RNA, 19 nt, Homo sapiens
ggacaucaacaaggacaaa

SEQ ID NO: 12887 - RNA, 19 nt, Homo sapiens
cuuaugaaguucgcauuaa

SEQ ID NO: 12888 - RNA, 19 nt, Homo sapiens
uaaaggauagacucacauu

SEQ ID NO: 12889 - RNA, 19 nt, Homo sapiens
gcuaugggagguaaagaaa

SEQ ID NO: 12890 - RNA, 19 nt, Homo sapiens
cggccuaucugcuguuaug

SEQ ID NO: 12891 - RNA, 19 nt, Homo sapiens
guagagaugggauggcaaa

SEQ ID NO: 12892 - RNA, 19 nt, Homo sapiens
ccaaaucccugggguaaaa

SEQ ID NO: 12893 - RNA, 19 nt, Homo sapiens
uagugaagguccaagaguu

SEQ ID NO: 12894 - RNA, 19 nt, Homo sapiens
ccaacaaaccuuccuucuu

SEQ ID NO: 12895 - RNA, 19 nt, Homo sapiens
caacaaggacaaauuugca

SEQ ID NO: 12896 - RNA, 19 nt, Homo sapiens
gaaaaugcagaguuuguaa

SEQ ID NO: 12897 - RNA, 19 nt, Homo sapiens
gaaauuucuuaggaacuca

SEQ ID NO: 12898 - RNA, 19 nt, Homo sapiens
guccaagaguucuaaauac

SEQ ID NO: 12899 - RNA, 19 nt, Homo sapiens
uacgagaucuggagcaaca

SEQ ID NO: 12900 - RNA, 19 nt, Homo sapiens
uucccacucucauuuguua

SEQ ID NO: 12901 - RNA, 19 nt, Homo sapiens
gaugaugacugaaaaugug

SEQ ID NO: 12902 - RNA, 19 nt, Homo sapiens
aguauuaguuuguggcuau

SEQ ID NO: 12903 - RNA, 19 nt, Homo sapiens
uaaccauucuacuguguca

SEQ ID NO: 12904 - RNA, 19 nt, Homo sapiens
gcagagaagaaauccacaa

SEQ ID NO: 12905 - RNA, 19 nt, Homo sapiens
augaaagaccuuagacaua

SEQ ID NO: 12906 - RNA, 19 nt, Homo sapiens
gggaauugaagccaacaaa

SEQ ID NO: 12907 - RNA, 19 nt, Homo sapiens
ggagcagccagaaucauug

SEQ ID NO: 12908 - RNA, 19 nt, Homo sapiens
cagagaagaaauccacaaa

SEQ ID NO: 12909 - RNA, 19 nt, Homo sapiens
ucuauuaacuaccaugucu

SEQ ID NO: 12910 - RNA, 19 nt, Homo sapiens
caaacaccuuaagcaauau

SEQ ID NO: 12911 - RNA, 19 nt, Homo sapiens
uccaagaguucuaaauaca

SEQ ID NO: 12912 - RNA, 19 nt, Homo sapiens
ucacuggaugcguuaauaa

SEQ ID NO: 12913 - RNA, 19 nt, Homo sapiens
caaaacuuguggcugauuu

SEQ ID NO: 12914 - RNA, 19 nt, Homo sapiens
gaagugcuaaaggaaauga

SEQ ID NO: 12915 - RNA, 19 nt, Homo sapiens
ggcuuuaaguguagagaug

SEQ ID NO: 12916 - RNA, 19 nt, Homo sapiens
guauuaguuuguggcuaua

SEQ ID NO: 12917 - RNA, 19 nt, Homo sapiens
uacaguaaauggcaguguu

SEQ ID NO: 12918 - RNA, 19 nt, Homo sapiens
aacaaaccuuccuucuuaa

SEQ ID NO: 12919 - RNA, 19 nt, Homo sapiens
aauaaacccuaugcugcua

SEQ ID NO: 12920 - RNA, 19 nt, Homo sapiens
acacggugguggaugagaa

SEQ ID NO: 12921 - RNA, 19 nt, Homo sapiens
caauaaaccuuccuucuua

SEQ ID NO: 12922 - RNA, 19 nt, Homo sapiens
gagaagaaauccacaagua

SEQ ID NO: 12923 - RNA, 19 nt, Homo sapiens
ccaaagaaauggaaauuga

SEQ ID NO: 12924 - RNA, 19 nt, Homo sapiens
caugauggcuucccuguua

SEQ ID NO: 12925 - RNA, 19 nt, Homo sapiens
gagaaagucugccucauug

SEQ ID NO: 12926 - RNA, 19 nt, Homo sapiens
uaaagaaucugucccgaaa

SEQ ID NO: 12927 - RNA, 19 nt, Homo sapiens
gaagacagaaucaauauga

SEQ ID NO: 12928 - RNA, 19 nt, Homo sapiens
ggagaaagucugccucauu

SEQ ID NO: 12929 - RNA, 19 nt, Homo sapiens
acagaugccuucccuugua

SEQ ID NO: 12930 - RNA, 19 nt, Homo sapiens
gagcaacagcuaggaaaua

SEQ ID NO: 12931 - RNA, 19 nt, Homo sapiens
gcucaugaaguucgcauua

SEQ ID NO: 12932 - RNA, 19 nt, Homo sapiens
caagaaacccauucaggaa

SEQ ID NO: 12933 - RNA, 19 nt, Homo sapiens
gaugguggcugcaggaauc

SEQ ID NO: 12934 - RNA, 19 nt, Homo sapiens
gagaagacagaaucaauau

SEQ ID NO: 12935 - RNA, 19 nt, Homo sapiens
caaaccaggugauaaaguc

SEQ ID NO: 12936 - RNA, 19 nt, Homo sapiens
cccagaaccucucaauaaa

SEQ ID NO: 12937 - RNA, 19 nt, Homo sapiens
gcaggaaucugucguucag

SEQ ID NO: 12938 - RNA, 19 nt, Homo sapiens
ccaauaaaccuuccuucuu

SEQ ID NO: 12939 - RNA, 19 nt, Homo sapiens
caacagcuaggaaauauca

SEQ ID NO: 12940 - RNA, 19 nt, Homo sapiens
caucaacccucaagacuac

SEQ ID NO: 12941 - RNA, 19 nt, Homo sapiens
caucaacaaggacaaauuu

SEQ ID NO: 12942 - RNA, 19 nt, Homo sapiens
ucccagaaccucucaauaa

SEQ ID NO: 12943 - RNA, 19 nt, Homo sapiens
agagaagacagaaucaaua

SEQ ID NO: 12944 - RNA, 19 nt, Homo sapiens
gaagaaauccacaaguacu

SEQ ID NO: 12945 - RNA, 19 nt, Homo sapiens
cagcuaggaaauaucauua

SEQ ID NO: 12946 - RNA, 19 nt, Homo sapiens
gaaucugucccgaaacuug

SEQ ID NO: 12947 - RNA, 19 nt, Homo sapiens
gcacucaagcagagaagaa

SEQ ID NO: 12948 - RNA, 19 nt, Homo sapiens
uuuggaggcuuuaagagua

SEQ ID NO: 12949 - RNA, 19 nt, Homo sapiens
uggcuucccuguuauguug

SEQ ID NO: 12950 - RNA, 19 nt, Homo sapiens
gcaucaacccucaagacua

SEQ ID NO: 12951 - RNA, 19 nt, Homo sapiens
ugcaaaggcuaaagaguug

SEQ ID NO: 12952 - RNA, 19 nt, Homo sapiens
acacagugguggaugagaa

SEQ ID NO: 12953 - RNA, 19 nt, Homo sapiens
gcucuuuacuccucagugu

SEQ ID NO: 12954 - RNA, 19 nt, Homo sapiens
cggccuaucuguuguuaug

SEQ ID NO: 12955 - RNA, 19 nt, Homo sapiens
ggaagcccauccaccacuu

SEQ ID NO: 12956 - RNA, 19 nt, Homo sapiens
gagcacagcaggaaaagua

SEQ ID NO: 12957 - RNA, 19 nt, Homo sapiens
gcuaugggaguuaaagaaa

SEQ ID NO: 12958 - RNA, 19 nt, Homo sapiens
ugaaggauuugaccugcuu

SEQ ID NO: 12959 - RNA, 19 nt, Homo sapiens
gaaacuuguggcugacuuu

SEQ ID NO: 12960 - RNA, 19 nt, Homo sapiens
ggacaucaacaaggacaaa

SEQ ID NO: 12961 - RNA, 19 nt, Homo sapiens
uacaugaucuggagcaaca

SEQ ID NO: 12962 - RNA, 19 nt, Homo sapiens
uggcugacuuuauggcuaa

SEQ ID NO: 12963 - RNA, 19 nt, Homo sapiens
caacaaggacaaauuugca

SEQ ID NO: 12964 - RNA, 19 nt, Homo sapiens
ucacuggaugcauuaauaa

SEQ ID NO: 12965 - RNA, 19 nt, Homo sapiens
uucacuggaugcauuaaua

SEQ ID NO: 12966 - RNA, 19 nt, Homo sapiens
uuaugggucugcagucaaa

SEQ ID NO: 12967 - RNA, 19 nt, Homo sapiens
cguggaaaguguuggagaa

SEQ ID NO: 12968 - RNA, 19 nt, Homo sapiens
gcagagaagaaauccacaa

SEQ ID NO: 12969 - RNA, 19 nt, Homo sapiens
ggagcagccagaaucauug

SEQ ID NO: 12970 - RNA, 19 nt, Homo sapiens
uccuaaggcucaugaaguu

SEQ ID NO: 12971 - RNA, 19 nt, Homo sapiens
gaagugcuaaaggaaauga

SEQ ID NO: 12972 - RNA, 19 nt, Homo sapiens
gcugugcuaugggaguuaa

SEQ ID NO: 12973 - RNA, 19 nt, Homo sapiens
aauaaacccuaugcugcua

SEQ ID NO: 12974 - RNA, 19 nt, Homo sapiens
cagagaagacagaaucaau

SEQ ID NO: 12975 - RNA, 19 nt, Homo sapiens
agucaaaccaggugauaaa

SEQ ID NO: 12976 - RNA, 19 nt, Homo sapiens
cagaugagcaugugguuag

SEQ ID NO: 12977 - RNA, 19 nt, Homo sapiens
cugcuucgcucuggaaaga

SEQ ID NO: 12978 - RNA, 19 nt, Homo sapiens
ccucauuggcuguggauuu

SEQ ID NO: 12979 - RNA, 19 nt, Homo sapiens
aauggaaauugaugggaaa

SEQ ID NO: 12980 - RNA, 19 nt, Homo sapiens
cuggaugcauuaauaacaa

SEQ ID NO: 12981 - RNA, 19 nt, Homo sapiens
gaaacccauucaggaagug

SEQ ID NO: 12982 - RNA, 19 nt, Homo sapiens
ucaugaaguucgcauuaag

SEQ ID NO: 12983 - RNA, 19 nt, Homo sapiens
cuuuauggcuaagaaguuu

SEQ ID NO: 12984 - RNA, 19 nt, Homo sapiens
cgaaacuuguggcugacuu

SEQ ID NO: 12985 - RNA, 19 nt, Homo sapiens
gcagagaagacagaaucaa

SEQ ID NO: 12986 - RNA, 19 nt, Homo sapiens
gagaaggggugacuacagu

SEQ ID NO: 12987 - RNA, 19 nt, Homo sapiens
agcaacagcuaggaaauau

SEQ ID NO: 12988 - RNA, 19 nt, Homo sapiens
agaaacccauucaggaagu

SEQ ID NO: 12989 - RNA, 19 nt, Homo sapiens
uugcaaaggcuaaagaguu

SEQ ID NO: 12990 - RNA, 19 nt, Homo sapiens
gguuaugggucugcaguca

SEQ ID NO: 12991 - RNA, 19 nt, Homo sapiens
gaacaucaacuggggaauu

SEQ ID NO: 12992 - RNA, 19 nt, Homo sapiens
aaacuuguggcugacuuua

SEQ ID NO: 12993 - RNA, 19 nt, Homo sapiens
aggaagugcuaaaggaaau

SEQ ID NO: 12994 - RNA, 19 nt, Homo sapiens
ccucaagacuacaagaaac

SEQ ID NO: 12995 - RNA, 19 nt, Homo sapiens
cucaugaaguucgcauuaa

SEQ ID NO: 12996 - RNA, 19 nt, Homo sapiens
ggagcaacagcuaggaaau

SEQ ID NO: 12997 - RNA, 19 nt, Homo sapiens
cagaaccucucaauaaacc

SEQ ID NO: 12998 - RNA, 19 nt, Homo sapiens
aaaccuuccuucuuaacca

SEQ ID NO: 12999 - RNA, 19 nt, Homo sapiens
caggaaaaguaaucaaaug

SEQ ID NO: 13000 - RNA, 19 nt, Homo sapiens
cagaugccuucccuuguag

SEQ ID NO: 13001 - RNA, 19 nt, Homo sapiens
aagaaucugucccgaaacu

SEQ ID NO: 13002 - RNA, 19 nt, Homo sapiens
uuggaggcuuuaagaguaa

SEQ ID NO: 13003 - RNA, 19 nt, Homo sapiens
cuaaaggaaaugacugaug

SEQ ID NO: 13004 - RNA, 19 nt, Homo sapiens
caugaaguucgcauuaaga

SEQ ID NO: 13005 - RNA, 19 nt, Homo sapiens
caggaagugcuaaaggaaa

SEQ ID NO: 13006 - RNA, 19 nt, Homo sapiens
aaucauugcuguggacauc

SEQ ID NO: 13007 - RNA, 19 nt, Homo sapiens
ucagcaccuucucccagua

SEQ ID NO: 13008 - RNA, 19 nt, Homo sapiens
acuuguggcugacuuuaug

SEQ ID NO: 13009 - RNA, 19 nt, Homo sapiens
caaauuugcaaaggcuaaa

SEQ ID NO: 13010 - RNA, 19 nt, Homo sapiens
ugacuggacgcacguggaa

SEQ ID NO: 13011 - RNA, 19 nt, Homo sapiens
ucaggaagugcuaaaggaa

SEQ ID NO: 13012 - RNA, 19 nt, Homo sapiens
uggagcagccagaaucauu

SEQ ID NO: 13013 - RNA, 19 nt, Homo sapiens
ccucuacccuacaugaucu

SEQ ID NO: 13014 - RNA, 19 nt, Homo sapiens
ucagaugagcaugugguua

SEQ ID NO: 13015 - RNA, 19 nt, Homo sapiens
acaaauuugcaaaggcuaa

SEQ ID NO: 13016 - RNA, 19 nt, Homo sapiens
ucauugcuguggacaucaa

SEQ ID NO: 13017 - RNA, 19 nt, Homo sapiens
cagcugugcuaugggaguu

SEQ ID NO: 13018 - RNA, 19 nt, Homo sapiens
gccaauaaaccuuccuucu

SEQ ID NO: 13019 - RNA, 19 nt, Homo sapiens
ccuguuauguugucaugag

SEQ ID NO: 13020 - RNA, 19 nt, Homo sapiens
aauaugagcacagcaggaa

SEQ ID NO: 13021 - RNA, 19 nt, Homo sapiens
gaaagaaacuuccaacaca

SEQ ID NO: 13022 - RNA, 19 nt, Homo sapiens
ggaagugauuggagaauua

SEQ ID NO: 13023 - RNA, 19 nt, Homo sapiens
gagaagaacagguaaguua

SEQ ID NO: 13024 - RNA, 19 nt, Homo sapiens
caaaccaggugacaaagua

SEQ ID NO: 13025 - RNA, 19 nt, Homo sapiens
caacacaguuucccaaaga

SEQ ID NO: 13026 - RNA, 19 nt, Homo sapiens
gaacaauccucaucuuugg

SEQ ID NO: 13027 - RNA, 19 nt, Homo sapiens
ggaaagccaugaguuuaaa

SEQ ID NO: 13028 - RNA, 19 nt, Homo sapiens
cagcugaaguccaauagua

SEQ ID NO: 13029 - RNA, 19 nt, Homo sapiens
gguaggaguuugaagcuuu

SEQ ID NO: 13030 - RNA, 19 nt, Homo sapiens
gaagaugccaggagcaauu

SEQ ID NO: 13031 - RNA, 19 nt, Homo sapiens
gaagcuuucuuaacucaga

SEQ ID NO: 13032 - RNA, 19 nt, Homo sapiens
gaagaacagguaaguuaaa

SEQ ID NO: 13033 - RNA, 19 nt, Homo sapiens
gaaguucgcauucagauca

SEQ ID NO: 13034 - RNA, 19 nt, Homo sapiens
ucaaagacagcucauuaua

SEQ ID NO: 13035 - RNA, 19 nt, Homo sapiens
gagagcaucaggaagaaua

SEQ ID NO: 13036 - RNA, 19 nt, Homo sapiens
ucccaaagcuggucacuga

SEQ ID NO: 13037 - RNA, 19 nt, Homo sapiens
caaggaaagccaugaguuu

SEQ ID NO: 13038 - RNA, 19 nt, Homo sapiens
ccucaauccuagagacuua

SEQ ID NO: 13039 - RNA, 19 nt, Homo sapiens
ggaguuugaagcuuucuua

SEQ ID NO: 13040 - RNA, 19 nt, Homo sapiens
gaauuaagcaacaugaaug

SEQ ID NO: 13041 - RNA, 19 nt, Homo sapiens
gaacagguaaguuaaaugg

SEQ ID NO: 13042 - RNA, 19 nt, Homo sapiens
gcaaaggauugacuauuuu

SEQ ID NO: 13043 - RNA, 19 nt, Homo sapiens
ggaguagaaauuuccuuua

SEQ ID NO: 13044 - RNA, 19 nt, Homo sapiens
gaaugaauaagaccuggua

SEQ ID NO: 13045 - RNA, 19 nt, Homo sapiens
agcaaaggauugacuauuu

SEQ ID NO: 13046 - RNA, 19 nt, Homo sapiens
aaagacagcucauuauagg

SEQ ID NO: 13047 - RNA, 19 nt, Homo sapiens
cauguacccuggaacuuaa

SEQ ID NO: 13048 - RNA, 19 nt, Homo sapiens
caucaacagugagaaguuu

SEQ ID NO: 13049 - RNA, 19 nt, Homo sapiens
gaguagaaauuuccuuuac

SEQ ID NO: 13050 - RNA, 19 nt, Homo sapiens
gccaugaguuuaaacaaau

SEQ ID NO: 13051 - RNA, 19 nt, Homo sapiens
gaaagcagcccuggacugu

SEQ ID NO: 13052 - RNA, 19 nt, Homo sapiens
gggcaaaguuauuaaaugc

SEQ ID NO: 13053 - RNA, 19 nt, Homo sapiens
uaacaaaccugcacauccu

SEQ ID NO: 13054 - RNA, 19 nt, Homo sapiens
uagauuggccauauguuua

SEQ ID NO: 13055 - RNA, 19 nt, Homo sapiens
gaaauucaaucuggaugca

SEQ ID NO: 13056 - RNA, 19 nt, Homo sapiens
gcaggagcuuccagaauca

SEQ ID NO: 13057 - RNA, 19 nt, Homo sapiens
ccaguguuaucgauucuaa

SEQ ID NO: 13058 - RNA, 19 nt, Homo sapiens
gaaguccaauaguacaaau

SEQ ID NO: 13059 - RNA, 19 nt, Homo sapiens
gggaucauguacuuucauu

SEQ ID NO: 13060 - RNA, 19 nt, Homo sapiens
caaaauagaugaugaugca

SEQ ID NO: 13061 - RNA, 19 nt, Homo sapiens
uaagcaacaugaaugguau

SEQ ID NO: 13062 - RNA, 19 nt, Homo sapiens
gagagagcaucaggaagaa

SEQ ID NO: 13063 - RNA, 19 nt, Homo sapiens
ucugggagcuaaaugauga

SEQ ID NO: 13064 - RNA, 19 nt, Homo sapiens
ccaggaaguuaucauugaa

SEQ ID NO: 13065 - RNA, 19 nt, Homo sapiens
ugaaggagaagaacaggua

SEQ ID NO: 13066 - RNA, 19 nt, Homo sapiens
ccaugaggcugcagguauu

SEQ ID NO: 13067 - RNA, 19 nt, Homo sapiens
caaagacagcucauuauag

SEQ ID NO: 13068 - RNA, 19 nt, Homo sapiens
gggaaugaagagauaauaa

SEQ ID NO: 13069 - RNA, 19 nt, Homo sapiens
guaaaccacuaaauaugca

SEQ ID NO: 13070 - RNA, 19 nt, Homo sapiens
ccaguacauucucucagua

SEQ ID NO: 13071 - RNA, 19 nt, Homo sapiens
gaagugauuggagaauuaa

SEQ ID NO: 13072 - RNA, 19 nt, Homo sapiens
acacaagcuuaaauaggua

SEQ ID NO: 13073 - RNA, 19 nt, Homo sapiens
cuaauaaucggccguacua

SEQ ID NO: 13074 - RNA, 19 nt, Homo sapiens
aaucauagguauugacauc

SEQ ID NO: 13075 - RNA, 19 nt, Homo sapiens
gcaaauuuagagagaguuu

SEQ ID NO: 13076 - RNA, 19 nt, Homo sapiens
gaugaucugugcagcaaag

SEQ ID NO: 13077 - RNA, 19 nt, Homo sapiens
cgaacaauccucaucuuug

SEQ ID NO: 13078 - RNA, 19 nt, Homo sapiens
ggaagaauagcuaauggau

SEQ ID NO: 13079 - RNA, 19 nt, Homo sapiens
guuugaagcuuucuuaacu

SEQ ID NO: 13080 - RNA, 19 nt, Homo sapiens
cuugcuagauuaacuauug

SEQ ID NO: 13081 - RNA, 19 nt, Homo sapiens
gggcuuuucucuauuauuu

SEQ ID NO: 13082 - RNA, 19 nt, Homo sapiens
ggagcuaaaugaugagaac

SEQ ID NO: 13083 - RNA, 19 nt, Homo sapiens
ggaacauucuuuggugguu

SEQ ID NO: 13084 - RNA, 19 nt, Homo sapiens
auaaucggccguacuauaa

SEQ ID NO: 13085 - RNA, 19 nt, Homo sapiens
agagagaguuugucugcuu

SEQ ID NO: 13086 - RNA, 19 nt, Homo sapiens
gcaccaagggcaaaguuau

SEQ ID NO: 13087 - RNA, 19 nt, Homo sapiens
uaguacaaaugauguggua

SEQ ID NO: 13088 - RNA, 19 nt, Homo sapiens
aauaaaugcuugaggagau

SEQ ID NO: 13089 - RNA, 19 nt, Homo sapiens
gcacaacagggagacuaua

SEQ ID NO: 13090 - RNA, 19 nt, Homo sapiens
uaaaugaugagaacacaug

SEQ ID NO: 13091 - RNA, 19 nt, Homo sapiens
uacacaagcuuaaauaggu

SEQ ID NO: 13092 - RNA, 19 nt, Homo sapiens
gaauacauggaguuucauu

SEQ ID NO: 13093 - RNA, 19 nt, Homo sapiens
aaacuagauuggccauaug

SEQ ID NO: 13094 - RNA, 19 nt, Homo sapiens
aauaaucggccguacuaua

SEQ ID NO: 13095 - RNA, 19 nt, Homo sapiens
acacauugcaugccuauau

SEQ ID NO: 13096 - RNA, 19 nt, Homo sapiens
gguugcagcugaaguccaa

SEQ ID NO: 13097 - RNA, 19 nt, Homo sapiens
uaagaccugguauuugaua

SEQ ID NO: 13098 - RNA, 19 nt, Homo sapiens
agagagagcaucaggaaga

SEQ ID NO: 13099 - RNA, 19 nt, Homo sapiens
gaucauguacuuucauugg

SEQ ID NO: 13100 - RNA, 19 nt, Homo sapiens
aaaccgauccaggaaguua

SEQ ID NO: 13101 - RNA, 19 nt, Homo sapiens
uguaauggguuguaaagca

SEQ ID NO: 13102 - RNA, 19 nt, Homo sapiens
agaaguuugugaaggcuaa

SEQ ID NO: 13103 - RNA, 19 nt, Homo sapiens
gaaggagaagaacagguaa

SEQ ID NO: 13104 - RNA, 19 nt, Homo sapiens
auucaaagacagcucauua

SEQ ID NO: 13105 - RNA, 19 nt, Homo sapiens
ggagaauuaagcaacauga

SEQ ID NO: 13106 - RNA, 19 nt, Homo sapiens
gauuggccauauguuuaua

SEQ ID NO: 13107 - RNA, 19 nt, Homo sapiens
gaaccaaggaaagccauga

SEQ ID NO: 13108 - RNA, 19 nt, Homo sapiens
uccaggaaguuaucauuga

SEQ ID NO: 13109 - RNA, 19 nt, Homo sapiens
gauccaggaaguuaucauu

SEQ ID NO: 13110 - RNA, 19 nt, Homo sapiens
ccuagagacuuacauaaac

SEQ ID NO: 13111 - RNA, 19 nt, Homo sapiens
uagauuggguaaugaauac

SEQ ID NO: 13112 - RNA, 19 nt, Homo sapiens
aaggaaagccaugaguuua

SEQ ID NO: 13113 - RNA, 19 nt, Homo sapiens
caagggagguguggauuuu

SEQ ID NO: 13114 - RNA, 19 nt, Homo sapiens
ggaaguuaucauugaauug

SEQ ID NO: 13115 - RNA, 19 nt, Homo sapiens
gcagguauuguggaaagua

SEQ ID NO: 13116 - RNA, 19 nt, Homo sapiens
cauugaagagguugaagua

SEQ ID NO: 13117 - RNA, 19 nt, Homo sapiens
caagggcaaaguuauuaaa

SEQ ID NO: 13118 - RNA, 19 nt, Homo sapiens
gcagcaaagcaccauggua

SEQ ID NO: 13119 - RNA, 19 nt, Homo sapiens
agaagaacagguaaguuaa

SEQ ID NO: 13120 - RNA, 19 nt, Homo sapiens
gcuaaaugaugagaacaca

SEQ ID NO: 13121 - RNA, 19 nt, Homo sapiens
caaaguuggugucugaaua

SEQ ID NO: 13122 - RNA, 19 nt, Homo sapiens
gaaagccucucuccauaga

SEQ ID NO: 13123 - RNA, 19 nt, Homo sapiens
ccaaauugcucuucaaagu

SEQ ID NO: 13124 - RNA, 19 nt, Homo sapiens
caagucugcuucugugaua

SEQ ID NO: 13125 - RNA, 19 nt, Homo sapiens
gaacagauccuagccauca

SEQ ID NO: 13126 - RNA, 19 nt, Homo sapiens
ggaaagagcauucgaacug

SEQ ID NO: 13127 - RNA, 19 nt, Homo sapiens
uaagacguaucacagaaua

SEQ ID NO: 13128 - RNA, 19 nt, Homo sapiens
gaugguaccagcagauuua

SEQ ID NO: 13129 - RNA, 19 nt, Homo sapiens
gccaguuucuguauuauaa

SEQ ID NO: 13130 - RNA, 19 nt, Homo sapiens
gguugugacuguacuauuu

SEQ ID NO: 13131 - RNA, 19 nt, Homo sapiens
ggaacauucuucugcauug

SEQ ID NO: 13132 - RNA, 19 nt, Homo sapiens
ggagucggauuggcaguua

SEQ ID NO: 13133 - RNA, 19 nt, Homo sapiens
gaacauggcgaacgagguu

SEQ ID NO: 13134 - RNA, 19 nt, Homo sapiens
gcugauaucucuguugcua

SEQ ID NO: 13135 - RNA, 19 nt, Homo sapiens
ccuaaaccaucuacucuuu

SEQ ID NO: 13136 - RNA, 19 nt, Homo sapiens
gaaagagcauucgaacugu

SEQ ID NO: 13137 - RNA, 19 nt, Homo sapiens
aaacuaaccuuugccagaa

SEQ ID NO: 13138 - RNA, 19 nt, Homo sapiens
cgaacgagguuaucaagug

SEQ ID NO: 13139 - RNA, 19 nt, Homo sapiens
gaacugaugcauucuggaa

SEQ ID NO: 13140 - RNA, 19 nt, Homo sapiens
ggaguggacuauuccuuug

SEQ ID NO: 13141 - RNA, 19 nt, Homo sapiens
guauuaacccucaggauuu

SEQ ID NO: 13142 - RNA, 19 nt, Homo sapiens
caaauugcucuucaaagua

SEQ ID NO: 13143 - RNA, 19 nt, Homo sapiens
cccaaaggcucaugaaguu

SEQ ID NO: 13144 - RNA, 19 nt, Homo sapiens
ggaagaguguagaaagugu

SEQ ID NO: 13145 - RNA, 19 nt, Homo sapiens
uauaaagucugccuucuag

SEQ ID NO: 13146 - RNA, 19 nt, Homo sapiens
guugccaguuucuguauua

SEQ ID NO: 13147 - RNA, 19 nt, Homo sapiens
uagaaagugucccaaaguu

SEQ ID NO: 13148 - RNA, 19 nt, Homo sapiens
ugauaucucuguugcuaaa

SEQ ID NO: 13149 - RNA, 19 nt, Homo sapiens
guacuuucacuguguauaa

SEQ ID NO: 13150 - RNA, 19 nt, Homo sapiens
ucagaaacauaacguugaa

SEQ ID NO: 13151 - RNA, 19 nt, Homo sapiens
uauuaacccucaggauuua

SEQ ID NO: 13152 - RNA, 19 nt, Homo sapiens
aaacagcauucugggcuua

SEQ ID NO: 13153 - RNA, 19 nt, Homo sapiens
gaaguucgaaucaagauca

SEQ ID NO: 13154 - RNA, 19 nt, Homo sapiens
guacugugccuuguucaua

SEQ ID NO: 13155 - RNA, 19 nt, Homo sapiens
ugaaaccucagaaacauaa

SEQ ID NO: 13156 - RNA, 19 nt, Homo sapiens
acaugaaggugcuggaauu

SEQ ID NO: 13157 - RNA, 19 nt, Homo sapiens
uauagacauugccaaauug

SEQ ID NO: 13158 - RNA, 19 nt, Homo sapiens
gaauguauugguaauguga

SEQ ID NO: 13159 - RNA, 19 nt, Homo sapiens
cagauuuacuugcaaagga

SEQ ID NO: 13160 - RNA, 19 nt, Homo sapiens
cagcagauuuacuugcaaa

SEQ ID NO: 13161 - RNA, 19 nt, Homo sapiens
ccagugaucuugggacaug

SEQ ID NO: 13162 - RNA, 19 nt, Homo sapiens
gaaucucuauaaucaagga

SEQ ID NO: 13163 - RNA, 19 nt, Homo sapiens
acacugucaucccacuuua

SEQ ID NO: 13164 - RNA, 19 nt, Homo sapiens
ccuaagacguaucacagaa

SEQ ID NO: 13165 - RNA, 19 nt, Homo sapiens
uacgggaacuaccauaauu

SEQ ID NO: 13166 - RNA, 19 nt, Homo sapiens
gagguacugugccuuguuc

SEQ ID NO: 13167 - RNA, 19 nt, Homo sapiens
caaggauaauucagucaug

SEQ ID NO: 13168 - RNA, 19 nt, Homo sapiens
guuggugucugaauauaug

SEQ ID NO: 13169 - RNA, 19 nt, Homo sapiens
uaacaggucgcacauggaa

SEQ ID NO: 13170 - RNA, 19 nt, Homo sapiens
guauaaagucugccuucua

SEQ ID NO: 13171 - RNA, 19 nt, Homo sapiens
ugaaggugcuggaauugug

SEQ ID NO: 13172 - RNA, 19 nt, Homo sapiens
ggaaugguguuuuauuaug

SEQ ID NO: 13173 - RNA, 19 nt, Homo sapiens
uccaagagguaacaauuau

SEQ ID NO: 13174 - RNA, 19 nt, Homo sapiens
ugugaacacugccaaguug

SEQ ID NO: 13175 - RNA, 19 nt, Homo sapiens
ugaauuacaugaguaugga

SEQ ID NO: 13176 - RNA, 19 nt, Homo sapiens
cgggaacuaccauaauuua

SEQ ID NO: 13177 - RNA, 19 nt, Homo sapiens
guauguauguguugguugu

SEQ ID NO: 13178 - RNA, 19 nt, Homo sapiens
ggaugcuccuccacauaaa

SEQ ID NO: 13179 - RNA, 19 nt, Homo sapiens
guaaacccauccaggaagu

SEQ ID NO: 13180 - RNA, 19 nt, Homo sapiens
gguaacaauuauccacaau

SEQ ID NO: 13181 - RNA, 19 nt, Homo sapiens
guguggacaucaauaaaga

SEQ ID NO: 13182 - RNA, 19 nt, Homo sapiens
gaagcucucguucauuaau

SEQ ID NO: 13183 - RNA, 19 nt, Homo sapiens
gaaacauaacguugaacuu

SEQ ID NO: 13184 - RNA, 19 nt, Homo sapiens
uguggaaauugucuuguuu

SEQ ID NO: 13185 - RNA, 19 nt, Homo sapiens
cuucacagcuacuccagaa

SEQ ID NO: 13186 - RNA, 19 nt, Homo sapiens
gauaggagcagcuuaacag

SEQ ID NO: 13187 - RNA, 19 nt, Homo sapiens
gcaguuaucaugggcugua

SEQ ID NO: 13188 - RNA, 19 nt, Homo sapiens
gaacauucuucugcauugg

SEQ ID NO: 13189 - RNA, 19 nt, Homo sapiens
uaucauuccuguguuguug

SEQ ID NO: 13190 - RNA, 19 nt, Homo sapiens
gaaauugccacucguccau

SEQ ID NO: 13191 - RNA, 19 nt, Homo sapiens
gaucauugguguggacauc

SEQ ID NO: 13192 - RNA, 19 nt, Homo sapiens
ggaaagccucucuccauag

SEQ ID NO: 13193 - RNA, 19 nt, Homo sapiens
ccuuugaacugaugcauuc

SEQ ID NO: 13194 - RNA, 19 nt, Homo sapiens
ggauuaaugccagauggua

SEQ ID NO: 13195 - RNA, 19 nt, Homo sapiens
ggaauuguggaaaguguug

SEQ ID NO: 13196 - RNA, 19 nt, Homo sapiens
ucaaggacaaggauaauuc

SEQ ID NO: 13197 - RNA, 19 nt, Homo sapiens
uaaucaaggacaaggauaa

SEQ ID NO: 13198 - RNA, 19 nt, Homo sapiens
caugggaaccagcacauuu

SEQ ID NO: 13199 - RNA, 19 nt, Homo sapiens
gcucaugaaguucgaauca

SEQ ID NO: 13200 - RNA, 19 nt, Homo sapiens
guagaaagugucccaaagu

SEQ ID NO: 13201 - RNA, 19 nt, Homo sapiens
gcaaaggaaagacaauuuu

SEQ ID NO: 13202 - RNA, 19 nt, Homo sapiens
cauacugaauauccaaguu

SEQ ID NO: 13203 - RNA, 19 nt, Homo sapiens
gauuaaagaacagauccua

SEQ ID NO: 13204 - RNA, 19 nt, Homo sapiens
cauucgaacuguuguaaag

SEQ ID NO: 13205 - RNA, 19 nt, Homo sapiens
aaagagcauucgaacuguu

SEQ ID NO: 13206 - RNA, 19 nt, Homo sapiens
guggacaucaauaaagaua

SEQ ID NO: 13207 - RNA, 19 nt, Homo sapiens
caagggaaagggaaaggaa

SEQ ID NO: 13208 - RNA, 19 nt, Homo sapiens
ugacucacaaucugucuuu

SEQ ID NO: 13209 - RNA, 19 nt, Homo sapiens
ggagccacugaauguauua

SEQ ID NO: 13210 - RNA, 19 nt, Homo sapiens
uaucaugggcuguaaagug

SEQ ID NO: 13211 - RNA, 19 nt, Homo sapiens
ggaaagacaauuuugcauu

SEQ ID NO: 13212 - RNA, 19 nt, Homo sapiens
guguggagaaugcaaauuu

SEQ ID NO: 13213 - RNA, 19 nt, Homo sapiens
uguauaaccuaaaccaucu

SEQ ID NO: 13214 - RNA, 19 nt, Homo sapiens
guguggaaauugucuuguu

SEQ ID NO: 13215 - RNA, 19 nt, Homo sapiens
uguauuaacccucaggauu

SEQ ID NO: 13216 - RNA, 19 nt, Homo sapiens
gauggaagaguguagaaag

SEQ ID NO: 13217 - RNA, 19 nt, Homo sapiens
uccaggaagugcucauuga

SEQ ID NO: 13218 - RNA, 19 nt, Homo sapiens
cuuuagcaccuuuguauaa

SEQ ID NO: 13219 - RNA, 19 nt, Homo sapiens
guucgaaucaagaucauug

SEQ ID NO: 13220 - RNA, 19 nt, Homo sapiens
acauuuagccuuauagaca

SEQ ID NO: 13221 - RNA, 19 nt, Homo sapiens
gagaaaguaugccuaauua

SEQ ID NO: 13222 - RNA, 19 nt, Homo sapiens
gaaucuagauccacuaauu

SEQ ID NO: 13223 - RNA, 19 nt, Homo sapiens
caaugaagcaguugaauua

SEQ ID NO: 13224 - RNA, 19 nt, Homo sapiens
gaaaccaggugacaaaguu

SEQ ID NO: 13225 - RNA, 19 nt, Homo sapiens
guacagagaugaaaguguu

SEQ ID NO: 13226 - RNA, 19 nt, Homo sapiens
gcagagaaguugaaucuag

SEQ ID NO: 13227 - RNA, 19 nt, Homo sapiens
gcacaucccuaaacugguu

SEQ ID NO: 13228 - RNA, 19 nt, Homo sapiens
gaagaggcuuucaggaauu

SEQ ID NO: 13229 - RNA, 19 nt, Homo sapiens
caaaggagguucgcauaaa

SEQ ID NO: 13230 - RNA, 19 nt, Homo sapiens
ggagucggcuugucuguug

SEQ ID NO: 13231 - RNA, 19 nt, Homo sapiens
caacugaugucugauggua

SEQ ID NO: 13232 - RNA, 19 nt, Homo sapiens
ggaucucccuuucucaaua

SEQ ID NO: 13233 - RNA, 19 nt, Homo sapiens
cuaaacugguugcugauua

SEQ ID NO: 13234 - RNA, 19 nt, Homo sapiens
uaaagaaacccauucaaga

SEQ ID NO: 13235 - RNA, 19 nt, Homo sapiens
gaaaguugcuacaggaucu

SEQ ID NO: 13236 - RNA, 19 nt, Homo sapiens
gcagacagcacaucccuaa

SEQ ID NO: 13237 - RNA, 19 nt, Homo sapiens
gaucucccuuucucaauaa

SEQ ID NO: 13238 - RNA, 19 nt, Homo sapiens
cagaagcuguauacugaua

SEQ ID NO: 13239 - RNA, 19 nt, Homo sapiens
gguauagacuucugcuuug

SEQ ID NO: 13240 - RNA, 19 nt, Homo sapiens
gcaaaggagguucgcauaa

SEQ ID NO: 13241 - RNA, 19 nt, Homo sapiens
ugaagcaguugaauuaaug

SEQ ID NO: 13242 - RNA, 19 nt, Homo sapiens
uaugacagaugcugguaua

SEQ ID NO: 13243 - RNA, 19 nt, Homo sapiens
ccucaacccucaggacuua

SEQ ID NO: 13244 - RNA, 19 nt, Homo sapiens
caagagaaaggguguauug

SEQ ID NO: 13245 - RNA, 19 nt, Homo sapiens
gaugguaccagcagguuua

SEQ ID NO: 13246 - RNA, 19 nt, Homo sapiens
aaacccaacugaugucuga

SEQ ID NO: 13247 - RNA, 19 nt, Homo sapiens
ugcagaagcuguauacuga

SEQ ID NO: 13248 - RNA, 19 nt, Homo sapiens
aaacugcccacauaaauuu

SEQ ID NO: 13249 - RNA, 19 nt, Homo sapiens
gaaacccauucaagaaguu

SEQ ID NO: 13250 - RNA, 19 nt, Homo sapiens
gcuguauacugauaauuga

SEQ ID NO: 13251 - RNA, 19 nt, Homo sapiens
aaagaaacccauucaagaa

SEQ ID NO: 13252 - RNA, 19 nt, Homo sapiens
uaaacugguugcugauuau

SEQ ID NO: 13253 - RNA, 19 nt, Homo sapiens
ccucuugccugaauucuga

SEQ ID NO: 13254 - RNA, 19 nt, Homo sapiens
cagagaaguugaaucuaga

SEQ ID NO: 13255 - RNA, 19 nt, Homo sapiens
gaagcuguauacugauaau

SEQ ID NO: 13256 - RNA, 19 nt, Homo sapiens
guaaacugcccacauaaau

SEQ ID NO: 13257 - RNA, 19 nt, Homo sapiens
gaaguugaaucuagaucca

SEQ ID NO: 13258 - RNA, 19 nt, Homo sapiens
gaguggaugucaacaagga

SEQ ID NO: 13259 - RNA, 19 nt, Homo sapiens
gaaaguaugccuaauuagc

SEQ ID NO: 13260 - RNA, 19 nt, Homo sapiens
gguaaacugcccacauaaa

SEQ ID NO: 13261 - RNA, 19 nt, Homo sapiens
uaagaaggcacaggaauug

SEQ ID NO: 13262 - RNA, 19 nt, Homo sapiens
gaaggaguaagcacaguga

SEQ ID NO: 13263 - RNA, 19 nt, Homo sapiens
uaaacugcccacauaaauu

SEQ ID NO: 13264 - RNA, 19 nt, Homo sapiens
guauagacuucugcuuuga

SEQ ID NO: 13265 - RNA, 19 nt, Homo sapiens
ggacuuaaagaaacccauu

SEQ ID NO: 13266 - RNA, 19 nt, Homo sapiens
gagaaaaucagcaugagua

SEQ ID NO: 13267 - RNA, 19 nt, Homo sapiens
gauccacuaauuacucaua

SEQ ID NO: 13268 - RNA, 19 nt, Homo sapiens
caaaaucaguggccaguug

SEQ ID NO: 13269 - RNA, 19 nt, Homo sapiens
gauaaaggaaaucucaguu

SEQ ID NO: 13270 - RNA, 19 nt, Homo sapiens
guaaacacuuggaccucuu

SEQ ID NO: 13271 - RNA, 19 nt, Homo sapiens
augguaaacugcccacaua

SEQ ID NO: 13272 - RNA, 19 nt, Homo sapiens
cggcuugucuguugucaug

SEQ ID NO: 13273 - RNA, 19 nt, Homo sapiens
agagaaaguaugccuaauu

SEQ ID NO: 13274 - RNA, 19 nt, Homo sapiens
gugaauacacagugauaaa

SEQ ID NO: 13275 - RNA, 19 nt, Homo sapiens
caaggugacuccagguucu

SEQ ID NO: 13276 - RNA, 19 nt, Homo sapiens
cugauuauauggcagagaa

SEQ ID NO: 13277 - RNA, 19 nt, Homo sapiens
gguguugccugccaguguu

SEQ ID NO: 13278 - RNA, 19 nt, Homo sapiens
ccucaggacuuaaagaaac

SEQ ID NO: 13279 - RNA, 19 nt, Homo sapiens
ugucauggguuguaaagca

SEQ ID NO: 13280 - RNA, 19 nt, Homo sapiens
cuaauuagcuguggcuuuu

SEQ ID NO: 13281 - RNA, 19 nt, Homo sapiens
acacagugauaaaggaaau

SEQ ID NO: 13282 - RNA, 19 nt, Homo sapiens
gacagaugcugguauagac

SEQ ID NO: 13283 - RNA, 19 nt, Homo sapiens
caacaaggagaaauuuaag

SEQ ID NO: 13284 - RNA, 19 nt, Homo sapiens
cuagagaaaguaugccuaa

SEQ ID NO: 13285 - RNA, 19 nt, Homo sapiens
gcuacaggaucucccuuuc

SEQ ID NO: 13286 - RNA, 19 nt, Homo sapiens
aaaggagguucgcauaaag

SEQ ID NO: 13287 - RNA, 19 nt, Homo sapiens
ggcaaaggagguucgcaua

SEQ ID NO: 13288 - RNA, 19 nt, Homo sapiens
uuaagaaggcacaggaauu

SEQ ID NO: 13289 - RNA, 19 nt, Homo sapiens
acacuuggaccucuuguau

SEQ ID NO: 13290 - RNA, 19 nt, Homo sapiens
gaagcaguugaauuaauga

SEQ ID NO: 13291 - RNA, 19 nt, Homo sapiens
uagauccacuaauuacuca

SEQ ID NO: 13292 - RNA, 19 nt, Homo sapiens
gacagcacaucccuaaacu

SEQ ID NO: 13293 - RNA, 19 nt, Homo sapiens
gaauacacagugauaaagg

SEQ ID NO: 13294 - RNA, 19 nt, Homo sapiens
ugacagaugcugguauaga

SEQ ID NO: 13295 - RNA, 19 nt, Homo sapiens
agaaacccauucaagaagu

SEQ ID NO: 13296 - RNA, 19 nt, Homo sapiens
ggagcagccaggaucauug

SEQ ID NO: 13297 - RNA, 19 nt, Homo sapiens
gcuuugaggccauuggaaa

SEQ ID NO: 13298 - RNA, 19 nt, Homo sapiens
uuaaagaaacccauucaag

SEQ ID NO: 13299 - RNA, 19 nt, Homo sapiens
gcuggaaucguugagagua

SEQ ID NO: 13300 - RNA, 19 nt, Homo sapiens
ugaaggggcuggaaucguu

SEQ ID NO: 13301 - RNA, 19 nt, Homo sapiens
aagaggcuuucaggaauuu

SEQ ID NO: 13302 - RNA, 19 nt, Homo sapiens
cucauacucugaaucuuga

SEQ ID NO: 13303 - RNA, 19 nt, Homo sapiens
gucaacaaggagaaauuua

SEQ ID NO: 13304 - RNA, 19 nt, Homo sapiens
gagaaggaguaagcacagu

SEQ ID NO: 13305 - RNA, 19 nt, Homo sapiens
ucaggaauuuguaaagcau

SEQ ID NO: 13306 - RNA, 19 nt, Homo sapiens
uguauuggcuugggaguag

SEQ ID NO: 13307 - RNA, 19 nt, Homo sapiens
cuaauuacucauacucuga

SEQ ID NO: 13308 - RNA, 19 nt, Homo sapiens
ugguauagacuucugcuuu

SEQ ID NO: 13309 - RNA, 19 nt, Homo sapiens
gauaugacagaugcuggua

SEQ ID NO: 13310 - RNA, 19 nt, Homo sapiens
acaaaguuaucacacucuu

SEQ ID NO: 13311 - RNA, 19 nt, Homo sapiens
aaaccaggugacaaaguua

SEQ ID NO: 13312 - RNA, 19 nt, Homo sapiens
ggaguaagcacagugaaac

SEQ ID NO: 13313 - RNA, 19 nt, Homo sapiens
gaguauuggagaaggagua

SEQ ID NO: 13314 - RNA, 19 nt, Homo sapiens
aauacacagugauaaagga

SEQ ID NO: 13315 - RNA, 19 nt, Homo sapiens
aagcagccauacucuggaa

SEQ ID NO: 13316 - RNA, 19 nt, Homo sapiens
aaaaucagcaugaguacua

SEQ ID NO: 13317 - RNA, 19 nt, Homo sapiens
ccagcaccuucugugaaua

SEQ ID NO: 13318 - RNA, 19 nt, Homo sapiens
ugagaguauuggagaagga

SEQ ID NO: 13319 - RNA, 19 nt, Homo sapiens
guuuggugcugcaaucaau

SEQ ID NO: 13320 - RNA, 19 nt, Homo sapiens
ggaaucguugagaguauug

SEQ ID NO: 13321 - RNA, 19 nt, Homo sapiens
gagaaagucuguuuaauug

SEQ ID NO: 13322 - RNA, 19 nt, Homo sapiens
gaacaaugguguccaaguu

SEQ ID NO: 13323 - RNA, 19 nt, Homo sapiens
ggauacaccuuugaaguua

SEQ ID NO: 13324 - RNA, 19 nt, Homo sapiens
gaaguucgcauuaagauuu

SEQ ID NO: 13325 - RNA, 19 nt, Homo sapiens
ggcacaagcugcuguuaua

SEQ ID NO: 13326 - RNA, 19 nt, Homo sapiens
ccaagaugcucaccuauga

SEQ ID NO: 13327 - RNA, 19 nt, Homo sapiens
acauagagcuagagucaua

SEQ ID NO: 13328 - RNA, 19 nt, Homo sapiens
gaagggaugugucuuugga

SEQ ID NO: 13329 - RNA, 19 nt, Homo sapiens
agacauagaacccuuauaa

SEQ ID NO: 13330 - RNA, 19 nt, Homo sapiens
gaaaccaggugacaaaguc

SEQ ID NO: 13331 - RNA, 19 nt, Homo sapiens
cuaaagaaguucgcauuaa

SEQ ID NO: 13332 - RNA, 19 nt, Homo sapiens
ccagaguaauauucacuua

SEQ ID NO: 13333 - RNA, 19 nt, Homo sapiens
guagugacuccauuuaaua

SEQ ID NO: 13334 - RNA, 19 nt, Homo sapiens
gcauauuacuggauuagau

SEQ ID NO: 13335 - RNA, 19 nt, Homo sapiens
uaaagaaguucgcauuaag

SEQ ID NO: 13336 - RNA, 19 nt, Homo sapiens
cauagaacccuuauaaaga

SEQ ID NO: 13337 - RNA, 19 nt, Homo sapiens
guacaccacuucaugaaca

SEQ ID NO: 13338 - RNA, 19 nt, Homo sapiens
guagaagauuuguugaaga

SEQ ID NO: 13339 - RNA, 19 nt, Homo sapiens
ggauauggcgcugcuguua

SEQ ID NO: 13340 - RNA, 19 nt, Homo sapiens
acacuuggauuucuauguu

SEQ ID NO: 13341 - RNA, 19 nt, Homo sapiens
ggaggucuguguugucaug

SEQ ID NO: 13342 - RNA, 19 nt, Homo sapiens
ugacugaguuccuggcaaa

SEQ ID NO: 13343 - RNA, 19 nt, Homo sapiens
gagcuagagucauauuauc

SEQ ID NO: 13344 - RNA, 19 nt, Homo sapiens
gaagauuuguugaagacau

SEQ ID NO: 13345 - RNA, 19 nt, Homo sapiens
caucugaaaucauguaucu

SEQ ID NO: 13346 - RNA, 19 nt, Homo sapiens
gauggcaccaccagauuua

SEQ ID NO: 13347 - RNA, 19 nt, Homo sapiens
gagaaggagugacuacagu

SEQ ID NO: 13348 - RNA, 19 nt, Homo sapiens
aagcaacccuucuccauug

SEQ ID NO: 13349 - RNA, 19 nt, Homo sapiens
aaaugcaucucccagagua

SEQ ID NO: 13350 - RNA, 19 nt, Homo sapiens
ucagugaggugcugucaga

SEQ ID NO: 13351 - RNA, 19 nt, Homo sapiens
uaagucagcuggugcaucu

SEQ ID NO: 13352 - RNA, 19 nt, Homo sapiens
ggaguuggccugucaguca

SEQ ID NO: 13353 - RNA, 19 nt, Homo sapiens
aaacauagagcuagaguca

SEQ ID NO: 13354 - RNA, 19 nt, Homo sapiens
agaguucccucaucugaaa

SEQ ID NO: 13355 - RNA, 19 nt, Homo sapiens
cagccaagaugcucaccua

SEQ ID NO: 13356 - RNA, 19 nt, Homo sapiens
gaaguuauugggcaucuug

SEQ ID NO: 13357 - RNA, 19 nt, Homo sapiens
gcagagaugaugucccaaa

SEQ ID NO: 13358 - RNA, 19 nt, Homo sapiens
gggauacaccuuugaaguu

SEQ ID NO: 13359 - RNA, 19 nt, Homo sapiens
aaauacagauccaagacaa

SEQ ID NO: 13360 - RNA, 19 nt, Homo sapiens
gaggugcugucagaaauga

SEQ ID NO: 13361 - RNA, 19 nt, Homo sapiens
gggaggaguuggccuguca

SEQ ID NO: 13362 - RNA, 19 nt, Homo sapiens
ccaguacauuuaccgagua

SEQ ID NO: 13363 - RNA, 19 nt, Homo sapiens
caacccagauggcaaccuu

SEQ ID NO: 13364 - RNA, 19 nt, Homo sapiens
ucauguaucugucucacaa

SEQ ID NO: 13365 - RNA, 19 nt, Homo sapiens
caacgugggauacaccuuu

SEQ ID NO: 13366 - RNA, 19 nt, Homo sapiens
guggaugaaucuucuguug

SEQ ID NO: 13367 - RNA, 19 nt, Homo sapiens
gcaaaccaguacaccacuu

SEQ ID NO: 13368 - RNA, 19 nt, Homo sapiens
ggaugaaucuucuguugcu

SEQ ID NO: 13369 - RNA, 19 nt, Homo sapiens
gaaggagugacuacaguga

SEQ ID NO: 13370 - RNA, 19 nt, Homo sapiens
cagaugaccaugugauaaa

SEQ ID NO: 13371 - RNA, 19 nt, Homo sapiens
ggaugugucuuuggagguu

SEQ ID NO: 13372 - RNA, 19 nt, Homo sapiens
gagcaccugggaauuagua

SEQ ID NO: 13373 - RNA, 19 nt, Homo sapiens
ucucacaaauacaagcaua

SEQ ID NO: 13374 - RNA, 19 nt, Homo sapiens
gaaauacagauccaagaca

SEQ ID NO: 13375 - RNA, 19 nt, Homo sapiens
gauauggcgcugcuguuaa

SEQ ID NO: 13376 - RNA, 19 nt, Homo sapiens
ugaguuaacuuggauuaca

SEQ ID NO: 13377 - RNA, 19 nt, Homo sapiens
ugaggcaacugggauugua

SEQ ID NO: 13378 - RNA, 19 nt, Homo sapiens
gcuauuugccagcauauau

SEQ ID NO: 13379 - RNA, 19 nt, Homo sapiens
caaaacagauauagcguau

SEQ ID NO: 13380 - RNA, 19 nt, Homo sapiens
gacauagaacccuuauaaa

SEQ ID NO: 13381 - RNA, 19 nt, Homo sapiens
cacaagcugcuguuauaua

SEQ ID NO: 13382 - RNA, 19 nt, Homo sapiens
gauacaccuuugaaguuau

SEQ ID NO: 13383 - RNA, 19 nt, Homo sapiens
caugaacaccaguacauuu

SEQ ID NO: 13384 - RNA, 19 nt, Homo sapiens
cuaagucccuauucacugu

SEQ ID NO: 13385 - RNA, 19 nt, Homo sapiens
gugaggugcugucagaaau

SEQ ID NO: 13386 - RNA, 19 nt, Homo sapiens
ccucaacaaagacaaauuu

SEQ ID NO: 13387 - RNA, 19 nt, Homo sapiens
uuacauaacuuggugaaac

SEQ ID NO: 13388 - RNA, 19 nt, Homo sapiens
gaugcauauuacuggauua

SEQ ID NO: 13389 - RNA, 19 nt, Homo sapiens
guaaggcuauaauuguauc

SEQ ID NO: 13390 - RNA, 19 nt, Homo sapiens
gcaccugggaauuaguaua

SEQ ID NO: 13391 - RNA, 19 nt, Homo sapiens
gucuauguuugcagaaaua

SEQ ID NO: 13392 - RNA, 19 nt, Homo sapiens
cuaccaaacccaucaguga

SEQ ID NO: 13393 - RNA, 19 nt, Homo sapiens
aaacauacacuuggauuuc

SEQ ID NO: 13394 - RNA, 19 nt, Homo sapiens
gaagacauagaacccuuau

SEQ ID NO: 13395 - RNA, 19 nt, Homo sapiens
acaagcugcuguuauauac

SEQ ID NO: 13396 - RNA, 19 nt, Homo sapiens
caccugggaauuaguauaa

SEQ ID NO: 13397 - RNA, 19 nt, Homo sapiens
caaauacaagcauaaguag

SEQ ID NO: 13398 - RNA, 19 nt, Homo sapiens
cagcgugguuguaggaguu

SEQ ID NO: 13399 - RNA, 19 nt, Homo sapiens
caucaugggcuguaaguca

SEQ ID NO: 13400 - RNA, 19 nt, Homo sapiens
auauggcgcugcuguuaaa

SEQ ID NO: 13401 - RNA, 19 nt, Homo sapiens
gaguuaacuuggauuacau

SEQ ID NO: 13402 - RNA, 19 nt, Homo sapiens
aagcugcuguuauauacaa

SEQ ID NO: 13403 - RNA, 19 nt, Homo sapiens
gcuggugcaucuaggauca

SEQ ID NO: 13404 - RNA, 19 nt, Homo sapiens
acacagugguggaugaauc

SEQ ID NO: 13405 - RNA, 19 nt, Homo sapiens
gcacaagcugcuguuauau

SEQ ID NO: 13406 - RNA, 19 nt, Homo sapiens
aguagugacuccauuuaau

SEQ ID NO: 13407 - RNA, 19 nt, Homo sapiens
ugaugcauauuacuggauu

SEQ ID NO: 13408 - RNA, 19 nt, Homo sapiens
acauagaacccuuauaaag

SEQ ID NO: 13409 - RNA, 19 nt, Homo sapiens
uagaagauuuguugaagac

SEQ ID NO: 13410 - RNA, 19 nt, Homo sapiens
gacccgauguugcucuuca

SEQ ID NO: 13411 - RNA, 19 nt, Homo sapiens
caccaaagacuaaagaagu

SEQ ID NO: 13412 - RNA, 19 nt, Homo sapiens
ccacuugcgucgucuuugg

SEQ ID NO: 13413 - RNA, 19 nt, Homo sapiens
ccugagaaagucuguuuaa

SEQ ID NO: 13414 - RNA, 19 nt, Homo sapiens
guccaaguuuccagugauu

SEQ ID NO: 13415 - RNA, 19 nt, Homo sapiens
ugugagcaccugggaauua

SEQ ID NO: 13416 - RNA, 19 nt, Homo sapiens
aaagaaguucgcauuaaga

SEQ ID NO: 13417 - RNA, 19 nt, Homo sapiens
acuaaagaaguucgcauua

SEQ ID NO: 13418 - RNA, 19 nt, Homo sapiens
caggaggucuguguuguca

SEQ ID NO: 13419 - RNA, 19 nt, Homo sapiens
accaaagacuaaagaaguu

SEQ ID NO: 13420 - RNA, 19 nt, Homo sapiens
acaaugguguccaaguuuc

SEQ ID NO: 13421 - RNA, 19 nt, Homo sapiens
ggacaaagauuuccuugau

SEQ ID NO: 13422 - RNA, 19 nt, Homo sapiens
gcagcaagcaucauaauua

SEQ ID NO: 13423 - RNA, 19 nt, Homo sapiens
gaaucuaucugcaccguuu

SEQ ID NO: 13424 - RNA, 19 nt, Homo sapiens
gagcaaggcuuugagacua

SEQ ID NO: 13425 - RNA, 19 nt, Homo sapiens
acaaggaacuguuugauga

SEQ ID NO: 13426 - RNA, 19 nt, Homo sapiens
gacaaagauuuccuugaua

SEQ ID NO: 13427 - RNA, 19 nt, Homo sapiens
gcaagaguuuguuauauag

SEQ ID NO: 13428 - RNA, 19 nt, Homo sapiens
gaaaccaaaugaccaaauc

SEQ ID NO: 13429 - RNA, 19 nt, Homo sapiens
gcauugggauagauaaauu

SEQ ID NO: 13430 - RNA, 19 nt, Homo sapiens
acacaaagcagcaacauuu

SEQ ID NO: 13431 - RNA, 19 nt, Homo sapiens
gcacucaacauguaauaaa

SEQ ID NO: 13432 - RNA, 19 nt, Homo sapiens
ugaugaaaguuaugccuua

SEQ ID NO: 13433 - RNA, 19 nt, Homo sapiens
ugacaucucugcuguagug

SEQ ID NO: 13434 - RNA, 19 nt, Homo sapiens
gaaauccucugcuugacau

SEQ ID NO: 13435 - RNA, 19 nt, Homo sapiens
ccugacaauucccauauua

SEQ ID NO: 13436 - RNA, 19 nt, Homo sapiens
gaucaagaccagaaagaaa

SEQ ID NO: 13437 - RNA, 19 nt, Homo sapiens
guacaaggguaugguaaug

SEQ ID NO: 13438 - RNA, 19 nt, Homo sapiens
uauaauggcuacagaaagu

SEQ ID NO: 13439 - RNA, 19 nt, Homo sapiens
gacaacaggucccucauag

SEQ ID NO: 13440 - RNA, 19 nt, Homo sapiens
ugccaaagaugaacucaaa

SEQ ID NO: 13441 - RNA, 19 nt, Homo sapiens
gggagauccugaagagaaa

SEQ ID NO: 13442 - RNA, 19 nt, Homo sapiens
caauggagcuggagaugca

SEQ ID NO: 13443 - RNA, 19 nt, Homo sapiens
agggagagaugacacuaua

SEQ ID NO: 13444 - RNA, 19 nt, Homo sapiens
gacagaagcugccacuuuu

SEQ ID NO: 13445 - RNA, 19 nt, Homo sapiens
ugaaaguuaugccuuaugu

SEQ ID NO: 13446 - RNA, 19 nt, Homo sapiens
ggaacuguuugaugaacuu

SEQ ID NO: 13447 - RNA, 19 nt, Homo sapiens
cagcaagcaucauaauuag

SEQ ID NO: 13448 - RNA, 19 nt, Homo sapiens
agacagaagcugccacuuu

SEQ ID NO: 13449 - RNA, 19 nt, Homo sapiens
gaccagaaagaaauuauug

SEQ ID NO: 13450 - RNA, 19 nt, Homo sapiens
ggagagaugacacuauaau

SEQ ID NO: 13451 - RNA, 19 nt, Homo sapiens
acaggucccucauagcuaa

SEQ ID NO: 13452 - RNA, 19 nt, Homo sapiens
gguaaugcuuguagaaucu

SEQ ID NO: 13453 - RNA, 19 nt, Homo sapiens
gaugaaaguuaugccuuau

SEQ ID NO: 13454 - RNA, 19 nt, Homo sapiens
ccuaauugcuuccugacaa

SEQ ID NO: 13455 - RNA, 19 nt, Homo sapiens
gcaaggcuuugagacuaaa

SEQ ID NO: 13456 - RNA, 19 nt, Homo sapiens
ugucucaacuggucucuga

SEQ ID NO: 13457 - RNA, 19 nt, Homo sapiens
aaaguuaugccuuauguug

SEQ ID NO: 13458 - RNA, 19 nt, Homo sapiens
ccaaagaugaacucaaaga

SEQ ID NO: 13459 - RNA, 19 nt, Homo sapiens
ugacaagccucugacugaa

SEQ ID NO: 13460 - RNA, 19 nt, Homo sapiens
cacaagcccugccaaagau

SEQ ID NO: 13461 - RNA, 19 nt, Homo sapiens
acacaagcccugccaaaga

SEQ ID NO: 13462 - RNA, 19 nt, Homo sapiens
ugacaacaggucccucaua

SEQ ID NO: 13463 - RNA, 19 nt, Homo sapiens
aguauucucugaaaccaaa

SEQ ID NO: 13464 - RNA, 19 nt, Homo sapiens
ccacauauacaccugauag

SEQ ID NO: 13465 - RNA, 19 nt, Homo sapiens
acaagccucugacugaaug

SEQ ID NO: 13466 - RNA, 19 nt, Homo sapiens
cuugauaaguauucucuga

SEQ ID NO: 13467 - RNA, 19 nt, Homo sapiens
cauauacaccugauaguca

SEQ ID NO: 13468 - RNA, 19 nt, Homo sapiens
gcaagcaucauaauuagac

SEQ ID NO: 13469 - RNA, 19 nt, Homo sapiens
ggaaauccucugcuugaca

SEQ ID NO: 13470 - RNA, 19 nt, Homo sapiens
ccucauagcuaaucuugcu

SEQ ID NO: 13471 - RNA, 19 nt, Homo sapiens
gaacuugugcugcaugcau

SEQ ID NO: 13472 - RNA, 19 nt, Homo sapiens
caacaggucccucauagcu

SEQ ID NO: 13473 - RNA, 19 nt, Homo sapiens
caagaccagaaagaaauua

SEQ ID NO: 13474 - RNA, 19 nt, Homo sapiens
gagagaugacacuauaaug

SEQ ID NO: 13475 - RNA, 19 nt, Homo sapiens
gauaaguauucucugaaac

SEQ ID NO: 13476 - RNA, 19 nt, Homo sapiens
ggaucaagaccagaaagaa

SEQ ID NO: 13477 - RNA, 19 nt, Homo sapiens
gaaaguuaugccuuauguu

SEQ ID NO: 13478 - RNA, 19 nt, Homo sapiens
caacaggauuuucacuuug

SEQ ID NO: 13479 - RNA, 19 nt, Homo sapiens
acacuauaauggcuacaga

SEQ ID NO: 13480 - RNA, 19 nt, Homo sapiens
uauccgugcuggccacuau

SEQ ID NO: 13481 - RNA, 19 nt, Homo sapiens
ggaugcauugggauagaua

SEQ ID NO: 13482 - RNA, 19 nt, Homo sapiens
ccauguggaugcucauuac

SEQ ID NO: 13483 - RNA, 19 nt, Homo sapiens
caaggaacuguuugaugaa

SEQ ID NO: 13484 - RNA, 19 nt, Homo sapiens
guuaugccuuauguugaua

SEQ ID NO: 13485 - RNA, 19 nt, Homo sapiens
gcucuacccagaauucaau

SEQ ID NO: 13486 - RNA, 19 nt, Homo sapiens
uggaagagcugaaaacaca

SEQ ID NO: 13487 - RNA, 19 nt, Homo sapiens
ugggaaauccucugcuuga

SEQ ID NO: 13488 - RNA, 19 nt, Homo sapiens
cuaucugcaccguuuauua

SEQ ID NO: 13489 - RNA, 19 nt, Homo sapiens
acaacaggauuuucacuuu

SEQ ID NO: 13490 - RNA, 19 nt, Homo sapiens
cugacaagccucugacuga

SEQ ID NO: 13491 - RNA, 19 nt, Homo sapiens
ucaagaccagaaagaaauu

SEQ ID NO: 13492 - RNA, 19 nt, Homo sapiens
uaucugcaccguuuauuag

SEQ ID NO: 13493 - RNA, 19 nt, Homo sapiens
cgaagccaaugacgucagu

SEQ ID NO: 13494 - RNA, 19 nt, Homo sapiens
cuauacacacacauacaua

SEQ ID NO: 13495 - RNA, 19 nt, Homo sapiens
cggacuggcugcaccuuuc

SEQ ID NO: 13496 - RNA, 19 nt, Homo sapiens
cagcgaaucgugaucuuca

SEQ ID NO: 13497 - RNA, 19 nt, Homo sapiens
ucaaagaggcagcgaaucg

SEQ ID NO: 13498 - RNA, 19 nt, Homo sapiens
cagagucaguauuaaaggu

SEQ ID NO: 13499 - RNA, 19 nt, Homo sapiens
ggcugcaccuuuccugaga

SEQ ID NO: 13500 - RNA, 19 nt, Homo sapiens
agcaaggcuuugagacuaa

SEQ ID NO: 13501 - RNA, 19 nt, Homo sapiens
aaugggaaauccucugcuu

SEQ ID NO: 13502 - RNA, 19 nt, Homo sapiens
guaugguaaugcuuguaga

SEQ ID NO: 13503 - RNA, 19 nt, Homo sapiens
gggagagaugacacuauaa

SEQ ID NO: 13504 - RNA, 19 nt, Homo sapiens
agacacaagcccugccaaa

SEQ ID NO: 13505 - RNA, 19 nt, Homo sapiens
gacuaaagacauuaaagag

SEQ ID NO: 13506 - RNA, 19 nt, Homo sapiens
cuagagagcaaggcuuuga

SEQ ID NO: 13507 - RNA, 19 nt, Homo sapiens
uaaucuugcugcugccaau

SEQ ID NO: 13508 - RNA, 19 nt, Homo sapiens
gugcacucaacauguaaua

SEQ ID NO: 13509 - RNA, 19 nt, Homo sapiens
auauacaccugauagucaa

SEQ ID NO: 13510 - RNA, 19 nt, Homo sapiens
gccacuuaaaugccaauua

SEQ ID NO: 13511 - RNA, 19 nt, Homo sapiens
gagcuggagaugcauuugu

SEQ ID NO: 13512 - RNA, 19 nt, Homo sapiens
agagaugacacuauaaugg

SEQ ID NO: 13513 - RNA, 19 nt, Homo sapiens
caaagaugaacucaaagag

SEQ ID NO: 13514 - RNA, 19 nt, Homo sapiens
gagacuaaagacauuaaag

SEQ ID NO: 13515 - RNA, 19 nt, Homo sapiens
uacaccugauagucaaaua

SEQ ID NO: 13516 - RNA, 19 nt, Homo sapiens
ugguaaugcuuguagaauc

SEQ ID NO: 13517 - RNA, 19 nt, Homo sapiens
ugaagacaaacacaaggaa

SEQ ID NO: 13518 - RNA, 19 nt, Homo sapiens
caagggagagaugacacua

SEQ ID NO: 13519 - RNA, 19 nt, Homo sapiens
cacaaggaacuguuugaug

SEQ ID NO: 13520 - RNA, 19 nt, Homo sapiens
cauuaaagagauagccaaa

SEQ ID NO: 13521 - RNA, 19 nt, Homo sapiens
ggacaaagauuuccuugau

SEQ ID NO: 13522 - RNA, 19 nt, Homo sapiens
gcagcaagcaucauaauua

SEQ ID NO: 13523 - RNA, 19 nt, Homo sapiens
gaaucuaucugcaccguuu

SEQ ID NO: 13524 - RNA, 19 nt, Homo sapiens
gagcaaggcuuugagacua

SEQ ID NO: 13525 - RNA, 19 nt, Homo sapiens
acaaggaacuguuugauga

SEQ ID NO: 13526 - RNA, 19 nt, Homo sapiens
gacaaagauuuccuugaua

SEQ ID NO: 13527 - RNA, 19 nt, Homo sapiens
gcaagaguuuguuauauag

SEQ ID NO: 13528 - RNA, 19 nt, Homo sapiens
gaaaccaaaugaccaaauc

SEQ ID NO: 13529 - RNA, 19 nt, Homo sapiens
gcauugggauagauaaauu

SEQ ID NO: 13530 - RNA, 19 nt, Homo sapiens
acacaaagcagcaacauuu

SEQ ID NO: 13531 - RNA, 19 nt, Homo sapiens
gcacucaacauguaauaaa

SEQ ID NO: 13532 - RNA, 19 nt, Homo sapiens
ugaugaaaguuaugccuua

SEQ ID NO: 13533 - RNA, 19 nt, Homo sapiens
ugacaucucugcuguagug

SEQ ID NO: 13534 - RNA, 19 nt, Homo sapiens
gaaauccucugcuugacau

SEQ ID NO: 13535 - RNA, 19 nt, Homo sapiens
ccugacaauucccauauua

SEQ ID NO: 13536 - RNA, 19 nt, Homo sapiens
gaucaagaccagaaagaaa

SEQ ID NO: 13537 - RNA, 19 nt, Homo sapiens
guacaaggguaugguaaug

SEQ ID NO: 13538 - RNA, 19 nt, Homo sapiens
uauaauggcuacagaaagu

SEQ ID NO: 13539 - RNA, 19 nt, Homo sapiens
gacaacaggucccucauag

SEQ ID NO: 13540 - RNA, 19 nt, Homo sapiens
ugccaaagaugaacucaaa

SEQ ID NO: 13541 - RNA, 19 nt, Homo sapiens
gggagauccugaagagaaa

SEQ ID NO: 13542 - RNA, 19 nt, Homo sapiens
caauggagcuggagaugca

SEQ ID NO: 13543 - RNA, 19 nt, Homo sapiens
agggagagaugacacuaua

SEQ ID NO: 13544 - RNA, 19 nt, Homo sapiens
gacagaagcugccacuuuu

SEQ ID NO: 13545 - RNA, 19 nt, Homo sapiens
ugaaaguuaugccuuaugu

SEQ ID NO: 13546 - RNA, 19 nt, Homo sapiens
ggaacuguuugaugaacuu

SEQ ID NO: 13547 - RNA, 19 nt, Homo sapiens
cagcaagcaucauaauuag

SEQ ID NO: 13548 - RNA, 19 nt, Homo sapiens
agacagaagcugccacuuu

SEQ ID NO: 13549 - RNA, 19 nt, Homo sapiens
gaccagaaagaaauuauug

SEQ ID NO: 13550 - RNA, 19 nt, Homo sapiens
ggagagaugacacuauaau

SEQ ID NO: 13551 - RNA, 19 nt, Homo sapiens
acaggucccucauagcuaa

SEQ ID NO: 13552 - RNA, 19 nt, Homo sapiens
gguaaugcuuguagaaucu

SEQ ID NO: 13553 - RNA, 19 nt, Homo sapiens
gaugaaaguuaugccuuau

SEQ ID NO: 13554 - RNA, 19 nt, Homo sapiens
ccuaauugcuuccugacaa

SEQ ID NO: 13555 - RNA, 19 nt, Homo sapiens
gcaaggcuuugagacuaaa

SEQ ID NO: 13556 - RNA, 19 nt, Homo sapiens
ugucucaacuggucucuga

SEQ ID NO: 13557 - RNA, 19 nt, Homo sapiens
aaaguuaugccuuauguug

SEQ ID NO: 13558 - RNA, 19 nt, Homo sapiens
ccaaagaugaacucaaaga

SEQ ID NO: 13559 - RNA, 19 nt, Homo sapiens
ugacaagccucugacugaa

SEQ ID NO: 13560 - RNA, 19 nt, Homo sapiens
cacaagcccugccaaagau

SEQ ID NO: 13561 - RNA, 19 nt, Homo sapiens
acacaagcccugccaaaga

SEQ ID NO: 13562 - RNA, 19 nt, Homo sapiens
ugacaacaggucccucaua

SEQ ID NO: 13563 - RNA, 19 nt, Homo sapiens
aguauucucugaaaccaaa

SEQ ID NO: 13564 - RNA, 19 nt, Homo sapiens
ccacauauacaccugauag

SEQ ID NO: 13565 - RNA, 19 nt, Homo sapiens
acaagccucugacugaaug

SEQ ID NO: 13566 - RNA, 19 nt, Homo sapiens
cuugauaaguauucucuga

SEQ ID NO: 13567 - RNA, 19 nt, Homo sapiens
cauauacaccugauaguca

SEQ ID NO: 13568 - RNA, 19 nt, Homo sapiens
gcaagcaucauaauuagac

SEQ ID NO: 13569 - RNA, 19 nt, Homo sapiens
ggaaauccucugcuugaca

SEQ ID NO: 13570 - RNA, 19 nt, Homo sapiens
ccucauagcuaaucuugcu

SEQ ID NO: 13571 - RNA, 19 nt, Homo sapiens
gaacuugugcugcaugcau

SEQ ID NO: 13572 - RNA, 19 nt, Homo sapiens
caacaggucccucauagcu

SEQ ID NO: 13573 - RNA, 19 nt, Homo sapiens
caagaccagaaagaaauua

SEQ ID NO: 13574 - RNA, 19 nt, Homo sapiens
gagagaugacacuauaaug

SEQ ID NO: 13575 - RNA, 19 nt, Homo sapiens
gauaaguauucucugaaac

SEQ ID NO: 13576 - RNA, 19 nt, Homo sapiens
ggaucaagaccagaaagaa

SEQ ID NO: 13577 - RNA, 19 nt, Homo sapiens
gaaaguuaugccuuauguu

SEQ ID NO: 13578 - RNA, 19 nt, Homo sapiens
caacaggauuuucacuuug

SEQ ID NO: 13579 - RNA, 19 nt, Homo sapiens
acacuauaauggcuacaga

SEQ ID NO: 13580 - RNA, 19 nt, Homo sapiens
uauccgugcuggccacuau

SEQ ID NO: 13581 - RNA, 19 nt, Homo sapiens
ggaugcauugggauagaua

SEQ ID NO: 13582 - RNA, 19 nt, Homo sapiens
ccauguggaugcucauuac

SEQ ID NO: 13583 - RNA, 19 nt, Homo sapiens
caaggaacuguuugaugaa

SEQ ID NO: 13584 - RNA, 19 nt, Homo sapiens
guuaugccuuauguugaua

SEQ ID NO: 13585 - RNA, 19 nt, Homo sapiens
gcucuacccagaauucaau

SEQ ID NO: 13586 - RNA, 19 nt, Homo sapiens
uggaagagcugaaaacaca

SEQ ID NO: 13587 - RNA, 19 nt, Homo sapiens
ugggaaauccucugcuuga

SEQ ID NO: 13588 - RNA, 19 nt, Homo sapiens
cuaucugcaccguuuauua

SEQ ID NO: 13589 - RNA, 19 nt, Homo sapiens
acaacaggauuuucacuuu

SEQ ID NO: 13590 - RNA, 19 nt, Homo sapiens
cugacaagccucugacuga

SEQ ID NO: 13591 - RNA, 19 nt, Homo sapiens
ucaagaccagaaagaaauu

SEQ ID NO: 13592 - RNA, 19 nt, Homo sapiens
uaucugcaccguuuauuag

SEQ ID NO: 13593 - RNA, 19 nt, Homo sapiens
cuauacacacacauacaua

SEQ ID NO: 13594 - RNA, 19 nt, Homo sapiens
cggacuggcugcaccuuuc

SEQ ID NO: 13595 - RNA, 19 nt, Homo sapiens
cagcgaaucgugaucuuca

SEQ ID NO: 13596 - RNA, 19 nt, Homo sapiens
ucaaagaggcagcgaaucg

SEQ ID NO: 13597 - RNA, 19 nt, Homo sapiens
uggcagaggugggcuguag

SEQ ID NO: 13598 - RNA, 19 nt, Homo sapiens
cagagucaguauuaaaggu

SEQ ID NO: 13599 - RNA, 19 nt, Homo sapiens
ggcugcaccuuuccugaga

SEQ ID NO: 13600 - RNA, 19 nt, Homo sapiens
aaugggaaauccucugcuu

SEQ ID NO: 13601 - RNA, 19 nt, Homo sapiens
agcaaggcuuugagacuaa

SEQ ID NO: 13602 - RNA, 19 nt, Homo sapiens
guaugguaaugcuuguaga

SEQ ID NO: 13603 - RNA, 19 nt, Homo sapiens
gggagagaugacacuauaa

SEQ ID NO: 13604 - RNA, 19 nt, Homo sapiens
agacacaagcccugccaaa

SEQ ID NO: 13605 - RNA, 19 nt, Homo sapiens
gacuaaagacauuaaagag

SEQ ID NO: 13606 - RNA, 19 nt, Homo sapiens
cuagagagcaaggcuuuga

SEQ ID NO: 13607 - RNA, 19 nt, Homo sapiens
uaaucuugcugcugccaau

SEQ ID NO: 13608 - RNA, 19 nt, Homo sapiens
gugcacucaacauguaaua

SEQ ID NO: 13609 - RNA, 19 nt, Homo sapiens
auauacaccugauagucaa

SEQ ID NO: 13610 - RNA, 19 nt, Homo sapiens
gccacuuaaaugccaauua

SEQ ID NO: 13611 - RNA, 19 nt, Homo sapiens
gagcuggagaugcauuugu

SEQ ID NO: 13612 - RNA, 19 nt, Homo sapiens
agagaugacacuauaaugg

SEQ ID NO: 13613 - RNA, 19 nt, Homo sapiens
caaagaugaacucaaagag

SEQ ID NO: 13614 - RNA, 19 nt, Homo sapiens
gagacuaaagacauuaaag

SEQ ID NO: 13615 - RNA, 19 nt, Homo sapiens
uacaccugauagucaaaua

SEQ ID NO: 13616 - RNA, 19 nt, Homo sapiens
ugguaaugcuuguagaauc

SEQ ID NO: 13617 - RNA, 19 nt, Homo sapiens
cacaaggaacuguuugaug

SEQ ID NO: 13618 - RNA, 19 nt, Homo sapiens
ugaagacaaacacaaggaa

SEQ ID NO: 13619 - RNA, 19 nt, Homo sapiens
uaaguauucucugaaacca

SEQ ID NO: 13620 - RNA, 19 nt, Homo sapiens
caagggagagaugacacua

SEQ ID NO: 13621 - RNA, 19 nt, Homo sapiens
gaaagagaaagacugauua

SEQ ID NO: 13622 - RNA, 19 nt, Homo sapiens
cgaaagaaguggaauaagu

SEQ ID NO: 13623 - RNA, 19 nt, Homo sapiens
gcagaucacucucuuagca

SEQ ID NO: 13624 - RNA, 19 nt, Homo sapiens
ggacucuggugucuucuaa

SEQ ID NO: 13625 - RNA, 19 nt, Homo sapiens
gaaagaaguggaauaagug

SEQ ID NO: 13626 - RNA, 19 nt, Homo sapiens
ggcgcaagccucacuauua

SEQ ID NO: 13627 - RNA, 19 nt, Homo sapiens
gaggagaaacugagaaaug

SEQ ID NO: 13628 - RNA, 19 nt, Homo sapiens
gcgcaagccucacuauuac

SEQ ID NO: 13629 - RNA, 19 nt, Homo sapiens
ucagcgagguguaaaguug

SEQ ID NO: 13630 - RNA, 19 nt, Homo sapiens
ugaaagagaaagacugauu

SEQ ID NO: 13631 - RNA, 19 nt, Homo sapiens
ccacuuucuuuaggauuua

SEQ ID NO: 13632 - RNA, 19 nt, Homo sapiens
aggagaaacugagaaauga

SEQ ID NO: 13633 - RNA, 19 nt, Homo sapiens
gagaggagaaacugagaaa

SEQ ID NO: 13634 - RNA, 19 nt, Homo sapiens
cagaagaauccgaguguuu

SEQ ID NO: 13635 - RNA, 19 nt, Homo sapiens
auacagagguaacuaucaa

SEQ ID NO: 13636 - RNA, 19 nt, Homo sapiens
gcaaugcguguuguacaua

SEQ ID NO: 13637 - RNA, 19 nt, Homo sapiens
gcagaagaauccgaguguu

SEQ ID NO: 13638 - RNA, 19 nt, Homo sapiens
acaccgagucucuguauaa

SEQ ID NO: 13639 - RNA, 19 nt, Homo sapiens
ggaaacaccgagucucugu

SEQ ID NO: 13640 - RNA, 19 nt, Homo sapiens
caccagaucuaccaguuca

SEQ ID NO: 13641 - RNA, 19 nt, Homo sapiens
ccgagucucuguauaaucu

SEQ ID NO: 13642 - RNA, 19 nt, Homo sapiens
gcaagccucacuauuacuu

SEQ ID NO: 13643 - RNA, 19 nt, Homo sapiens
gagaaacugagaaaugaau

SEQ ID NO: 13644 - RNA, 19 nt, Homo sapiens
gaaacaccgagucucugua

SEQ ID NO: 13645 - RNA, 19 nt, Homo sapiens
guuuguugcugucaagauu

SEQ ID NO: 13646 - RNA, 19 nt, Homo sapiens
gaaugugaguguguuugug

SEQ ID NO: 13647 - RNA, 19 nt, Homo sapiens
guacauacagagguaacua

SEQ ID NO: 13648 - RNA, 19 nt, Homo sapiens
ucacagauaaggacaagga

SEQ ID NO: 13649 - RNA, 19 nt, Homo sapiens
uggaauaagugggcucuga

SEQ ID NO: 13650 - RNA, 19 nt, Homo sapiens
caugaaagagaaagacuga

SEQ ID NO: 13651 - RNA, 19 nt, Homo sapiens
gccagagcaugaacaacuu

SEQ ID NO: 13652 - RNA, 19 nt, Homo sapiens
acagagguaacuaucaaua

SEQ ID NO: 13653 - RNA, 19 nt, Homo sapiens
cccacaaacugauuucuca

SEQ ID NO: 13654 - RNA, 19 nt, Homo sapiens
ggagaaacugagaaaugaa

SEQ ID NO: 13655 - RNA, 19 nt, Homo sapiens
ucuaccaguucacagauaa

SEQ ID NO: 13656 - RNA, 19 nt, Homo sapiens
cgucggaguuucgaaagaa

SEQ ID NO: 13657 - RNA, 19 nt, Homo sapiens
ggaaugugaguguguuugu

SEQ ID NO: 13658 - RNA, 19 nt, Homo sapiens
gcccaugguacaaggaaua

SEQ ID NO: 13659 - RNA, 19 nt, Homo sapiens
guacuuggcagaucacucu

SEQ ID NO: 13660 - RNA, 19 nt, Homo sapiens
ggaugucgcgucggaguuu

SEQ ID NO: 13661 - RNA, 19 nt, Homo sapiens
ggugauaugcgaacagcaa

SEQ ID NO: 13662 - RNA, 19 nt, Homo sapiens
aaacaccgagucucuguau

SEQ ID NO: 13663 - RNA, 19 nt, Homo sapiens
gggcuuggacuucggaguu

SEQ ID NO: 13664 - RNA, 19 nt, Homo sapiens
cccacuuucuuuaggauuu

SEQ ID NO: 13665 - RNA, 19 nt, Homo sapiens
gagucucuguauaaucuau

SEQ ID NO: 13666 - RNA, 19 nt, Homo sapiens
ggaauagucgcgcaagcau

SEQ ID NO: 13667 - RNA, 19 nt, Homo sapiens
cacaccagaucuaccaguu

SEQ ID NO: 13668 - RNA, 19 nt, Homo sapiens
gauuaccuccuguguggaa

SEQ ID NO: 13669 - RNA, 19 nt, Homo sapiens
ggagaggagaaacugagaa

SEQ ID NO: 13670 - RNA, 19 nt, Homo sapiens
agaagaauccgaguguuug

SEQ ID NO: 13671 - RNA, 19 nt, Homo sapiens
cagauaaggacaaggacaa

SEQ ID NO: 13672 - RNA, 19 nt, Homo sapiens
uaaguuuguugcugucaag

SEQ ID NO: 13673 - RNA, 19 nt, Homo sapiens
cagagguaacuaucaauau

SEQ ID NO: 13674 - RNA, 19 nt, Homo sapiens
ggcuuggacuucggaguuu

SEQ ID NO: 13675 - RNA, 19 nt, Homo sapiens
gaauaagugggcucugagu

SEQ ID NO: 13676 - RNA, 19 nt, Homo sapiens
caccgagucucuguauaau

SEQ ID NO: 13677 - RNA, 19 nt, Homo sapiens
aagccucacuauuacuuga

SEQ ID NO: 13678 - RNA, 19 nt, Homo sapiens
ggcgagcucuggcuuugca

SEQ ID NO: 13679 - RNA, 19 nt, Homo sapiens
caaugcguguuguacauac

SEQ ID NO: 13680 - RNA, 19 nt, Homo sapiens
gcgucggaguuucgaaaga

SEQ ID NO: 13681 - RNA, 19 nt, Homo sapiens
gucggacucuggugucuuc

SEQ ID NO: 13682 - RNA, 19 nt, Homo sapiens
guucacagauaaggacaag

SEQ ID NO: 13683 - RNA, 19 nt, Homo sapiens
cacuauuacuugaacuuuc

SEQ ID NO: 13684 - RNA, 19 nt, Homo sapiens
gggcgcaagccucacuauu

SEQ ID NO: 13685 - RNA, 19 nt, Homo sapiens
gaaacugagaaaugaaugc

SEQ ID NO: 13686 - RNA, 19 nt, Homo sapiens
gcucugagucgugggaaga

SEQ ID NO: 13687 - RNA, 19 nt, Homo sapiens
gaagaauccgaguguuugc

SEQ ID NO: 13688 - RNA, 19 nt, Homo sapiens
agagaaagacugauuaccu

SEQ ID NO: 13689 - RNA, 19 nt, Homo sapiens
uaaggagaggagaaacuga

SEQ ID NO: 13690 - RNA, 19 nt, Homo sapiens
uggcagaucacucucuuag

SEQ ID NO: 13691 - RNA, 19 nt, Homo sapiens
aaagagaaagacugauuac

SEQ ID NO: 13692 - RNA, 19 nt, Homo sapiens
uuaaguuuguugcugucaa

SEQ ID NO: 13693 - RNA, 19 nt, Homo sapiens
aaagugcaaugcguguugu

SEQ ID NO: 13694 - RNA, 19 nt, Homo sapiens
agagggaacugcggauguc

SEQ ID NO: 13695 - RNA, 19 nt, Homo sapiens
ugcaaugcguguuguacau

SEQ ID NO: 13696 - RNA, 19 nt, Homo sapiens
cauacagagguaacuauca

SEQ ID NO: 13697 - RNA, 19 nt, Homo sapiens
gcagcugggcuuggacuuc

SEQ ID NO: 13698 - RNA, 19 nt, Homo sapiens
gcaagcagcucaacaagaa

SEQ ID NO: 13699 - RNA, 19 nt, Homo sapiens
ggaggagccuggaguguaa

SEQ ID NO: 13700 - RNA, 19 nt, Homo sapiens
gcacuggccuguucuguag

SEQ ID NO: 13701 - RNA, 19 nt, Homo sapiens
gaaaggguagguucaguaa

SEQ ID NO: 13702 - RNA, 19 nt, Homo sapiens
gguaggugcuggccucaaa

SEQ ID NO: 13703 - RNA, 19 nt, Homo sapiens
ggagucugcuugucuuaga

SEQ ID NO: 13704 - RNA, 19 nt, Homo sapiens
gaagagauacccacagagu

SEQ ID NO: 13705 - RNA, 19 nt, Homo sapiens
gaaggaaucccuggagcua

SEQ ID NO: 13706 - RNA, 19 nt, Homo sapiens
ggaaggccuugcugucaug

SEQ ID NO: 13707 - RNA, 19 nt, Homo sapiens
ugacgaggaucucccagaa

SEQ ID NO: 13708 - RNA, 19 nt, Homo sapiens
ucaugugaaucccucaaua

SEQ ID NO: 13709 - RNA, 19 nt, Homo sapiens
gaggagaacacuagacaug

SEQ ID NO: 13710 - RNA, 19 nt, Homo sapiens
ggaguguaauuaccuguca

SEQ ID NO: 13711 - RNA, 19 nt, Homo sapiens
gaagggugccuguucugaa

SEQ ID NO: 13712 - RNA, 19 nt, Homo sapiens
cagaagagaggccugauga

SEQ ID NO: 13713 - RNA, 19 nt, Homo sapiens
uaaccucacuggaaggaau

SEQ ID NO: 13714 - RNA, 19 nt, Homo sapiens
ggaguuaacuacccuacac

SEQ ID NO: 13715 - RNA, 19 nt, Homo sapiens
ucaccuuccuuaagauuug

SEQ ID NO: 13716 - RNA, 19 nt, Homo sapiens
ggaacgugcuggugaucug

SEQ ID NO: 13717 - RNA, 19 nt, Homo sapiens
agagaggccugaugacuag

SEQ ID NO: 13718 - RNA, 19 nt, Homo sapiens
aaggguagguucaguaauc

SEQ ID NO: 13719 - RNA, 19 nt, Homo sapiens
gggaggagccuggagugua

SEQ ID NO: 13720 - RNA, 19 nt, Homo sapiens
cugaagagauacccacaga

SEQ ID NO: 13721 - RNA, 19 nt, Homo sapiens
gggaggcccaugugacuaa

SEQ ID NO: 13722 - RNA, 19 nt, Homo sapiens
gacgagggagugucuguaa

SEQ ID NO: 13723 - RNA, 19 nt, Homo sapiens
gagaggagaacacuagaca

SEQ ID NO: 13724 - RNA, 19 nt, Homo sapiens
ggagggaccaggugucuag

SEQ ID NO: 13725 - RNA, 19 nt, Homo sapiens
acgaggaucucccagaaga

SEQ ID NO: 13726 - RNA, 19 nt, Homo sapiens
cagcauccuuaccuacauu

SEQ ID NO: 13727 - RNA, 19 nt, Homo sapiens
gaagagaggccugaugacu

SEQ ID NO: 13728 - RNA, 19 nt, Homo sapiens
ccaagucgcuggcccucau

SEQ ID NO: 13729 - RNA, 19 nt, Homo sapiens
gaugccaccuucugcuuca

SEQ ID NO: 13730 - RNA, 19 nt, Homo sapiens
gggaaggccuugcugucau

SEQ ID NO: 13731 - RNA, 19 nt, Homo sapiens
cacaagcccagcauccuua

SEQ ID NO: 13732 - RNA, 19 nt, Homo sapiens
ggagcuagcggcugcugaa

SEQ ID NO: 13733 - RNA, 19 nt, Homo sapiens
uguaaggacucaguguuga

SEQ ID NO: 13734 - RNA, 19 nt, Homo sapiens
ggacugaccccuauguuug

SEQ ID NO: 13735 - RNA, 19 nt, Homo sapiens
aggcccaugugacuaauaa

SEQ ID NO: 13736 - RNA, 19 nt, Homo sapiens
aagagaggccugaugacua

SEQ ID NO: 13737 - RNA, 19 nt, Homo sapiens
gagggagugucuguaagga

SEQ ID NO: 13738 - RNA, 19 nt, Homo sapiens
agaaaggguagguucagua

SEQ ID NO: 13739 - RNA, 19 nt, Homo sapiens
ggacgagggagugucugua

SEQ ID NO: 13740 - RNA, 19 nt, Homo sapiens
gguagguucaguaaucauu

SEQ ID NO: 13741 - RNA, 19 nt, Homo sapiens
uuaccuacauugccaucuu

SEQ ID NO: 13742 - RNA, 19 nt, Homo sapiens
guagguucaguaaucauuu

SEQ ID NO: 13743 - RNA, 19 nt, Homo sapiens
cgcgucaccuuccuuaaga

SEQ ID NO: 13744 - RNA, 19 nt, Homo sapiens
guacauggucuacuucaac

SEQ ID NO: 13745 - RNA, 19 nt, Homo sapiens
cugcuugucuuagauguug

SEQ ID NO: 13746 - RNA, 19 nt, Homo sapiens
ggucuacuucaacuucuuu

SEQ ID NO: 13747 - RNA, 19 nt, Homo sapiens
gggagcccgugaucaagug

SEQ ID NO: 13748 - RNA, 19 nt, Homo sapiens
ccacaagcccagcauccuu

SEQ ID NO: 13749 - RNA, 19 nt, Homo sapiens
ucgagaaggucaucagcau

SEQ ID NO: 13750 - RNA, 19 nt, Homo sapiens
agagauacccacagagugu

SEQ ID NO: 13751 - RNA, 19 nt, Homo sapiens
aagggugccuguucugaau

SEQ ID NO: 13752 - RNA, 19 nt, Homo sapiens
uccaagcccuucccucugu

SEQ ID NO: 13753 - RNA, 19 nt, Homo sapiens
uccuuaagauuuggaauga

SEQ ID NO: 13754 - RNA, 19 nt, Homo sapiens
ccucauccucuuccucuuu

SEQ ID NO: 13755 - RNA, 19 nt, Homo sapiens
gcugcuggauccucuccuu

SEQ ID NO: 13756 - RNA, 19 nt, Homo sapiens
cgguugaccuucugaacau

SEQ ID NO: 13757 - RNA, 19 nt, Homo sapiens
aggaugcacuggccuguuc

SEQ ID NO: 13758 - RNA, 19 nt, Homo sapiens
uagguucaguaaucauuuc

SEQ ID NO: 13759 - RNA, 19 nt, Homo sapiens
cagaaaggguagguucagu

SEQ ID NO: 13760 - RNA, 19 nt, Homo sapiens
uagggugccugcucuccuu

SEQ ID NO: 13761 - RNA, 19 nt, Homo sapiens
gagagagguugaggaugca

SEQ ID NO: 13762 - RNA, 19 nt, Homo sapiens
gggagccggaggacuauga

SEQ ID NO: 13763 - RNA, 19 nt, Homo sapiens
gcgacccgcagaaguacua

SEQ ID NO: 13764 - RNA, 19 nt, Homo sapiens
ccacaccugccucaugguu

SEQ ID NO: 13765 - RNA, 19 nt, Homo sapiens
ccaagggaggcccauguga

SEQ ID NO: 13766 - RNA, 19 nt, Homo sapiens
aggccuugcugucauguga

SEQ ID NO: 13767 - RNA, 19 nt, Homo sapiens
ggagccuggaguguaauua

SEQ ID NO: 13768 - RNA, 19 nt, Homo sapiens
ucaguccaguccucacaug

SEQ ID NO: 13769 - RNA, 19 nt, Homo sapiens
uacuucaacuucuuugugu

SEQ ID NO: 13770 - RNA, 19 nt, Homo sapiens
cuccaggacuugcuuccaa

SEQ ID NO: 13771 - RNA, 19 nt, Homo sapiens
gaggcuggcaggugaggaa

SEQ ID NO: 13772 - RNA, 19 nt, Homo sapiens
gcucaucgcccuggucucu

SEQ ID NO: 13773 - RNA, 19 nt, Homo sapiens
gcaggugaggaaggguuua

SEQ ID NO: 13774 - RNA, 19 nt, Homo sapiens
ccagcauccuuaccuacau

SEQ ID NO: 13775 - RNA, 19 nt, Homo sapiens
ggaggcccaugugacuaau

SEQ ID NO: 13776 - RNA, 19 nt, Homo sapiens
ucaacugcaucacccucuu

SEQ ID NO: 13777 - RNA, 19 nt, Homo sapiens
cuacuucaacuucuuugug

SEQ ID NO: 13778 - RNA, 19 nt, Homo sapiens
caagugcgaguucgagaag

SEQ ID NO: 13779 - RNA, 19 nt, Homo sapiens
ccaagcccuucccucuguu

SEQ ID NO: 13780 - RNA, 19 nt, Homo sapiens
ggccgucgguugaccuucu

SEQ ID NO: 13781 - RNA, 19 nt, Homo sapiens
cacggcaacucggccauga

SEQ ID NO: 13782 - RNA, 19 nt, Homo sapiens
ggauggaaggagagagguu

SEQ ID NO: 13783 - RNA, 19 nt, Homo sapiens
gagucugcuugucuuagau

SEQ ID NO: 13784 - RNA, 19 nt, Homo sapiens
gccauccucaucaacauug

SEQ ID NO: 13785 - RNA, 19 nt, Homo sapiens
uaccuacauugccaucuuc

SEQ ID NO: 13786 - RNA, 19 nt, Homo sapiens
caacugcaucacccucuuc

SEQ ID NO: 13787 - RNA, 19 nt, Homo sapiens
ucaucgcccuggucucugu

SEQ ID NO: 13788 - RNA, 19 nt, Homo sapiens
cuucugaacaugaguguca

SEQ ID NO: 13789 - RNA, 19 nt, Homo sapiens
gagccuggaguguaauuac

SEQ ID NO: 13790 - RNA, 19 nt, Homo sapiens
gcagaaaggguagguucag

SEQ ID NO: 13791 - RNA, 19 nt, Homo sapiens
guacgugggagaggcagaa

SEQ ID NO: 13792 - RNA, 19 nt, Homo sapiens
ccagaagagaggccugaug

SEQ ID NO: 13793 - RNA, 19 nt, Homo sapiens
cauggucuacuucaacuuc

SEQ ID NO: 13794 - RNA, 19 nt, Homo sapiens
ucaagugcgaguucgagaa

SEQ ID NO: 13795 - RNA, 19 nt, Homo sapiens
agugucaacuccaggacuu

SEQ ID NO: 13796 - RNA, 19 nt, Homo sapiens
gccuugcugucaugugaau

SEQ ID NO: 13797 - RNA, 19 nt, Homo sapiens
gggaugccaccuucugcuu

SEQ ID NO: 13798 - RNA, 19 nt, Homo sapiens
gcgcagagcuacccaguga

SEQ ID NO: 13799 - RNA, 19 nt, Homo sapiens
gaacgucaccaacuacuuu

SEQ ID NO: 13800 - RNA, 19 nt, Homo sapiens
gcccagaggugacauuuga

SEQ ID NO: 13801 - RNA, 19 nt, Homo sapiens
uaacugccuuuccuucuaa

SEQ ID NO: 13802 - RNA, 19 nt, Homo sapiens
ccaaguggccugucucuuu

SEQ ID NO: 13803 - RNA, 19 nt, Homo sapiens
gauagggaguuguaacaga

SEQ ID NO: 13804 - RNA, 19 nt, Homo sapiens
caaguggccugucucuuug

SEQ ID NO: 13805 - RNA, 19 nt, Homo sapiens
ugacaaagcugggaucaag

SEQ ID NO: 13806 - RNA, 19 nt, Homo sapiens
gaucaaggauagggaguug

SEQ ID NO: 13807 - RNA, 19 nt, Homo sapiens
ggaguguccugaugauuca

SEQ ID NO: 13808 - RNA, 19 nt, Homo sapiens
gacgacagcugaagcagau

SEQ ID NO: 13809 - RNA, 19 nt, Homo sapiens
gggcuuggguucugaggaa

SEQ ID NO: 13810 - RNA, 19 nt, Homo sapiens
cuaacugccuuuccuucua

SEQ ID NO: 13811 - RNA, 19 nt, Homo sapiens
acgcagagcuccaucuuca

SEQ ID NO: 13812 - RNA, 19 nt, Homo sapiens
gagccugccugucgucugu

SEQ ID NO: 13813 - RNA, 19 nt, Homo sapiens
ggcagccgguuccuacuuu

SEQ ID NO: 13814 - RNA, 19 nt, Homo sapiens
cgccagaccuuccgcaaga

SEQ ID NO: 13815 - RNA, 19 nt, Homo sapiens
gguccacacugcagaagga

SEQ ID NO: 13816 - RNA, 19 nt, Homo sapiens
ugagaggccuugucuaacu

SEQ ID NO: 13817 - RNA, 19 nt, Homo sapiens
gcagagcuacccagugaga

SEQ ID NO: 13818 - RNA, 19 nt, Homo sapiens
ccaagucacuggccaucau

SEQ ID NO: 13819 - RNA, 19 nt, Homo sapiens
ucaaggauagggaguugua

SEQ ID NO: 13820 - RNA, 19 nt, Homo sapiens
uaagggaaggagaucuuua

SEQ ID NO: 13821 - RNA, 19 nt, Homo sapiens
ugaggaagcagauguuuca

SEQ ID NO: 13822 - RNA, 19 nt, Homo sapiens
gguccaugcugccaaguca

SEQ ID NO: 13823 - RNA, 19 nt, Homo sapiens
acacaccacucucccuaga

SEQ ID NO: 13824 - RNA, 19 nt, Homo sapiens
caugcugggugucuauuug

SEQ ID NO: 13825 - RNA, 19 nt, Homo sapiens
caacugcggucagccaaag

SEQ ID NO: 13826 - RNA, 19 nt, Homo sapiens
caacuacuuugugguguca

SEQ ID NO: 13827 - RNA, 19 nt, Homo sapiens
gagaggccuugucuaacug

SEQ ID NO: 13828 - RNA, 19 nt, Homo sapiens
gcaugaggcccagcaagaa

SEQ ID NO: 13829 - RNA, 19 nt, Homo sapiens
ugcagaacgucaccaacua

SEQ ID NO: 13830 - RNA, 19 nt, Homo sapiens
gcagagcuccaucuucagu

SEQ ID NO: 13831 - RNA, 19 nt, Homo sapiens
agugagaggccuugucuaa

SEQ ID NO: 13832 - RNA, 19 nt, Homo sapiens
aagcugggaucaaggauag

SEQ ID NO: 13833 - RNA, 19 nt, Homo sapiens
aaauguaagugugaggaaa

SEQ ID NO: 13834 - RNA, 19 nt, Homo sapiens
gccauugaccgcuacauug

SEQ ID NO: 13835 - RNA, 19 nt, Homo sapiens
caaaggagggcaagaacca

SEQ ID NO: 13836 - RNA, 19 nt, Homo sapiens
agaggugacauuugacuuu

SEQ ID NO: 13837 - RNA, 19 nt, Homo sapiens
gcagccgguuccuacuuug

SEQ ID NO: 13838 - RNA, 19 nt, Homo sapiens
ccacggcugccucuucauu

SEQ ID NO: 13839 - RNA, 19 nt, Homo sapiens
gcagcaagaaccuuucaag

SEQ ID NO: 13840 - RNA, 19 nt, Homo sapiens
cggccugacucccaugcua

SEQ ID NO: 13841 - RNA, 19 nt, Homo sapiens
cgagccacaucguguuuua

SEQ ID NO: 13842 - RNA, 19 nt, Homo sapiens
gaggugacauuugacuuuu

SEQ ID NO: 13843 - RNA, 19 nt, Homo sapiens
caucaacugcuucacuuuc

SEQ ID NO: 13844 - RNA, 19 nt, Homo sapiens
gaucuuuaucuuucugguu

SEQ ID NO: 13845 - RNA, 19 nt, Homo sapiens
ugaggcagcaagaaccuuu

SEQ ID NO: 13846 - RNA, 19 nt, Homo sapiens
gcaucccgcuccgguacaa

SEQ ID NO: 13847 - RNA, 19 nt, Homo sapiens
guuuuaagcuuguccaaau

SEQ ID NO: 13848 - RNA, 19 nt, Homo sapiens
gcagaacgucaccaacuac

SEQ ID NO: 13849 - RNA, 19 nt, Homo sapiens
caggucagccuccgucuca

SEQ ID NO: 13850 - RNA, 19 nt, Homo sapiens
caacugcuucacuuucuuc

SEQ ID NO: 13851 - RNA, 19 nt, Homo sapiens
aaagcugggaucaaggaua

SEQ ID NO: 13852 - RNA, 19 nt, Homo sapiens
ucacagcugccauccacuu

SEQ ID NO: 13853 - RNA, 19 nt, Homo sapiens
ucaacugcuucacuuucuu

SEQ ID NO: 13854 - RNA, 19 nt, Homo sapiens
ccguguggcucaacagcaa

SEQ ID NO: 13855 - RNA, 19 nt, Homo sapiens
gcccuccacugcagaagca

SEQ ID NO: 13856 - RNA, 19 nt, Homo sapiens
ggaguuugccccuuccuaa

SEQ ID NO: 13857 - RNA, 19 nt, Homo sapiens
ggagggagugcccaagagu

SEQ ID NO: 13858 - RNA, 19 nt, Homo sapiens
gcugggugcugucguuugc

SEQ ID NO: 13859 - RNA, 19 nt, Homo sapiens
ccacuggcaugugcugagu

SEQ ID NO: 13860 - RNA, 19 nt, Homo sapiens
acagcaaccugcagaacgu

SEQ ID NO: 13861 - RNA, 19 nt, Homo sapiens
caagucacuggccaucauu

SEQ ID NO: 13862 - RNA, 19 nt, Homo sapiens
gguguacuucaacuucuuu

SEQ ID NO: 13863 - RNA, 19 nt, Homo sapiens
uuaagcuuguccaaaugaa

SEQ ID NO: 13864 - RNA, 19 nt, Homo sapiens
gcagagggccugguuucag

SEQ ID NO: 13865 - RNA, 19 nt, Homo sapiens
acaaagcugggaucaagga

SEQ ID NO: 13866 - RNA, 19 nt, Homo sapiens
cagcaccagcagcaucuuu

SEQ ID NO: 13867 - RNA, 19 nt, Homo sapiens
ucauguaccuggccaucgu

SEQ ID NO: 13868 - RNA, 19 nt, Homo sapiens
gcucaugcugggugucuau

SEQ ID NO: 13869 - RNA, 19 nt, Homo sapiens
uaagcuuguccaaaugaaa

SEQ ID NO: 13870 - RNA, 19 nt, Homo sapiens
gggcagccgguuccuacuu

SEQ ID NO: 13871 - RNA, 19 nt, Homo sapiens
aagggaaggagaucuuuau

SEQ ID NO: 13872 - RNA, 19 nt, Homo sapiens
gcggaggcccaauggcuau

SEQ ID NO: 13873 - RNA, 19 nt, Homo sapiens
ccagugagaggccuugucu

SEQ ID NO: 13874 - RNA, 19 nt, Homo sapiens
ugccacggcugccucuuca

SEQ ID NO: 13875 - RNA, 19 nt, Homo sapiens
acaccacucucccuagacu

SEQ ID NO: 13876 - RNA, 19 nt, Homo sapiens
caugguguacuucaacuuc

SEQ ID NO: 13877 - RNA, 19 nt, Homo sapiens
gggcuaagggcaucauugc

SEQ ID NO: 13878 - RNA, 19 nt, Homo sapiens
ccagacguggagcuccuua

SEQ ID NO: 13879 - RNA, 19 nt, Homo sapiens
gcagaaggagguccaugcu

SEQ ID NO: 13880 - RNA, 19 nt, Homo sapiens
caaggauagggaguuguaa

SEQ ID NO: 13881 - RNA, 19 nt, Homo sapiens
ggaucaaggauagggaguu

SEQ ID NO: 13882 - RNA, 19 nt, Homo sapiens
cuaagggaaggagaucuuu

SEQ ID NO: 13883 - RNA, 19 nt, Homo sapiens
ucacgcagagcuccaucuu

SEQ ID NO: 13884 - RNA, 19 nt, Homo sapiens
gaaacagugugaacuauua

SEQ ID NO: 13885 - RNA, 19 nt, Homo sapiens
ccacguaucuagcuaauau

SEQ ID NO: 13886 - RNA, 19 nt, Homo sapiens
gaaagcugcugccuuguga

SEQ ID NO: 13887 - RNA, 19 nt, Homo sapiens
gaaauggacugccucucuu

SEQ ID NO: 13888 - RNA, 19 nt, Homo sapiens
guaguaggcuccaaggauu

SEQ ID NO: 13889 - RNA, 19 nt, Homo sapiens
ugagcuacaugguauauuu

SEQ ID NO: 13890 - RNA, 19 nt, Homo sapiens
aaaccagccuguccaauau

SEQ ID NO: 13891 - RNA, 19 nt, Homo sapiens
cuccaaggauugacaaaua

SEQ ID NO: 13892 - RNA, 19 nt, Homo sapiens
gccaacagcuugaauggau

SEQ ID NO: 13893 - RNA, 19 nt, Homo sapiens
uaacuuagaggcaauggaa

SEQ ID NO: 13894 - RNA, 19 nt, Homo sapiens
gauggaaccacgaaugaaa

SEQ ID NO: 13895 - RNA, 19 nt, Homo sapiens
ccaagcagaugucaagagu

SEQ ID NO: 13896 - RNA, 19 nt, Homo sapiens
ggaaauggacugccucucu

SEQ ID NO: 13897 - RNA, 19 nt, Homo sapiens
ccaagucacuggccaugau

SEQ ID NO: 13898 - RNA, 19 nt, Homo sapiens
acgcagagcuccaucuuca

SEQ ID NO: 13899 - RNA, 19 nt, Homo sapiens
gcucacaccuguaauucca

SEQ ID NO: 13900 - RNA, 19 nt, Homo sapiens
uuaaaagucugccuuguuu

SEQ ID NO: 13901 - RNA, 19 nt, Homo sapiens
gauacaaauccacaagaaa

SEQ ID NO: 13902 - RNA, 19 nt, Homo sapiens
agauacaaauccacaagaa

SEQ ID NO: 13903 - RNA, 19 nt, Homo sapiens
ccaagugggcaaugaauau

SEQ ID NO: 13904 - RNA, 19 nt, Homo sapiens
uuauaaugcuggugaucua

SEQ ID NO: 13905 - RNA, 19 nt, Homo sapiens
gaagauacaaauccacaag

SEQ ID NO: 13906 - RNA, 19 nt, Homo sapiens
ggugugggccuaugaucua

SEQ ID NO: 13907 - RNA, 19 nt, Homo sapiens
gugaaacagugugaacuau

SEQ ID NO: 13908 - RNA, 19 nt, Homo sapiens
ccaaggauugacaaauaua

SEQ ID NO: 13909 - RNA, 19 nt, Homo sapiens
gggauggaaccacgaauga

SEQ ID NO: 13910 - RNA, 19 nt, Homo sapiens
guaaagacagugccaccaa

SEQ ID NO: 13911 - RNA, 19 nt, Homo sapiens
caaauccacaagaaacaaa

SEQ ID NO: 13912 - RNA, 19 nt, Homo sapiens
cuggugaucuacauuaaga

SEQ ID NO: 13913 - RNA, 19 nt, Homo sapiens
ccaacagcuugaauggauu

SEQ ID NO: 13914 - RNA, 19 nt, Homo sapiens
ggagcuaccacguaucuag

SEQ ID NO: 13915 - RNA, 19 nt, Homo sapiens
ccaauucaguugucaaucc

SEQ ID NO: 13916 - RNA, 19 nt, Homo sapiens
ucacaugccaauucaguug

SEQ ID NO: 13917 - RNA, 19 nt, Homo sapiens
gcugcugccuugugaagug

SEQ ID NO: 13918 - RNA, 19 nt, Homo sapiens
ugaaacagugugaacuauu

SEQ ID NO: 13919 - RNA, 19 nt, Homo sapiens
uccaaggauugacaaauau

SEQ ID NO: 13920 - RNA, 19 nt, Homo sapiens
ggacacggcugguuuucau

SEQ ID NO: 13921 - RNA, 19 nt, Homo sapiens
ccagccagcucaggguaaa

SEQ ID NO: 13922 - RNA, 19 nt, Homo sapiens
acagaacccugggauggaa

SEQ ID NO: 13923 - RNA, 19 nt, Homo sapiens
aaaauuaucuccagguauc

SEQ ID NO: 13924 - RNA, 19 nt, Homo sapiens
gagacuuccgcuacacuuu

SEQ ID NO: 13925 - RNA, 19 nt, Homo sapiens
gcaucggauugacuccauu

SEQ ID NO: 13926 - RNA, 19 nt, Homo sapiens
aaaaccagccuguccaaua

SEQ ID NO: 13927 - RNA, 19 nt, Homo sapiens
guauacuuguugccaggaa

SEQ ID NO: 13928 - RNA, 19 nt, Homo sapiens
uagcuacaccucacaagga

SEQ ID NO: 13929 - RNA, 19 nt, Homo sapiens
gcuacaugguauauuucaa

SEQ ID NO: 13930 - RNA, 19 nt, Homo sapiens
cuugugaagugucucuuug

SEQ ID NO: 13931 - RNA, 19 nt, Homo sapiens
ccguggcagucgacagaua

SEQ ID NO: 13932 - RNA, 19 nt, Homo sapiens
ggauggaaccacgaaugaa

SEQ ID NO: 13933 - RNA, 19 nt, Homo sapiens
ugugaaacagugugaacua

SEQ ID NO: 13934 - RNA, 19 nt, Homo sapiens
gagcuacaugguauauuuc

SEQ ID NO: 13935 - RNA, 19 nt, Homo sapiens
gaucacgaggucaggaguu

SEQ ID NO: 13936 - RNA, 19 nt, Homo sapiens
acaaaauuaucuccaggua

SEQ ID NO: 13937 - RNA, 19 nt, Homo sapiens
ccgcuacacuuuucacaaa

SEQ ID NO: 13938 - RNA, 19 nt, Homo sapiens
gauuaugccaacagcuuga

SEQ ID NO: 13939 - RNA, 19 nt, Homo sapiens
aagaggacacggcugguuu

SEQ ID NO: 13940 - RNA, 19 nt, Homo sapiens
cuucugcacugacuucuac

SEQ ID NO: 13941 - RNA, 19 nt, Homo sapiens
ugaaagcugcugccuugug

SEQ ID NO: 13942 - RNA, 19 nt, Homo sapiens
gauccaugcagccaaguca

SEQ ID NO: 13943 - RNA, 19 nt, Homo sapiens
gugucccgcucagguauaa

SEQ ID NO: 13944 - RNA, 19 nt, Homo sapiens
gcucagguauaaaaguuug

SEQ ID NO: 13945 - RNA, 19 nt, Homo sapiens
ugcagacgcccaccaacua

SEQ ID NO: 13946 - RNA, 19 nt, Homo sapiens
caagugggcaaugaauaug

SEQ ID NO: 13947 - RNA, 19 nt, Homo sapiens
caagucacuggccaugauu

SEQ ID NO: 13948 - RNA, 19 nt, Homo sapiens
caccaacaacugcacagaa

SEQ ID NO: 13949 - RNA, 19 nt, Homo sapiens
caaugggugccgccucuug

SEQ ID NO: 13950 - RNA, 19 nt, Homo sapiens
cuacaccucacaaggaaau

SEQ ID NO: 13951 - RNA, 19 nt, Homo sapiens
guggaacaguaaagacagu

SEQ ID NO: 13952 - RNA, 19 nt, Homo sapiens
gcagacgcccaccaacuac

SEQ ID NO: 13953 - RNA, 19 nt, Homo sapiens
auacaaauccacaagaaac

SEQ ID NO: 13954 - RNA, 19 nt, Homo sapiens
ucugucacaugccaauuca

SEQ ID NO: 13955 - RNA, 19 nt, Homo sapiens
gagcacuucccuggagcua

SEQ ID NO: 13956 - RNA, 19 nt, Homo sapiens
uaccacguaucuagcuaau

SEQ ID NO: 13957 - RNA, 19 nt, Homo sapiens
ccaugcugcuggagacaca

SEQ ID NO: 13958 - RNA, 19 nt, Homo sapiens
ggcaucggauugacuccau

SEQ ID NO: 13959 - RNA, 19 nt, Homo sapiens
caauuucuuuggguguguu

SEQ ID NO: 13960 - RNA, 19 nt, Homo sapiens
ggauucuaacagacucuuu

SEQ ID NO: 13961 - RNA, 19 nt, Homo sapiens
cccuggagcuaccacguau

SEQ ID NO: 13962 - RNA, 19 nt, Homo sapiens
ugcaugcuguuaacugugu

SEQ ID NO: 13963 - RNA, 19 nt, Homo sapiens
ugugcaugcuguuaacugu

SEQ ID NO: 13964 - RNA, 19 nt, Homo sapiens
uaaugcuggugaucuacau

SEQ ID NO: 13965 - RNA, 19 nt, Homo sapiens
ucacgcagagcuccaucuu

SEQ ID NO: 13966 - RNA, 19 nt, Homo sapiens
guuaacugugucacucuuu

SEQ ID NO: 13967 - RNA, 19 nt, Homo sapiens
ggguggaacaguaaagaca

SEQ ID NO: 13968 - RNA, 19 nt, Homo sapiens
ccucuggguccuugccuuu

SEQ ID NO: 13969 - RNA, 19 nt, Homo sapiens
gaacuuaucuaacuccaaa

SEQ ID NO: 13970 - RNA, 19 nt, Homo sapiens
gaagaauucugaguaguua

SEQ ID NO: 13971 - RNA, 19 nt, Homo sapiens
gcagaaagauugcauaguc

SEQ ID NO: 13972 - RNA, 19 nt, Homo sapiens
ggacaacguauuauugaua

SEQ ID NO: 13973 - RNA, 19 nt, Homo sapiens
ggacuuaaacugcugaauu

SEQ ID NO: 13974 - RNA, 19 nt, Homo sapiens
gagaauggacuacauggua

SEQ ID NO: 13975 - RNA, 19 nt, Homo sapiens
gagaaggguuuccaagaga

SEQ ID NO: 13976 - RNA, 19 nt, Homo sapiens
gaugaacccuaucgucuau

SEQ ID NO: 13977 - RNA, 19 nt, Homo sapiens
ggagaaggguuuccaagag

SEQ ID NO: 13978 - RNA, 19 nt, Homo sapiens
gacuuaaacugcugaauuc

SEQ ID NO: 13979 - RNA, 19 nt, Homo sapiens
ggaagugacccaccuguga

SEQ ID NO: 13980 - RNA, 19 nt, Homo sapiens
cagcagcacuuucagauuc

SEQ ID NO: 13981 - RNA, 19 nt, Homo sapiens
acacaagcauugagaagaa

SEQ ID NO: 13982 - RNA, 19 nt, Homo sapiens
caaagagacaggugcauuu

SEQ ID NO: 13983 - RNA, 19 nt, Homo sapiens
gaacagaagaaauaaacug

SEQ ID NO: 13984 - RNA, 19 nt, Homo sapiens
gaauaguucuggcuaaggu

SEQ ID NO: 13985 - RNA, 19 nt, Homo sapiens
gaauucaccuguggauguu

SEQ ID NO: 13986 - RNA, 19 nt, Homo sapiens
ggucaccacucacagaaga

SEQ ID NO: 13987 - RNA, 19 nt, Homo sapiens
gaggaugccuagaagaugu

SEQ ID NO: 13988 - RNA, 19 nt, Homo sapiens
uaaagaaguucaaggaaac

SEQ ID NO: 13989 - RNA, 19 nt, Homo sapiens
gaaugaaugaacucugaua

SEQ ID NO: 13990 - RNA, 19 nt, Homo sapiens
guucugagcucuguacuuc

SEQ ID NO: 13991 - RNA, 19 nt, Homo sapiens
guugggaacagaagaaaua

SEQ ID NO: 13992 - RNA, 19 nt, Homo sapiens
gcaagaacuuagcaggaau

SEQ ID NO: 13993 - RNA, 19 nt, Homo sapiens
ggucaugccuuuggccauu

SEQ ID NO: 13994 - RNA, 19 nt, Homo sapiens
ugaagaggguugcuuaucu

SEQ ID NO: 13995 - RNA, 19 nt, Homo sapiens
uaucgucuaugccuauaaa

SEQ ID NO: 13996 - RNA, 19 nt, Homo sapiens
cagaagaaauaaacugagu

SEQ ID NO: 13997 - RNA, 19 nt, Homo sapiens
gaggaugugcggugcauaa

SEQ ID NO: 13998 - RNA, 19 nt, Homo sapiens
gaggguugcuuaucuugau

SEQ ID NO: 13999 - RNA, 19 nt, Homo sapiens
gaacucugauacccaaucu

SEQ ID NO: 14000 - RNA, 19 nt, Homo sapiens
cagauucaguccauauaga

SEQ ID NO: 14001 - RNA, 19 nt, Homo sapiens
ugucauggcugccuuuauc

SEQ ID NO: 14002 - RNA, 19 nt, Homo sapiens
cuacuuuaauggugaggua

SEQ ID NO: 14003 - RNA, 19 nt, Homo sapiens
gaauggacuacaugguaua

SEQ ID NO: 14004 - RNA, 19 nt, Homo sapiens
caagaacuuagcaggaaua

SEQ ID NO: 14005 - RNA, 19 nt, Homo sapiens
cagaaagauugcauaguca

SEQ ID NO: 14006 - RNA, 19 nt, Homo sapiens
ugacuugccuacugcuuau

SEQ ID NO: 14007 - RNA, 19 nt, Homo sapiens
gcaucacaauccacuucua

SEQ ID NO: 14008 - RNA, 19 nt, Homo sapiens
gcaacgugcuggucaucug

SEQ ID NO: 14009 - RNA, 19 nt, Homo sapiens
gaugugcggugcauaaagg

SEQ ID NO: 14010 - RNA, 19 nt, Homo sapiens
cugaaugaaugaacucuga

SEQ ID NO: 14011 - RNA, 19 nt, Homo sapiens
cuaguugacuuacugacaa

SEQ ID NO: 14012 - RNA, 19 nt, Homo sapiens
ccugaagggugccuaguug

SEQ ID NO: 14013 - RNA, 19 nt, Homo sapiens
acaagagggucaccacuca

SEQ ID NO: 14014 - RNA, 19 nt, Homo sapiens
gcagaggcguugaggacau

SEQ ID NO: 14015 - RNA, 19 nt, Homo sapiens
uuaggaggcugccaccaaa

SEQ ID NO: 14016 - RNA, 19 nt, Homo sapiens
caucuaucuugacaucuuu

SEQ ID NO: 14017 - RNA, 19 nt, Homo sapiens
ccaucuaucuugacaucuu

SEQ ID NO: 14018 - RNA, 19 nt, Homo sapiens
agaauggacuacaugguau

SEQ ID NO: 14019 - RNA, 19 nt, Homo sapiens
ccaauuuguuuccgucaug

SEQ ID NO: 14020 - RNA, 19 nt, Homo sapiens
agaaaugucaccuuccuuu

SEQ ID NO: 14021 - RNA, 19 nt, Homo sapiens
uuacauccuugauuacuuc

SEQ ID NO: 14022 - RNA, 19 nt, Homo sapiens
caggaauaguucuggcuaa

SEQ ID NO: 14023 - RNA, 19 nt, Homo sapiens
caacugcaucaucuacuuu

SEQ ID NO: 14024 - RNA, 19 nt, Homo sapiens
ccacuccacuacucucuuc

SEQ ID NO: 14025 - RNA, 19 nt, Homo sapiens
ucaacugcaucaucuacuu

SEQ ID NO: 14026 - RNA, 19 nt, Homo sapiens
ucuggaaacuugaggaugu

SEQ ID NO: 14027 - RNA, 19 nt, Homo sapiens
gcagaccaccaccuucuau

SEQ ID NO: 14028 - RNA, 19 nt, Homo sapiens
gaagugacccaccugugau

SEQ ID NO: 14029 - RNA, 19 nt, Homo sapiens
agucugaacuuaucuaacu

SEQ ID NO: 14030 - RNA, 19 nt, Homo sapiens
ugaauucaccuguggaugu

SEQ ID NO: 14031 - RNA, 19 nt, Homo sapiens
uuaucuaacuccaaagaga

SEQ ID NO: 14032 - RNA, 19 nt, Homo sapiens
uaagcuggcagaaagauug

SEQ ID NO: 14033 - RNA, 19 nt, Homo sapiens
guaguuauccaucagagau

SEQ ID NO: 14034 - RNA, 19 nt, Homo sapiens
ggacacaagcauugagaag

SEQ ID NO: 14035 - RNA, 19 nt, Homo sapiens
ccaaagagacaggugcauu

SEQ ID NO: 14036 - RNA, 19 nt, Homo sapiens
ggucaagcuuaccgucaga

SEQ ID NO: 14037 - RNA, 19 nt, Homo sapiens
gaccaccaccuucuauuuc

SEQ ID NO: 14038 - RNA, 19 nt, Homo sapiens
uugcuaagcuggcagaaag

SEQ ID NO: 14039 - RNA, 19 nt, Homo sapiens
gcaagaugcccaacaacag

SEQ ID NO: 14040 - RNA, 19 nt, Homo sapiens
gcagcagcacuuucagauu

SEQ ID NO: 14041 - RNA, 19 nt, Homo sapiens
ugcaagaacuuagcaggaa

SEQ ID NO: 14042 - RNA, 19 nt, Homo sapiens
gguggugacucauuuccau

SEQ ID NO: 14043 - RNA, 19 nt, Homo sapiens
uuacaucauucggaacaaa

SEQ ID NO: 14044 - RNA, 19 nt, Homo sapiens
cuacaucaccauggaaauu

SEQ ID NO: 14045 - RNA, 19 nt, Homo sapiens
gcguugaggacaucuguuu

SEQ ID NO: 14046 - RNA, 19 nt, Homo sapiens
gggacaacguauuauugau

SEQ ID NO: 14047 - RNA, 19 nt, Homo sapiens
ggacuacaugguauacuuc

SEQ ID NO: 14048 - RNA, 19 nt, Homo sapiens
ugucauuccuggugggauu

SEQ ID NO: 14049 - RNA, 19 nt, Homo sapiens
caacucgugcaagaacuua

SEQ ID NO: 14050 - RNA, 19 nt, Homo sapiens
gagcagcagcacuuucaga

SEQ ID NO: 14051 - RNA, 19 nt, Homo sapiens
caucucacuuccugaaaca

SEQ ID NO: 14052 - RNA, 19 nt, Homo sapiens
gggaacagaagaaauaaac

SEQ ID NO: 14053 - RNA, 19 nt, Homo sapiens
ugcaucaucuacuuuaaug

SEQ ID NO: 14054 - RNA, 19 nt, Homo sapiens
caauuuguuuccgucauga

SEQ ID NO: 14055 - RNA, 19 nt, Homo sapiens
uggacuacaugguauacuu

SEQ ID NO: 14056 - RNA, 19 nt, Homo sapiens
agaccaccaccuucuauuu

SEQ ID NO: 14057 - RNA, 19 nt, Homo sapiens
gugaugagcccuuucuaag

SEQ ID NO: 14058 - RNA, 19 nt, Homo sapiens
acucauggcuccucuucug

SEQ ID NO: 14059 - RNA, 19 nt, Homo sapiens
ggaggaugccuagaagaug

SEQ ID NO: 14060 - RNA, 19 nt, Homo sapiens
gugccuaguugacuuacug

SEQ ID NO: 14061 - RNA, 19 nt, Homo sapiens
ccucagaguaccacagaaa

SEQ ID NO: 14062 - RNA, 19 nt, Homo sapiens
uuaccuacaucaccaugga

SEQ ID NO: 14063 - RNA, 19 nt, Homo sapiens
gacugucacugcacaugga

SEQ ID NO: 14064 - RNA, 19 nt, Homo sapiens
ggguaggaaugagcaaguu

SEQ ID NO: 14065 - RNA, 19 nt, Homo sapiens
gugugguggugacucauuu

SEQ ID NO: 14066 - RNA, 19 nt, Homo sapiens
uaguugggcugaacaugug

SEQ ID NO: 14067 - RNA, 19 nt, Homo sapiens
ucuggucccugaaugaaug

SEQ ID NO: 14068 - RNA, 19 nt, Homo sapiens
acagcauucuggaaacuug

SEQ ID NO: 14069 - RNA, 19 nt, Homo sapiens
gugggaagguggagaguua

SEQ ID NO: 14070 - RNA, 19 nt, Homo sapiens
uguauuaccuccuugcuaa

SEQ ID NO: 14071 - RNA, 19 nt, Homo sapiens
gauguucacuucugaugga

SEQ ID NO: 14072 - RNA, 19 nt, Homo sapiens
gaagauacaccggcaguug

SEQ ID NO: 14073 - RNA, 19 nt, Homo sapiens
ccaaucaggcuacuuugua

SEQ ID NO: 14074 - RNA, 19 nt, Homo sapiens
acacuguaauuucccuuua

SEQ ID NO: 14075 - RNA, 19 nt, Homo sapiens
gcacuuggccacagcagaa

SEQ ID NO: 14076 - RNA, 19 nt, Homo sapiens
agagacagcuagggcuuua

SEQ ID NO: 14077 - RNA, 19 nt, Homo sapiens
ggagagggaucaguucuac

SEQ ID NO: 14078 - RNA, 19 nt, Homo sapiens
agaaguauguggcugcuau

SEQ ID NO: 14079 - RNA, 19 nt, Homo sapiens
gaaacuagaauacagaaac

SEQ ID NO: 14080 - RNA, 19 nt, Homo sapiens
ggaguuauguaugguuuua

SEQ ID NO: 14081 - RNA, 19 nt, Homo sapiens
gaagguggagaguuaguga

SEQ ID NO: 14082 - RNA, 19 nt, Homo sapiens
gugagggacugauggagaa

SEQ ID NO: 14083 - RNA, 19 nt, Homo sapiens
cccaauggcuggaggauuc

SEQ ID NO: 14084 - RNA, 19 nt, Homo sapiens
uauauucucucgggucaaa

SEQ ID NO: 14085 - RNA, 19 nt, Homo sapiens
agcagaagcucuuguggaa

SEQ ID NO: 14086 - RNA, 19 nt, Homo sapiens
cagcuagggcuuuauauuc

SEQ ID NO: 14087 - RNA, 19 nt, Homo sapiens
gcuggaggauucccuucaa

SEQ ID NO: 14088 - RNA, 19 nt, Homo sapiens
agacagcuagggcuuuaua

SEQ ID NO: 14089 - RNA, 19 nt, Homo sapiens
gugagucccuccaacuaug

SEQ ID NO: 14090 - RNA, 19 nt, Homo sapiens
guucacuucugauggauuc

SEQ ID NO: 14091 - RNA, 19 nt, Homo sapiens
gagaaacuagaauacagaa

SEQ ID NO: 14092 - RNA, 19 nt, Homo sapiens
gagugagucccuccaacua

SEQ ID NO: 14093 - RNA, 19 nt, Homo sapiens
gaaggagagggaucaguuc

SEQ ID NO: 14094 - RNA, 19 nt, Homo sapiens
ugaaggagagggaucaguu

SEQ ID NO: 14095 - RNA, 19 nt, Homo sapiens
gagaguuagugacgacaca

SEQ ID NO: 14096 - RNA, 19 nt, Homo sapiens
aagaagacacuguaauuuc

SEQ ID NO: 14097 - RNA, 19 nt, Homo sapiens
caacuaugagaaacuagaa

SEQ ID NO: 14098 - RNA, 19 nt, Homo sapiens
ugacucaacuguauuaccu

SEQ ID NO: 14099 - RNA, 19 nt, Homo sapiens
ccuauuuccuuugucuuaa

SEQ ID NO: 14100 - RNA, 19 nt, Homo sapiens
gguccuacuuccaaaccaa

SEQ ID NO: 14101 - RNA, 19 nt, Homo sapiens
ucaacuguauuaccuccuu

SEQ ID NO: 14102 - RNA, 19 nt, Homo sapiens
ggacugauggagaaguaug

SEQ ID NO: 14103 - RNA, 19 nt, Homo sapiens
gcccuugcgucugcucuuu

SEQ ID NO: 14104 - RNA, 19 nt, Homo sapiens
acagaaaccggcuggaaga

SEQ ID NO: 14105 - RNA, 19 nt, Homo sapiens
agaagacacuguaauuucc

SEQ ID NO: 14106 - RNA, 19 nt, Homo sapiens
ugagaaacuagaauacaga

SEQ ID NO: 14107 - RNA, 19 nt, Homo sapiens
uuaccaagacugcauggaa

SEQ ID NO: 14108 - RNA, 19 nt, Homo sapiens
gagaugcccugggguacua

SEQ ID NO: 14109 - RNA, 19 nt, Homo sapiens
caaaccaaaugggaaaauu

SEQ ID NO: 14110 - RNA, 19 nt, Homo sapiens
cauccuauuuccuuugucu

SEQ ID NO: 14111 - RNA, 19 nt, Homo sapiens
uguccaaucaggcuacuuu

SEQ ID NO: 14112 - RNA, 19 nt, Homo sapiens
cuccagagcccagcaauug

SEQ ID NO: 14113 - RNA, 19 nt, Homo sapiens
acacugguccuacuuccaa

SEQ ID NO: 14114 - RNA, 19 nt, Homo sapiens
agggacugauggagaagua

SEQ ID NO: 14115 - RNA, 19 nt, Homo sapiens
acagcuagggcuuuauauu

SEQ ID NO: 14116 - RNA, 19 nt, Homo sapiens
ccaacuaugagaaacuaga

SEQ ID NO: 14117 - RNA, 19 nt, Homo sapiens
cuaccuucccugagucuuu

SEQ ID NO: 14118 - RNA, 19 nt, Homo sapiens
gcugcuaccagaagcuaaa

SEQ ID NO: 14119 - RNA, 19 nt, Homo sapiens
cuccaacuaugagaaacua

SEQ ID NO: 14120 - RNA, 19 nt, Homo sapiens
cuacgaugcuguucuugcu

SEQ ID NO: 14121 - RNA, 19 nt, Homo sapiens
gacacuguaauuucccuuu

SEQ ID NO: 14122 - RNA, 19 nt, Homo sapiens
gcuagggcuuuauauucuc

SEQ ID NO: 14123 - RNA, 19 nt, Homo sapiens
ccagagcccagcaauugug

SEQ ID NO: 14124 - RNA, 19 nt, Homo sapiens
gcuaagcauuaccaagacu

SEQ ID NO: 14125 - RNA, 19 nt, Homo sapiens
ucugauggauucuucuuuu

SEQ ID NO: 14126 - RNA, 19 nt, Homo sapiens
gaaguauguggcugcuaug

SEQ ID NO: 14127 - RNA, 19 nt, Homo sapiens
ggauucuucuuuuguguau

SEQ ID NO: 14128 - RNA, 19 nt, Homo sapiens
aaacuagaauacagaaacc

SEQ ID NO: 14129 - RNA, 19 nt, Homo sapiens
uccuauuuccuuugucuua

SEQ ID NO: 14130 - RNA, 19 nt, Homo sapiens
acaacgccaugcagcugaa

SEQ ID NO: 14131 - RNA, 19 nt, Homo sapiens
guuagugacgacacaguga

SEQ ID NO: 14132 - RNA, 19 nt, Homo sapiens
ggaggauucccuucaacag

SEQ ID NO: 14133 - RNA, 19 nt, Homo sapiens
ggccacagcagaagcucuu

SEQ ID NO: 14134 - RNA, 19 nt, Homo sapiens
ggaagguggagaguuagug

SEQ ID NO: 14135 - RNA, 19 nt, Homo sapiens
caaaagaagacacuguaau

SEQ ID NO: 14136 - RNA, 19 nt, Homo sapiens
ugccuacgaugcuguucuu

SEQ ID NO: 14137 - RNA, 19 nt, Homo sapiens
ucagggaauuuugagauaa

SEQ ID NO: 14138 - RNA, 19 nt, Homo sapiens
gauggauucuucuuuugug

SEQ ID NO: 14139 - RNA, 19 nt, Homo sapiens
cacuguaauuucccuuuag

SEQ ID NO: 14140 - RNA, 19 nt, Homo sapiens
ggggaguuauguaugguuu

SEQ ID NO: 14141 - RNA, 19 nt, Homo sapiens
cggcuuggaugcccuagac

SEQ ID NO: 14142 - RNA, 19 nt, Homo sapiens
gggaaagccccuaaguuga

SEQ ID NO: 14143 - RNA, 19 nt, Homo sapiens
cuucaacacugguccuacu

SEQ ID NO: 14144 - RNA, 19 nt, Homo sapiens
ggaaagauguuaagcauuu

SEQ ID NO: 14145 - RNA, 19 nt, Homo sapiens
caugggagcucuugaaaua

SEQ ID NO: 14146 - RNA, 19 nt, Homo sapiens
gaacaaggaugaagugaag

SEQ ID NO: 14147 - RNA, 19 nt, Homo sapiens
gaaggaacgcuaacaauuu

SEQ ID NO: 14148 - RNA, 19 nt, Homo sapiens
ugaagaagcucacaguaaa

SEQ ID NO: 14149 - RNA, 19 nt, Homo sapiens
ggaggaagguaucaacaaa

SEQ ID NO: 14150 - RNA, 19 nt, Homo sapiens
caacucaccuggccgcuaa

SEQ ID NO: 14151 - RNA, 19 nt, Homo sapiens
gauuucaucuggugugaua

SEQ ID NO: 14152 - RNA, 19 nt, Homo sapiens
gaaaguguguucaacuaau

SEQ ID NO: 14153 - RNA, 19 nt, Homo sapiens
ggagagagauucuguugca

SEQ ID NO: 14154 - RNA, 19 nt, Homo sapiens
gcaacaaacuggaacagau

SEQ ID NO: 14155 - RNA, 19 nt, Homo sapiens
ggaaggaacgcuaacaauu

SEQ ID NO: 14156 - RNA, 19 nt, Homo sapiens
ccaaaggaauuccgagaaa

SEQ ID NO: 14157 - RNA, 19 nt, Homo sapiens
caacaaaucugaaaagaga

SEQ ID NO: 14158 - RNA, 19 nt, Homo sapiens
gaagucaucgauaucuuua

SEQ ID NO: 14159 - RNA, 19 nt, Homo sapiens
ggaaacauguaugaacuga

SEQ ID NO: 14160 - RNA, 19 nt, Homo sapiens
gaacaugggagcucuugaa

SEQ ID NO: 14161 - RNA, 19 nt, Homo sapiens
gaaaacagguauuggauau

SEQ ID NO: 14162 - RNA, 19 nt, Homo sapiens
agacaccucucuacuauau

SEQ ID NO: 14163 - RNA, 19 nt, Homo sapiens
gcaaggaucccaucgaugu

SEQ ID NO: 14164 - RNA, 19 nt, Homo sapiens
ccaagagccuucaggaguu

SEQ ID NO: 14165 - RNA, 19 nt, Homo sapiens
ugaaggagcuacucaucuu

SEQ ID NO: 14166 - RNA, 19 nt, Homo sapiens
gaacaucaaggacgagcua

SEQ ID NO: 14167 - RNA, 19 nt, Homo sapiens
ugaaguaucugcugaaacu

SEQ ID NO: 14168 - RNA, 19 nt, Homo sapiens
acaccucucuacuauauaa

SEQ ID NO: 14169 - RNA, 19 nt, Homo sapiens
ggaagucaucgauaucuuu

SEQ ID NO: 14170 - RNA, 19 nt, Homo sapiens
agaaagccaugguggagua

SEQ ID NO: 14171 - RNA, 19 nt, Homo sapiens
caagagcgaugccuauuac

SEQ ID NO: 14172 - RNA, 19 nt, Homo sapiens
gaagugaaggccaugauug

SEQ ID NO: 14173 - RNA, 19 nt, Homo sapiens
aaccaaagcuucguuagaa

SEQ ID NO: 14174 - RNA, 19 nt, Homo sapiens
gagagauucuguugcauag

SEQ ID NO: 14175 - RNA, 19 nt, Homo sapiens
aaacagguauuggauauuc

SEQ ID NO: 14176 - RNA, 19 nt, Homo sapiens
gaagauggaggaaguaaag

SEQ ID NO: 14177 - RNA, 19 nt, Homo sapiens
aagaaaguguguucaacua

SEQ ID NO: 14178 - RNA, 19 nt, Homo sapiens
gaugaucuuugauguggaa

SEQ ID NO: 14179 - RNA, 19 nt, Homo sapiens
ggugaucgguagcaacaaa

SEQ ID NO: 14180 - RNA, 19 nt, Homo sapiens
aaacauguaugaacugaag

SEQ ID NO: 14181 - RNA, 19 nt, Homo sapiens
agaaaucucuuaccucaag

SEQ ID NO: 14182 - RNA, 19 nt, Homo sapiens
ggaaccaacuccuacuaca

SEQ ID NO: 14183 - RNA, 19 nt, Homo sapiens
ggcagagccuguugaaguu

SEQ ID NO: 14184 - RNA, 19 nt, Homo sapiens
guacuaaaccaccucagaa

SEQ ID NO: 14185 - RNA, 19 nt, Homo sapiens
gcugugaacuccucugcuu

SEQ ID NO: 14186 - RNA, 19 nt, Homo sapiens
acgaguacauugucuauga

SEQ ID NO: 14187 - RNA, 19 nt, Homo sapiens
ccaucgaugucaacuauga

SEQ ID NO: 14188 - RNA, 19 nt, Homo sapiens
agaacgaccugaucuggaa

SEQ ID NO: 14189 - RNA, 19 nt, Homo sapiens
uagaaugucugccuuacug

SEQ ID NO: 14190 - RNA, 19 nt, Homo sapiens
gaaccaacuccuacuacaa

SEQ ID NO: 14191 - RNA, 19 nt, Homo sapiens
ucaagagcgaugccuauua

SEQ ID NO: 14192 - RNA, 19 nt, Homo sapiens
ugaaggccaugauugagaa

SEQ ID NO: 14193 - RNA, 19 nt, Homo sapiens
caaaggaauuccgagaaau

SEQ ID NO: 14194 - RNA, 19 nt, Homo sapiens
gaagaagccgagaucauca

SEQ ID NO: 14195 - RNA, 19 nt, Homo sapiens
guucuuagcgcacaucuug

SEQ ID NO: 14196 - RNA, 19 nt, Homo sapiens
cauccaggcugcuuuguca

SEQ ID NO: 14197 - RNA, 19 nt, Homo sapiens
gcucuugaaauauguagua

SEQ ID NO: 14198 - RNA, 19 nt, Homo sapiens
gggagaaguugcccuugga

SEQ ID NO: 14199 - RNA, 19 nt, Homo sapiens
gagcaguucaugaaauuau

SEQ ID NO: 14200 - RNA, 19 nt, Homo sapiens
ccaaggaggaugccauuga

SEQ ID NO: 14201 - RNA, 19 nt, Homo sapiens
cagcaaggaucccaucgau

SEQ ID NO: 14202 - RNA, 19 nt, Homo sapiens
caacuaaugaccugaagga

SEQ ID NO: 14203 - RNA, 19 nt, Homo sapiens
acagaaacguguuaaaggu

SEQ ID NO: 14204 - RNA, 19 nt, Homo sapiens
caggcuacauguuugguaa

SEQ ID NO: 14205 - RNA, 19 nt, Homo sapiens
gaagaagcucacaguaaau

SEQ ID NO: 14206 - RNA, 19 nt, Homo sapiens
caacaaacuggaacagaug

SEQ ID NO: 14207 - RNA, 19 nt, Homo sapiens
ggaacaaggaugaagugaa

SEQ ID NO: 14208 - RNA, 19 nt, Homo sapiens
agacaaggauaguaagcuu

SEQ ID NO: 14209 - RNA, 19 nt, Homo sapiens
gcaaaggccaggauggaau

SEQ ID NO: 14210 - RNA, 19 nt, Homo sapiens
aaggaacgcuaacaauuuc

SEQ ID NO: 14211 - RNA, 19 nt, Homo sapiens
uaaaccaccucagaaagga

SEQ ID NO: 14212 - RNA, 19 nt, Homo sapiens
ccacacacagugcguauga

SEQ ID NO: 14213 - RNA, 19 nt, Homo sapiens
caaggacgagcuaaagaaa

SEQ ID NO: 14214 - RNA, 19 nt, Homo sapiens
uggaugaaguggcgaagaa

SEQ ID NO: 14215 - RNA, 19 nt, Homo sapiens
gagauucuguugcauagac

SEQ ID NO: 14216 - RNA, 19 nt, Homo sapiens
gaaguugcccuuggaaaca

SEQ ID NO: 14217 - RNA, 19 nt, Homo sapiens
ccaagagugccaacuacua

SEQ ID NO: 14218 - RNA, 19 nt, Homo sapiens
gcucaaaacugacauuaag

SEQ ID NO: 14219 - RNA, 19 nt, Homo sapiens
auaagaagauggaggaagu

SEQ ID NO: 14220 - RNA, 19 nt, Homo sapiens
uaaagaagcccugaagaag

SEQ ID NO: 14221 - RNA, 19 nt, Homo sapiens
gaagguaucaacaaaucug

SEQ ID NO: 14222 - RNA, 19 nt, Homo sapiens
gcaagggccaggucaagga

SEQ ID NO: 14223 - RNA, 19 nt, Homo sapiens
aaaguguguucaacuaaug

SEQ ID NO: 14224 - RNA, 19 nt, Homo sapiens
gauaaagaagcccugaaga

SEQ ID NO: 14225 - RNA, 19 nt, Homo sapiens
ccaaaggaaggaacgcuaa

SEQ ID NO: 14226 - RNA, 19 nt, Homo sapiens
aaauacacuuccacccuuu

SEQ ID NO: 14227 - RNA, 19 nt, Homo sapiens
caaggaggaugccauugag

SEQ ID NO: 14228 - RNA, 19 nt, Homo sapiens
caagagccuucaggaguug

SEQ ID NO: 14229 - RNA, 19 nt, Homo sapiens
uaaagaaaguguguucaac

SEQ ID NO: 14230 - RNA, 19 nt, Homo sapiens
ugggagcucuugaaauaug

SEQ ID NO: 14231 - RNA, 19 nt, Homo sapiens
ugauauugcucagguaaau

SEQ ID NO: 14232 - RNA, 19 nt, Homo sapiens
ucccaucgaugucaacuau

SEQ ID NO: 14233 - RNA, 19 nt, Homo sapiens
cauacuccauccucaguga

SEQ ID NO: 14234 - RNA, 19 nt, Homo sapiens
aagaagcccugaagaagca

SEQ ID NO: 14235 - RNA, 19 nt, Homo sapiens
auaaagaagcccugaagaa

SEQ ID NO: 14236 - RNA, 19 nt, Homo sapiens
cagaaaggauuuuacagaa

SEQ ID NO: 14237 - RNA, 19 nt, Homo sapiens
guuaagaacacucaugcaa

SEQ ID NO: 14238 - RNA, 19 nt, Homo sapiens
aagccgagaucaucaggaa

SEQ ID NO: 14239 - RNA, 19 nt, Homo sapiens
guucaggaccucaucaaga

SEQ ID NO: 14240 - RNA, 19 nt, Homo sapiens
ccauugagcaguucaugaa

SEQ ID NO: 14241 - RNA, 19 nt, Homo sapiens
caaaggccaggauggaauu

SEQ ID NO: 14242 - RNA, 19 nt, Homo sapiens
agagagauucuguugcaua

SEQ ID NO: 14243 - RNA, 19 nt, Homo sapiens
agaaaaggcuggagagaga

SEQ ID NO: 14244 - RNA, 19 nt, Homo sapiens
gcacauaguuggagagauu

SEQ ID NO: 14245 - RNA, 19 nt, Homo sapiens
gaagacaguuugcuauaaa

SEQ ID NO: 14246 - RNA, 19 nt, Homo sapiens
gaacugggacuuauauuaa

SEQ ID NO: 14247 - RNA, 19 nt, Homo sapiens
ggacaaggcuuugaaugaa

SEQ ID NO: 14248 - RNA, 19 nt, Homo sapiens
gaagacaacuggaacuaug

SEQ ID NO: 14249 - RNA, 19 nt, Homo sapiens
ggacagaacuccucagucu

SEQ ID NO: 14250 - RNA, 19 nt, Homo sapiens
gguugaagauuaccaguua

SEQ ID NO: 14251 - RNA, 19 nt, Homo sapiens
ggaauuaucucagccagaa

SEQ ID NO: 14252 - RNA, 19 nt, Homo sapiens
gcagggaaagccuaaauua

SEQ ID NO: 14253 - RNA, 19 nt, Homo sapiens
caacugaaccacuauuuaa

SEQ ID NO: 14254 - RNA, 19 nt, Homo sapiens
gagcaguucugaagugaaa

SEQ ID NO: 14255 - RNA, 19 nt, Homo sapiens
gcacacauauaaucuuaga

SEQ ID NO: 14256 - RNA, 19 nt, Homo sapiens
gcacagcuuucuuaaacaa

SEQ ID NO: 14257 - RNA, 19 nt, Homo sapiens
caccaucccuggccaaaua

SEQ ID NO: 14258 - RNA, 19 nt, Homo sapiens
caacugaauucuauccaaa

SEQ ID NO: 14259 - RNA, 19 nt, Homo sapiens
ccacagacuuugaggauga

SEQ ID NO: 14260 - RNA, 19 nt, Homo sapiens
gugcacacauauaaucuua

SEQ ID NO: 14261 - RNA, 19 nt, Homo sapiens
gcaacugaaccacuauuua

SEQ ID NO: 14262 - RNA, 19 nt, Homo sapiens
gaaauaggaacaaagcaaa

SEQ ID NO: 14263 - RNA, 19 nt, Homo sapiens
gcgcuuaccugaugaguca

SEQ ID NO: 14264 - RNA, 19 nt, Homo sapiens
gauggcuucuggaaacuua

SEQ ID NO: 14265 - RNA, 19 nt, Homo sapiens
gaaccacuauuuaagaaag

SEQ ID NO: 14266 - RNA, 19 nt, Homo sapiens
aaacaaaccuugaaaucuc

SEQ ID NO: 14267 - RNA, 19 nt, Homo sapiens
gcaagugaauggguaagaa

SEQ ID NO: 14268 - RNA, 19 nt, Homo sapiens
guacgugauugaauucauu

SEQ ID NO: 14269 - RNA, 19 nt, Homo sapiens
gagcaaacuugguaaugug

SEQ ID NO: 14270 - RNA, 19 nt, Homo sapiens
guuaaugucugugaaacua

SEQ ID NO: 14271 - RNA, 19 nt, Homo sapiens
gccaagaggugagcgauuu

SEQ ID NO: 14272 - RNA, 19 nt, Homo sapiens
ggaagucgauguccugucu

SEQ ID NO: 14273 - RNA, 19 nt, Homo sapiens
gaaggacaguacccaucua

SEQ ID NO: 14274 - RNA, 19 nt, Homo sapiens
gcaacauccuggaggcuuu

SEQ ID NO: 14275 - RNA, 19 nt, Homo sapiens
ccaauuagcaucugaacaa

SEQ ID NO: 14276 - RNA, 19 nt, Homo sapiens
cgucacgucuuaaggauuu

SEQ ID NO: 14277 - RNA, 19 nt, Homo sapiens
gacaaggcuuugaaugaaa

SEQ ID NO: 14278 - RNA, 19 nt, Homo sapiens
ccaagaauguggguugaaa

SEQ ID NO: 14279 - RNA, 19 nt, Homo sapiens
gaagugggauuuauuucag

SEQ ID NO: 14280 - RNA, 19 nt, Homo sapiens
gaagugaaccugggacuau

SEQ ID NO: 14281 - RNA, 19 nt, Homo sapiens
gggauucuccuucuaguaa

SEQ ID NO: 14282 - RNA, 19 nt, Homo sapiens
gaggauggcuucuggaaac

SEQ ID NO: 14283 - RNA, 19 nt, Homo sapiens
gcaacucugugugcacuaa

SEQ ID NO: 14284 - RNA, 19 nt, Homo sapiens
gaugagagccugacauuac

SEQ ID NO: 14285 - RNA, 19 nt, Homo sapiens
ggauuagccucaacgaugu

SEQ ID NO: 14286 - RNA, 19 nt, Homo sapiens
caauaaagcaagcaaguga

SEQ ID NO: 14287 - RNA, 19 nt, Homo sapiens
gaacuaugauccacaagcu

SEQ ID NO: 14288 - RNA, 19 nt, Homo sapiens
aagcauaucacaagcaaua

SEQ ID NO: 14289 - RNA, 19 nt, Homo sapiens
gaagugauuauuugucuug

SEQ ID NO: 14290 - RNA, 19 nt, Homo sapiens
acaaggauuucuacuaaga

SEQ ID NO: 14291 - RNA, 19 nt, Homo sapiens
gccguugguuccuaucuua

SEQ ID NO: 14292 - RNA, 19 nt, Homo sapiens
caaaugaccaggcuauguu

SEQ ID NO: 14293 - RNA, 19 nt, Homo sapiens
caucaaagggagaaucaua

SEQ ID NO: 14294 - RNA, 19 nt, Homo sapiens
gaccugaguuuucaaauuu

SEQ ID NO: 14295 - RNA, 19 nt, Homo sapiens
ggaauacagaccugaguuu

SEQ ID NO: 14296 - RNA, 19 nt, Homo sapiens
gagaucagauaaaggacuu

SEQ ID NO: 14297 - RNA, 19 nt, Homo sapiens
guggaugucuugcagauau

SEQ ID NO: 14298 - RNA, 19 nt, Homo sapiens
gcuacaaacugacauuaag

SEQ ID NO: 14299 - RNA, 19 nt, Homo sapiens
agaagaggaugaaauagug

SEQ ID NO: 14300 - RNA, 19 nt, Homo sapiens
gcacaaugcccaaagaagu

SEQ ID NO: 14301 - RNA, 19 nt, Homo sapiens
agaagacaguuugcuauaa

SEQ ID NO: 14302 - RNA, 19 nt, Homo sapiens
ccacaaugcugguacuaca

SEQ ID NO: 14303 - RNA, 19 nt, Homo sapiens
ggaagugggauuuauuuca

SEQ ID NO: 14304 - RNA, 19 nt, Homo sapiens
uugaagaacugaagaaaca

SEQ ID NO: 14305 - RNA, 19 nt, Homo sapiens
gggaauaguguucaaauca

SEQ ID NO: 14306 - RNA, 19 nt, Homo sapiens
guacaauggugucgacuac

SEQ ID NO: 14307 - RNA, 19 nt, Homo sapiens
gggaaucuuugcaaauugu

SEQ ID NO: 14308 - RNA, 19 nt, Homo sapiens
gaacagacgucggaaaccu

SEQ ID NO: 14309 - RNA, 19 nt, Homo sapiens
uugcagauauuuagaguug

SEQ ID NO: 14310 - RNA, 19 nt, Homo sapiens
cuaauaagagacaugguua

SEQ ID NO: 14311 - RNA, 19 nt, Homo sapiens
ggacaguacccaucuaucu

SEQ ID NO: 14312 - RNA, 19 nt, Homo sapiens
agaacugggacuuauauua

SEQ ID NO: 14313 - RNA, 19 nt, Homo sapiens
gaacuccucagucuacaga

SEQ ID NO: 14314 - RNA, 19 nt, Homo sapiens
cacagaaagugaugagcua

SEQ ID NO: 14315 - RNA, 19 nt, Homo sapiens
gauguccugucuuugcuuu

SEQ ID NO: 14316 - RNA, 19 nt, Homo sapiens
gaaggaagaagcccagcaa

SEQ ID NO: 14317 - RNA, 19 nt, Homo sapiens
gcgaagugauuauuugucu

SEQ ID NO: 14318 - RNA, 19 nt, Homo sapiens
ccauggcgcuuaccugaug

SEQ ID NO: 14319 - RNA, 19 nt, Homo sapiens
ggaagaagcccagcaagag

SEQ ID NO: 14320 - RNA, 19 nt, Homo sapiens
gcaugguucuccuguacaa

SEQ ID NO: 14321 - RNA, 19 nt, Homo sapiens
ggugagcgauuuaguagag

SEQ ID NO: 14322 - RNA, 19 nt, Homo sapiens
uggaaaagcuauuggauuu

SEQ ID NO: 14323 - RNA, 19 nt, Homo sapiens
ggugagaagcagaaaguaa

SEQ ID NO: 14324 - RNA, 19 nt, Homo sapiens
ugaauuagaggaauacaga

SEQ ID NO: 14325 - RNA, 19 nt, Homo sapiens
gaacagaauacugaagaau

SEQ ID NO: 14326 - RNA, 19 nt, Homo sapiens
gcagagcaauugcaaaaga

SEQ ID NO: 14327 - RNA, 19 nt, Homo sapiens
gaacaggauuagccucaac

SEQ ID NO: 14328 - RNA, 19 nt, Homo sapiens
ggaagacacuguggaacuc

SEQ ID NO: 14329 - RNA, 19 nt, Homo sapiens
ggaggaagacacuguggaa

SEQ ID NO: 14330 - RNA, 19 nt, Homo sapiens
ggaaaucuaucagagaaaa

SEQ ID NO: 14331 - RNA, 19 nt, Homo sapiens
gaaaauggaugacccuucu

SEQ ID NO: 14332 - RNA, 19 nt, Homo sapiens
ugggaaacaucuacuucua

SEQ ID NO: 14333 - RNA, 19 nt, Homo sapiens
ugaaaccagucaugagaug

SEQ ID NO: 14334 - RNA, 19 nt, Homo sapiens
cagcagaguucaucauguc

SEQ ID NO: 14335 - RNA, 19 nt, Homo sapiens
gcagcagaguucaucaugu

SEQ ID NO: 14336 - RNA, 19 nt, Homo sapiens
acaaggagcuauuuucgua

SEQ ID NO: 14337 - RNA, 19 nt, Homo sapiens
gugagaagcagaaaguaaa

SEQ ID NO: 14338 - RNA, 19 nt, Homo sapiens
aaagucacgugcccauuga

SEQ ID NO: 14339 - RNA, 19 nt, Homo sapiens
ggaagaucguggugugcaa

SEQ ID NO: 14340 - RNA, 19 nt, Homo sapiens
uggaggaagucaugaauuc

SEQ ID NO: 14341 - RNA, 19 nt, Homo sapiens
ccauuacagucaaggcuaa

SEQ ID NO: 14342 - RNA, 19 nt, Homo sapiens
cauucaaucucuaggugua

SEQ ID NO: 14343 - RNA, 19 nt, Homo sapiens
gauuuaaguuggacagagu

SEQ ID NO: 14344 - RNA, 19 nt, Homo sapiens
ggagaccgauauuuaagga

SEQ ID NO: 14345 - RNA, 19 nt, Homo sapiens
gaagaaagcggccaagacu

SEQ ID NO: 14346 - RNA, 19 nt, Homo sapiens
cagggcagcugcucuguga

SEQ ID NO: 14347 - RNA, 19 nt, Homo sapiens
ggacucaggugcccagaac

SEQ ID NO: 14348 - RNA, 19 nt, Homo sapiens
uacgggagaccgauauuua

SEQ ID NO: 14349 - RNA, 19 nt, Homo sapiens
cugguucccuuucuucuuu

SEQ ID NO: 14350 - RNA, 19 nt, Homo sapiens
ugacaucccugaggaacug

SEQ ID NO: 14351 - RNA, 19 nt, Homo sapiens
cccaaucccuauuugagaa

SEQ ID NO: 14352 - RNA, 19 nt, Homo sapiens
ccaagacucuggccaucgu

SEQ ID NO: 14353 - RNA, 19 nt, Homo sapiens
ggaacugggcagagcuuga

SEQ ID NO: 14354 - RNA, 19 nt, Homo sapiens
gagaagaaagcggccaaga

SEQ ID NO: 14355 - RNA, 19 nt, Homo sapiens
caaguacccagccaucaug

SEQ ID NO: 14356 - RNA, 19 nt, Homo sapiens
cuggcagccuucauccuua

SEQ ID NO: 14357 - RNA, 19 nt, Homo sapiens
ucggagacccggaaacuga

SEQ ID NO: 14358 - RNA, 19 nt, Homo sapiens
gagcgcuucugcgguauca

SEQ ID NO: 14359 - RNA, 19 nt, Homo sapiens
gaacugggcagagcuugag

SEQ ID NO: 14360 - RNA, 19 nt, Homo sapiens
gcgugaacccgcucaucua

SEQ ID NO: 14361 - RNA, 19 nt, Homo sapiens
gcgggcugguguucuaaga

SEQ ID NO: 14362 - RNA, 19 nt, Homo sapiens
gaccgucaccaacuauuuc

SEQ ID NO: 14363 - RNA, 19 nt, Homo sapiens
gcagaccgucaccaacuau

SEQ ID NO: 14364 - RNA, 19 nt, Homo sapiens
caggugcccagaacucuuu

SEQ ID NO: 14365 - RNA, 19 nt, Homo sapiens
ccuacgaauuggccgacua

SEQ ID NO: 14366 - RNA, 19 nt, Homo sapiens
ugcagaccgucaccaacua

SEQ ID NO: 14367 - RNA, 19 nt, Homo sapiens
gugcgccacucacucaagu

SEQ ID NO: 14368 - RNA, 19 nt, Homo sapiens
agaaagcggccaagacucu

SEQ ID NO: 14369 - RNA, 19 nt, Homo sapiens
uggcagccuucauccuuau

SEQ ID NO: 14370 - RNA, 19 nt, Homo sapiens
gggcagcugcucugugaca

SEQ ID NO: 14371 - RNA, 19 nt, Homo sapiens
acgggagaccgauauuuaa

SEQ ID NO: 14372 - RNA, 19 nt, Homo sapiens
cugccaggccuacgaauug

SEQ ID NO: 14373 - RNA, 19 nt, Homo sapiens
caucggagggcgucuucaa

SEQ ID NO: 14374 - RNA, 19 nt, Homo sapiens
uuauggccguggcagguaa

SEQ ID NO: 14375 - RNA, 19 nt, Homo sapiens
ccugaacccugaguagaca

SEQ ID NO: 14376 - RNA, 19 nt, Homo sapiens
agaccgucaccaacuauuu

SEQ ID NO: 14377 - RNA, 19 nt, Homo sapiens
caaaucggagacccggaaa

SEQ ID NO: 14378 - RNA, 19 nt, Homo sapiens
ucaaguacccagccaucau

SEQ ID NO: 14379 - RNA, 19 nt, Homo sapiens
ccaaucccuauuugagaaa

SEQ ID NO: 14380 - RNA, 19 nt, Homo sapiens
gcucccaaucccuauuuga

SEQ ID NO: 14381 - RNA, 19 nt, Homo sapiens
cuacgggagaccgauauuu

SEQ ID NO: 14382 - RNA, 19 nt, Homo sapiens
gaggaacugggcagagcuu

SEQ ID NO: 14383 - RNA, 19 nt, Homo sapiens
ggucaucguggucauguac

SEQ ID NO: 14384 - RNA, 19 nt, Homo sapiens
ucuccagccugucgcacaa

SEQ ID NO: 14385 - RNA, 19 nt, Homo sapiens
uggcucggcuacuucaaca

SEQ ID NO: 14386 - RNA, 19 nt, Homo sapiens
guacugccgugucuauaua

SEQ ID NO: 14387 - RNA, 19 nt, Homo sapiens
gcuaagacguugggcauug

SEQ ID NO: 14388 - RNA, 19 nt, Homo sapiens
gaggacacccuuagcagua

SEQ ID NO: 14389 - RNA, 19 nt, Homo sapiens
gggcggaucuucugugaca

SEQ ID NO: 14390 - RNA, 19 nt, Homo sapiens
ugaaggagauguccaacuc

SEQ ID NO: 14391 - RNA, 19 nt, Homo sapiens
uuccauagcugucaaacuu

SEQ ID NO: 14392 - RNA, 19 nt, Homo sapiens
caacauccuagucaucuug

SEQ ID NO: 14393 - RNA, 19 nt, Homo sapiens
gcaacauccuagucaucuu

SEQ ID NO: 14394 - RNA, 19 nt, Homo sapiens
gaggauccauuccaagaac

SEQ ID NO: 14395 - RNA, 19 nt, Homo sapiens
ccaagagaaccaccaagaa

SEQ ID NO: 14396 - RNA, 19 nt, Homo sapiens
ggacaccggccacaacaca

SEQ ID NO: 14397 - RNA, 19 nt, Homo sapiens
ggaguuccauagcugucaa

SEQ ID NO: 14398 - RNA, 19 nt, Homo sapiens
gccaagagaaccaccaaga

SEQ ID NO: 14399 - RNA, 19 nt, Homo sapiens
gaccugcuguugagcuuca

SEQ ID NO: 14400 - RNA, 19 nt, Homo sapiens
ccaacuacuucauugucaa

SEQ ID NO: 14401 - RNA, 19 nt, Homo sapiens
gaaaagaaagcagcuaaga

SEQ ID NO: 14402 - RNA, 19 nt, Homo sapiens
caagagaaccaccaagaac

SEQ ID NO: 14403 - RNA, 19 nt, Homo sapiens
gcauuguggucgguauguu

SEQ ID NO: 14404 - RNA, 19 nt, Homo sapiens
agaaagcagcuaagacguu

SEQ ID NO: 14405 - RNA, 19 nt, Homo sapiens
gaaccaccaagaaccuaga

SEQ ID NO: 14406 - RNA, 19 nt, Homo sapiens
ggacgcccaccaacuacuu

SEQ ID NO: 14407 - RNA, 19 nt, Homo sapiens
uuuaaguucuccagggaaa

SEQ ID NO: 14408 - RNA, 19 nt, Homo sapiens
ggagggcggacucuaagau

SEQ ID NO: 14409 - RNA, 19 nt, Homo sapiens
ccgcuuggcuccuuguucu

SEQ ID NO: 14410 - RNA, 19 nt, Homo sapiens
ucucugggcuccuucuaca

SEQ ID NO: 14411 - RNA, 19 nt, Homo sapiens
gggcggacucuaagaugaa

SEQ ID NO: 14412 - RNA, 19 nt, Homo sapiens
uauggagggcggacucuaa

SEQ ID NO: 14413 - RNA, 19 nt, Homo sapiens
aggcaggagucaugaagga

SEQ ID NO: 14414 - RNA, 19 nt, Homo sapiens
gagaaccaccaagaaccua

SEQ ID NO: 14415 - RNA, 19 nt, Homo sapiens
uggcugggcuacuucaaca

SEQ ID NO: 14416 - RNA, 19 nt, Homo sapiens
aaccagaccucgagcaacu

SEQ ID NO: 14417 - RNA, 19 nt, Homo sapiens
ccauagcugucaaacuuuu

SEQ ID NO: 14418 - RNA, 19 nt, Homo sapiens
gcccaccaacuacuucauu

SEQ ID NO: 14419 - RNA, 19 nt, Homo sapiens
gucgguauguucaucuugu

SEQ ID NO: 14420 - RNA, 19 nt, Homo sapiens
cuaagacguugggcauugu

SEQ ID NO: 14421 - RNA, 19 nt, Homo sapiens
gagggcggacucuaagaug

SEQ ID NO: 14422 - RNA, 19 nt, Homo sapiens
caucgugggcaacauccua

SEQ ID NO: 14423 - RNA, 19 nt, Homo sapiens
gauccauuccaagaacuuu

SEQ ID NO: 14424 - RNA, 19 nt, Homo sapiens
cccaccaacuacuucauug

SEQ ID NO: 14425 - RNA, 19 nt, Homo sapiens
ccaaccagaccucgagcaa

SEQ ID NO: 14426 - RNA, 19 nt, Homo sapiens
caggagucaugaaggagau

SEQ ID NO: 14427 - RNA, 19 nt, Homo sapiens
ccuagaggcaggagucaug

SEQ ID NO: 14428 - RNA, 19 nt, Homo sapiens
ucuuggcgcugcucagugu

SEQ ID NO: 14429 - RNA, 19 nt, Homo sapiens
cuccaucgaucgcuacauc

SEQ ID NO: 14430 - RNA, 19 nt, Homo sapiens
gggaaaagaaagcagcuaa

SEQ ID NO: 14431 - RNA, 19 nt, Homo sapiens
ggcggucauucuagucaug

SEQ ID NO: 14432 - RNA, 19 nt, Homo sapiens
agggcggacucuaagauga

SEQ ID NO: 14433 - RNA, 19 nt, Homo sapiens
gggcaacauccuagucauc

SEQ ID NO: 14434 - RNA, 19 nt, Homo sapiens
ugaggauccauuccaagaa

SEQ ID NO: 14435 - RNA, 19 nt, Homo sapiens
cuauauaguggccaagaga

SEQ ID NO: 14436 - RNA, 19 nt, Homo sapiens
cauguacugccgugucuau

SEQ ID NO: 14437 - RNA, 19 nt, Homo sapiens
ggucuuguccaccgucauc

SEQ ID NO: 14438 - RNA, 19 nt, Homo sapiens
cugaggauccauuccaaga

SEQ ID NO: 14439 - RNA, 19 nt, Homo sapiens
ucaccagggccaucucugu

SEQ ID NO: 14440 - RNA, 19 nt, Homo sapiens
uagaggugcucggcuacug

SEQ ID NO: 14441 - RNA, 19 nt, Homo sapiens
gcagaaagcagucuuccaa

SEQ ID NO: 14442 - RNA, 19 nt, Homo sapiens
gagcacacacucuaaguuu

SEQ ID NO: 14443 - RNA, 19 nt, Homo sapiens
caggaaagaugcagaggaa

SEQ ID NO: 14444 - RNA, 19 nt, Homo sapiens
ggauuacaguguccaaaga

SEQ ID NO: 14445 - RNA, 19 nt, Homo sapiens
gaaagcagucuuccaaaca

SEQ ID NO: 14446 - RNA, 19 nt, Homo sapiens
ugacauuuaugccggaauu

SEQ ID NO: 14447 - RNA, 19 nt, Homo sapiens
cagccacauuugacauuua

SEQ ID NO: 14448 - RNA, 19 nt, Homo sapiens
caucaaguuccaaccauua

SEQ ID NO: 14449 - RNA, 19 nt, Homo sapiens
caagacggauggcguuugu

SEQ ID NO: 14450 - RNA, 19 nt, Homo sapiens
gagggugucucacaaccaa

SEQ ID NO: 14451 - RNA, 19 nt, Homo sapiens
caagacaggaccaaucaaa

SEQ ID NO: 14452 - RNA, 19 nt, Homo sapiens
gaagagggagggugucuca

SEQ ID NO: 14453 - RNA, 19 nt, Homo sapiens
gcauuucccugcagcuaau

SEQ ID NO: 14454 - RNA, 19 nt, Homo sapiens
ggacaagacaggaccaauc

SEQ ID NO: 14455 - RNA, 19 nt, Homo sapiens
ggagcuauuucuugaugga

SEQ ID NO: 14456 - RNA, 19 nt, Homo sapiens
guuuggagcuauuucuuga

SEQ ID NO: 14457 - RNA, 19 nt, Homo sapiens
gagggagggugucucacaa

SEQ ID NO: 14458 - RNA, 19 nt, Homo sapiens
ggaaaggggaauaaucuua

SEQ ID NO: 14459 - RNA, 19 nt, Homo sapiens
ggaaagaugcagaggaaag

SEQ ID NO: 14460 - RNA, 19 nt, Homo sapiens
ugacaagaaccaucaaguu

SEQ ID NO: 14461 - RNA, 19 nt, Homo sapiens
cagaaugucuugagaaucc

SEQ ID NO: 14462 - RNA, 19 nt, Homo sapiens
aaagaccaauccuccugua

SEQ ID NO: 14463 - RNA, 19 nt, Homo sapiens
ggucuuucuucccugauuu

SEQ ID NO: 14464 - RNA, 19 nt, Homo sapiens
gacaagacaggaccaauca

SEQ ID NO: 14465 - RNA, 19 nt, Homo sapiens
ggauggcguuugugaaugg

SEQ ID NO: 14466 - RNA, 19 nt, Homo sapiens
caagagagaccuucuacag

SEQ ID NO: 14467 - RNA, 19 nt, Homo sapiens
gaucaagagagaccuucua

SEQ ID NO: 14468 - RNA, 19 nt, Homo sapiens
caagcccucugaaacaguu

SEQ ID NO: 14469 - RNA, 19 nt, Homo sapiens
caaccaaccaguucagaau

SEQ ID NO: 14470 - RNA, 19 nt, Homo sapiens
cgaaucaugugcagaaugc

SEQ ID NO: 14471 - RNA, 19 nt, Homo sapiens
gaacauuuccaaggccauu

SEQ ID NO: 14472 - RNA, 19 nt, Homo sapiens
ggaagucuaggacaggaaa

SEQ ID NO: 14473 - RNA, 19 nt, Homo sapiens
aaagcagauucucguaauu

SEQ ID NO: 14474 - RNA, 19 nt, Homo sapiens
gaagugaggggauuuuauu

SEQ ID NO: 14475 - RNA, 19 nt, Homo sapiens
agacaggaccaaucaaaga

SEQ ID NO: 14476 - RNA, 19 nt, Homo sapiens
gaaaagcagauucucguaa

SEQ ID NO: 14477 - RNA, 19 nt, Homo sapiens
gaggucugcugcuguguag

SEQ ID NO: 14478 - RNA, 19 nt, Homo sapiens
ggaggucugcugcugugua

SEQ ID NO: 14479 - RNA, 19 nt, Homo sapiens
gagagaccuucuacaggau

SEQ ID NO: 14480 - RNA, 19 nt, Homo sapiens
gcacacacucuaaguuugg

SEQ ID NO: 14481 - RNA, 19 nt, Homo sapiens
ccaucaaguuccaaccauu

SEQ ID NO: 14482 - RNA, 19 nt, Homo sapiens
ccucaagucuggccucaag

SEQ ID NO: 14483 - RNA, 19 nt, Homo sapiens
ccauuaagguccacaccau

SEQ ID NO: 14484 - RNA, 19 nt, Homo sapiens
gaccaauccuccuguacca

SEQ ID NO: 14485 - RNA, 19 nt, Homo sapiens
caaccaguucagaaugaua

SEQ ID NO: 14486 - RNA, 19 nt, Homo sapiens
gaauaagacagcgcggaaa

SEQ ID NO: 14487 - RNA, 19 nt, Homo sapiens
aaagcagucuuccaaacau

SEQ ID NO: 14488 - RNA, 19 nt, Homo sapiens
gaccaagacgcacuucuca

SEQ ID NO: 14489 - RNA, 19 nt, Homo sapiens
cggcaccggugaacauuuc

SEQ ID NO: 14490 - RNA, 19 nt, Homo sapiens
agaaagcagucuuccaaac

SEQ ID NO: 14491 - RNA, 19 nt, Homo sapiens
uaucuaaacagcugcauca

SEQ ID NO: 14492 - RNA, 19 nt, Homo sapiens
ccaucauccuggucaugua

SEQ ID NO: 14493 - RNA, 19 nt, Homo sapiens
ggugagaaguaaaagcuuu

SEQ ID NO: 14494 - RNA, 19 nt, Homo sapiens
gaaagaugcagaggaaagg

SEQ ID NO: 14495 - RNA, 19 nt, Homo sapiens
ccguggaucugccaggauu

SEQ ID NO: 14496 - RNA, 19 nt, Homo sapiens
ccaagacgcacuucucagu

SEQ ID NO: 14497 - RNA, 19 nt, Homo sapiens
ggugcuggguaacauccua

SEQ ID NO: 14498 - RNA, 19 nt, Homo sapiens
cuacugacagccacauuug

SEQ ID NO: 14499 - RNA, 19 nt, Homo sapiens
gcaucaaccccaucauaua

SEQ ID NO: 14500 - RNA, 19 nt, Homo sapiens
gacagccacauuugacauu

SEQ ID NO: 14501 - RNA, 19 nt, Homo sapiens
agacggauggcguuuguga

SEQ ID NO: 14502 - RNA, 19 nt, Homo sapiens
cagaaagcagucuuccaaa

SEQ ID NO: 14503 - RNA, 19 nt, Homo sapiens
acagccacauuugacauuu

SEQ ID NO: 14504 - RNA, 19 nt, Homo sapiens
accaaccaguucagaauga

SEQ ID NO: 14505 - RNA, 19 nt, Homo sapiens
gggucuuucuucccugauu

SEQ ID NO: 14506 - RNA, 19 nt, Homo sapiens
gaagaaagcggccaaaacg

SEQ ID NO: 14507 - RNA, 19 nt, Homo sapiens
ucucagcgcugggcuccuu

SEQ ID NO: 14508 - RNA, 19 nt, Homo sapiens
gcuauuucuugauggaagu

SEQ ID NO: 14509 - RNA, 19 nt, Homo sapiens
aaaagcagauucucguaau

SEQ ID NO: 14510 - RNA, 19 nt, Homo sapiens
aacagaauuucaugcacaa

SEQ ID NO: 14511 - RNA, 19 nt, Homo sapiens
uuucuucccugauuucaag

SEQ ID NO: 14512 - RNA, 19 nt, Homo sapiens
ggagaagaaagcggccaaa

SEQ ID NO: 14513 - RNA, 19 nt, Homo sapiens
gcacucucccuggucauau

SEQ ID NO: 14514 - RNA, 19 nt, Homo sapiens
gugaggggauuuuauuuuc

SEQ ID NO: 14515 - RNA, 19 nt, Homo sapiens
uuggagcuauuucuugaug

SEQ ID NO: 14516 - RNA, 19 nt, Homo sapiens
aaggccagcucuucuugga

SEQ ID NO: 14517 - RNA, 19 nt, Homo sapiens
gaaaggggaauaaucuuag

SEQ ID NO: 14518 - RNA, 19 nt, Homo sapiens
ggaaaagcagauucucgua

SEQ ID NO: 14519 - RNA, 19 nt, Homo sapiens
gggcuggccaggguuguuu

SEQ ID NO: 14520 - RNA, 19 nt, Homo sapiens
gcccuucuccgccaucuuc

SEQ ID NO: 14521 - RNA, 19 nt, Homo sapiens
agccacauuugacauuuau

SEQ ID NO: 14522 - RNA, 19 nt, Homo sapiens
gaggggaccugcugggaau

SEQ ID NO: 14523 - RNA, 19 nt, Homo sapiens
uucagaaugucuugagaau

SEQ ID NO: 14524 - RNA, 19 nt, Homo sapiens
gcacuacuacaucgucaac

SEQ ID NO: 14525 - RNA, 19 nt, Homo sapiens
ccuacugacagccacauuu

SEQ ID NO: 14526 - RNA, 19 nt, Homo sapiens
acucuaaguuuggagcuau

SEQ ID NO: 14527 - RNA, 19 nt, Homo sapiens
cagaauuucaugcacaauc

SEQ ID NO: 14528 - RNA, 19 nt, Homo sapiens
caccaugggaaacagaauu

SEQ ID NO: 14529 - RNA, 19 nt, Homo sapiens
ccaaccaguucagaaugau

SEQ ID NO: 14530 - RNA, 19 nt, Homo sapiens
gacaggaccaaucaaagag

SEQ ID NO: 14531 - RNA, 19 nt, Homo sapiens
gaucugccaggauuacagu

SEQ ID NO: 14532 - RNA, 19 nt, Homo sapiens
cccgugggaucaagagaga

SEQ ID NO: 14533 - RNA, 19 nt, Homo sapiens
ugagcacacacucuaaguu

SEQ ID NO: 14534 - RNA, 19 nt, Homo sapiens
cagcuaaugcuuucuuggu

SEQ ID NO: 14535 - RNA, 19 nt, Homo sapiens
ccagccaggacgaauaaga

SEQ ID NO: 14536 - RNA, 19 nt, Homo sapiens
uggcguuugugaauggaaa

SEQ ID NO: 14537 - RNA, 19 nt, Homo sapiens
aagcagucuuccaaacaug

SEQ ID NO: 14538 - RNA, 19 nt, Homo sapiens
gaacggggaggaagucuag

SEQ ID NO: 14539 - RNA, 19 nt, Homo sapiens
uccagugucuccgcagaaa

SEQ ID NO: 14540 - RNA, 19 nt, Homo sapiens
ggcacucucccuggucaua

SEQ ID NO: 14541 - RNA, 19 nt, Homo sapiens
gcacaaauccaacauguua

SEQ ID NO: 14542 - RNA, 19 nt, Homo sapiens
gcagaaagcagucuuccaa

SEQ ID NO: 14543 - RNA, 19 nt, Homo sapiens
ggaaugaucaugaaugcaa

SEQ ID NO: 14544 - RNA, 19 nt, Homo sapiens
ggauuacaguguccaaaga

SEQ ID NO: 14545 - RNA, 19 nt, Homo sapiens
gaaagcagucuuccaaaca

SEQ ID NO: 14546 - RNA, 19 nt, Homo sapiens
gaaugaucaugaaugcaaa

SEQ ID NO: 14547 - RNA, 19 nt, Homo sapiens
caagacggauggcguuugu

SEQ ID NO: 14548 - RNA, 19 nt, Homo sapiens
aacaguaacuuaaggaaug

SEQ ID NO: 14549 - RNA, 19 nt, Homo sapiens
acacuuggauuuacuucuu

SEQ ID NO: 14550 - RNA, 19 nt, Homo sapiens
cagaaugucuugagaaucc

SEQ ID NO: 14551 - RNA, 19 nt, Homo sapiens
aaagaccaauccuccugua

SEQ ID NO: 14552 - RNA, 19 nt, Homo sapiens
ggucuuucuucccugauuu

SEQ ID NO: 14553 - RNA, 19 nt, Homo sapiens
ggauggcguuugugaaugg

SEQ ID NO: 14554 - RNA, 19 nt, Homo sapiens
caagagagaccuucuacag

SEQ ID NO: 14555 - RNA, 19 nt, Homo sapiens
gaucaagagagaccuucua

SEQ ID NO: 14556 - RNA, 19 nt, Homo sapiens
caagcccucugaaacaguu

SEQ ID NO: 14557 - RNA, 19 nt, Homo sapiens
cgaaucaugugcagaaugc

SEQ ID NO: 14558 - RNA, 19 nt, Homo sapiens
gaacauuuccaaggccauu

SEQ ID NO: 14559 - RNA, 19 nt, Homo sapiens
aaagcagauucucguaauu

SEQ ID NO: 14560 - RNA, 19 nt, Homo sapiens
cuuaaggaaugaucaugaa

SEQ ID NO: 14561 - RNA, 19 nt, Homo sapiens
gaaaagcagauucucguaa

SEQ ID NO: 14562 - RNA, 19 nt, Homo sapiens
gagagaccuucuacaggau

SEQ ID NO: 14563 - RNA, 19 nt, Homo sapiens
gagccuugccugacacuug

SEQ ID NO: 14564 - RNA, 19 nt, Homo sapiens
ccucaagucuggccucaag

SEQ ID NO: 14565 - RNA, 19 nt, Homo sapiens
uaaggaaugaucaugaaug

SEQ ID NO: 14566 - RNA, 19 nt, Homo sapiens
ggacacacacccaugacau

SEQ ID NO: 14567 - RNA, 19 nt, Homo sapiens
gaccaauccuccuguacca

SEQ ID NO: 14568 - RNA, 19 nt, Homo sapiens
gaauaagacagcgcggaaa

SEQ ID NO: 14569 - RNA, 19 nt, Homo sapiens
aaagcagucuuccaaacau

SEQ ID NO: 14570 - RNA, 19 nt, Homo sapiens
gaccaagacgcacuucuca

SEQ ID NO: 14571 - RNA, 19 nt, Homo sapiens
cauguuacuguuacugaua

SEQ ID NO: 14572 - RNA, 19 nt, Homo sapiens
ucaagcauccaucugacua

SEQ ID NO: 14573 - RNA, 19 nt, Homo sapiens
cggcaccggugaacauuuc

SEQ ID NO: 14574 - RNA, 19 nt, Homo sapiens
agaaagcagucuuccaaac

SEQ ID NO: 14575 - RNA, 19 nt, Homo sapiens
uaucuaaacagcugcauca

SEQ ID NO: 14576 - RNA, 19 nt, Homo sapiens
ccaucauccuggucaugua

SEQ ID NO: 14577 - RNA, 19 nt, Homo sapiens
ccacgacuguuguccuuac

SEQ ID NO: 14578 - RNA, 19 nt, Homo sapiens
gagccuucagggacaaaua

SEQ ID NO: 14579 - RNA, 19 nt, Homo sapiens
acaguaacuuaaggaauga

SEQ ID NO: 14580 - RNA, 19 nt, Homo sapiens
ccguggaucugccaggauu

SEQ ID NO: 14581 - RNA, 19 nt, Homo sapiens
ccaagacgcacuucucagu

SEQ ID NO: 14582 - RNA, 19 nt, Homo sapiens
ggugcuggguaacauccua

SEQ ID NO: 14583 - RNA, 19 nt, Homo sapiens
caagcauccaucugacuaa

SEQ ID NO: 14584 - RNA, 19 nt, Homo sapiens
gcaucaaccccaucauaua

SEQ ID NO: 14585 - RNA, 19 nt, Homo sapiens
aggcacaaauccaacaugu

SEQ ID NO: 14586 - RNA, 19 nt, Homo sapiens
gcgacccacugucuuugga

SEQ ID NO: 14587 - RNA, 19 nt, Homo sapiens
cacuuggauuuacuucuuu

SEQ ID NO: 14588 - RNA, 19 nt, Homo sapiens
gacccacugucuuuggaau

SEQ ID NO: 14589 - RNA, 19 nt, Homo sapiens
guccacgacuguuguccuu

SEQ ID NO: 14590 - RNA, 19 nt, Homo sapiens
agacggauggcguuuguga

SEQ ID NO: 14591 - RNA, 19 nt, Homo sapiens
cagaaagcagucuuccaaa

SEQ ID NO: 14592 - RNA, 19 nt, Homo sapiens
gcaaagggaaagaggaaaa

SEQ ID NO: 14593 - RNA, 19 nt, Homo sapiens
gacuaaggcacaaauccaa

SEQ ID NO: 14594 - RNA, 19 nt, Homo sapiens
gggucuuucuucccugauu

SEQ ID NO: 14595 - RNA, 19 nt, Homo sapiens
gaagaaagcggccaaaacg

SEQ ID NO: 14596 - RNA, 19 nt, Homo sapiens
ucucagcgcugggcuccuu

SEQ ID NO: 14597 - RNA, 19 nt, Homo sapiens
aaaagcagauucucguaau

SEQ ID NO: 14598 - RNA, 19 nt, Homo sapiens
uuucuucccugauuucaag

SEQ ID NO: 14599 - RNA, 19 nt, Homo sapiens
ggagaagaaagcggccaaa

SEQ ID NO: 14600 - RNA, 19 nt, Homo sapiens
gcacucucccuggucauau

SEQ ID NO: 14601 - RNA, 19 nt, Homo sapiens
aaggaaugaucaugaaugc

SEQ ID NO: 14602 - RNA, 19 nt, Homo sapiens
uuaucaagcauccaucuga

SEQ ID NO: 14603 - RNA, 19 nt, Homo sapiens
ggaaaagcagauucucgua

SEQ ID NO: 14604 - RNA, 19 nt, Homo sapiens
gggcuggccaggguuguuu

SEQ ID NO: 14605 - RNA, 19 nt, Homo sapiens
gcccuucuccgccaucuuc

SEQ ID NO: 14606 - RNA, 19 nt, Homo sapiens
uucagaaugucuugagaau

SEQ ID NO: 14607 - RNA, 19 nt, Homo sapiens
gcacuacuacaucgucaac

SEQ ID NO: 14608 - RNA, 19 nt, Homo sapiens
ugccugacacuuggauuua

SEQ ID NO: 14609 - RNA, 19 nt, Homo sapiens
gaucugccaggauuacagu

SEQ ID NO: 14610 - RNA, 19 nt, Homo sapiens
cccgugggaucaagagaga

SEQ ID NO: 14611 - RNA, 19 nt, Homo sapiens
uggcguuugugaauggaaa

SEQ ID NO: 14612 - RNA, 19 nt, Homo sapiens
ccagccaggacgaauaaga

SEQ ID NO: 14613 - RNA, 19 nt, Homo sapiens
aagcagucuuccaaacaug

SEQ ID NO: 14614 - RNA, 19 nt, Homo sapiens
aaagagccuucagggacaa

SEQ ID NO: 14615 - RNA, 19 nt, Homo sapiens
uccagugucuccgcagaaa

SEQ ID NO: 14616 - RNA, 19 nt, Homo sapiens
ggcacucucccuggucaua

SEQ ID NO: 14617 - RNA, 19 nt, Homo sapiens
aagcagauucucguaauuc

SEQ ID NO: 14618 - RNA, 19 nt, Homo sapiens
cggauggcguuugugaaug

SEQ ID NO: 14619 - RNA, 19 nt, Homo sapiens
uggcucggauaucuaaaca

SEQ ID NO: 14620 - RNA, 19 nt, Homo sapiens
ugacuaaggcacaaaucca

SEQ ID NO: 14621 - RNA, 19 nt, Homo sapiens
cuggguaacauccuaguga

SEQ ID NO: 14622 - RNA, 19 nt, Homo sapiens
gaugaaaucuugcucagaa

SEQ ID NO: 14623 - RNA, 19 nt, Homo sapiens
gcagaaagcagucuuccaa

SEQ ID NO: 14624 - RNA, 19 nt, Homo sapiens
uaucuuaccuucccauaga

SEQ ID NO: 14625 - RNA, 19 nt, Homo sapiens
ggauuacaguguccaaaga

SEQ ID NO: 14626 - RNA, 19 nt, Homo sapiens
gaaagcagucuuccaaaca

SEQ ID NO: 14627 - RNA, 19 nt, Homo sapiens
caagacggauggcguuugu

SEQ ID NO: 14628 - RNA, 19 nt, Homo sapiens
ggacuacacauucuucugu

SEQ ID NO: 14629 - RNA, 19 nt, Homo sapiens
ggagugcaguggcaugauc

SEQ ID NO: 14630 - RNA, 19 nt, Homo sapiens
ccaaagugcugggauuaca

SEQ ID NO: 14631 - RNA, 19 nt, Homo sapiens
cagaaugucuugagaaucc

SEQ ID NO: 14632 - RNA, 19 nt, Homo sapiens
aaagaccaauccuccugua

SEQ ID NO: 14633 - RNA, 19 nt, Homo sapiens
ggucuuucuucccugauuu

SEQ ID NO: 14634 - RNA, 19 nt, Homo sapiens
ggauggcguuugugaaugg

SEQ ID NO: 14635 - RNA, 19 nt, Homo sapiens
caagagagaccuucuacag

SEQ ID NO: 14636 - RNA, 19 nt, Homo sapiens
gaucaagagagaccuucua

SEQ ID NO: 14637 - RNA, 19 nt, Homo sapiens
caagcccucugaaacaguu

SEQ ID NO: 14638 - RNA, 19 nt, Homo sapiens
cgaaucaugugcagaaugc

SEQ ID NO: 14639 - RNA, 19 nt, Homo sapiens
gaacauuuccaaggccauu

SEQ ID NO: 14640 - RNA, 19 nt, Homo sapiens
aaagcagauucucguaauu

SEQ ID NO: 14641 - RNA, 19 nt, Homo sapiens
ccacuggacuacacauucu

SEQ ID NO: 14642 - RNA, 19 nt, Homo sapiens
gaaaagcagauucucguaa

SEQ ID NO: 14643 - RNA, 19 nt, Homo sapiens
gcucagaagcucaauaugc

SEQ ID NO: 14644 - RNA, 19 nt, Homo sapiens
caccaggcccagcuaauuu

SEQ ID NO: 14645 - RNA, 19 nt, Homo sapiens
gagagaccuucuacaggau

SEQ ID NO: 14646 - RNA, 19 nt, Homo sapiens
ccaagcagcugggacuaca

SEQ ID NO: 14647 - RNA, 19 nt, Homo sapiens
ccucaagucuggccucaag

SEQ ID NO: 14648 - RNA, 19 nt, Homo sapiens
caccauggagcacgguuua

SEQ ID NO: 14649 - RNA, 19 nt, Homo sapiens
gaccaauccuccuguacca

SEQ ID NO: 14650 - RNA, 19 nt, Homo sapiens
ccaccaggcccagcuaauu

SEQ ID NO: 14651 - RNA, 19 nt, Homo sapiens
ggacgaagucucgcucugu

SEQ ID NO: 14652 - RNA, 19 nt, Homo sapiens
gaauaagacagcgcggaaa

SEQ ID NO: 14653 - RNA, 19 nt, Homo sapiens
aaagcagucuuccaaacau

SEQ ID NO: 14654 - RNA, 19 nt, Homo sapiens
gaccaagacgcacuucuca

SEQ ID NO: 14655 - RNA, 19 nt, Homo sapiens
cggcaccggugaacauuuc

SEQ ID NO: 14656 - RNA, 19 nt, Homo sapiens
acacacacauucucuccau

SEQ ID NO: 14657 - RNA, 19 nt, Homo sapiens
agaaagcagucuuccaaac

SEQ ID NO: 14658 - RNA, 19 nt, Homo sapiens
uaucuaaacagcugcauca

SEQ ID NO: 14659 - RNA, 19 nt, Homo sapiens
ccaucauccuggucaugua

SEQ ID NO: 14660 - RNA, 19 nt, Homo sapiens
cucagaagcucaauaugca

SEQ ID NO: 14661 - RNA, 19 nt, Homo sapiens
ccguggaucugccaggauu

SEQ ID NO: 14662 - RNA, 19 nt, Homo sapiens
ccaagacgcacuucucagu

SEQ ID NO: 14663 - RNA, 19 nt, Homo sapiens
ggugcuggguaacauccua

SEQ ID NO: 14664 - RNA, 19 nt, Homo sapiens
cagaagcucaauaugcaaa

SEQ ID NO: 14665 - RNA, 19 nt, Homo sapiens
gcaucaaccccaucauaua

SEQ ID NO: 14666 - RNA, 19 nt, Homo sapiens
caacacacacacacauucu

SEQ ID NO: 14667 - RNA, 19 nt, Homo sapiens
cauagacacccagcccaua

SEQ ID NO: 14668 - RNA, 19 nt, Homo sapiens
agacggauggcguuuguga

SEQ ID NO: 14669 - RNA, 19 nt, Homo sapiens
cagaaagcagucuuccaaa

SEQ ID NO: 14670 - RNA, 19 nt, Homo sapiens
gggucuuucuucccugauu

SEQ ID NO: 14671 - RNA, 19 nt, Homo sapiens
gaagaaagcggccaaaacg

SEQ ID NO: 14672 - RNA, 19 nt, Homo sapiens
ccaacacacacacacauuc

SEQ ID NO: 14673 - RNA, 19 nt, Homo sapiens
ucucagcgcugggcuccuu

SEQ ID NO: 14674 - RNA, 19 nt, Homo sapiens
uaacagugcaauccuuucu

SEQ ID NO: 14675 - RNA, 19 nt, Homo sapiens
aaaagcagauucucguaau

SEQ ID NO: 14676 - RNA, 19 nt, Homo sapiens
ggcaugaucuuggcucacu

SEQ ID NO: 14677 - RNA, 19 nt, Homo sapiens
uuucuucccugauuucaag

SEQ ID NO: 14678 - RNA, 19 nt, Homo sapiens
ggagaagaaagcggccaaa

SEQ ID NO: 14679 - RNA, 19 nt, Homo sapiens
gcacucucccuggucauau

SEQ ID NO: 14680 - RNA, 19 nt, Homo sapiens
ggaaaagcagauucucgua

SEQ ID NO: 14681 - RNA, 19 nt, Homo sapiens
gggcuggccaggguuguuu

SEQ ID NO: 14682 - RNA, 19 nt, Homo sapiens
gcccuucuccgccaucuuc

SEQ ID NO: 14683 - RNA, 19 nt, Homo sapiens
ggaugaaaucuugcucaga

SEQ ID NO: 14684 - RNA, 19 nt, Homo sapiens
uucagaaugucuugagaau

SEQ ID NO: 14685 - RNA, 19 nt, Homo sapiens
gcacuacuacaucgucaac

SEQ ID NO: 14686 - RNA, 19 nt, Homo sapiens
gaucugccaggauuacagu

SEQ ID NO: 14687 - RNA, 19 nt, Homo sapiens
cccgugggaucaagagaga

SEQ ID NO: 14688 - RNA, 19 nt, Homo sapiens
uggcguuugugaauggaaa

SEQ ID NO: 14689 - RNA, 19 nt, Homo sapiens
ccagccaggacgaauaaga

SEQ ID NO: 14690 - RNA, 19 nt, Homo sapiens
aagcagucuuccaaacaug

SEQ ID NO: 14691 - RNA, 19 nt, Homo sapiens
gaaaucuugcucagaagcu

SEQ ID NO: 14692 - RNA, 19 nt, Homo sapiens
uccagugucuccgcagaaa

SEQ ID NO: 14693 - RNA, 19 nt, Homo sapiens
ggcacucucccuggucaua

SEQ ID NO: 14694 - RNA, 19 nt, Homo sapiens
aagcagauucucguaauuc

SEQ ID NO: 14695 - RNA, 19 nt, Homo sapiens
cggauggcguuugugaaug

SEQ ID NO: 14696 - RNA, 19 nt, Homo sapiens
uggcucggauaucuaaaca

SEQ ID NO: 14697 - RNA, 19 nt, Homo sapiens
cuggguaacauccuaguga

SEQ ID NO: 14698 - RNA, 19 nt, Homo sapiens
ugacaucgcuuguuccuaa

SEQ ID NO: 14699 - RNA, 19 nt, Homo sapiens
gggaauggauuguagauau

SEQ ID NO: 14700 - RNA, 19 nt, Homo sapiens
guagauauuucaccaagaa

SEQ ID NO: 14701 - RNA, 19 nt, Homo sapiens
ggaauggauuguagauauu

SEQ ID NO: 14702 - RNA, 19 nt, Homo sapiens
ccaguagguuucaugguua

SEQ ID NO: 14703 - RNA, 19 nt, Homo sapiens
gagaaagggucuagaaugc

SEQ ID NO: 14704 - RNA, 19 nt, Homo sapiens
gcagaaagcagucuuccaa

SEQ ID NO: 14705 - RNA, 19 nt, Homo sapiens
gcagagagcauaucaagca

SEQ ID NO: 14706 - RNA, 19 nt, Homo sapiens
ggagaaagggucuagaaug

SEQ ID NO: 14707 - RNA, 19 nt, Homo sapiens
gagcauaucaagcauguga

SEQ ID NO: 14708 - RNA, 19 nt, Homo sapiens
ggauuacaguguccaaaga

SEQ ID NO: 14709 - RNA, 19 nt, Homo sapiens
gagagcauaucaagcaugu

SEQ ID NO: 14710 - RNA, 19 nt, Homo sapiens
gaaagcagucuuccaaaca

SEQ ID NO: 14711 - RNA, 19 nt, Homo sapiens
gaaugcugaucuccaggua

SEQ ID NO: 14712 - RNA, 19 nt, Homo sapiens
caagacggauggcguuugu

SEQ ID NO: 14713 - RNA, 19 nt, Homo sapiens
uggaagcuauggcuaugua

SEQ ID NO: 14714 - RNA, 19 nt, Homo sapiens
gauauuucaccaagaauug

SEQ ID NO: 14715 - RNA, 19 nt, Homo sapiens
aagcuauggcuauguauua

SEQ ID NO: 14716 - RNA, 19 nt, Homo sapiens
gaagcuauggcuauguauu

SEQ ID NO: 14717 - RNA, 19 nt, Homo sapiens
cagaaugucuugagaaucc

SEQ ID NO: 14718 - RNA, 19 nt, Homo sapiens
aaagaccaauccuccugua

SEQ ID NO: 14719 - RNA, 19 nt, Homo sapiens
ggucuuucuucccugauuu

SEQ ID NO: 14720 - RNA, 19 nt, Homo sapiens
ggauggcguuugugaaugg

SEQ ID NO: 14721 - RNA, 19 nt, Homo sapiens
caagagagaccuucuacag

SEQ ID NO: 14722 - RNA, 19 nt, Homo sapiens
gaucaagagagaccuucua

SEQ ID NO: 14723 - RNA, 19 nt, Homo sapiens
caagcccucugaaacaguu

SEQ ID NO: 14724 - RNA, 19 nt, Homo sapiens
gaacauuuccaaggccauu

SEQ ID NO: 14725 - RNA, 19 nt, Homo sapiens
gagagaccuucuacaggau

SEQ ID NO: 14726 - RNA, 19 nt, Homo sapiens
gcuggaagcuauggcuaug

SEQ ID NO: 14727 - RNA, 19 nt, Homo sapiens
ccucaagucuggccucaag

SEQ ID NO: 14728 - RNA, 19 nt, Homo sapiens
gaccaauccuccuguacca

SEQ ID NO: 14729 - RNA, 19 nt, Homo sapiens
cuauggcuauguauuaugu

SEQ ID NO: 14730 - RNA, 19 nt, Homo sapiens
aaagcagucuuccaaacau

SEQ ID NO: 14731 - RNA, 19 nt, Homo sapiens
gaccaagacgcacuucuca

SEQ ID NO: 14732 - RNA, 19 nt, Homo sapiens
cggcaccggugaacauuuc

SEQ ID NO: 14733 - RNA, 19 nt, Homo sapiens
agaaagcagucuuccaaac

SEQ ID NO: 14734 - RNA, 19 nt, Homo sapiens
uaucuaaacagcugcauca

SEQ ID NO: 14735 - RNA, 19 nt, Homo sapiens
ccaucauccuggucaugua

SEQ ID NO: 14736 - RNA, 19 nt, Homo sapiens
gcauaucaagcaugugaau

SEQ ID NO: 14737 - RNA, 19 nt, Homo sapiens
gagaacauuuuaggaacua

SEQ ID NO: 14738 - RNA, 19 nt, Homo sapiens
ccguggaucugccaggauu

SEQ ID NO: 14739 - RNA, 19 nt, Homo sapiens
ccaagacgcacuucucagu

SEQ ID NO: 14740 - RNA, 19 nt, Homo sapiens
ggugcuggguaacauccua

SEQ ID NO: 14741 - RNA, 19 nt, Homo sapiens
gcaucaaccccaucauaua

SEQ ID NO: 14742 - RNA, 19 nt, Homo sapiens
ggucuagaaugcugaucuc

SEQ ID NO: 14743 - RNA, 19 nt, Homo sapiens
guggagaaagggucuagaa

SEQ ID NO: 14744 - RNA, 19 nt, Homo sapiens
gcaugugaauuuuaugaug

SEQ ID NO: 14745 - RNA, 19 nt, Homo sapiens
ggcuauguauuaugugaca

SEQ ID NO: 14746 - RNA, 19 nt, Homo sapiens
agacggauggcguuuguga

SEQ ID NO: 14747 - RNA, 19 nt, Homo sapiens
cagaaagcagucuuccaaa

SEQ ID NO: 14748 - RNA, 19 nt, Homo sapiens
gggucuuucuucccugauu

SEQ ID NO: 14749 - RNA, 19 nt, Homo sapiens
gaagaaagcggccaaaacg

SEQ ID NO: 14750 - RNA, 19 nt, Homo sapiens
ucucagcgcugggcuccuu

SEQ ID NO: 14751 - RNA, 19 nt, Homo sapiens
ggaggggaauggauuguag

SEQ ID NO: 14752 - RNA, 19 nt, Homo sapiens
uuucuucccugauuucaag

SEQ ID NO: 14753 - RNA, 19 nt, Homo sapiens
ggagaagaaagcggccaaa

SEQ ID NO: 14754 - RNA, 19 nt, Homo sapiens
gcacucucccuggucauau

SEQ ID NO: 14755 - RNA, 19 nt, Homo sapiens
gggcuggccaggguuguuu

SEQ ID NO: 14756 - RNA, 19 nt, Homo sapiens
gcccuucuccgccaucuuc

SEQ ID NO: 14757 - RNA, 19 nt, Homo sapiens
uccagugucucugcagaaa

SEQ ID NO: 14758 - RNA, 19 nt, Homo sapiens
uucagaaugucuugagaau

SEQ ID NO: 14759 - RNA, 19 nt, Homo sapiens
gcacuacuacaucgucaac

SEQ ID NO: 14760 - RNA, 19 nt, Homo sapiens
caucgcuuguuccuaagug

SEQ ID NO: 14761 - RNA, 19 nt, Homo sapiens
aagaauugcagagagcaua

SEQ ID NO: 14762 - RNA, 19 nt, Homo sapiens
gaucugccaggauuacagu

SEQ ID NO: 14763 - RNA, 19 nt, Homo sapiens
cccgugggaucaagagaga

SEQ ID NO: 14764 - RNA, 19 nt, Homo sapiens
uggcguuugugaauggaaa

SEQ ID NO: 14765 - RNA, 19 nt, Homo sapiens
aagcagucuuccaaacaug

SEQ ID NO: 14766 - RNA, 19 nt, Homo sapiens
cagagagcauaucaagcau

SEQ ID NO: 14767 - RNA, 19 nt, Homo sapiens
ggcacucucccuggucaua

SEQ ID NO: 14768 - RNA, 19 nt, Homo sapiens
gcuauggcuauguauuaug

SEQ ID NO: 14769 - RNA, 19 nt, Homo sapiens
cggauggcguuugugaaug

SEQ ID NO: 14770 - RNA, 19 nt, Homo sapiens
uggcucggauaucuaaaca

SEQ ID NO: 14771 - RNA, 19 nt, Homo sapiens
aaugaggagucagcuggaa

SEQ ID NO: 14772 - RNA, 19 nt, Homo sapiens
cuggguaacauccuaguga

SEQ ID NO: 14773 - RNA, 19 nt, Homo sapiens
ucaccaagaauugcagaga

SEQ ID NO: 14774 - RNA, 19 nt, Homo sapiens
uguagauauuucaccaaga

SEQ ID NO: 14775 - RNA, 19 nt, Homo sapiens
ggaagaagcaaaccugaua

SEQ ID NO: 14776 - RNA, 19 nt, Homo sapiens
gaugguggaucaagacaua

SEQ ID NO: 14777 - RNA, 19 nt, Homo sapiens
aaacuuggcuguauuagga

SEQ ID NO: 14778 - RNA, 19 nt, Homo sapiens
aagcaaaccugauacaauu

SEQ ID NO: 14779 - RNA, 19 nt, Homo sapiens
gggcagagacuuuguguuu

SEQ ID NO: 14780 - RNA, 19 nt, Homo sapiens
gaagcaaaccugauacaau

SEQ ID NO: 14781 - RNA, 19 nt, Homo sapiens
gcagagacuuuguguuuac

SEQ ID NO: 14782 - RNA, 19 nt, Homo sapiens
cccaagagcuguuagguau

SEQ ID NO: 14783 - RNA, 19 nt, Homo sapiens
acacggaccugcuuugaga

SEQ ID NO: 14784 - RNA, 19 nt, Homo sapiens
cccaguaacucacuuuaaa

SEQ ID NO: 14785 - RNA, 19 nt, Homo sapiens
ggcagagacuuuguguuua

SEQ ID NO: 14786 - RNA, 19 nt, Homo sapiens
gaguggaaauuauguggaa

SEQ ID NO: 14787 - RNA, 19 nt, Homo sapiens
caucagcccuguguauaaa

SEQ ID NO: 14788 - RNA, 19 nt, Homo sapiens
guuuacagaucaaauguga

SEQ ID NO: 14789 - RNA, 19 nt, Homo sapiens
gcacucuuauuucacuaaa

SEQ ID NO: 14790 - RNA, 19 nt, Homo sapiens
caagagcuguuagguauca

SEQ ID NO: 14791 - RNA, 19 nt, Homo sapiens
guuuacaucugcauuucua

SEQ ID NO: 14792 - RNA, 19 nt, Homo sapiens
ucacacaggccaucgagua

SEQ ID NO: 14793 - RNA, 19 nt, Homo sapiens
cagcagggcgcacaacuuu

SEQ ID NO: 14794 - RNA, 19 nt, Homo sapiens
ggccugcacucuuauuuca

SEQ ID NO: 14795 - RNA, 19 nt, Homo sapiens
aaaccucucuuuccagugu

SEQ ID NO: 14796 - RNA, 19 nt, Homo sapiens
ggaccugcuuugagauuuc

SEQ ID NO: 14797 - RNA, 19 nt, Homo sapiens
ggaggagggcagagacuuu

SEQ ID NO: 14798 - RNA, 19 nt, Homo sapiens
cacgcacgcucuucaaauu

SEQ ID NO: 14799 - RNA, 19 nt, Homo sapiens
caaaugggccugccaaacu

SEQ ID NO: 14800 - RNA, 19 nt, Homo sapiens
gcuuugagauuuccugaca

SEQ ID NO: 14801 - RNA, 19 nt, Homo sapiens
gcucaagauucaagauaca

SEQ ID NO: 14802 - RNA, 19 nt, Homo sapiens
guugagaucaugucauuga

SEQ ID NO: 14803 - RNA, 19 nt, Homo sapiens
guuaugaagucccucuaug

SEQ ID NO: 14804 - RNA, 19 nt, Homo sapiens
gcaacgugcucgucaucau

SEQ ID NO: 14805 - RNA, 19 nt, Homo sapiens
ggccacugcuugaagaaga

SEQ ID NO: 14806 - RNA, 19 nt, Homo sapiens
cuggagagcugaucguuca

SEQ ID NO: 14807 - RNA, 19 nt, Homo sapiens
gauacaauuugcccaaggu

SEQ ID NO: 14808 - RNA, 19 nt, Homo sapiens
gcuugaagaagaauaugua

SEQ ID NO: 14809 - RNA, 19 nt, Homo sapiens
uaaagccauuauucucuga

SEQ ID NO: 14810 - RNA, 19 nt, Homo sapiens
ucaaauucuucuucugguu

SEQ ID NO: 14811 - RNA, 19 nt, Homo sapiens
ugguugagaucaugucauu

SEQ ID NO: 14812 - RNA, 19 nt, Homo sapiens
ggaucaagacauaaguaaa

SEQ ID NO: 14813 - RNA, 19 nt, Homo sapiens
gcaagcccuuucugguguu

SEQ ID NO: 14814 - RNA, 19 nt, Homo sapiens
uaaucacuauugcuuccua

SEQ ID NO: 14815 - RNA, 19 nt, Homo sapiens
ccaaggaguggaaauuaug

SEQ ID NO: 14816 - RNA, 19 nt, Homo sapiens
gugccuaacagcauaauug

SEQ ID NO: 14817 - RNA, 19 nt, Homo sapiens
caucugcauuucuacaugu

SEQ ID NO: 14818 - RNA, 19 nt, Homo sapiens
uuaauuuccugucauccuu

SEQ ID NO: 14819 - RNA, 19 nt, Homo sapiens
gaaauaaaacuuggcugua

SEQ ID NO: 14820 - RNA, 19 nt, Homo sapiens
caucggcucucccuacucu

SEQ ID NO: 14821 - RNA, 19 nt, Homo sapiens
gcacauguugcuaaugaca

SEQ ID NO: 14822 - RNA, 19 nt, Homo sapiens
gagacuuuguguuuacauc

SEQ ID NO: 14823 - RNA, 19 nt, Homo sapiens
acaauuugcccaagguaaa

SEQ ID NO: 14824 - RNA, 19 nt, Homo sapiens
gaagccagagagucgguaa

SEQ ID NO: 14825 - RNA, 19 nt, Homo sapiens
caucaaggccaucaucauc

SEQ ID NO: 14826 - RNA, 19 nt, Homo sapiens
agacagagacaauuuaagg

SEQ ID NO: 14827 - RNA, 19 nt, Homo sapiens
guuaucaggccaccgauga

SEQ ID NO: 14828 - RNA, 19 nt, Homo sapiens
uugaugaacugccaaaguc

SEQ ID NO: 14829 - RNA, 19 nt, Homo sapiens
caagcccuuucugguguua

SEQ ID NO: 14830 - RNA, 19 nt, Homo sapiens
gcagggcgcacaacuuugg

SEQ ID NO: 14831 - RNA, 19 nt, Homo sapiens
gcuguuagguaucaaaaug

SEQ ID NO: 14832 - RNA, 19 nt, Homo sapiens
ccaacucucucucucuuuu

SEQ ID NO: 14833 - RNA, 19 nt, Homo sapiens
gggcauggcucacaaaagg

SEQ ID NO: 14834 - RNA, 19 nt, Homo sapiens
gcacgcucuucaaauucuu

SEQ ID NO: 14835 - RNA, 19 nt, Homo sapiens
ccacgcucgucaucccuuu

SEQ ID NO: 14836 - RNA, 19 nt, Homo sapiens
aaaugggccugccaaacug

SEQ ID NO: 14837 - RNA, 19 nt, Homo sapiens
gaagaagcaaaccugauac

SEQ ID NO: 14838 - RNA, 19 nt, Homo sapiens
cagggccacugcuugaaga

SEQ ID NO: 14839 - RNA, 19 nt, Homo sapiens
uaacagcauaauugccuuu

SEQ ID NO: 14840 - RNA, 19 nt, Homo sapiens
acaagggcauggcucacaa

SEQ ID NO: 14841 - RNA, 19 nt, Homo sapiens
agcaagcacuggacuacaa

SEQ ID NO: 14842 - RNA, 19 nt, Homo sapiens
gugcaucggcuccuucuuc

SEQ ID NO: 14843 - RNA, 19 nt, Homo sapiens
gaggagggcagagacuuug

SEQ ID NO: 14844 - RNA, 19 nt, Homo sapiens
cacaggccaucgaguacaa

SEQ ID NO: 14845 - RNA, 19 nt, Homo sapiens
ugucauccuuccaaguuau

SEQ ID NO: 14846 - RNA, 19 nt, Homo sapiens
guuucuaucuuguaugucu

SEQ ID NO: 14847 - RNA, 19 nt, Homo sapiens
ggucaucuacaccaucuuc

SEQ ID NO: 14848 - RNA, 19 nt, Homo sapiens
gccacugcuugaagaagaa

SEQ ID NO: 14849 - RNA, 19 nt, Homo sapiens
cgacacggaccugcuuuga

SEQ ID NO: 14850 - RNA, 19 nt, Homo sapiens
gcucuucaaauucuucuuc

SEQ ID NO: 14851 - RNA, 19 nt, Homo sapiens
acaucagcccuguguauaa

SEQ ID NO: 14852 - RNA, 19 nt, Homo sapiens
gagccuuucugccucacau

SEQ ID NO: 14853 - RNA, 19 nt, Homo sapiens
auaaguaaaugagccuuuc

SEQ ID NO: 14854 - RNA, 19 nt, Homo sapiens
cauaaguaaaugagccuuu

SEQ ID NO: 14855 - RNA, 19 nt, Homo sapiens
ccacgcacgcucuucaaau

SEQ ID NO: 14856 - RNA, 19 nt, Homo sapiens
uggaaauuauguggaagaa

SEQ ID NO: 14857 - RNA, 19 nt, Homo sapiens
caucuucaaccacgauuuc

SEQ ID NO: 14858 - RNA, 19 nt, Homo sapiens
ggucaucucggccgucauc

SEQ ID NO: 14859 - RNA, 19 nt, Homo sapiens
caaggaguggaaauuaugu

SEQ ID NO: 14860 - RNA, 19 nt, Homo sapiens
caagacauaaguaaaugag

SEQ ID NO: 14861 - RNA, 19 nt, Homo sapiens
guggaucaagacauaagua

SEQ ID NO: 14862 - RNA, 19 nt, Homo sapiens
ccugucauccuuccaaguu

SEQ ID NO: 14863 - RNA, 19 nt, Homo sapiens
gacaaaugggccugccaaa

SEQ ID NO: 14864 - RNA, 19 nt, Homo sapiens
gcaaugcaagcccuuucug

SEQ ID NO: 14865 - RNA, 19 nt, Homo sapiens
cacuauugcuuccuaaagg

SEQ ID NO: 14866 - RNA, 19 nt, Homo sapiens
aaucacuauugcuuccuaa

SEQ ID NO: 14867 - RNA, 19 nt, Homo sapiens
ggcucaagauucaagauac

SEQ ID NO: 14868 - RNA, 19 nt, Homo sapiens
uggaucaagacauaaguaa

SEQ ID NO: 14869 - RNA, 19 nt, Homo sapiens
ucccaacucucucucucuu

SEQ ID NO: 14870 - RNA, 19 nt, Homo sapiens
caacgugcucgucaucauc

SEQ ID NO: 14871 - RNA, 19 nt, Homo sapiens
cugucauccuuccaaguua

SEQ ID NO: 14872 - RNA, 19 nt, Homo sapiens
ggauguaaggcgacagaca

SEQ ID NO: 14873 - RNA, 19 nt, Homo sapiens
guguuuacaucugcauuuc

SEQ ID NO: 14874 - RNA, 19 nt, Homo sapiens
gacuuuguguuuacaucug

SEQ ID NO: 14875 - RNA, 19 nt, Homo sapiens
gcaaaggucugaguuauua

SEQ ID NO: 14876 - RNA, 19 nt, Homo sapiens
gcagacagaaucacuauuu

SEQ ID NO: 14877 - RNA, 19 nt, Homo sapiens
caaauccucuggaacauag

SEQ ID NO: 14878 - RNA, 19 nt, Homo sapiens
gggccuggcuucaacauug

SEQ ID NO: 14879 - RNA, 19 nt, Homo sapiens
ggagagggacugacuguga

SEQ ID NO: 14880 - RNA, 19 nt, Homo sapiens
agauggaccugcuagauuu

SEQ ID NO: 14881 - RNA, 19 nt, Homo sapiens
ugacaacguuucgacauuu

SEQ ID NO: 14882 - RNA, 19 nt, Homo sapiens
ccaaaugaguccuugugaa

SEQ ID NO: 14883 - RNA, 19 nt, Homo sapiens
gaucugugguuccuuugaa

SEQ ID NO: 14884 - RNA, 19 nt, Homo sapiens
ggagccagccuuccacuuu

SEQ ID NO: 14885 - RNA, 19 nt, Homo sapiens
caauggaucggcuuccuua

SEQ ID NO: 14886 - RNA, 19 nt, Homo sapiens
cggcaacagucuaagauga

SEQ ID NO: 14887 - RNA, 19 nt, Homo sapiens
cagaaucacuauuucaagu

SEQ ID NO: 14888 - RNA, 19 nt, Homo sapiens
cgauggaggugguucaaau

SEQ ID NO: 14889 - RNA, 19 nt, Homo sapiens
ccaguguucuugccuguga

SEQ ID NO: 14890 - RNA, 19 nt, Homo sapiens
gcaacagucuaagaugaga

SEQ ID NO: 14891 - RNA, 19 nt, Homo sapiens
caagacagcucaaaauauc

SEQ ID NO: 14892 - RNA, 19 nt, Homo sapiens
gccaucaccuuccucauuc

SEQ ID NO: 14893 - RNA, 19 nt, Homo sapiens
cagcaucggaucuuucuuu

SEQ ID NO: 14894 - RNA, 19 nt, Homo sapiens
ccaccugucuuccuguaga

SEQ ID NO: 14895 - RNA, 19 nt, Homo sapiens
ggaacacacuagagaacca

SEQ ID NO: 14896 - RNA, 19 nt, Homo sapiens
gaagaaacgaagacugauc

SEQ ID NO: 14897 - RNA, 19 nt, Homo sapiens
uagcaagggucccagugaa

SEQ ID NO: 14898 - RNA, 19 nt, Homo sapiens
ggccaucaccuuccucauu

SEQ ID NO: 14899 - RNA, 19 nt, Homo sapiens
gagagggccuggcuucaac

SEQ ID NO: 14900 - RNA, 19 nt, Homo sapiens
gacagaaucacuauuucaa

SEQ ID NO: 14901 - RNA, 19 nt, Homo sapiens
cagauggaccugcuagauu

SEQ ID NO: 14902 - RNA, 19 nt, Homo sapiens
gagaagagagagcacuuuc

SEQ ID NO: 14903 - RNA, 19 nt, Homo sapiens
caucggaucuuucuuugcu

SEQ ID NO: 14904 - RNA, 19 nt, Homo sapiens
gggcgugggugcuauaggu

SEQ ID NO: 14905 - RNA, 19 nt, Homo sapiens
ggagagggccuggcuucaa

SEQ ID NO: 14906 - RNA, 19 nt, Homo sapiens
gacaacguuucgacauuuc

SEQ ID NO: 14907 - RNA, 19 nt, Homo sapiens
gcugcaaaggucugaguua

SEQ ID NO: 14908 - RNA, 19 nt, Homo sapiens
ucacuugcuugugguguuu

SEQ ID NO: 14909 - RNA, 19 nt, Homo sapiens
ggagaagagagagcacuuu

SEQ ID NO: 14910 - RNA, 19 nt, Homo sapiens
caaaugaguccuugugaac

SEQ ID NO: 14911 - RNA, 19 nt, Homo sapiens
ggauaagucuuuugucauc

SEQ ID NO: 14912 - RNA, 19 nt, Homo sapiens
cagacagaaucacuauuuc

SEQ ID NO: 14913 - RNA, 19 nt, Homo sapiens
gaagggcaccgagggaguu

SEQ ID NO: 14914 - RNA, 19 nt, Homo sapiens
ccagaacaguuggaagugu

SEQ ID NO: 14915 - RNA, 19 nt, Homo sapiens
cugcaaaggucugaguuau

SEQ ID NO: 14916 - RNA, 19 nt, Homo sapiens
ccacgcucaucaucccuuu

SEQ ID NO: 14917 - RNA, 19 nt, Homo sapiens
ucggaucugugguuccuuu

SEQ ID NO: 14918 - RNA, 19 nt, Homo sapiens
ucaaauccucuggaacaua

SEQ ID NO: 14919 - RNA, 19 nt, Homo sapiens
cggcaacgcucuggucauc

SEQ ID NO: 14920 - RNA, 19 nt, Homo sapiens
ggaggaggaggaagagugu

SEQ ID NO: 14921 - RNA, 19 nt, Homo sapiens
caucaaggaggcaaauugu

SEQ ID NO: 14922 - RNA, 19 nt, Homo sapiens
ggggauaagucuuuuguca

SEQ ID NO: 14923 - RNA, 19 nt, Homo sapiens
caccaccugucuuccugua

SEQ ID NO: 14924 - RNA, 19 nt, Homo sapiens
aggaagaaacgaagacuga

SEQ ID NO: 14925 - RNA, 19 nt, Homo sapiens
gagccagccuuccacuuuu

SEQ ID NO: 14926 - RNA, 19 nt, Homo sapiens
ugucugggcuucccuuucu

SEQ ID NO: 14927 - RNA, 19 nt, Homo sapiens
ucacugaacccuguuaucu

SEQ ID NO: 14928 - RNA, 19 nt, Homo sapiens
cgacaugcaggugguguuu

SEQ ID NO: 14929 - RNA, 19 nt, Homo sapiens
ccaguaggcaucuuagcuu

SEQ ID NO: 14930 - RNA, 19 nt, Homo sapiens
uuauuacgcuacaugacaa

SEQ ID NO: 14931 - RNA, 19 nt, Homo sapiens
gaacacacuagagaaccaa

SEQ ID NO: 14932 - RNA, 19 nt, Homo sapiens
gcaacgcucuggucauccu

SEQ ID NO: 14933 - RNA, 19 nt, Homo sapiens
cccauggccucuuccaguu

SEQ ID NO: 14934 - RNA, 19 nt, Homo sapiens
gggaguggcagacagaauc

SEQ ID NO: 14935 - RNA, 19 nt, Homo sapiens
auagcucacugccuacuug

SEQ ID NO: 14936 - RNA, 19 nt, Homo sapiens
ccuguuaucuacaccaucu

SEQ ID NO: 14937 - RNA, 19 nt, Homo sapiens
guuauuacgcuacaugaca

SEQ ID NO: 14938 - RNA, 19 nt, Homo sapiens
ccagaaggaggguguuugu

SEQ ID NO: 14939 - RNA, 19 nt, Homo sapiens
gguccucaguggguuguug

SEQ ID NO: 14940 - RNA, 19 nt, Homo sapiens
ucaaggaggcaaauugucu

SEQ ID NO: 14941 - RNA, 19 nt, Homo sapiens
agacagaaucacuauuuca

SEQ ID NO: 14942 - RNA, 19 nt, Homo sapiens
acucugagcuauuuuauca

SEQ ID NO: 14943 - RNA, 19 nt, Homo sapiens
gaccucuuauugcgacaug

SEQ ID NO: 14944 - RNA, 19 nt, Homo sapiens
gaguaucgcccugggaugu

SEQ ID NO: 14945 - RNA, 19 nt, Homo sapiens
acugaacccuguuaucuac

SEQ ID NO: 14946 - RNA, 19 nt, Homo sapiens
ucaucaaggaggcaaauug

SEQ ID NO: 14947 - RNA, 19 nt, Homo sapiens
ggcaacaccaagaggguuu

SEQ ID NO: 14948 - RNA, 19 nt, Homo sapiens
ggaguggcagacagaauca

SEQ ID NO: 14949 - RNA, 19 nt, Homo sapiens
gccaagaccaggagaagag

SEQ ID NO: 14950 - RNA, 19 nt, Homo sapiens
ucuugccugugaccucuua

SEQ ID NO: 14951 - RNA, 19 nt, Homo sapiens
uuugaaagccagaacaaug

SEQ ID NO: 14952 - RNA, 19 nt, Homo sapiens
ucaccuuccucauucucuu

SEQ ID NO: 14953 - RNA, 19 nt, Homo sapiens
aagaaacgaagacugauca

SEQ ID NO: 14954 - RNA, 19 nt, Homo sapiens
ggaagaaacgaagacugau

SEQ ID NO: 14955 - RNA, 19 nt, Homo sapiens
cccaugcucuccagaccaa

SEQ ID NO: 14956 - RNA, 19 nt, Homo sapiens
uccuguaggccucaucuua

SEQ ID NO: 14957 - RNA, 19 nt, Homo sapiens
ggucauccuggcuguguug

SEQ ID NO: 14958 - RNA, 19 nt, Homo sapiens
gcacccagaacaguuggaa

SEQ ID NO: 14959 - RNA, 19 nt, Homo sapiens
augacaacguuucgacauu

SEQ ID NO: 14960 - RNA, 19 nt, Homo sapiens
gaguuauuacgcuacauga

SEQ ID NO: 14961 - RNA, 19 nt, Homo sapiens
ucccuuuccucuguguuua

SEQ ID NO: 14962 - RNA, 19 nt, Homo sapiens
guaggccucaucuuaggaa

SEQ ID NO: 14963 - RNA, 19 nt, Homo sapiens
cacugaacccuguuaucua

SEQ ID NO: 14964 - RNA, 19 nt, Homo sapiens
cgugcuggcuguggucauu

SEQ ID NO: 14965 - RNA, 19 nt, Homo sapiens
ggaccugcuagauuuggaa

SEQ ID NO: 14966 - RNA, 19 nt, Homo sapiens
ccagauggaccugcuagau

SEQ ID NO: 14967 - RNA, 19 nt, Homo sapiens
gauggaggugguucaaauc

SEQ ID NO: 14968 - RNA, 19 nt, Homo sapiens
ggaucuuucuuugcuccuu

SEQ ID NO: 14969 - RNA, 19 nt, Homo sapiens
uacgcuacaugacaacguu

SEQ ID NO: 14970 - RNA, 19 nt, Homo sapiens
ccuccagcaucggaucuuu

SEQ ID NO: 14971 - RNA, 19 nt, Homo sapiens
gaaagccagaacaauggau

SEQ ID NO: 14972 - RNA, 19 nt, Homo sapiens
uccagaggaugaagcugaa

SEQ ID NO: 14973 - RNA, 19 nt, Homo sapiens
gauggaccugcuagauuug

SEQ ID NO: 14974 - RNA, 19 nt, Homo sapiens
cuucaacauugggccagua

SEQ ID NO: 14975 - RNA, 19 nt, Homo sapiens
ggcaggagcuuggcagaga

SEQ ID NO: 14976 - RNA, 19 nt, Homo sapiens
ggagaaagcaccgacaauc

SEQ ID NO: 14977 - RNA, 19 nt, Homo sapiens
gcaacgugcugguggugau

SEQ ID NO: 14978 - RNA, 19 nt, Homo sapiens
gagaaagcaccgacaaucu

SEQ ID NO: 14979 - RNA, 19 nt, Homo sapiens
gagagcaguggcagaggua

SEQ ID NO: 14980 - RNA, 19 nt, Homo sapiens
agaaagcaccgacaaucuu

SEQ ID NO: 14981 - RNA, 19 nt, Homo sapiens
ggagcuuggcagagagaua

SEQ ID NO: 14982 - RNA, 19 nt, Homo sapiens
gagcuuggcagagagauag

SEQ ID NO: 14983 - RNA, 19 nt, Homo sapiens
gugcaucugugugccauca

SEQ ID NO: 14984 - RNA, 19 nt, Homo sapiens
gcucaacccggucaucuac

SEQ ID NO: 14985 - RNA, 19 nt, Homo sapiens
gcucuucaaguucuucuuc

SEQ ID NO: 14986 - RNA, 19 nt, Homo sapiens
ucaacgacgagaccuggua

SEQ ID NO: 14987 - RNA, 19 nt, Homo sapiens
gcucaucucggccgucauc

SEQ ID NO: 14988 - RNA, 19 nt, Homo sapiens
ccucgucgaucgugcaucu

SEQ ID NO: 14989 - RNA, 19 nt, Homo sapiens
ggcgcucgaugugcuguuu

SEQ ID NO: 14990 - RNA, 19 nt, Homo sapiens
guaccuggcgcucgaugug

SEQ ID NO: 14991 - RNA, 19 nt, Homo sapiens
ccgggaaaguaaaguugga

SEQ ID NO: 14992 - RNA, 19 nt, Homo sapiens
ucaaguucuucuucuggau

SEQ ID NO: 14993 - RNA, 19 nt, Homo sapiens
ccaaaacaaccaaacuauu

SEQ ID NO: 14994 - RNA, 19 nt, Homo sapiens
gcugugaggucaggguuuu

SEQ ID NO: 14995 - RNA, 19 nt, Homo sapiens
gaccaagggcugacuucuc

SEQ ID NO: 14996 - RNA, 19 nt, Homo sapiens
ggccauccuucaagcacau

SEQ ID NO: 14997 - RNA, 19 nt, Homo sapiens
aagcaccgacaaucuuuga

SEQ ID NO: 14998 - RNA, 19 nt, Homo sapiens
cgacgagaccugguacauc

SEQ ID NO: 14999 - RNA, 19 nt, Homo sapiens
cuaaaugggcaagcaagga

SEQ ID NO: 15000 - RNA, 19 nt, Homo sapiens
uggaucggcuacugcaaca

SEQ ID NO: 15001 - RNA, 19 nt, Homo sapiens
ggagaucuguguuuacuua

SEQ ID NO: 15002 - RNA, 19 nt, Homo sapiens
gagaguggcuugcugaugu

SEQ ID NO: 15003 - RNA, 19 nt, Homo sapiens
gauagcaggugaacucgaa

SEQ ID NO: 15004 - RNA, 19 nt, Homo sapiens
gaucuguguuuacuuaaga

SEQ ID NO: 15005 - RNA, 19 nt, Homo sapiens
ccacaauccucgucugaau

SEQ ID NO: 15006 - RNA, 19 nt, Homo sapiens
gcaaugugcuggugaucgu

SEQ ID NO: 15007 - RNA, 19 nt, Homo sapiens
gaggagaucuguguuuacu

SEQ ID NO: 15008 - RNA, 19 nt, Homo sapiens
agaagcaggugaagaagau

SEQ ID NO: 15009 - RNA, 19 nt, Homo sapiens
acgaggagaucuguguuua

SEQ ID NO: 15010 - RNA, 19 nt, Homo sapiens
gggcaugggucugcugaug

SEQ ID NO: 15011 - RNA, 19 nt, Homo sapiens
ggaacgaggagaucugugu

SEQ ID NO: 15012 - RNA, 19 nt, Homo sapiens
ucaccaaccucuucaucau

SEQ ID NO: 15013 - RNA, 19 nt, Homo sapiens
gaacgaggagaucuguguu

SEQ ID NO: 15014 - RNA, 19 nt, Homo sapiens
ggacgacgacgacgacgau

SEQ ID NO: 15015 - RNA, 19 nt, Homo sapiens
caucauggccuucguguac

SEQ ID NO: 15016 - RNA, 19 nt, Homo sapiens
uugcugauguuccuuguug

SEQ ID NO: 15017 - RNA, 19 nt, Homo sapiens
gaguacggcuccuucuucu

SEQ ID NO: 15018 - RNA, 19 nt, Homo sapiens
ucaagacgcugggcaucau

SEQ ID NO: 15019 - RNA, 19 nt, Homo sapiens
cccagaagcaggugaagaa

SEQ ID NO: 15020 - RNA, 19 nt, Homo sapiens
gcaucgagacccugugugu

SEQ ID NO: 15021 - RNA, 19 nt, Homo sapiens
cauccgaggcaaagagaaa

SEQ ID NO: 15022 - RNA, 19 nt, Homo sapiens
gaacucgaagcccacaauc

SEQ ID NO: 15023 - RNA, 19 nt, Homo sapiens
gagacccugugugucauug

SEQ ID NO: 15024 - RNA, 19 nt, Homo sapiens
ggagaguggcuugcugaug

SEQ ID NO: 15025 - RNA, 19 nt, Homo sapiens
gagaucuguguuuacuuaa

SEQ ID NO: 15026 - RNA, 19 nt, Homo sapiens
cagaagcaggugaagaaga

SEQ ID NO: 15027 - RNA, 19 nt, Homo sapiens
ucucggcccugguguccuu

SEQ ID NO: 15028 - RNA, 19 nt, Homo sapiens
agaguggcuugcugauguu

SEQ ID NO: 15029 - RNA, 19 nt, Homo sapiens
acaauccucgucugaauca

SEQ ID NO: 15030 - RNA, 19 nt, Homo sapiens
gcccacaauccucgucuga

SEQ ID NO: 15031 - RNA, 19 nt, Homo sapiens
gcugcgacuucgucaccaa

SEQ ID NO: 15032 - RNA, 19 nt, Homo sapiens
accaaccucuucaucaugu

SEQ ID NO: 15033 - RNA, 19 nt, Homo sapiens
cgacgacgacgacgauguc

SEQ ID NO: 15034 - RNA, 19 nt, Homo sapiens
gcucaccaaccucuucauc

SEQ ID NO: 15035 - RNA, 19 nt, Homo sapiens
gcaucauggccuucgugua

SEQ ID NO: 15036 - RNA, 19 nt, Homo sapiens
ccucggaauccaaggugua

SEQ ID NO: 15037 - RNA, 19 nt, Homo sapiens
gagcaaaggucuaaaguuu

SEQ ID NO: 15038 - RNA, 19 nt, Homo sapiens
gaaccaagccuaugccauu

SEQ ID NO: 15039 - RNA, 19 nt, Homo sapiens
gcauggaauuuguaaguuu

SEQ ID NO: 15040 - RNA, 19 nt, Homo sapiens
caacagaacacuaaacaga

SEQ ID NO: 15041 - RNA, 19 nt, Homo sapiens
cuauuuaacuugaggguaa

SEQ ID NO: 15042 - RNA, 19 nt, Homo sapiens
ccgcagaucuuccaaguuc

SEQ ID NO: 15043 - RNA, 19 nt, Homo sapiens
gaucgcuacuuugccauua

SEQ ID NO: 15044 - RNA, 19 nt, Homo sapiens
ucacagccauugccaaguu

SEQ ID NO: 15045 - RNA, 19 nt, Homo sapiens
acaaagcccucaagacguu

SEQ ID NO: 15046 - RNA, 19 nt, Homo sapiens
gcgauaacauugauucaca

SEQ ID NO: 15047 - RNA, 19 nt, Homo sapiens
gcugguaauuuguaucuga

SEQ ID NO: 15048 - RNA, 19 nt, Homo sapiens
gagcccagauuucaggauu

SEQ ID NO: 15049 - RNA, 19 nt, Homo sapiens
cuaccucacuauucaagua

SEQ ID NO: 15050 - RNA, 19 nt, Homo sapiens
aaaauaaacugcuguguga

SEQ ID NO: 15051 - RNA, 19 nt, Homo sapiens
aaaggcagcuccagaagau

SEQ ID NO: 15052 - RNA, 19 nt, Homo sapiens
gaacggcagcgccuucuug

SEQ ID NO: 15053 - RNA, 19 nt, Homo sapiens
ccauucagaugcacuggua

SEQ ID NO: 15054 - RNA, 19 nt, Homo sapiens
guaucuaccucacuauuca

SEQ ID NO: 15055 - RNA, 19 nt, Homo sapiens
caagggaggaauuguagua

SEQ ID NO: 15056 - RNA, 19 nt, Homo sapiens
ccauguaucuaccucacua

SEQ ID NO: 15057 - RNA, 19 nt, Homo sapiens
ggaccugagucugcuauau

SEQ ID NO: 15058 - RNA, 19 nt, Homo sapiens
gaaguuuacauccuccuaa

SEQ ID NO: 15059 - RNA, 19 nt, Homo sapiens
ccucacuauucaaguauua

SEQ ID NO: 15060 - RNA, 19 nt, Homo sapiens
gaguggauaucacguggaa

SEQ ID NO: 15061 - RNA, 19 nt, Homo sapiens
gaccugagucugcuauauu

SEQ ID NO: 15062 - RNA, 19 nt, Homo sapiens
ccaacuacuucaucacuuc

SEQ ID NO: 15063 - RNA, 19 nt, Homo sapiens
auagagauaugcagaagga

SEQ ID NO: 15064 - RNA, 19 nt, Homo sapiens
guacugugccuagcgauaa

SEQ ID NO: 15065 - RNA, 19 nt, Homo sapiens
gaccugcugugacuucuuc

SEQ ID NO: 15066 - RNA, 19 nt, Homo sapiens
ccaaugagaccugcuguga

SEQ ID NO: 15067 - RNA, 19 nt, Homo sapiens
caacugcuaugccaaugag

SEQ ID NO: 15068 - RNA, 19 nt, Homo sapiens
cgcaguggaucgcuacuuu

SEQ ID NO: 15069 - RNA, 19 nt, Homo sapiens
gccauuacuucaccuuuca

SEQ ID NO: 15070 - RNA, 19 nt, Homo sapiens
gcaaugugcuggucaucac

SEQ ID NO: 15071 - RNA, 19 nt, Homo sapiens
aggagcagcuucaguuguu

SEQ ID NO: 15072 - RNA, 19 nt, Homo sapiens
ggagcagcuucaguuguuu

SEQ ID NO: 15073 - RNA, 19 nt, Homo sapiens
caaaugacucacugcugua

SEQ ID NO: 15074 - RNA, 19 nt, Homo sapiens
ugucaauucugguuucaau

SEQ ID NO: 15075 - RNA, 19 nt, Homo sapiens
guauagagauaugcagaag

SEQ ID NO: 15076 - RNA, 19 nt, Homo sapiens
cgauaacauugauucacaa

SEQ ID NO: 15077 - RNA, 19 nt, Homo sapiens
cugcgcaggucuucuuuga

SEQ ID NO: 15078 - RNA, 19 nt, Homo sapiens
gagcacaaagcccucaaga

SEQ ID NO: 15079 - RNA, 19 nt, Homo sapiens
gaucauggucuucgucuac

SEQ ID NO: 15080 - RNA, 19 nt, Homo sapiens
ugucaggccuuaccuccuu

SEQ ID NO: 15081 - RNA, 19 nt, Homo sapiens
acaguucaguuccucuuug

SEQ ID NO: 15082 - RNA, 19 nt, Homo sapiens
caucguguccuucuacguu

SEQ ID NO: 15083 - RNA, 19 nt, Homo sapiens
uugaguaucucggaccuuu

SEQ ID NO: 15084 - RNA, 19 nt, Homo sapiens
gaacaggagaaagaaaaua

SEQ ID NO: 15085 - RNA, 19 nt, Homo sapiens
ggaaguuuacauccuccua

SEQ ID NO: 15086 - RNA, 19 nt, Homo sapiens
ugcagacggucaccaacua

SEQ ID NO: 15087 - RNA, 19 nt, Homo sapiens
aggaagccaucaacugcua

SEQ ID NO: 15088 - RNA, 19 nt, Homo sapiens
ccuaugccauugccucuuc

SEQ ID NO: 15089 - RNA, 19 nt, Homo sapiens
aaugagaccugcugugacu

SEQ ID NO: 15090 - RNA, 19 nt, Homo sapiens
uggauugugucaggccuua

SEQ ID NO: 15091 - RNA, 19 nt, Homo sapiens
cccuuggacuugaggauuu

SEQ ID NO: 15092 - RNA, 19 nt, Homo sapiens
gaguaucucggaccuuuca

SEQ ID NO: 15093 - RNA, 19 nt, Homo sapiens
accugagucugcuauauuu

SEQ ID NO: 15094 - RNA, 19 nt, Homo sapiens
gacguuaggcaucaucaug

SEQ ID NO: 15095 - RNA, 19 nt, Homo sapiens
ucacuggccugugcugauc

SEQ ID NO: 15096 - RNA, 19 nt, Homo sapiens
gaggguaauaaacuuagaa

SEQ ID NO: 15097 - RNA, 19 nt, Homo sapiens
gugccuagcgauaacauug

SEQ ID NO: 15098 - RNA, 19 nt, Homo sapiens
gguacugugccuagcgaua

SEQ ID NO: 15099 - RNA, 19 nt, Homo sapiens
gauaaccucauccguaagg

SEQ ID NO: 15100 - RNA, 19 nt, Homo sapiens
gggcauggacuccgcagau

SEQ ID NO: 15101 - RNA, 19 nt, Homo sapiens
gcaguggaucgcuacuuug

SEQ ID NO: 15102 - RNA, 19 nt, Homo sapiens
uauugcugcugguaauuug

SEQ ID NO: 15103 - RNA, 19 nt, Homo sapiens
gaacacuaaacagacuauu

SEQ ID NO: 15104 - RNA, 19 nt, Homo sapiens
acagaacacuaaacagacu

SEQ ID NO: 15105 - RNA, 19 nt, Homo sapiens
auaaacugcugugugaaga

SEQ ID NO: 15106 - RNA, 19 nt, Homo sapiens
cgagcaaaggucuaaaguu

SEQ ID NO: 15107 - RNA, 19 nt, Homo sapiens
guaauuuguaucugaagga

SEQ ID NO: 15108 - RNA, 19 nt, Homo sapiens
caucguguuuggcaaugug

SEQ ID NO: 15109 - RNA, 19 nt, Homo sapiens
gcaucaucaugggcacuuu

SEQ ID NO: 15110 - RNA, 19 nt, Homo sapiens
gaggagcagcuucaguugu

SEQ ID NO: 15111 - RNA, 19 nt, Homo sapiens
gaucuuccaaguucugcuu

SEQ ID NO: 15112 - RNA, 19 nt, Homo sapiens
auauauugcugcugguaau

SEQ ID NO: 15113 - RNA, 19 nt, Homo sapiens
guacaguucaguuccucuu

SEQ ID NO: 15114 - RNA, 19 nt, Homo sapiens
ugaggguaauaaacuuaga

SEQ ID NO: 15115 - RNA, 19 nt, Homo sapiens
uaacuugaggguaauaaac

SEQ ID NO: 15116 - RNA, 19 nt, Homo sapiens
ccucauccguaaggaaguu

SEQ ID NO: 15117 - RNA, 19 nt, Homo sapiens
ccucuuccaucguguccuu

SEQ ID NO: 15118 - RNA, 19 nt, Homo sapiens
caucaacugcuaugccaau

SEQ ID NO: 15119 - RNA, 19 nt, Homo sapiens
gcucacacgggguauuuua

SEQ ID NO: 15120 - RNA, 19 nt, Homo sapiens
uaauauauugcugcuggua

SEQ ID NO: 15121 - RNA, 19 nt, Homo sapiens
guggauaucacguggaaca

SEQ ID NO: 15122 - RNA, 19 nt, Homo sapiens
gaagccaucaacugcuaug

SEQ ID NO: 15123 - RNA, 19 nt, Homo sapiens
agagccugcugaccaagaa

SEQ ID NO: 15124 - RNA, 19 nt, Homo sapiens
gauuugaggagcagcuuca

SEQ ID NO: 15125 - RNA, 19 nt, Homo sapiens
cuaugucaauucugguuuc

SEQ ID NO: 15126 - RNA, 19 nt, Homo sapiens
gcuaugucaauucugguuu

SEQ ID NO: 15127 - RNA, 19 nt, Homo sapiens
cguccuggccaucguguuu

SEQ ID NO: 15128 - RNA, 19 nt, Homo sapiens
ggucaccaacuacuucauc

SEQ ID NO: 15129 - RNA, 19 nt, Homo sapiens
gucaccaacuacuucauca

SEQ ID NO: 15130 - RNA, 19 nt, Homo sapiens
ggaauggcuacuccagcaa

SEQ ID NO: 15131 - RNA, 19 nt, Homo sapiens
ggacuccgcagaucuucca

SEQ ID NO: 15132 - RNA, 19 nt, Homo sapiens
aaccaagccuaugccauug

SEQ ID NO: 15133 - RNA, 19 nt, Homo sapiens
gccuagcgauaacauugau

SEQ ID NO: 15134 - RNA, 19 nt, Homo sapiens
caacuacuucaucacuuca

SEQ ID NO: 15135 - RNA, 19 nt, Homo sapiens
ggagaaagaaaauaaacug

SEQ ID NO: 15136 - RNA, 19 nt, Homo sapiens
cuucaucguuaacauugug

SEQ ID NO: 15137 - RNA, 19 nt, Homo sapiens
ggagugagcuugagccuuu

SEQ ID NO: 15138 - RNA, 19 nt, Homo sapiens
ucaaaugucuugugucaua

SEQ ID NO: 15139 - RNA, 19 nt, Homo sapiens
auaagaaggugaaccauua

SEQ ID NO: 15140 - RNA, 19 nt, Homo sapiens
ugacagaggcaguaaauua

SEQ ID NO: 15141 - RNA, 19 nt, Homo sapiens
gaaauccaguugccauuga

SEQ ID NO: 15142 - RNA, 19 nt, Homo sapiens
ggucaaaugucuuguguca

SEQ ID NO: 15143 - RNA, 19 nt, Homo sapiens
gaacagaucccuucuuuuc

SEQ ID NO: 15144 - RNA, 19 nt, Homo sapiens
gcuccaggguucauaagaa

SEQ ID NO: 15145 - RNA, 19 nt, Homo sapiens
ggccuaauccucacucuuu

SEQ ID NO: 15146 - RNA, 19 nt, Homo sapiens
gcccugaacuggcuagguu

SEQ ID NO: 15147 - RNA, 19 nt, Homo sapiens
gcacaggcacaaagcauug

SEQ ID NO: 15148 - RNA, 19 nt, Homo sapiens
ugaccaacccgcugcguua

SEQ ID NO: 15149 - RNA, 19 nt, Homo sapiens
caaaugucuugugucauaa

SEQ ID NO: 15150 - RNA, 19 nt, Homo sapiens
gaugagaccuuaguguucu

SEQ ID NO: 15151 - RNA, 19 nt, Homo sapiens
ggagggauccuuaccaagu

SEQ ID NO: 15152 - RNA, 19 nt, Homo sapiens
gaaaaccucuggccucugu

SEQ ID NO: 15153 - RNA, 19 nt, Homo sapiens
gaucagaaccuguggaaaa

SEQ ID NO: 15154 - RNA, 19 nt, Homo sapiens
gagggauccuuaccaagug

SEQ ID NO: 15155 - RNA, 19 nt, Homo sapiens
gagcuugagccuuugauau

SEQ ID NO: 15156 - RNA, 19 nt, Homo sapiens
aaagagagcuccccugguu

SEQ ID NO: 15157 - RNA, 19 nt, Homo sapiens
auaauccaguggugccuua

SEQ ID NO: 15158 - RNA, 19 nt, Homo sapiens
ggugaaccauuagaacaga

SEQ ID NO: 15159 - RNA, 19 nt, Homo sapiens
cauaagaaggugaaccauu

SEQ ID NO: 15160 - RNA, 19 nt, Homo sapiens
gagagcagcaggguagaaa

SEQ ID NO: 15161 - RNA, 19 nt, Homo sapiens
ucugagagauguuuucuaa

SEQ ID NO: 15162 - RNA, 19 nt, Homo sapiens
gacagaggcaguaaauuag

SEQ ID NO: 15163 - RNA, 19 nt, Homo sapiens
caccuugggucucaucaug

SEQ ID NO: 15164 - RNA, 19 nt, Homo sapiens
ucaacccgcucaucuacug

SEQ ID NO: 15165 - RNA, 19 nt, Homo sapiens
gaccaugaccaacguguuc

SEQ ID NO: 15166 - RNA, 19 nt, Homo sapiens
gaaggugaaccauuagaac

SEQ ID NO: 15167 - RNA, 19 nt, Homo sapiens
ggacaagaagcaacaacuc

SEQ ID NO: 15168 - RNA, 19 nt, Homo sapiens
ugggacagcuagagaagau

SEQ ID NO: 15169 - RNA, 19 nt, Homo sapiens
ggagcuccaggguucauaa

SEQ ID NO: 15170 - RNA, 19 nt, Homo sapiens
uaucucugguucccuuauu

SEQ ID NO: 15171 - RNA, 19 nt, Homo sapiens
caagaagcaacaacucugu

SEQ ID NO: 15172 - RNA, 19 nt, Homo sapiens
aaacccugaugagaccuua

SEQ ID NO: 15173 - RNA, 19 nt, Homo sapiens
gaggcaaccugcuggucau

SEQ ID NO: 15174 - RNA, 19 nt, Homo sapiens
guagaaaagaccaagauuu

SEQ ID NO: 15175 - RNA, 19 nt, Homo sapiens
uggaauggcuccgaucuac

SEQ ID NO: 15176 - RNA, 19 nt, Homo sapiens
uagaaaagaccaagauuug

SEQ ID NO: 15177 - RNA, 19 nt, Homo sapiens
cuuacucccuucccuucua

SEQ ID NO: 15178 - RNA, 19 nt, Homo sapiens
ccaacguguucgugacuuc

SEQ ID NO: 15179 - RNA, 19 nt, Homo sapiens
gacaagaagcaacaacucu

SEQ ID NO: 15180 - RNA, 19 nt, Homo sapiens
gcuagguuaugccaauucu

SEQ ID NO: 15181 - RNA, 19 nt, Homo sapiens
cugaaacucuugaaaucca

SEQ ID NO: 15182 - RNA, 19 nt, Homo sapiens
gcaaccugcuggucaucgu

SEQ ID NO: 15183 - RNA, 19 nt, Homo sapiens
uccugaaacucuugaaauc

SEQ ID NO: 15184 - RNA, 19 nt, Homo sapiens
gcuugagccuuugauaucu

SEQ ID NO: 15185 - RNA, 19 nt, Homo sapiens
ccacuuucccuccguuugu

SEQ ID NO: 15186 - RNA, 19 nt, Homo sapiens
ugccuuacauggugugugu

SEQ ID NO: 15187 - RNA, 19 nt, Homo sapiens
ugaaauccaguugccauug

SEQ ID NO: 15188 - RNA, 19 nt, Homo sapiens
ugaugagaccuuaguguuc

SEQ ID NO: 15189 - RNA, 19 nt, Homo sapiens
gagcuccccugguuccauu

SEQ ID NO: 15190 - RNA, 19 nt, Homo sapiens
ugaaggacaagaagcaaca

SEQ ID NO: 15191 - RNA, 19 nt, Homo sapiens
ucuuaggccugaaggacaa

SEQ ID NO: 15192 - RNA, 19 nt, Homo sapiens
agaaggugaaccauuagaa

SEQ ID NO: 15193 - RNA, 19 nt, Homo sapiens
ccuccuccgucuccuucua

SEQ ID NO: 15194 - RNA, 19 nt, Homo sapiens
ugcagucagugagugcuua

SEQ ID NO: 15195 - RNA, 19 nt, Homo sapiens
cggcuugccugugcaguca

SEQ ID NO: 15196 - RNA, 19 nt, Homo sapiens
ugaacuggcuagguuaugc

SEQ ID NO: 15197 - RNA, 19 nt, Homo sapiens
cggcuuuccuugcccugaa

SEQ ID NO: 15198 - RNA, 19 nt, Homo sapiens
gaauggcuccgaucuaccu

SEQ ID NO: 15199 - RNA, 19 nt, Homo sapiens
ugacgacugggccauguga

SEQ ID NO: 15200 - RNA, 19 nt, Homo sapiens
uuccuaaucuucaucaaac

SEQ ID NO: 15201 - RNA, 19 nt, Homo sapiens
cugaugagaccuuaguguu

SEQ ID NO: 15202 - RNA, 19 nt, Homo sapiens
gaaggacaagaagcaacaa

SEQ ID NO: 15203 - RNA, 19 nt, Homo sapiens
ggcacaggcacaaagcauu

SEQ ID NO: 15204 - RNA, 19 nt, Homo sapiens
gaucccuucuuuuccuuuu

SEQ ID NO: 15205 - RNA, 19 nt, Homo sapiens
uaagaaggugaaccauuag

SEQ ID NO: 15206 - RNA, 19 nt, Homo sapiens
ccucacagcagugucagaa

SEQ ID NO: 15207 - RNA, 19 nt, Homo sapiens
ccgagacuccagaccauga

SEQ ID NO: 15208 - RNA, 19 nt, Homo sapiens
gcugugccuucgccuccaa

SEQ ID NO: 15209 - RNA, 19 nt, Homo sapiens
ugagcuugagccuuugaua

SEQ ID NO: 15210 - RNA, 19 nt, Homo sapiens
ucacuuuagccauggaaug

SEQ ID NO: 15211 - RNA, 19 nt, Homo sapiens
caguugccauugaguagca

SEQ ID NO: 15212 - RNA, 19 nt, Homo sapiens
ccuuauuacugcucucaag

SEQ ID NO: 15213 - RNA, 19 nt, Homo sapiens
agugagugcuuagggcaaa

SEQ ID NO: 15214 - RNA, 19 nt, Homo sapiens
gacacucuacccuccagaa

SEQ ID NO: 15215 - RNA, 19 nt, Homo sapiens
gcacagggauccgacuuga

SEQ ID NO: 15216 - RNA, 19 nt, Homo sapiens
ggaagaauguggagcucaa

SEQ ID NO: 15217 - RNA, 19 nt, Homo sapiens
gcagugucaugcagaagua

SEQ ID NO: 15218 - RNA, 19 nt, Homo sapiens
gcuggaggcucgcaagaaa

SEQ ID NO: 15219 - RNA, 19 nt, Homo sapiens
gcaagaaagccaagaacaa

SEQ ID NO: 15220 - RNA, 19 nt, Homo sapiens
gcaagugccugcuccucaa

SEQ ID NO: 15221 - RNA, 19 nt, Homo sapiens
ugacaguccucuccaccua

SEQ ID NO: 15222 - RNA, 19 nt, Homo sapiens
augaggagaucaagaagua

SEQ ID NO: 15223 - RNA, 19 nt, Homo sapiens
ggaauucuaugaggagauc

SEQ ID NO: 15224 - RNA, 19 nt, Homo sapiens
acaagcagcugggccauga

SEQ ID NO: 15225 - RNA, 19 nt, Homo sapiens
gcacaagaccaaagacaag

SEQ ID NO: 15226 - RNA, 19 nt, Homo sapiens
ggugcaugcucuucaaguu

SEQ ID NO: 15227 - RNA, 19 nt, Homo sapiens
cagcgugcaucgcaucauu

SEQ ID NO: 15228 - RNA, 19 nt, Homo sapiens
gggagaucuucgacucaua

SEQ ID NO: 15229 - RNA, 19 nt, Homo sapiens
gaucuucgacucauacauc

SEQ ID NO: 15230 - RNA, 19 nt, Homo sapiens
gggcaaggacugcaucaug

SEQ ID NO: 15231 - RNA, 19 nt, Homo sapiens
caagaaagccaagaacaag

SEQ ID NO: 15232 - RNA, 19 nt, Homo sapiens
gggacguguuccagaaauu

SEQ ID NO: 15233 - RNA, 19 nt, Homo sapiens
ggugggaaacaguucauuu

SEQ ID NO: 15234 - RNA, 19 nt, Homo sapiens
gaagccagccaacauccuu

SEQ ID NO: 15235 - RNA, 19 nt, Homo sapiens
ggcaagauguacgccauga

SEQ ID NO: 15236 - RNA, 19 nt, Homo sapiens
ggccgacgccuucgacauu

SEQ ID NO: 15237 - RNA, 19 nt, Homo sapiens
ggaaacaguucauuuugca

SEQ ID NO: 15238 - RNA, 19 nt, Homo sapiens
caagauccgcggugggaaa

SEQ ID NO: 15239 - RNA, 19 nt, Homo sapiens
gcucgcaucccuucucgaa

SEQ ID NO: 15240 - RNA, 19 nt, Homo sapiens
ccaaagacaagcaugagau

SEQ ID NO: 15241 - RNA, 19 nt, Homo sapiens
uuccagaaauucauugaga

SEQ ID NO: 15242 - RNA, 19 nt, Homo sapiens
aaaaugagacuaugcguuu

SEQ ID NO: 15243 - RNA, 19 nt, Homo sapiens
ggacugcccauucauuguc

SEQ ID NO: 15244 - RNA, 19 nt, Homo sapiens
ggccugaggucucgcugau

SEQ ID NO: 15245 - RNA, 19 nt, Homo sapiens
gggcguuucuuugccgauu

SEQ ID NO: 15246 - RNA, 19 nt, Homo sapiens
gcagcugggccaugaggaa

SEQ ID NO: 15247 - RNA, 19 nt, Homo sapiens
gggcucaggaggugaaaga

SEQ ID NO: 15248 - RNA, 19 nt, Homo sapiens
caagauguacgccaugaag

SEQ ID NO: 15249 - RNA, 19 nt, Homo sapiens
ucauugagagcgauaaguu

SEQ ID NO: 15250 - RNA, 19 nt, Homo sapiens
ggacguguuccagaaauuc

SEQ ID NO: 15251 - RNA, 19 nt, Homo sapiens
gaucaagaaguacgagaag

SEQ ID NO: 15252 - RNA, 19 nt, Homo sapiens
ucuaugaggagaucaagaa

SEQ ID NO: 15253 - RNA, 19 nt, Homo sapiens
gccugugacuucuccaaga

SEQ ID NO: 15254 - RNA, 19 nt, Homo sapiens
gaggaggugccaacagugu

SEQ ID NO: 15255 - RNA, 19 nt, Homo sapiens
acagggauccgacuugaau

SEQ ID NO: 15256 - RNA, 19 nt, Homo sapiens
ugcccaagaugaagaacaa

SEQ ID NO: 15257 - RNA, 19 nt, Homo sapiens
gaagaucuuuucccagaag

SEQ ID NO: 15258 - RNA, 19 nt, Homo sapiens
caaagacaagcaugagauc

SEQ ID NO: 15259 - RNA, 19 nt, Homo sapiens
ggagaucuucgacucauac

SEQ ID NO: 15260 - RNA, 19 nt, Homo sapiens
gcucaggaggugaaagaga

SEQ ID NO: 15261 - RNA, 19 nt, Homo sapiens
gaugucaaccggagauugg

SEQ ID NO: 15262 - RNA, 19 nt, Homo sapiens
ccaccgccauggcuuccaa

SEQ ID NO: 15263 - RNA, 19 nt, Homo sapiens
cgacgugagcuaccugaug

SEQ ID NO: 15264 - RNA, 19 nt, Homo sapiens
caaaaggaaucaaguuacu

SEQ ID NO: 15265 - RNA, 19 nt, Homo sapiens
gcaagauguacgccaugaa

SEQ ID NO: 15266 - RNA, 19 nt, Homo sapiens
ggcccuugguggaauucua

SEQ ID NO: 15267 - RNA, 19 nt, Homo sapiens
ucugugggcugcacuugug

SEQ ID NO: 15268 - RNA, 19 nt, Homo sapiens
ucgaugaggaggacacaaa

SEQ ID NO: 15269 - RNA, 19 nt, Homo sapiens
cgacauuggcuccuucgau

SEQ ID NO: 15270 - RNA, 19 nt, Homo sapiens
gugcaugcucuucaaguug

SEQ ID NO: 15271 - RNA, 19 nt, Homo sapiens
ugagagcgauaaguucaca

SEQ ID NO: 15272 - RNA, 19 nt, Homo sapiens
ccaggcccuugguggaauu

SEQ ID NO: 15273 - RNA, 19 nt, Homo sapiens
aggaggaggugccaacagu

SEQ ID NO: 15274 - RNA, 19 nt, Homo sapiens
cauccuggcccaucagugu

SEQ ID NO: 15275 - RNA, 19 nt, Homo sapiens
ggagcucuaccgcaacuuc

SEQ ID NO: 15276 - RNA, 19 nt, Homo sapiens
cacaaaaggaaucaaguua

SEQ ID NO: 15277 - RNA, 19 nt, Homo sapiens
gccgacgccuucgacauug

SEQ ID NO: 15278 - RNA, 19 nt, Homo sapiens
agaagggcguggccuacga

SEQ ID NO: 15279 - RNA, 19 nt, Homo sapiens
cuccggagguccugcagaa

SEQ ID NO: 15280 - RNA, 19 nt, Homo sapiens
gaggggacguguuccagaa

SEQ ID NO: 15281 - RNA, 19 nt, Homo sapiens
ggcguuucuuugccgauuu

SEQ ID NO: 15282 - RNA, 19 nt, Homo sapiens
gagcuggugcaguggaaga

SEQ ID NO: 15283 - RNA, 19 nt, Homo sapiens
cagcgggugcccaagauga

SEQ ID NO: 15284 - RNA, 19 nt, Homo sapiens
agaccaaagacaagcauga

SEQ ID NO: 15285 - RNA, 19 nt, Homo sapiens
acauccaccugaccaugaa

SEQ ID NO: 15286 - RNA, 19 nt, Homo sapiens
agccauacaucgaagagau

SEQ ID NO: 15287 - RNA, 19 nt, Homo sapiens
acagugaucaggagcucua

SEQ ID NO: 15288 - RNA, 19 nt, Homo sapiens
ccauacaucgaagagauuu

SEQ ID NO: 15289 - RNA, 19 nt, Homo sapiens
ggaugucaaccggagauug

SEQ ID NO: 15290 - RNA, 19 nt, Homo sapiens
gcugacaugcgcuucuaug

SEQ ID NO: 15291 - RNA, 19 nt, Homo sapiens
gccauacaucgaagagauu

SEQ ID NO: 15292 - RNA, 19 nt, Homo sapiens
gaugaugccacaccaagcu

SEQ ID NO: 15293 - RNA, 19 nt, Homo sapiens
caggagcucuaccgcaacu

SEQ ID NO: 15294 - RNA, 19 nt, Homo sapiens
ggcagauggucuucuugca

SEQ ID NO: 15295 - RNA, 19 nt, Homo sapiens
gcccauucauugucugcau

SEQ ID NO: 15296 - RNA, 19 nt, Homo sapiens
gauaaguucacacgguuuu

SEQ ID NO: 15297 - RNA, 19 nt, Homo sapiens
gcacagugucugggugauc

SEQ ID NO: 15298 - RNA, 19 nt, Homo sapiens
uggaggagacgcagaucaa

SEQ ID NO: 15299 - RNA, 19 nt, Homo sapiens
gccaggcccuugguggaau

SEQ ID NO: 15300 - RNA, 19 nt, Homo sapiens
aggcugacaugcgcuucua

SEQ ID NO: 15301 - RNA, 19 nt, Homo sapiens
caucgaagagauuugucaa

SEQ ID NO: 15302 - RNA, 19 nt, Homo sapiens
gauccgcggugggaaacag

SEQ ID NO: 15303 - RNA, 19 nt, Homo sapiens
caugaagugccuggacaaa

SEQ ID NO: 15304 - RNA, 19 nt, Homo sapiens
gcaaugaaaugcuuagaua

SEQ ID NO: 15305 - RNA, 19 nt, Homo sapiens
ccaaauagaugcuggguua

SEQ ID NO: 15306 - RNA, 19 nt, Homo sapiens
gaaauaaccuuugacaaga

SEQ ID NO: 15307 - RNA, 19 nt, Homo sapiens
gaaacaaggagaaacauua

SEQ ID NO: 15308 - RNA, 19 nt, Homo sapiens
ggagaaacauuagcuuuaa

SEQ ID NO: 15309 - RNA, 19 nt, Homo sapiens
gauauuggcucauuugaug

SEQ ID NO: 15310 - RNA, 19 nt, Homo sapiens
ggauuaagcuacuugauug

SEQ ID NO: 15311 - RNA, 19 nt, Homo sapiens
ggaaagauuuacagugauu

SEQ ID NO: 15312 - RNA, 19 nt, Homo sapiens
caagugacaucaacucuuu

SEQ ID NO: 15313 - RNA, 19 nt, Homo sapiens
ucucaggucucgacaauua

SEQ ID NO: 15314 - RNA, 19 nt, Homo sapiens
caaauauucucuuggauga

SEQ ID NO: 15315 - RNA, 19 nt, Homo sapiens
gaagauauuucugcacuug

SEQ ID NO: 15316 - RNA, 19 nt, Homo sapiens
ggagugugaugcagaagua

SEQ ID NO: 15317 - RNA, 19 nt, Homo sapiens
gcagaagucgacaaauuua

SEQ ID NO: 15318 - RNA, 19 nt, Homo sapiens
uuaaagauguucaguguug

SEQ ID NO: 15319 - RNA, 19 nt, Homo sapiens
gaacagcaacggccucuga

SEQ ID NO: 15320 - RNA, 19 nt, Homo sapiens
gaacuucccuuuggucauc

SEQ ID NO: 15321 - RNA, 19 nt, Homo sapiens
ccaaaaggguccauuauuu

SEQ ID NO: 15322 - RNA, 19 nt, Homo sapiens
cagcaugucuacuuacaaa

SEQ ID NO: 15323 - RNA, 19 nt, Homo sapiens
gaagaccgccuuugcagaa

SEQ ID NO: 15324 - RNA, 19 nt, Homo sapiens
gcagagagaaaugaaauaa

SEQ ID NO: 15325 - RNA, 19 nt, Homo sapiens
gcugaugccuuugauauug

SEQ ID NO: 15326 - RNA, 19 nt, Homo sapiens
caaagucauuuauccaaga

SEQ ID NO: 15327 - RNA, 19 nt, Homo sapiens
gauguucaguguuggguaa

SEQ ID NO: 15328 - RNA, 19 nt, Homo sapiens
gaagaaagaguugaacgaa

SEQ ID NO: 15329 - RNA, 19 nt, Homo sapiens
cagcaaauauucucuugga

SEQ ID NO: 15330 - RNA, 19 nt, Homo sapiens
gaaguaccuugcagagaga

SEQ ID NO: 15331 - RNA, 19 nt, Homo sapiens
ugagagugauccagaguuu

SEQ ID NO: 15332 - RNA, 19 nt, Homo sapiens
gggaaggacuguauuaugc

SEQ ID NO: 15333 - RNA, 19 nt, Homo sapiens
ucacagcccuuucagacaa

SEQ ID NO: 15334 - RNA, 19 nt, Homo sapiens
ugaggcaucugaucuauuc

SEQ ID NO: 15335 - RNA, 19 nt, Homo sapiens
gaacauggacacgcaagaa

SEQ ID NO: 15336 - RNA, 19 nt, Homo sapiens
gaacacguacaaagucauu

SEQ ID NO: 15337 - RNA, 19 nt, Homo sapiens
gguuaacuguguauauuga

SEQ ID NO: 15338 - RNA, 19 nt, Homo sapiens
caaagacaagcaugaaauu

SEQ ID NO: 15339 - RNA, 19 nt, Homo sapiens
agacuguccuuucauugua

SEQ ID NO: 15340 - RNA, 19 nt, Homo sapiens
ugaaauaaccuuugacaag

SEQ ID NO: 15341 - RNA, 19 nt, Homo sapiens
cauaagaguuacuuugcaa

SEQ ID NO: 15342 - RNA, 19 nt, Homo sapiens
ccacguauuugucccauuc

SEQ ID NO: 15343 - RNA, 19 nt, Homo sapiens
ggagacauaucaguaaugg

SEQ ID NO: 15344 - RNA, 19 nt, Homo sapiens
accaagaacucuacaagaa

SEQ ID NO: 15345 - RNA, 19 nt, Homo sapiens
gaggauaccaaagggauua

SEQ ID NO: 15346 - RNA, 19 nt, Homo sapiens
gcaugaaauugaccgaaug

SEQ ID NO: 15347 - RNA, 19 nt, Homo sapiens
gaagucgacaaauuuauga

SEQ ID NO: 15348 - RNA, 19 nt, Homo sapiens
gcaguuauuuugagaguuu

SEQ ID NO: 15349 - RNA, 19 nt, Homo sapiens
caucugcccugugaaguuu

SEQ ID NO: 15350 - RNA, 19 nt, Homo sapiens
gaaugaaugugucaaaaug

SEQ ID NO: 15351 - RNA, 19 nt, Homo sapiens
uuggaaagauuuacaguga

SEQ ID NO: 15352 - RNA, 19 nt, Homo sapiens
caauuugucuugcaaugug

SEQ ID NO: 15353 - RNA, 19 nt, Homo sapiens
gggauuaagcuacuugauu

SEQ ID NO: 15354 - RNA, 19 nt, Homo sapiens
agaaucauguugucucuug

SEQ ID NO: 15355 - RNA, 19 nt, Homo sapiens
uugcagaagucgacaaauu

SEQ ID NO: 15356 - RNA, 19 nt, Homo sapiens
guucacauccuuucucaaa

SEQ ID NO: 15357 - RNA, 19 nt, Homo sapiens
caaaauggguuaacugugu

SEQ ID NO: 15358 - RNA, 19 nt, Homo sapiens
guaaaugcagacacagaua

SEQ ID NO: 15359 - RNA, 19 nt, Homo sapiens
gauuugcacuaccaccuuu

SEQ ID NO: 15360 - RNA, 19 nt, Homo sapiens
gguaacagauugcccuaag

SEQ ID NO: 15361 - RNA, 19 nt, Homo sapiens
guggaagaaacucaaauua

SEQ ID NO: 15362 - RNA, 19 nt, Homo sapiens
gaaugacggacacguacua

SEQ ID NO: 15363 - RNA, 19 nt, Homo sapiens
acauuugucugcauuagaa

SEQ ID NO: 15364 - RNA, 19 nt, Homo sapiens
uaaaugcagacacagauaa

SEQ ID NO: 15365 - RNA, 19 nt, Homo sapiens
caagaacucuacaagaacu

SEQ ID NO: 15366 - RNA, 19 nt, Homo sapiens
ggaaagcagacacuggaaa

SEQ ID NO: 15367 - RNA, 19 nt, Homo sapiens
aaggguccauuauuucaua

SEQ ID NO: 15368 - RNA, 19 nt, Homo sapiens
aagaaagaguugaacgaaa

SEQ ID NO: 15369 - RNA, 19 nt, Homo sapiens
uacaagaacuucccuuugg

SEQ ID NO: 15370 - RNA, 19 nt, Homo sapiens
caaugcugcugaugccuuu

SEQ ID NO: 15371 - RNA, 19 nt, Homo sapiens
uuacagugauucugaagga

SEQ ID NO: 15372 - RNA, 19 nt, Homo sapiens
gcacuucgcaacugacuuc

SEQ ID NO: 15373 - RNA, 19 nt, Homo sapiens
agaaagaguugaacgaaac

SEQ ID NO: 15374 - RNA, 19 nt, Homo sapiens
ggaagaaagaguugaacga

SEQ ID NO: 15375 - RNA, 19 nt, Homo sapiens
ccaaauagacuugaaugga

SEQ ID NO: 15376 - RNA, 19 nt, Homo sapiens
ccaaagggauuaagcuacu

SEQ ID NO: 15377 - RNA, 19 nt, Homo sapiens
gaacugaagucccuuuugg

SEQ ID NO: 15378 - RNA, 19 nt, Homo sapiens
cgccaaagcucgccaacau

SEQ ID NO: 15379 - RNA, 19 nt, Homo sapiens
uaacuugacaucguaauug

SEQ ID NO: 15380 - RNA, 19 nt, Homo sapiens
ccaaagacaagcaugaaau

SEQ ID NO: 15381 - RNA, 19 nt, Homo sapiens
aauagaugcuggguuauga

SEQ ID NO: 15382 - RNA, 19 nt, Homo sapiens
uauggaaagugacaaguuc

SEQ ID NO: 15383 - RNA, 19 nt, Homo sapiens
acacguacaaagucauuua

SEQ ID NO: 15384 - RNA, 19 nt, Homo sapiens
gauuuacagugauucugaa

SEQ ID NO: 15385 - RNA, 19 nt, Homo sapiens
gcacuaccaccuuucacaa

SEQ ID NO: 15386 - RNA, 19 nt, Homo sapiens
cuucgcaacugacuucuug

SEQ ID NO: 15387 - RNA, 19 nt, Homo sapiens
cagauugcccuaagcauug

SEQ ID NO: 15388 - RNA, 19 nt, Homo sapiens
cuaugaaccuagaacuuga

SEQ ID NO: 15389 - RNA, 19 nt, Homo sapiens
gaagagauaaaggaauaug

SEQ ID NO: 15390 - RNA, 19 nt, Homo sapiens
uggguuaacuguguauauu

SEQ ID NO: 15391 - RNA, 19 nt, Homo sapiens
gaccaagaacucuacaaga

SEQ ID NO: 15392 - RNA, 19 nt, Homo sapiens
agaaggagaugcgguuuua

SEQ ID NO: 15393 - RNA, 19 nt, Homo sapiens
aggagaaacauuagcuuua

SEQ ID NO: 15394 - RNA, 19 nt, Homo sapiens
gaggaaugaaugugucaaa

SEQ ID NO: 15395 - RNA, 19 nt, Homo sapiens
agacauaucaguaauggau

SEQ ID NO: 15396 - RNA, 19 nt, Homo sapiens
ccuaagcauugccacauau

SEQ ID NO: 15397 - RNA, 19 nt, Homo sapiens
gcaacuuggccacgaagaa

SEQ ID NO: 15398 - RNA, 19 nt, Homo sapiens
agaaguaacggaaacaguu

SEQ ID NO: 15399 - RNA, 19 nt, Homo sapiens
gccagcaaauauucucuug

SEQ ID NO: 15400 - RNA, 19 nt, Homo sapiens
uuugagaguuuggaagaua

SEQ ID NO: 15401 - RNA, 19 nt, Homo sapiens
ccacauauucugucuaguc

SEQ ID NO: 15402 - RNA, 19 nt, Homo sapiens
ucccugggcugcaugcuuu

SEQ ID NO: 15403 - RNA, 19 nt, Homo sapiens
gagacuguccuuucauugu

SEQ ID NO: 15404 - RNA, 19 nt, Homo sapiens
gaacauuucugaaggauug

SEQ ID NO: 15405 - RNA, 19 nt, Homo sapiens
gaacauagacuucaagaug

SEQ ID NO: 15406 - RNA, 19 nt, Homo sapiens
gaacguugcugcagucuug

SEQ ID NO: 15407 - RNA, 19 nt, Homo sapiens
caagugcgaugccauauaa

SEQ ID NO: 15408 - RNA, 19 nt, Homo sapiens
uaagagagcuuucaucauc

SEQ ID NO: 15409 - RNA, 19 nt, Homo sapiens
guacagcacuuucuucuuc

SEQ ID NO: 15410 - RNA, 19 nt, Homo sapiens
ggaagagaauuaaacgaaa

SEQ ID NO: 15411 - RNA, 19 nt, Homo sapiens
gaaggugaaagcagaauua

SEQ ID NO: 15412 - RNA, 19 nt, Homo sapiens
gcaggcagcuucugugguu

SEQ ID NO: 15413 - RNA, 19 nt, Homo sapiens
gaacaaauccaggagauga

SEQ ID NO: 15414 - RNA, 19 nt, Homo sapiens
gaaguugacucugcucuug

SEQ ID NO: 15415 - RNA, 19 nt, Homo sapiens
gagaugugcuucguguuua

SEQ ID NO: 15416 - RNA, 19 nt, Homo sapiens
gggaaacguugcugucuuu

SEQ ID NO: 15417 - RNA, 19 nt, Homo sapiens
gagaaacguuuacgacaug

SEQ ID NO: 15418 - RNA, 19 nt, Homo sapiens
caaagagcguugaaguuga

SEQ ID NO: 15419 - RNA, 19 nt, Homo sapiens
ggagguagccgccaggauu

SEQ ID NO: 15420 - RNA, 19 nt, Homo sapiens
ggagaugugcuucguguuu

SEQ ID NO: 15421 - RNA, 19 nt, Homo sapiens
agacaauacugacuugauu

SEQ ID NO: 15422 - RNA, 19 nt, Homo sapiens
ggugaaagcagaauuaugu

SEQ ID NO: 15423 - RNA, 19 nt, Homo sapiens
uaucacagaugaacaaauc

SEQ ID NO: 15424 - RNA, 19 nt, Homo sapiens
gaacgcacacuggaugaua

SEQ ID NO: 15425 - RNA, 19 nt, Homo sapiens
gggcagacauauacacgaa

SEQ ID NO: 15426 - RNA, 19 nt, Homo sapiens
ugaauacgcugcagaacau

SEQ ID NO: 15427 - RNA, 19 nt, Homo sapiens
ccauggugcuuuccuguuu

SEQ ID NO: 15428 - RNA, 19 nt, Homo sapiens
cgagaauuguuaccuuaaa

SEQ ID NO: 15429 - RNA, 19 nt, Homo sapiens
ggagauggaggaacccuuu

SEQ ID NO: 15430 - RNA, 19 nt, Homo sapiens
aaucaaaccuggagaacau

SEQ ID NO: 15431 - RNA, 19 nt, Homo sapiens
acucugcucuugcauagua

SEQ ID NO: 15432 - RNA, 19 nt, Homo sapiens
aaacguugcugucuuugga

SEQ ID NO: 15433 - RNA, 19 nt, Homo sapiens
gacaauacugacuugauua

SEQ ID NO: 15434 - RNA, 19 nt, Homo sapiens
guuaauugcugaggcauga

SEQ ID NO: 15435 - RNA, 19 nt, Homo sapiens
gagccagucuacccacauu

SEQ ID NO: 15436 - RNA, 19 nt, Homo sapiens
ggagguguauccccuguua

SEQ ID NO: 15437 - RNA, 19 nt, Homo sapiens
gggcaucagugcacaagau

SEQ ID NO: 15438 - RNA, 19 nt, Homo sapiens
caagauggcagcugaggaa

SEQ ID NO: 15439 - RNA, 19 nt, Homo sapiens
uccaggagaugaaaucaaa

SEQ ID NO: 15440 - RNA, 19 nt, Homo sapiens
gcucuugcauaguaaaugu

SEQ ID NO: 15441 - RNA, 19 nt, Homo sapiens
gacaagauggugacagaaa

SEQ ID NO: 15442 - RNA, 19 nt, Homo sapiens
gcacagcugaccacaguug

SEQ ID NO: 15443 - RNA, 19 nt, Homo sapiens
cagcaucuguccagugguu

SEQ ID NO: 15444 - RNA, 19 nt, Homo sapiens
gagaugaccauaagguaga

SEQ ID NO: 15445 - RNA, 19 nt, Homo sapiens
acaaagagcguugaaguug

SEQ ID NO: 15446 - RNA, 19 nt, Homo sapiens
aauuaugucuguagaguug

SEQ ID NO: 15447 - RNA, 19 nt, Homo sapiens
gcaggugcagagauucuua

SEQ ID NO: 15448 - RNA, 19 nt, Homo sapiens
gcucaagugcgaugccaua

SEQ ID NO: 15449 - RNA, 19 nt, Homo sapiens
uggcaaaccucaaggagau

SEQ ID NO: 15450 - RNA, 19 nt, Homo sapiens
ugagggagaugaccauaag

SEQ ID NO: 15451 - RNA, 19 nt, Homo sapiens
cauuagguuucacacauuu

SEQ ID NO: 15452 - RNA, 19 nt, Homo sapiens
aaacaaagagcguugaagu

SEQ ID NO: 15453 - RNA, 19 nt, Homo sapiens
uaccgcagauacuauauug

SEQ ID NO: 15454 - RNA, 19 nt, Homo sapiens
ugccaaagcuugccagagu

SEQ ID NO: 15455 - RNA, 19 nt, Homo sapiens
ugaggaagagaaacguuua

SEQ ID NO: 15456 - RNA, 19 nt, Homo sapiens
ggaaucccaugcguucaga

SEQ ID NO: 15457 - RNA, 19 nt, Homo sapiens
gagcagacauuggguuugc

SEQ ID NO: 15458 - RNA, 19 nt, Homo sapiens
ucacagggcagacauauac

SEQ ID NO: 15459 - RNA, 19 nt, Homo sapiens
ugacucugcucuugcauag

SEQ ID NO: 15460 - RNA, 19 nt, Homo sapiens
gcagacauauacacgaaaa

SEQ ID NO: 15461 - RNA, 19 nt, Homo sapiens
cacauuagguuucacacau

SEQ ID NO: 15462 - RNA, 19 nt, Homo sapiens
gguauaaauuccggacaug

SEQ ID NO: 15463 - RNA, 19 nt, Homo sapiens
ccgcagauacuauauugaa

SEQ ID NO: 15464 - RNA, 19 nt, Homo sapiens
caagauuugcaccgacaua

SEQ ID NO: 15465 - RNA, 19 nt, Homo sapiens
caucagugcacaagauuug

SEQ ID NO: 15466 - RNA, 19 nt, Homo sapiens
gaaaaggcaggauuuaaga

SEQ ID NO: 15467 - RNA, 19 nt, Homo sapiens
gauggcagcugaggaagag

SEQ ID NO: 15468 - RNA, 19 nt, Homo sapiens
cucgagaauuguuaccuua

SEQ ID NO: 15469 - RNA, 19 nt, Homo sapiens
ccagguugaugccuacuuc

SEQ ID NO: 15470 - RNA, 19 nt, Homo sapiens
gggagaugaccauaaggua

SEQ ID NO: 15471 - RNA, 19 nt, Homo sapiens
agagaaacguuuacgacau

SEQ ID NO: 15472 - RNA, 19 nt, Homo sapiens
guaauugaacggcgcauuc

SEQ ID NO: 15473 - RNA, 19 nt, Homo sapiens
uggaagagaauuaaacgaa

SEQ ID NO: 15474 - RNA, 19 nt, Homo sapiens
ccacagagaacaucaucau

SEQ ID NO: 15475 - RNA, 19 nt, Homo sapiens
ucaagugcgaugccauaua

SEQ ID NO: 15476 - RNA, 19 nt, Homo sapiens
acauuagguuucacacauu

SEQ ID NO: 15477 - RNA, 19 nt, Homo sapiens
ggaagagaaacguuuacga

SEQ ID NO: 15478 - RNA, 19 nt, Homo sapiens
gaauuaugucuguagaguu

SEQ ID NO: 15479 - RNA, 19 nt, Homo sapiens
cugcacagcugaccacagu

SEQ ID NO: 15480 - RNA, 19 nt, Homo sapiens
gagaacauagacuucaaga

SEQ ID NO: 15481 - RNA, 19 nt, Homo sapiens
agaauuaugucuguagagu

SEQ ID NO: 15482 - RNA, 19 nt, Homo sapiens
uagaguuggaagagaauua

SEQ ID NO: 15483 - RNA, 19 nt, Homo sapiens
cccagcaggugcagagauu

SEQ ID NO: 15484 - RNA, 19 nt, Homo sapiens
gagacaauacugacuugau

SEQ ID NO: 15485 - RNA, 19 nt, Homo sapiens
ugaaaucaaaccuggagaa

SEQ ID NO: 15486 - RNA, 19 nt, Homo sapiens
gagcguauccagguugaug

SEQ ID NO: 15487 - RNA, 19 nt, Homo sapiens
cauagagcguauccagguu

SEQ ID NO: 15488 - RNA, 19 nt, Homo sapiens
cauaugaaagcgugaugaa

SEQ ID NO: 15489 - RNA, 19 nt, Homo sapiens
gagguagccgccaggauug

SEQ ID NO: 15490 - RNA, 19 nt, Homo sapiens
ccucgagaauuguuaccuu

SEQ ID NO: 15491 - RNA, 19 nt, Homo sapiens
uauuuuaccucgagaauug

SEQ ID NO: 15492 - RNA, 19 nt, Homo sapiens
gauggaggaacccuuugaa

SEQ ID NO: 15493 - RNA, 19 nt, Homo sapiens
cgacuuugcuaaggaacga

SEQ ID NO: 15494 - RNA, 19 nt, Homo sapiens
uggcucacgugcacacauu

SEQ ID NO: 15495 - RNA, 19 nt, Homo sapiens
acauuggguuugccuauca

SEQ ID NO: 15496 - RNA, 19 nt, Homo sapiens
guuucucagucucacauuu

SEQ ID NO: 15497 - RNA, 19 nt, Homo sapiens
ccucuugccucccgcuaug

SEQ ID NO: 15498 - RNA, 19 nt, Homo sapiens
uugacaagauggugacaga

SEQ ID NO: 15499 - RNA, 19 nt, Homo sapiens
ccaaagcuugccagaguga

SEQ ID NO: 15500 - RNA, 19 nt, Homo sapiens
uacuggauccuucuucuuu

SEQ ID NO: 15501 - RNA, 19 nt, Homo sapiens
gcaagagcugccuuucaug

SEQ ID NO: 15502 - RNA, 19 nt, Homo sapiens
acauacgccuccuggcaaa

SEQ ID NO: 15503 - RNA, 19 nt, Homo sapiens
gacauuggguuugccuauc

SEQ ID NO: 15504 - RNA, 19 nt, Homo sapiens
ugacagagcucauauugua

SEQ ID NO: 15505 - RNA, 19 nt, Homo sapiens
gaaauggugugguaauuca

SEQ ID NO: 15506 - RNA, 19 nt, Homo sapiens
caaguuagauggugaaauc

SEQ ID NO: 15507 - RNA, 19 nt, Homo sapiens
ggugagagauggaguuuau

SEQ ID NO: 15508 - RNA, 19 nt, Homo sapiens
gagcucauauuguauuuga

SEQ ID NO: 15509 - RNA, 19 nt, Homo sapiens
gaacacagacauaucaaau

SEQ ID NO: 15510 - RNA, 19 nt, Homo sapiens
ggugaaaucauaccucaua

SEQ ID NO: 15511 - RNA, 19 nt, Homo sapiens
uggaguugcuuacaaguua

SEQ ID NO: 15512 - RNA, 19 nt, Homo sapiens
guuagauggugaaaucaua

SEQ ID NO: 15513 - RNA, 19 nt, Homo sapiens
ggaaauagacauugaaggu

SEQ ID NO: 15514 - RNA, 19 nt, Homo sapiens
gagcuucaaauuccaguua

SEQ ID NO: 15515 - RNA, 19 nt, Homo sapiens
cuacagagcaagacaauga

SEQ ID NO: 15516 - RNA, 19 nt, Homo sapiens
gguuuaaaguucuagcuaa

SEQ ID NO: 15517 - RNA, 19 nt, Homo sapiens
ucaucuaccuggauuguuu

SEQ ID NO: 15518 - RNA, 19 nt, Homo sapiens
agacauugaaggugaauua

SEQ ID NO: 15519 - RNA, 19 nt, Homo sapiens
gcagcacuauuagauauug

SEQ ID NO: 15520 - RNA, 19 nt, Homo sapiens
ggaaaucaaaguuggaguu

SEQ ID NO: 15521 - RNA, 19 nt, Homo sapiens
gguagagaguuugguguaa

SEQ ID NO: 15522 - RNA, 19 nt, Homo sapiens
cauugaaggugaauuacaa

SEQ ID NO: 15523 - RNA, 19 nt, Homo sapiens
ucugagagguuuaaaguuc

SEQ ID NO: 15524 - RNA, 19 nt, Homo sapiens
ucaagcagcugaugguauc

SEQ ID NO: 15525 - RNA, 19 nt, Homo sapiens
gcaagggcguuuaaagaac

SEQ ID NO: 15526 - RNA, 19 nt, Homo sapiens
ggagaaguguauggaguug

SEQ ID NO: 15527 - RNA, 19 nt, Homo sapiens
ggagguguuuguacugguu

SEQ ID NO: 15528 - RNA, 19 nt, Homo sapiens
caaaugcaagggcguuuaa

SEQ ID NO: 15529 - RNA, 19 nt, Homo sapiens
ggaaauaaugcuggccaua

SEQ ID NO: 15530 - RNA, 19 nt, Homo sapiens
gcuaaccaauacaaaucua

SEQ ID NO: 15531 - RNA, 19 nt, Homo sapiens
gaaaucaaaguuggaguug

SEQ ID NO: 15532 - RNA, 19 nt, Homo sapiens
ugugaaagcuuauacaacu

SEQ ID NO: 15533 - RNA, 19 nt, Homo sapiens
gcaaaugcagcacuauuag

SEQ ID NO: 15534 - RNA, 19 nt, Homo sapiens
gaaagcuuauacaacuaga

SEQ ID NO: 15535 - RNA, 19 nt, Homo sapiens
gugaaagcuuauacaacua

SEQ ID NO: 15536 - RNA, 19 nt, Homo sapiens
cuacauggaccaccaaaga

SEQ ID NO: 15537 - RNA, 19 nt, Homo sapiens
ugagagauggaguuuauuu

SEQ ID NO: 15538 - RNA, 19 nt, Homo sapiens
cgaccuuguuucugacuuu

SEQ ID NO: 15539 - RNA, 19 nt, Homo sapiens
acucaaggguuauauggaa

SEQ ID NO: 15540 - RNA, 19 nt, Homo sapiens
gaaauaaugcuggccauac

SEQ ID NO: 15541 - RNA, 19 nt, Homo sapiens
uaauucaucuaccuggauu

SEQ ID NO: 15542 - RNA, 19 nt, Homo sapiens
ggacauguuuacggaaauc

SEQ ID NO: 15543 - RNA, 19 nt, Homo sapiens
acacagacauaucaaaugc

SEQ ID NO: 15544 - RNA, 19 nt, Homo sapiens
gaaaucauaccucauaucc

SEQ ID NO: 15545 - RNA, 19 nt, Homo sapiens
ggaaauggugugguaauuc

SEQ ID NO: 15546 - RNA, 19 nt, Homo sapiens
ucacugcauucauuggaaa

SEQ ID NO: 15547 - RNA, 19 nt, Homo sapiens
guugguaaauccagagaau

SEQ ID NO: 15548 - RNA, 19 nt, Homo sapiens
acagacauaucaaaugcaa

SEQ ID NO: 15549 - RNA, 19 nt, Homo sapiens
ggaacacagacauaucaaa

SEQ ID NO: 15550 - RNA, 19 nt, Homo sapiens
gacaagaacaagcaggaaa

SEQ ID NO: 15551 - RNA, 19 nt, Homo sapiens
aaauaaugcuggccauaca

SEQ ID NO: 15552 - RNA, 19 nt, Homo sapiens
agaacuaccuguuaaugca

SEQ ID NO: 15553 - RNA, 19 nt, Homo sapiens
uguaaccucuucaaauugu

SEQ ID NO: 15554 - RNA, 19 nt, Homo sapiens
gaacaacagagacaagaac

SEQ ID NO: 15555 - RNA, 19 nt, Homo sapiens
ggaacaacagagacaagaa

SEQ ID NO: 15556 - RNA, 19 nt, Homo sapiens
guaaauccagagaaucuau

SEQ ID NO: 15557 - RNA, 19 nt, Homo sapiens
aagaugagcuucaaauucc

SEQ ID NO: 15558 - RNA, 19 nt, Homo sapiens
ucucuuacccaguggaaua

SEQ ID NO: 15559 - RNA, 19 nt, Homo sapiens
guggauugguguugguaaa

SEQ ID NO: 15560 - RNA, 19 nt, Homo sapiens
gcacaaaacuauguucgau

SEQ ID NO: 15561 - RNA, 19 nt, Homo sapiens
ugagagguuuaaaguucua

SEQ ID NO: 15562 - RNA, 19 nt, Homo sapiens
ugugcgaccuuguuucuga

SEQ ID NO: 15563 - RNA, 19 nt, Homo sapiens
cagagcucauauuguauuu

SEQ ID NO: 15564 - RNA, 19 nt, Homo sapiens
ggacuagaaggcugggaaa

SEQ ID NO: 15565 - RNA, 19 nt, Homo sapiens
caaaugcagcacuauuaga

SEQ ID NO: 15566 - RNA, 19 nt, Homo sapiens
gcauuggcccaguuuauuc

SEQ ID NO: 15567 - RNA, 19 nt, Homo sapiens
caacagagacaagaacaag

SEQ ID NO: 15568 - RNA, 19 nt, Homo sapiens
caagggcguuuaaagaacu

SEQ ID NO: 15569 - RNA, 19 nt, Homo sapiens
gugaaaucauaccucauau

SEQ ID NO: 15570 - RNA, 19 nt, Homo sapiens
uuacccaguggaauaauua

SEQ ID NO: 15571 - RNA, 19 nt, Homo sapiens
uggaaauggugugguaauu

SEQ ID NO: 15572 - RNA, 19 nt, Homo sapiens
gcucauaugaucaauggau

SEQ ID NO: 15573 - RNA, 19 nt, Homo sapiens
ggguagagaguuuggugua

SEQ ID NO: 15574 - RNA, 19 nt, Homo sapiens
agaaguguauggaguugug

SEQ ID NO: 15575 - RNA, 19 nt, Homo sapiens
ccauacaguuguuguggau

SEQ ID NO: 15576 - RNA, 19 nt, Homo sapiens
ggaaaagauuaaaccaaug

SEQ ID NO: 15577 - RNA, 19 nt, Homo sapiens
ggauggaacacagacauau

SEQ ID NO: 15578 - RNA, 19 nt, Homo sapiens
guaaccucuucaaauugua

SEQ ID NO: 15579 - RNA, 19 nt, Homo sapiens
ggaguugcuuacaaguuag

SEQ ID NO: 15580 - RNA, 19 nt, Homo sapiens
cuaccuggauuguuugaag

SEQ ID NO: 15581 - RNA, 19 nt, Homo sapiens
ugacuuugauggcuucucu

SEQ ID NO: 15582 - RNA, 19 nt, Homo sapiens
agagcaagacaaugaaauu

SEQ ID NO: 15583 - RNA, 19 nt, Homo sapiens
ucaaaugcaagggcguuua

SEQ ID NO: 15584 - RNA, 19 nt, Homo sapiens
uguaacuacuggaaggaaa

SEQ ID NO: 15585 - RNA, 19 nt, Homo sapiens
guagagaguuugguguaac

SEQ ID NO: 15586 - RNA, 19 nt, Homo sapiens
augcagcacuauuagauau

SEQ ID NO: 15587 - RNA, 19 nt, Homo sapiens
ggcauuggcccaguuuauu

SEQ ID NO: 15588 - RNA, 19 nt, Homo sapiens
auacaguuguuguggauuc

SEQ ID NO: 15589 - RNA, 19 nt, Homo sapiens
acagagcucauauuguauu

SEQ ID NO: 15590 - RNA, 19 nt, Homo sapiens
aaagaacuaccuguuaaug

SEQ ID NO: 15591 - RNA, 19 nt, Homo sapiens
uaccucauaucccagcaaa

SEQ ID NO: 15592 - RNA, 19 nt, Homo sapiens
ggaguugugaaagcuuaua

SEQ ID NO: 15593 - RNA, 19 nt, Homo sapiens
ugcaagggcguuuaaagaa

SEQ ID NO: 15594 - RNA, 19 nt, Homo sapiens
ucaaaguuggaguugcuua

SEQ ID NO: 15595 - RNA, 19 nt, Homo sapiens
aaucaaaguuggaguugcu

SEQ ID NO: 15596 - RNA, 19 nt, Homo sapiens
gaccuuguuucugacuuug

SEQ ID NO: 15597 - RNA, 19 nt, Homo sapiens
gguauuggugccuuuccua

SEQ ID NO: 15598 - RNA, 19 nt, Homo sapiens
aaaugcagcacuauuagau

SEQ ID NO: 15599 - RNA, 19 nt, Homo sapiens
uagcuaaccaauacaaauc

SEQ ID NO: 15600 - RNA, 19 nt, Homo sapiens
gaugugcgaccuuguuucu

SEQ ID NO: 15601 - RNA, 19 nt, Homo sapiens
gauggaacacagacauauc

SEQ ID NO: 15602 - RNA, 19 nt, Homo sapiens
gaagauguggcugguugga

SEQ ID NO: 15603 - RNA, 19 nt, Homo sapiens
cagcacuauuagauauuga

SEQ ID NO: 15604 - RNA, 19 nt, Homo sapiens
gcaaagaggcggaaauuaa

SEQ ID NO: 15605 - RNA, 19 nt, Homo sapiens
gcauguaucucuucuaugg

SEQ ID NO: 15606 - RNA, 19 nt, Homo sapiens
ccaagaaggugcagcauuc

SEQ ID NO: 15607 - RNA, 19 nt, Homo sapiens
ccgaugaguugcugaauaa

SEQ ID NO: 15608 - RNA, 19 nt, Homo sapiens
gcaagaagaacccagauga

SEQ ID NO: 15609 - RNA, 19 nt, Homo sapiens
gaacccagaugacuucaag

SEQ ID NO: 15610 - RNA, 19 nt, Homo sapiens
ggacuacaccuacuacuuc

SEQ ID NO: 15611 - RNA, 19 nt, Homo sapiens
ccaccgaccuccaggacua

SEQ ID NO: 15612 - RNA, 19 nt, Homo sapiens
caacaacgccaucaagaau

SEQ ID NO: 15613 - RNA, 19 nt, Homo sapiens
cagagaagcaaauagguua

SEQ ID NO: 15614 - RNA, 19 nt, Homo sapiens
gccgaugaguugcugaaua

SEQ ID NO: 15615 - RNA, 19 nt, Homo sapiens
ggacaucggcccucccauu

SEQ ID NO: 15616 - RNA, 19 nt, Homo sapiens
gagcaaagaggcggaaauu

SEQ ID NO: 15617 - RNA, 19 nt, Homo sapiens
ggacuuuccuccggccuuu

SEQ ID NO: 15618 - RNA, 19 nt, Homo sapiens
gcuccgaguucucccauga

SEQ ID NO: 15619 - RNA, 19 nt, Homo sapiens
acaaggaacuggccaacau

SEQ ID NO: 15620 - RNA, 19 nt, Homo sapiens
gcucugcucuccuggacaa

SEQ ID NO: 15621 - RNA, 19 nt, Homo sapiens
ccgcauguaucucuucuau

SEQ ID NO: 15622 - RNA, 19 nt, Homo sapiens
guucaucugcugcuguuua

SEQ ID NO: 15623 - RNA, 19 nt, Homo sapiens
acaacgccaucaagaauga

SEQ ID NO: 15624 - RNA, 19 nt, Homo sapiens
caacauccgcuccaaguuc

SEQ ID NO: 15625 - RNA, 19 nt, Homo sapiens
caaagaggcggaaauuaag

SEQ ID NO: 15626 - RNA, 19 nt, Homo sapiens
gcagaucggagucaaguca

SEQ ID NO: 15627 - RNA, 19 nt, Homo sapiens
uuaagagaaucaacaagga

SEQ ID NO: 15628 - RNA, 19 nt, Homo sapiens
gaccuccacuggugacaga

SEQ ID NO: 15629 - RNA, 19 nt, Homo sapiens
ugguacaccugcucaauga

SEQ ID NO: 15630 - RNA, 19 nt, Homo sapiens
ccacggugcuggaggagau

SEQ ID NO: 15631 - RNA, 19 nt, Homo sapiens
ggagaugggcgaggccuuu

SEQ ID NO: 15632 - RNA, 19 nt, Homo sapiens
cugaauaaguuugugugua

SEQ ID NO: 15633 - RNA, 19 nt, Homo sapiens
gagaagacaccaggguuug

SEQ ID NO: 15634 - RNA, 19 nt, Homo sapiens
ucaccugucucugcaagaa

SEQ ID NO: 15635 - RNA, 19 nt, Homo sapiens
gccaugacauugacuuugg

SEQ ID NO: 15636 - RNA, 19 nt, Homo sapiens
gaaguacgccguggacuac

SEQ ID NO: 15637 - RNA, 19 nt, Homo sapiens
ccaccuacaucaaguucau

SEQ ID NO: 15638 - RNA, 19 nt, Homo sapiens
caaguucaaaggagacaaa

SEQ ID NO: 15639 - RNA, 19 nt, Homo sapiens
ugagugaggagguguggua

SEQ ID NO: 15640 - RNA, 19 nt, Homo sapiens
ucaacaacgccaucaagaa

SEQ ID NO: 15641 - RNA, 19 nt, Homo sapiens
uuggauggcuacaguaaga

SEQ ID NO: 15642 - RNA, 19 nt, Homo sapiens
cggugcaguuccagaauuu

SEQ ID NO: 15643 - RNA, 19 nt, Homo sapiens
ccaauaaauacacagagaa

SEQ ID NO: 15644 - RNA, 19 nt, Homo sapiens
uccaauaaauacacagaga

SEQ ID NO: 15645 - RNA, 19 nt, Homo sapiens
uaagagaaucaacaaggaa

SEQ ID NO: 15646 - RNA, 19 nt, Homo sapiens
gaauaaguuuguguguaag

SEQ ID NO: 15647 - RNA, 19 nt, Homo sapiens
ucuguugaguuccaauaaa

SEQ ID NO: 15648 - RNA, 19 nt, Homo sapiens
gagcgaauaaacagagaga

SEQ ID NO: 15649 - RNA, 19 nt, Homo sapiens
cagugaccaucaacaaguu

SEQ ID NO: 15650 - RNA, 19 nt, Homo sapiens
cgacaccaccgccaucaug

SEQ ID NO: 15651 - RNA, 19 nt, Homo sapiens
augaguugcugaauaaguu

SEQ ID NO: 15652 - RNA, 19 nt, Homo sapiens
aggcggaaauuaagagaau

SEQ ID NO: 15653 - RNA, 19 nt, Homo sapiens
guaaacugcuuuucaucuu

SEQ ID NO: 15654 - RNA, 19 nt, Homo sapiens
gaagguuggcggcuacauc

SEQ ID NO: 15655 - RNA, 19 nt, Homo sapiens
ggacgcagaaguuacuaag

SEQ ID NO: 15656 - RNA, 19 nt, Homo sapiens
agaaguacgccguggacua

SEQ ID NO: 15657 - RNA, 19 nt, Homo sapiens
gggacagcauggacagugu

SEQ ID NO: 15658 - RNA, 19 nt, Homo sapiens
caauaaauacacagagaag

SEQ ID NO: 15659 - RNA, 19 nt, Homo sapiens
ggauggcuacaguaagaaa

SEQ ID NO: 15660 - RNA, 19 nt, Homo sapiens
agagaagacaccaggguuu

SEQ ID NO: 15661 - RNA, 19 nt, Homo sapiens
gacaucggcccucccauuc

SEQ ID NO: 15662 - RNA, 19 nt, Homo sapiens
cgucaucaaugcccucaag

SEQ ID NO: 15663 - RNA, 19 nt, Homo sapiens
cugugaaucuguugaguuc

SEQ ID NO: 15664 - RNA, 19 nt, Homo sapiens
gaugaguugcugaauaagu

SEQ ID NO: 15665 - RNA, 19 nt, Homo sapiens
ccagugaccaucaacaagu

SEQ ID NO: 15666 - RNA, 19 nt, Homo sapiens
ggagcaaugccaagcagau

SEQ ID NO: 15667 - RNA, 19 nt, Homo sapiens
uggagacugugcucaacaa

SEQ ID NO: 15668 - RNA, 19 nt, Homo sapiens
agaagaacccagaugacuu

SEQ ID NO: 15669 - RNA, 19 nt, Homo sapiens
gugaaucuguugaguucca

SEQ ID NO: 15670 - RNA, 19 nt, Homo sapiens
agucagaguuccgacagaa

SEQ ID NO: 15671 - RNA, 19 nt, Homo sapiens
gaccaucagccucaucauc

SEQ ID NO: 15672 - RNA, 19 nt, Homo sapiens
gagaccaucagccucauca

SEQ ID NO: 15673 - RNA, 19 nt, Homo sapiens
acagagaagcaaauagguu

SEQ ID NO: 15674 - RNA, 19 nt, Homo sapiens
auacacagagaagcaaaua

SEQ ID NO: 15675 - RNA, 19 nt, Homo sapiens
cuguugaguuccaauaaau

SEQ ID NO: 15676 - RNA, 19 nt, Homo sapiens
gcugugaaucuguugaguu

SEQ ID NO: 15677 - RNA, 19 nt, Homo sapiens
ggaacuguaagagcaaaga

SEQ ID NO: 15678 - RNA, 19 nt, Homo sapiens
ucggugcaguuccagaauu

SEQ ID NO: 15679 - RNA, 19 nt, Homo sapiens
ucaaguucaucaaccucuu

SEQ ID NO: 15680 - RNA, 19 nt, Homo sapiens
ggaguuugggaaccugauu

SEQ ID NO: 15681 - RNA, 19 nt, Homo sapiens
uaaauacacagagaagcaa

SEQ ID NO: 15682 - RNA, 19 nt, Homo sapiens
ccuccggccuuuuguauuu

SEQ ID NO: 15683 - RNA, 19 nt, Homo sapiens
ucauuucugugcuggugaa

SEQ ID NO: 15684 - RNA, 19 nt, Homo sapiens
acacagagaagcaaauagg

SEQ ID NO: 15685 - RNA, 19 nt, Homo sapiens
gccaacauccgcuccaagu

SEQ ID NO: 15686 - RNA, 19 nt, Homo sapiens
gcggaaauuaagagaauca

SEQ ID NO: 15687 - RNA, 19 nt, Homo sapiens
aaagaggcggaaauuaaga

SEQ ID NO: 15688 - RNA, 19 nt, Homo sapiens
cauggaggcugugaaucug

SEQ ID NO: 15689 - RNA, 19 nt, Homo sapiens
auaaacagagagacgcuaa

SEQ ID NO: 15690 - RNA, 19 nt, Homo sapiens
gugagcgaauaaacagaga

SEQ ID NO: 15691 - RNA, 19 nt, Homo sapiens
uccggaagccgaugaguug

SEQ ID NO: 15692 - RNA, 19 nt, Homo sapiens
acgagaacauggugaaggu

SEQ ID NO: 15693 - RNA, 19 nt, Homo sapiens
cagaggaugcggcugugaa

SEQ ID NO: 15694 - RNA, 19 nt, Homo sapiens
aacauccgcuccaaguuca

SEQ ID NO: 15695 - RNA, 19 nt, Homo sapiens
caucaacaacgccaucaag

SEQ ID NO: 15696 - RNA, 19 nt, Homo sapiens
gggcuguguauuauuguga

SEQ ID NO: 15697 - RNA, 19 nt, Homo sapiens
ucucuucuauggcaacaag

SEQ ID NO: 15698 - RNA, 19 nt, Homo sapiens
ggugugguaccgugugcua

SEQ ID NO: 15699 - RNA, 19 nt, Homo sapiens
gcagaucgugucggagaug

SEQ ID NO: 15700 - RNA, 19 nt, Homo sapiens
gagcaaugccaagcagauc

SEQ ID NO: 15701 - RNA, 19 nt, Homo sapiens
uggaggcugugaaucuguu

SEQ ID NO: 15702 - RNA, 19 nt, Homo sapiens
gaguuccaauaaauacaca

SEQ ID NO: 15703 - RNA, 19 nt, Homo sapiens
gaacuguaagagcaaagag

SEQ ID NO: 15704 - RNA, 19 nt, Homo sapiens
gcaaagaggcggaaauuaa

SEQ ID NO: 15705 - RNA, 19 nt, Homo sapiens
gcauguaucucuucuaugg

SEQ ID NO: 15706 - RNA, 19 nt, Homo sapiens
ccaagaaggugcagcauuc

SEQ ID NO: 15707 - RNA, 19 nt, Homo sapiens
ccgaugaguugcugaauaa

SEQ ID NO: 15708 - RNA, 19 nt, Homo sapiens
gcaagaagaacccagauga

SEQ ID NO: 15709 - RNA, 19 nt, Homo sapiens
gaacccagaugacuucaag

SEQ ID NO: 15710 - RNA, 19 nt, Homo sapiens
ggacuacaccuacuacuuc

SEQ ID NO: 15711 - RNA, 19 nt, Homo sapiens
ccaccgaccuccaggacua

SEQ ID NO: 15712 - RNA, 19 nt, Homo sapiens
caacaacgccaucaagaau

SEQ ID NO: 15713 - RNA, 19 nt, Homo sapiens
cagagaagcaaauagguua

SEQ ID NO: 15714 - RNA, 19 nt, Homo sapiens
gccgaugaguugcugaaua

SEQ ID NO: 15715 - RNA, 19 nt, Homo sapiens
ggacaucggcccucccauu

SEQ ID NO: 15716 - RNA, 19 nt, Homo sapiens
gagcaaagaggcggaaauu

SEQ ID NO: 15717 - RNA, 19 nt, Homo sapiens
ggacuuuccuccggccuuu

SEQ ID NO: 15718 - RNA, 19 nt, Homo sapiens
gcuccgaguucucccauga

SEQ ID NO: 15719 - RNA, 19 nt, Homo sapiens
acaaggaacuggccaacau

SEQ ID NO: 15720 - RNA, 19 nt, Homo sapiens
gcucugcucuccuggacaa

SEQ ID NO: 15721 - RNA, 19 nt, Homo sapiens
ccgcauguaucucuucuau

SEQ ID NO: 15722 - RNA, 19 nt, Homo sapiens
guucaucugcugcuguuua

SEQ ID NO: 15723 - RNA, 19 nt, Homo sapiens
acaacgccaucaagaauga

SEQ ID NO: 15724 - RNA, 19 nt, Homo sapiens
caacauccgcuccaaguuc

SEQ ID NO: 15725 - RNA, 19 nt, Homo sapiens
caaagaggcggaaauuaag

SEQ ID NO: 15726 - RNA, 19 nt, Homo sapiens
gcagaucggagucaaguca

SEQ ID NO: 15727 - RNA, 19 nt, Homo sapiens
uuaagagaaucaacaagga

SEQ ID NO: 15728 - RNA, 19 nt, Homo sapiens
gaccuccacuggugacaga

SEQ ID NO: 15729 - RNA, 19 nt, Homo sapiens
ugguacaccugcucaauga

SEQ ID NO: 15730 - RNA, 19 nt, Homo sapiens
ccacggugcuggaggagau

SEQ ID NO: 15731 - RNA, 19 nt, Homo sapiens
ggagaugggcgaggccuuu

SEQ ID NO: 15732 - RNA, 19 nt, Homo sapiens
cugaauaaguuugugugua

SEQ ID NO: 15733 - RNA, 19 nt, Homo sapiens
gagaagacaccaggguuug

SEQ ID NO: 15734 - RNA, 19 nt, Homo sapiens
ucaccugucucugcaagaa

SEQ ID NO: 15735 - RNA, 19 nt, Homo sapiens
gccaugacauugacuuugg

SEQ ID NO: 15736 - RNA, 19 nt, Homo sapiens
gaaguacgccguggacuac

SEQ ID NO: 15737 - RNA, 19 nt, Homo sapiens
ccaccuacaucaaguucau

SEQ ID NO: 15738 - RNA, 19 nt, Homo sapiens
caaguucaaaggagacaaa

SEQ ID NO: 15739 - RNA, 19 nt, Homo sapiens
ugagugaggagguguggua

SEQ ID NO: 15740 - RNA, 19 nt, Homo sapiens
ucaacaacgccaucaagaa

SEQ ID NO: 15741 - RNA, 19 nt, Homo sapiens
uuggauggcuacaguaaga

SEQ ID NO: 15742 - RNA, 19 nt, Homo sapiens
cggugcaguuccagaauuu

SEQ ID NO: 15743 - RNA, 19 nt, Homo sapiens
ccaauaaauacacagagaa

SEQ ID NO: 15744 - RNA, 19 nt, Homo sapiens
uccaauaaauacacagaga

SEQ ID NO: 15745 - RNA, 19 nt, Homo sapiens
uaagagaaucaacaaggaa

SEQ ID NO: 15746 - RNA, 19 nt, Homo sapiens
gaauaaguuuguguguaag

SEQ ID NO: 15747 - RNA, 19 nt, Homo sapiens
ucuguugaguuccaauaaa

SEQ ID NO: 15748 - RNA, 19 nt, Homo sapiens
gagcgaauaaacagagaga

SEQ ID NO: 15749 - RNA, 19 nt, Homo sapiens
cagugaccaucaacaaguu

SEQ ID NO: 15750 - RNA, 19 nt, Homo sapiens
cgacaccaccgccaucaug

SEQ ID NO: 15751 - RNA, 19 nt, Homo sapiens
augaguugcugaauaaguu

SEQ ID NO: 15752 - RNA, 19 nt, Homo sapiens
aggcggaaauuaagagaau

SEQ ID NO: 15753 - RNA, 19 nt, Homo sapiens
guaaacugcuuuucaucuu

SEQ ID NO: 15754 - RNA, 19 nt, Homo sapiens
gaagguuggcggcuacauc

SEQ ID NO: 15755 - RNA, 19 nt, Homo sapiens
ggacgcagaaguuacuaag

SEQ ID NO: 15756 - RNA, 19 nt, Homo sapiens
agaaguacgccguggacua

SEQ ID NO: 15757 - RNA, 19 nt, Homo sapiens
gggacagcauggacagugu

SEQ ID NO: 15758 - RNA, 19 nt, Homo sapiens
caauaaauacacagagaag

SEQ ID NO: 15759 - RNA, 19 nt, Homo sapiens
ggauggcuacaguaagaaa

SEQ ID NO: 15760 - RNA, 19 nt, Homo sapiens
agagaagacaccaggguuu

SEQ ID NO: 15761 - RNA, 19 nt, Homo sapiens
gacaucggcccucccauuc

SEQ ID NO: 15762 - RNA, 19 nt, Homo sapiens
cgucaucaaugcccucaag

SEQ ID NO: 15763 - RNA, 19 nt, Homo sapiens
cugugaaucuguugaguuc

SEQ ID NO: 15764 - RNA, 19 nt, Homo sapiens
gaugaguugcugaauaagu

SEQ ID NO: 15765 - RNA, 19 nt, Homo sapiens
ccagugaccaucaacaagu

SEQ ID NO: 15766 - RNA, 19 nt, Homo sapiens
ggagcaaugccaagcagau

SEQ ID NO: 15767 - RNA, 19 nt, Homo sapiens
uggagacugugcucaacaa

SEQ ID NO: 15768 - RNA, 19 nt, Homo sapiens
agaagaacccagaugacuu

SEQ ID NO: 15769 - RNA, 19 nt, Homo sapiens
gugaaucuguugaguucca

SEQ ID NO: 15770 - RNA, 19 nt, Homo sapiens
agucagaguuccgacagaa

SEQ ID NO: 15771 - RNA, 19 nt, Homo sapiens
gaccaucagccucaucauc

SEQ ID NO: 15772 - RNA, 19 nt, Homo sapiens
gagaccaucagccucauca

SEQ ID NO: 15773 - RNA, 19 nt, Homo sapiens
acagagaagcaaauagguu

SEQ ID NO: 15774 - RNA, 19 nt, Homo sapiens
auacacagagaagcaaaua

SEQ ID NO: 15775 - RNA, 19 nt, Homo sapiens
cuguugaguuccaauaaau

SEQ ID NO: 15776 - RNA, 19 nt, Homo sapiens
gcugugaaucuguugaguu

SEQ ID NO: 15777 - RNA, 19 nt, Homo sapiens
ggaacuguaagagcaaaga

SEQ ID NO: 15778 - RNA, 19 nt, Homo sapiens
ucggugcaguuccagaauu

SEQ ID NO: 15779 - RNA, 19 nt, Homo sapiens
ucaaguucaucaaccucuu

SEQ ID NO: 15780 - RNA, 19 nt, Homo sapiens
ggaguuugggaaccugauu

SEQ ID NO: 15781 - RNA, 19 nt, Homo sapiens
uaaauacacagagaagcaa

SEQ ID NO: 15782 - RNA, 19 nt, Homo sapiens
ccuccggccuuuuguauuu

SEQ ID NO: 15783 - RNA, 19 nt, Homo sapiens
ucauuucugugcuggugaa

SEQ ID NO: 15784 - RNA, 19 nt, Homo sapiens
acacagagaagcaaauagg

SEQ ID NO: 15785 - RNA, 19 nt, Homo sapiens
gccaacauccgcuccaagu

SEQ ID NO: 15786 - RNA, 19 nt, Homo sapiens
gcggaaauuaagagaauca

SEQ ID NO: 15787 - RNA, 19 nt, Homo sapiens
aaagaggcggaaauuaaga

SEQ ID NO: 15788 - RNA, 19 nt, Homo sapiens
cauggaggcugugaaucug

SEQ ID NO: 15789 - RNA, 19 nt, Homo sapiens
auaaacagagagacgcuaa

SEQ ID NO: 15790 - RNA, 19 nt, Homo sapiens
gugagcgaauaaacagaga

SEQ ID NO: 15791 - RNA, 19 nt, Homo sapiens
uccggaagccgaugaguug

SEQ ID NO: 15792 - RNA, 19 nt, Homo sapiens
acgagaacauggugaaggu

SEQ ID NO: 15793 - RNA, 19 nt, Homo sapiens
cagaggaugcggcugugaa

SEQ ID NO: 15794 - RNA, 19 nt, Homo sapiens
aacauccgcuccaaguuca

SEQ ID NO: 15795 - RNA, 19 nt, Homo sapiens
caucaacaacgccaucaag

SEQ ID NO: 15796 - RNA, 19 nt, Homo sapiens
gggcuguguauuauuguga

SEQ ID NO: 15797 - RNA, 19 nt, Homo sapiens
ucucuucuauggcaacaag

SEQ ID NO: 15798 - RNA, 19 nt, Homo sapiens
ggugugguaccgugugcua

SEQ ID NO: 15799 - RNA, 19 nt, Homo sapiens
gcagaucgugucggagaug

SEQ ID NO: 15800 - RNA, 19 nt, Homo sapiens
gagcaaugccaagcagauc

SEQ ID NO: 15801 - RNA, 19 nt, Homo sapiens
uggaggcugugaaucuguu

SEQ ID NO: 15802 - RNA, 19 nt, Homo sapiens
gaguuccaauaaauacaca

SEQ ID NO: 15803 - RNA, 19 nt, Homo sapiens
gaacuguaagagcaaagag

SEQ ID NO: 15804 - RNA, 19 nt, Homo sapiens
ccacagaucuccaggauua

SEQ ID NO: 15805 - RNA, 19 nt, Homo sapiens
gaauuuaggucggauguuu

SEQ ID NO: 15806 - RNA, 19 nt, Homo sapiens
gagaagagauugugcugaa

SEQ ID NO: 15807 - RNA, 19 nt, Homo sapiens
uggcaaagcucaagaagaa

SEQ ID NO: 15808 - RNA, 19 nt, Homo sapiens
acaaggaacuggcaaauau

SEQ ID NO: 15809 - RNA, 19 nt, Homo sapiens
gaagaacccagaagaguuu

SEQ ID NO: 15810 - RNA, 19 nt, Homo sapiens
gaaauggcuucucaggauu

SEQ ID NO: 15811 - RNA, 19 nt, Homo sapiens
gcccaucacucucaacaaa

SEQ ID NO: 15812 - RNA, 19 nt, Homo sapiens
gauaccaucuugaacuuga

SEQ ID NO: 15813 - RNA, 19 nt, Homo sapiens
gcucugaguucucccauga

SEQ ID NO: 15814 - RNA, 19 nt, Homo sapiens
gccaucagcuuaaucauuc

SEQ ID NO: 15815 - RNA, 19 nt, Homo sapiens
cagaacaucuucaaagcaa

SEQ ID NO: 15816 - RNA, 19 nt, Homo sapiens
ucaaacagauacacggaaa

SEQ ID NO: 15817 - RNA, 19 nt, Homo sapiens
cagacgaccuucagccuaa

SEQ ID NO: 15818 - RNA, 19 nt, Homo sapiens
caacaacgccaucaagaau

SEQ ID NO: 15819 - RNA, 19 nt, Homo sapiens
ggacacagaagucaccaaa

SEQ ID NO: 15820 - RNA, 19 nt, Homo sapiens
ugaagaaguugauccuaau

SEQ ID NO: 15821 - RNA, 19 nt, Homo sapiens
ccaucacucucaacaaauu

SEQ ID NO: 15822 - RNA, 19 nt, Homo sapiens
gcaaagcucaagaagaaga

SEQ ID NO: 15823 - RNA, 19 nt, Homo sapiens
uugaagaaguugauccuaa

SEQ ID NO: 15824 - RNA, 19 nt, Homo sapiens
ucaacgcccugaagacuga

SEQ ID NO: 15825 - RNA, 19 nt, Homo sapiens
agacaacuuugccagguuu

SEQ ID NO: 15826 - RNA, 19 nt, Homo sapiens
caggauuucuuucaacguu

SEQ ID NO: 15827 - RNA, 19 nt, Homo sapiens
uggcaaauaucagaucaaa

SEQ ID NO: 15828 - RNA, 19 nt, Homo sapiens
guaaggaagccguuucuca

SEQ ID NO: 15829 - RNA, 19 nt, Homo sapiens
gcacuugggugugguaacu

SEQ ID NO: 15830 - RNA, 19 nt, Homo sapiens
acaacgccaucaagaauga

SEQ ID NO: 15831 - RNA, 19 nt, Homo sapiens
gaacccagaagaguuuaaa

SEQ ID NO: 15832 - RNA, 19 nt, Homo sapiens
cgugggagcuggaaucauc

SEQ ID NO: 15833 - RNA, 19 nt, Homo sapiens
ggaacuggcaaauaucaga

SEQ ID NO: 15834 - RNA, 19 nt, Homo sapiens
caaguugcucuucaucuuu

SEQ ID NO: 15835 - RNA, 19 nt, Homo sapiens
gaacaucuucaaagcaaag

SEQ ID NO: 15836 - RNA, 19 nt, Homo sapiens
ggucggauguuuaucuuuu

SEQ ID NO: 15837 - RNA, 19 nt, Homo sapiens
ucagagauuaugugaauug

SEQ ID NO: 15838 - RNA, 19 nt, Homo sapiens
caagaucauuggauuuggu

SEQ ID NO: 15839 - RNA, 19 nt, Homo sapiens
acacagaagucaccaaagc

SEQ ID NO: 15840 - RNA, 19 nt, Homo sapiens
gcugugaaccugcugaguu

SEQ ID NO: 15841 - RNA, 19 nt, Homo sapiens
ccgaauugcuggugauuac

SEQ ID NO: 15842 - RNA, 19 nt, Homo sapiens
gacauugacuuuggacaca

SEQ ID NO: 15843 - RNA, 19 nt, Homo sapiens
gcuugugugucuuguguug

SEQ ID NO: 15844 - RNA, 19 nt, Homo sapiens
acgagaaccuggucaaagu

SEQ ID NO: 15845 - RNA, 19 nt, Homo sapiens
gugauuacgugagugaaga

SEQ ID NO: 15846 - RNA, 19 nt, Homo sapiens
aagcagaucggcuaccuuu

SEQ ID NO: 15847 - RNA, 19 nt, Homo sapiens
aaugguguguuguuugaaa

SEQ ID NO: 15848 - RNA, 19 nt, Homo sapiens
ggccaucagcuuaaucauu

SEQ ID NO: 15849 - RNA, 19 nt, Homo sapiens
caccaaagccaagaucauu

SEQ ID NO: 15850 - RNA, 19 nt, Homo sapiens
gcagcagguggucaacaua

SEQ ID NO: 15851 - RNA, 19 nt, Homo sapiens
ucaacaacgccaucaagaa

SEQ ID NO: 15852 - RNA, 19 nt, Homo sapiens
gaucaacaacgccaucaag

SEQ ID NO: 15853 - RNA, 19 nt, Homo sapiens
ggauuugguucugcacuuc

SEQ ID NO: 15854 - RNA, 19 nt, Homo sapiens
ucauucagaucgucaucaa

SEQ ID NO: 15855 - RNA, 19 nt, Homo sapiens
ggacuacaccugguaugug

SEQ ID NO: 15856 - RNA, 19 nt, Homo sapiens
gaagaaguugauccuaauc

SEQ ID NO: 15857 - RNA, 19 nt, Homo sapiens
gcagaacaucuucaaagca

SEQ ID NO: 15858 - RNA, 19 nt, Homo sapiens
gaaaaccagcugcuucaaa

SEQ ID NO: 15859 - RNA, 19 nt, Homo sapiens
uggccgagaugcugagcua

SEQ ID NO: 15860 - RNA, 19 nt, Homo sapiens
agaagaacccagaagaguu

SEQ ID NO: 15861 - RNA, 19 nt, Homo sapiens
gcacagaagaacccagaag

SEQ ID NO: 15862 - RNA, 19 nt, Homo sapiens
aagcaaagcacccaaugga

SEQ ID NO: 15863 - RNA, 19 nt, Homo sapiens
caaagcaaagcacccaaug

SEQ ID NO: 15864 - RNA, 19 nt, Homo sapiens
gaaccgcccaagucgaaga

SEQ ID NO: 15865 - RNA, 19 nt, Homo sapiens
gaacuggcaaauaucagau

SEQ ID NO: 15866 - RNA, 19 nt, Homo sapiens
gcucuugauggcuauagua

SEQ ID NO: 15867 - RNA, 19 nt, Homo sapiens
gaagaccaggcuugugugu

SEQ ID NO: 15868 - RNA, 19 nt, Homo sapiens
gugcagaacaucuucaaag

SEQ ID NO: 15869 - RNA, 19 nt, Homo sapiens
caacauucaguucagguau

SEQ ID NO: 15870 - RNA, 19 nt, Homo sapiens
uggauaccaucuugaacuu

SEQ ID NO: 15871 - RNA, 19 nt, Homo sapiens
guucugugguuaaaucuac

SEQ ID NO: 15872 - RNA, 19 nt, Homo sapiens
gaaccugcaagcccagaug

SEQ ID NO: 15873 - RNA, 19 nt, Homo sapiens
ggaagcaguugagcaaucc

SEQ ID NO: 15874 - RNA, 19 nt, Homo sapiens
ggauauccgcaacuguaaa

SEQ ID NO: 15875 - RNA, 19 nt, Homo sapiens
uaaacaaggaacuggcaaa

SEQ ID NO: 15876 - RNA, 19 nt, Homo sapiens
cgaccgugcuggaggagau

SEQ ID NO: 15877 - RNA, 19 nt, Homo sapiens
gauccgaauugcuggugau

SEQ ID NO: 15878 - RNA, 19 nt, Homo sapiens
agaaguacgcgguggacua

SEQ ID NO: 15879 - RNA, 19 nt, Homo sapiens
uggugcaccugcucaauga

SEQ ID NO: 15880 - RNA, 19 nt, Homo sapiens
ugagugaagagguguggua

SEQ ID NO: 15881 - RNA, 19 nt, Homo sapiens
aaaguacgucugcaaguug

SEQ ID NO: 15882 - RNA, 19 nt, Homo sapiens
gaaguacgcgguggacuac

SEQ ID NO: 15883 - RNA, 19 nt, Homo sapiens
ggaaucauccacacgaaaa

SEQ ID NO: 15884 - RNA, 19 nt, Homo sapiens
aaaaccagcugcuucaaau

SEQ ID NO: 15885 - RNA, 19 nt, Homo sapiens
gaggugugguaccgaguca

SEQ ID NO: 15886 - RNA, 19 nt, Homo sapiens
cuucgaggccaucagcuua

SEQ ID NO: 15887 - RNA, 19 nt, Homo sapiens
gagaccauccugaacaaag

SEQ ID NO: 15888 - RNA, 19 nt, Homo sapiens
uggaagcaguugagcaauc

SEQ ID NO: 15889 - RNA, 19 nt, Homo sapiens
gcuccuggcuccgaagaca

SEQ ID NO: 15890 - RNA, 19 nt, Homo sapiens
ccaccuacaucaaguucgu

SEQ ID NO: 15891 - RNA, 19 nt, Homo sapiens
ugacuacuccauccgagaa

SEQ ID NO: 15892 - RNA, 19 nt, Homo sapiens
cagaagaacccagaagagu

SEQ ID NO: 15893 - RNA, 19 nt, Homo sapiens
ucacgcugcgcacaaguaa

SEQ ID NO: 15894 - RNA, 19 nt, Homo sapiens
auccuaauccugcgaauuu

SEQ ID NO: 15895 - RNA, 19 nt, Homo sapiens
gaagucaccaaagccaaga

SEQ ID NO: 15896 - RNA, 19 nt, Homo sapiens
gcaauccacagcaggaagu

SEQ ID NO: 15897 - RNA, 19 nt, Homo sapiens
caacuuugccagguuuguu

SEQ ID NO: 15898 - RNA, 19 nt, Homo sapiens
gaggccaucagcuuaauca

SEQ ID NO: 15899 - RNA, 19 nt, Homo sapiens
uggagaccauccugaacaa

SEQ ID NO: 15900 - RNA, 19 nt, Homo sapiens
caaguaaggaagccguuuc

SEQ ID NO: 15901 - RNA, 19 nt, Homo sapiens
cugcugaguucaaacagau

SEQ ID NO: 15902 - RNA, 19 nt, Homo sapiens
guuggaagcaguugagcaa

SEQ ID NO: 15903 - RNA, 19 nt, Homo sapiens
cgccaguccucaacauuca

SEQ ID NO: 15904 - RNA, 19 nt, Homo sapiens
uggcagagcugaaagagua

SEQ ID NO: 15905 - RNA, 19 nt, Homo sapiens
ucauggagauguugucuaa

SEQ ID NO: 15906 - RNA, 19 nt, Homo sapiens
ggacgaggauccauaugug

SEQ ID NO: 15907 - RNA, 19 nt, Homo sapiens
caaaaugacugacucaaaa

SEQ ID NO: 15908 - RNA, 19 nt, Homo sapiens
aggcagagcucaacaguga

SEQ ID NO: 15909 - RNA, 19 nt, Homo sapiens
uagacgagcuuaucugcua

SEQ ID NO: 15910 - RNA, 19 nt, Homo sapiens
ugaaggugcugaugaaguu

SEQ ID NO: 15911 - RNA, 19 nt, Homo sapiens
gaaagaguacgcaacagaa

SEQ ID NO: 15912 - RNA, 19 nt, Homo sapiens
ggaugagccugaagggauu

SEQ ID NO: 15913 - RNA, 19 nt, Homo sapiens
gcagcaacaucuucacugu

SEQ ID NO: 15914 - RNA, 19 nt, Homo sapiens
gcaaguaccccaacaagua

SEQ ID NO: 15915 - RNA, 19 nt, Homo sapiens
gcagcgcucucagaaauug

SEQ ID NO: 15916 - RNA, 19 nt, Homo sapiens
cuaaggacuuggacuacua

SEQ ID NO: 15917 - RNA, 19 nt, Homo sapiens
ccaacuauaugcccaagga

SEQ ID NO: 15918 - RNA, 19 nt, Homo sapiens
gaugggagcuguggaccuu

SEQ ID NO: 15919 - RNA, 19 nt, Homo sapiens
gaaggacgaggauccauau

SEQ ID NO: 15920 - RNA, 19 nt, Homo sapiens
gaaggaggcagugaagaaa

SEQ ID NO: 15921 - RNA, 19 nt, Homo sapiens
gcacacugcucaagaagcu

SEQ ID NO: 15922 - RNA, 19 nt, Homo sapiens
guauaccucuacuugauga

SEQ ID NO: 15923 - RNA, 19 nt, Homo sapiens
gcauuagguuuuccuguua

SEQ ID NO: 15924 - RNA, 19 nt, Homo sapiens
agccagagcugcaguaugu

SEQ ID NO: 15925 - RNA, 19 nt, Homo sapiens
agaagccacucaucucuga

SEQ ID NO: 15926 - RNA, 19 nt, Homo sapiens
uggcagcgcucucagaaau

SEQ ID NO: 15927 - RNA, 19 nt, Homo sapiens
ccacucaggacucagauaa

SEQ ID NO: 15928 - RNA, 19 nt, Homo sapiens
gcucaacagugacaagaag

SEQ ID NO: 15929 - RNA, 19 nt, Homo sapiens
gauguugucuaaggacuug

SEQ ID NO: 15930 - RNA, 19 nt, Homo sapiens
gcaaccugcucgaucugaa

SEQ ID NO: 15931 - RNA, 19 nt, Homo sapiens
gaagauggaccggcagaug

SEQ ID NO: 15932 - RNA, 19 nt, Homo sapiens
caucgagcccacacuguua

SEQ ID NO: 15933 - RNA, 19 nt, Homo sapiens
ugaagaagcuaguauaccu

SEQ ID NO: 15934 - RNA, 19 nt, Homo sapiens
cuaaagaagccaacagaga

SEQ ID NO: 15935 - RNA, 19 nt, Homo sapiens
ggaaggcugugcgugcuau

SEQ ID NO: 15936 - RNA, 19 nt, Homo sapiens
guacaacgacccuaucuac

SEQ ID NO: 15937 - RNA, 19 nt, Homo sapiens
ggccugagauccugaagca

SEQ ID NO: 15938 - RNA, 19 nt, Homo sapiens
gaagaaggaggcagugaag

SEQ ID NO: 15939 - RNA, 19 nt, Homo sapiens
ugacagccauugugaaacu

SEQ ID NO: 15940 - RNA, 19 nt, Homo sapiens
acaagaaggagaagaagaa

SEQ ID NO: 15941 - RNA, 19 nt, Homo sapiens
uugacaagaucacagagua

SEQ ID NO: 15942 - RNA, 19 nt, Homo sapiens
uggcuuccgucuaccauaa

SEQ ID NO: 15943 - RNA, 19 nt, Homo sapiens
agaaagugauugcaucgau

SEQ ID NO: 15944 - RNA, 19 nt, Homo sapiens
ugaaagaguacgcaacaga

SEQ ID NO: 15945 - RNA, 19 nt, Homo sapiens
uggagaagcuggacaucau

SEQ ID NO: 15946 - RNA, 19 nt, Homo sapiens
gaccucaucuccgacucua

SEQ ID NO: 15947 - RNA, 19 nt, Homo sapiens
ugaaggacgaggauccaua

SEQ ID NO: 15948 - RNA, 19 nt, Homo sapiens
ugaauuacgccaagaguca

SEQ ID NO: 15949 - RNA, 19 nt, Homo sapiens
ugacagagcauuagguuuu

SEQ ID NO: 15950 - RNA, 19 nt, Homo sapiens
gaagauggagccucugaac

SEQ ID NO: 15951 - RNA, 19 nt, Homo sapiens
gcaguaccagccaaucuug

SEQ ID NO: 15952 - RNA, 19 nt, Homo sapiens
ugcagcagguccucaguuu

SEQ ID NO: 15953 - RNA, 19 nt, Homo sapiens
gagaagcuggacaucauga

SEQ ID NO: 15954 - RNA, 19 nt, Homo sapiens
ggacugccucgccaacuau

SEQ ID NO: 15955 - RNA, 19 nt, Homo sapiens
gaaggcagagcucaacagu

SEQ ID NO: 15956 - RNA, 19 nt, Homo sapiens
agaaggaggcagugaagaa

SEQ ID NO: 15957 - RNA, 19 nt, Homo sapiens
ccgaaugucaggauugaaa

SEQ ID NO: 15958 - RNA, 19 nt, Homo sapiens
caccgaaugucaggauuga

SEQ ID NO: 15959 - RNA, 19 nt, Homo sapiens
acuuagagcugucccugaa

SEQ ID NO: 15960 - RNA, 19 nt, Homo sapiens
gcagagcagcaacaucuuc

SEQ ID NO: 15961 - RNA, 19 nt, Homo sapiens
agaaggagaagaagaagga

SEQ ID NO: 15962 - RNA, 19 nt, Homo sapiens
ggacaucuuccgcaaguac

SEQ ID NO: 15963 - RNA, 19 nt, Homo sapiens
gaaguacaacgacccuauc

SEQ ID NO: 15964 - RNA, 19 nt, Homo sapiens
gggcugccaugaucuggau

SEQ ID NO: 15965 - RNA, 19 nt, Homo sapiens
ccaucaagguggagcaauc

SEQ ID NO: 15966 - RNA, 19 nt, Homo sapiens
gcugaaagaguacgcaaca

SEQ ID NO: 15967 - RNA, 19 nt, Homo sapiens
cggacaaccuggagcugaa

SEQ ID NO: 15968 - RNA, 19 nt, Homo sapiens
gaaggauauucccaaugag

SEQ ID NO: 15969 - RNA, 19 nt, Homo sapiens
ccacugcacauccucuuug

SEQ ID NO: 15970 - RNA, 19 nt, Homo sapiens
agauggagccucugaacaa

SEQ ID NO: 15971 - RNA, 19 nt, Homo sapiens
gcacgcugcucgaccucau

SEQ ID NO: 15972 - RNA, 19 nt, Homo sapiens
uggacugccucgccaacua

SEQ ID NO: 15973 - RNA, 19 nt, Homo sapiens
gacaagaaggagaagaaga

SEQ ID NO: 15974 - RNA, 19 nt, Homo sapiens
gaagcuaguauaccucuac

SEQ ID NO: 15975 - RNA, 19 nt, Homo sapiens
ggguuucucuguagugucu

SEQ ID NO: 15976 - RNA, 19 nt, Homo sapiens
gaggugguguuggcugaga

SEQ ID NO: 15977 - RNA, 19 nt, Homo sapiens
aaggacaucuuccgcaagu

SEQ ID NO: 15978 - RNA, 19 nt, Homo sapiens
ggucaucaaggacaucuuc

SEQ ID NO: 15979 - RNA, 19 nt, Homo sapiens
gaagcuggacaucaugauc

SEQ ID NO: 15980 - RNA, 19 nt, Homo sapiens
cugagauccugaagcauga

SEQ ID NO: 15981 - RNA, 19 nt, Homo sapiens
gugauacauuccucagugu

SEQ ID NO: 15982 - RNA, 19 nt, Homo sapiens
gcagagcucaacagugaca

SEQ ID NO: 15983 - RNA, 19 nt, Homo sapiens
guacgcaacagaaguggau

SEQ ID NO: 15984 - RNA, 19 nt, Homo sapiens
gugacaagaaggagaagaa

SEQ ID NO: 15985 - RNA, 19 nt, Homo sapiens
gcugugaaggugcugauga

SEQ ID NO: 15986 - RNA, 19 nt, Homo sapiens
guggugcucucugcuguga

SEQ ID NO: 15987 - RNA, 19 nt, Homo sapiens
uaccucuacuugaugaauu

SEQ ID NO: 15988 - RNA, 19 nt, Homo sapiens
caaagacugggccgagaga

SEQ ID NO: 15989 - RNA, 19 nt, Homo sapiens
acgagaccauccucaagaa

SEQ ID NO: 15990 - RNA, 19 nt, Homo sapiens
gccaggacaugcucuacca

SEQ ID NO: 15991 - RNA, 19 nt, Homo sapiens
gcucggucaugaagaugga

SEQ ID NO: 15992 - RNA, 19 nt, Homo sapiens
cgacuuugccauccaguuc

SEQ ID NO: 15993 - RNA, 19 nt, Homo sapiens
gaccguggcuacaucuacu

SEQ ID NO: 15994 - RNA, 19 nt, Homo sapiens
ggagaagcuggacaucaug

SEQ ID NO: 15995 - RNA, 19 nt, Homo sapiens
aaagugauugcaucgauga

SEQ ID NO: 15996 - RNA, 19 nt, Homo sapiens
uggccugagugaccucuuu

SEQ ID NO: 15997 - RNA, 19 nt, Homo sapiens
gagcucaacagugacaaga

SEQ ID NO: 15998 - RNA, 19 nt, Homo sapiens
gcagugaagaaagugauug

SEQ ID NO: 15999 - RNA, 19 nt, Homo sapiens
ugaaguacaacgacccuau

SEQ ID NO: 16000 - RNA, 19 nt, Homo sapiens
ucaaucucaucgugcagaa

SEQ ID NO: 16001 - RNA, 19 nt, Homo sapiens
gaaguucauggagauguug

SEQ ID NO: 16002 - RNA, 19 nt, Homo sapiens
uacgguaacuagaucuaau

SEQ ID NO: 16003 - RNA, 19 nt, Homo sapiens
gauggagccucugaacaac

SEQ ID NO: 16004 - RNA, 19 nt, Homo sapiens
uggcagagcugaaagagua

SEQ ID NO: 16005 - RNA, 19 nt, Homo sapiens
ucauggagauguugucuaa

SEQ ID NO: 16006 - RNA, 19 nt, Homo sapiens
ggacgaggauccauaugug

SEQ ID NO: 16007 - RNA, 19 nt, Homo sapiens
caaaaugacugacucaaaa

SEQ ID NO: 16008 - RNA, 19 nt, Homo sapiens
aggcagagcucaacaguga

SEQ ID NO: 16009 - RNA, 19 nt, Homo sapiens
uagacgagcuuaucugcua

SEQ ID NO: 16010 - RNA, 19 nt, Homo sapiens
ugaaggugcugaugaaguu

SEQ ID NO: 16011 - RNA, 19 nt, Homo sapiens
gaaagaguacgcaacagaa

SEQ ID NO: 16012 - RNA, 19 nt, Homo sapiens
gcagcaacaucuucacugu

SEQ ID NO: 16013 - RNA, 19 nt, Homo sapiens
gcaaguaccccaacaagua

SEQ ID NO: 16014 - RNA, 19 nt, Homo sapiens
gcagcgcucucagaaauug

SEQ ID NO: 16015 - RNA, 19 nt, Homo sapiens
cuaaggacuuggacuacua

SEQ ID NO: 16016 - RNA, 19 nt, Homo sapiens
ccaacuauaugcccaagga

SEQ ID NO: 16017 - RNA, 19 nt, Homo sapiens
gaugggagcuguggaccuu

SEQ ID NO: 16018 - RNA, 19 nt, Homo sapiens
gaaggacgaggauccauau

SEQ ID NO: 16019 - RNA, 19 nt, Homo sapiens
gaaggaggcagugaagaaa

SEQ ID NO: 16020 - RNA, 19 nt, Homo sapiens
gcacacugcucaagaagcu

SEQ ID NO: 16021 - RNA, 19 nt, Homo sapiens
guauaccucuacuugauga

SEQ ID NO: 16022 - RNA, 19 nt, Homo sapiens
gcauuagguuuuccuguua

SEQ ID NO: 16023 - RNA, 19 nt, Homo sapiens
agccagagcugcaguaugu

SEQ ID NO: 16024 - RNA, 19 nt, Homo sapiens
agaagccacucaucucuga

SEQ ID NO: 16025 - RNA, 19 nt, Homo sapiens
uggcagcgcucucagaaau

SEQ ID NO: 16026 - RNA, 19 nt, Homo sapiens
ccacucaggacucagauaa

SEQ ID NO: 16027 - RNA, 19 nt, Homo sapiens
gcucaacagugacaagaag

SEQ ID NO: 16028 - RNA, 19 nt, Homo sapiens
gauguugucuaaggacuug

SEQ ID NO: 16029 - RNA, 19 nt, Homo sapiens
gcaaccugcucgaucugaa

SEQ ID NO: 16030 - RNA, 19 nt, Homo sapiens
gaagauggaccggcagaug

SEQ ID NO: 16031 - RNA, 19 nt, Homo sapiens
caucgagcccacacuguua

SEQ ID NO: 16032 - RNA, 19 nt, Homo sapiens
ugaagaagcuaguauaccu

SEQ ID NO: 16033 - RNA, 19 nt, Homo sapiens
cuaaagaagccaacagaga

SEQ ID NO: 16034 - RNA, 19 nt, Homo sapiens
ggaaggcugugcgugcuau

SEQ ID NO: 16035 - RNA, 19 nt, Homo sapiens
guacaacgacccuaucuac

SEQ ID NO: 16036 - RNA, 19 nt, Homo sapiens
ggccugagauccugaagca

SEQ ID NO: 16037 - RNA, 19 nt, Homo sapiens
gaagaaggaggcagugaag

SEQ ID NO: 16038 - RNA, 19 nt, Homo sapiens
ugacagccauugugaaacu

SEQ ID NO: 16039 - RNA, 19 nt, Homo sapiens
acaagaaggagaagaagaa

SEQ ID NO: 16040 - RNA, 19 nt, Homo sapiens
uugacaagaucacagagua

SEQ ID NO: 16041 - RNA, 19 nt, Homo sapiens
uggcuuccgucuaccauaa

SEQ ID NO: 16042 - RNA, 19 nt, Homo sapiens
agaaagugauugcaucgau

SEQ ID NO: 16043 - RNA, 19 nt, Homo sapiens
ugaaagaguacgcaacaga

SEQ ID NO: 16044 - RNA, 19 nt, Homo sapiens
uggagaagcuggacaucau

SEQ ID NO: 16045 - RNA, 19 nt, Homo sapiens
gaccucaucuccgacucua

SEQ ID NO: 16046 - RNA, 19 nt, Homo sapiens
ugaaggacgaggauccaua

SEQ ID NO: 16047 - RNA, 19 nt, Homo sapiens
ugaauuacgccaagaguca

SEQ ID NO: 16048 - RNA, 19 nt, Homo sapiens
ugacagagcauuagguuuu

SEQ ID NO: 16049 - RNA, 19 nt, Homo sapiens
gaagauggagccucugaac

SEQ ID NO: 16050 - RNA, 19 nt, Homo sapiens
gcaguaccagccaaucuug

SEQ ID NO: 16051 - RNA, 19 nt, Homo sapiens
ugcagcagguccucaguuu

SEQ ID NO: 16052 - RNA, 19 nt, Homo sapiens
gaaggcagagcucaacagu

SEQ ID NO: 16053 - RNA, 19 nt, Homo sapiens
gagaagcuggacaucauga

SEQ ID NO: 16054 - RNA, 19 nt, Homo sapiens
ggacugccucgccaacuau

SEQ ID NO: 16055 - RNA, 19 nt, Homo sapiens
agaaggaggcagugaagaa

SEQ ID NO: 16056 - RNA, 19 nt, Homo sapiens
ccgaaugucaggauugaaa

SEQ ID NO: 16057 - RNA, 19 nt, Homo sapiens
caccgaaugucaggauuga

SEQ ID NO: 16058 - RNA, 19 nt, Homo sapiens
acuuagagcugucccugaa

SEQ ID NO: 16059 - RNA, 19 nt, Homo sapiens
gcagagcagcaacaucuuc

SEQ ID NO: 16060 - RNA, 19 nt, Homo sapiens
agaaggagaagaagaagga

SEQ ID NO: 16061 - RNA, 19 nt, Homo sapiens
ggacaucuuccgcaaguac

SEQ ID NO: 16062 - RNA, 19 nt, Homo sapiens
gaaguacaacgacccuauc

SEQ ID NO: 16063 - RNA, 19 nt, Homo sapiens
gggcugccaugaucuggau

SEQ ID NO: 16064 - RNA, 19 nt, Homo sapiens
ccaucaagguggagcaauc

SEQ ID NO: 16065 - RNA, 19 nt, Homo sapiens
gcugaaagaguacgcaaca

SEQ ID NO: 16066 - RNA, 19 nt, Homo sapiens
cggacaaccuggagcugaa

SEQ ID NO: 16067 - RNA, 19 nt, Homo sapiens
gaaggauauucccaaugag

SEQ ID NO: 16068 - RNA, 19 nt, Homo sapiens
ccacugcacauccucuuug

SEQ ID NO: 16069 - RNA, 19 nt, Homo sapiens
agauggagccucugaacaa

SEQ ID NO: 16070 - RNA, 19 nt, Homo sapiens
gcacgcugcucgaccucau

SEQ ID NO: 16071 - RNA, 19 nt, Homo sapiens
uggacugccucgccaacua

SEQ ID NO: 16072 - RNA, 19 nt, Homo sapiens
gacaagaaggagaagaaga

SEQ ID NO: 16073 - RNA, 19 nt, Homo sapiens
gaagcuaguauaccucuac

SEQ ID NO: 16074 - RNA, 19 nt, Homo sapiens
ggguuucucuguagugucu

SEQ ID NO: 16075 - RNA, 19 nt, Homo sapiens
gaggugguguuggcugaga

SEQ ID NO: 16076 - RNA, 19 nt, Homo sapiens
aaggacaucuuccgcaagu

SEQ ID NO: 16077 - RNA, 19 nt, Homo sapiens
ggucaucaaggacaucuuc

SEQ ID NO: 16078 - RNA, 19 nt, Homo sapiens
gaagcuggacaucaugauc

SEQ ID NO: 16079 - RNA, 19 nt, Homo sapiens
cugagauccugaagcauga

SEQ ID NO: 16080 - RNA, 19 nt, Homo sapiens
gugauacauuccucagugu

SEQ ID NO: 16081 - RNA, 19 nt, Homo sapiens
guacgcaacagaaguggau

SEQ ID NO: 16082 - RNA, 19 nt, Homo sapiens
gcagagcucaacagugaca

SEQ ID NO: 16083 - RNA, 19 nt, Homo sapiens
gcugugaaggugcugauga

SEQ ID NO: 16084 - RNA, 19 nt, Homo sapiens
guggugcucucugcuguga

SEQ ID NO: 16085 - RNA, 19 nt, Homo sapiens
gugacaagaaggagaagaa

SEQ ID NO: 16086 - RNA, 19 nt, Homo sapiens
uaccucuacuugaugaauu

SEQ ID NO: 16087 - RNA, 19 nt, Homo sapiens
caaagacugggccgagaga

SEQ ID NO: 16088 - RNA, 19 nt, Homo sapiens
acgagaccauccucaagaa

SEQ ID NO: 16089 - RNA, 19 nt, Homo sapiens
gccaggacaugcucuacca

SEQ ID NO: 16090 - RNA, 19 nt, Homo sapiens
gcucggucaugaagaugga

SEQ ID NO: 16091 - RNA, 19 nt, Homo sapiens
cgacuuugccauccaguuc

SEQ ID NO: 16092 - RNA, 19 nt, Homo sapiens
gaccguggcuacaucuacu

SEQ ID NO: 16093 - RNA, 19 nt, Homo sapiens
ggagaagcuggacaucaug

SEQ ID NO: 16094 - RNA, 19 nt, Homo sapiens
aaagugauugcaucgauga

SEQ ID NO: 16095 - RNA, 19 nt, Homo sapiens
uggccugagugaccucuuu

SEQ ID NO: 16096 - RNA, 19 nt, Homo sapiens
gagcucaacagugacaaga

SEQ ID NO: 16097 - RNA, 19 nt, Homo sapiens
gcagugaagaaagugauug

SEQ ID NO: 16098 - RNA, 19 nt, Homo sapiens
ugaaguacaacgacccuau

SEQ ID NO: 16099 - RNA, 19 nt, Homo sapiens
ucaaucucaucgugcagaa

SEQ ID NO: 16100 - RNA, 19 nt, Homo sapiens
gaaguucauggagauguug

SEQ ID NO: 16101 - RNA, 19 nt, Homo sapiens
uacgguaacuagaucuaau

SEQ ID NO: 16102 - RNA, 19 nt, Homo sapiens
gauggagccucugaacaac

SEQ ID NO: 16103 - RNA, 19 nt, Homo sapiens
cagcagguccucaguuugg

SEQ ID NO: 16104 - RNA, 19 nt, Homo sapiens
ugacagaaguuauaccuua

SEQ ID NO: 16105 - RNA, 19 nt, Homo sapiens
ggaaggaagucauggaauu

SEQ ID NO: 16106 - RNA, 19 nt, Homo sapiens
uaaagaagcuuguguaucu

SEQ ID NO: 16107 - RNA, 19 nt, Homo sapiens
gagcuaaucugccacauug

SEQ ID NO: 16108 - RNA, 19 nt, Homo sapiens
gaagugagcuuagagaugu

SEQ ID NO: 16109 - RNA, 19 nt, Homo sapiens
gaaguagucuugucugaga

SEQ ID NO: 16110 - RNA, 19 nt, Homo sapiens
gaaaggaggcugugaagaa

SEQ ID NO: 16111 - RNA, 19 nt, Homo sapiens
gcagaugaguuacuagaaa

SEQ ID NO: 16112 - RNA, 19 nt, Homo sapiens
gcuaaaggcuuggagauuu

SEQ ID NO: 16113 - RNA, 19 nt, Homo sapiens
uggcagaacugaaagaaua

SEQ ID NO: 16114 - RNA, 19 nt, Homo sapiens
gcacauugcuugaucuaau

SEQ ID NO: 16115 - RNA, 19 nt, Homo sapiens
caacuuaauuguccagaaa

SEQ ID NO: 16116 - RNA, 19 nt, Homo sapiens
gaucagggauuucuggauu

SEQ ID NO: 16117 - RNA, 19 nt, Homo sapiens
gaacggugaucuucuugaa

SEQ ID NO: 16118 - RNA, 19 nt, Homo sapiens
gaaaaggccugaaaucuug

SEQ ID NO: 16119 - RNA, 19 nt, Homo sapiens
gaucugcucuuucuucaug

SEQ ID NO: 16120 - RNA, 19 nt, Homo sapiens
guacaaugaucccaucuau

SEQ ID NO: 16121 - RNA, 19 nt, Homo sapiens
aagcugaacucaacaauga

SEQ ID NO: 16122 - RNA, 19 nt, Homo sapiens
cagaauaggugcagagaug

SEQ ID NO: 16123 - RNA, 19 nt, Homo sapiens
acacugcacuuuacuguuu

SEQ ID NO: 16124 - RNA, 19 nt, Homo sapiens
caacacaggauucugauaa

SEQ ID NO: 16125 - RNA, 19 nt, Homo sapiens
gggagaauaugcugaaaga

SEQ ID NO: 16126 - RNA, 19 nt, Homo sapiens
cuacagagguggauguuga

SEQ ID NO: 16127 - RNA, 19 nt, Homo sapiens
gauaacagcuccuauucuc

SEQ ID NO: 16128 - RNA, 19 nt, Homo sapiens
gcaaauaccccaacaagua

SEQ ID NO: 16129 - RNA, 19 nt, Homo sapiens
ugacagcccugaaugaaug

SEQ ID NO: 16130 - RNA, 19 nt, Homo sapiens
cuacaaaggagaaagauaa

SEQ ID NO: 16131 - RNA, 19 nt, Homo sapiens
gcacaucuauauggaaaug

SEQ ID NO: 16132 - RNA, 19 nt, Homo sapiens
ggagauuuccggaacauuu

SEQ ID NO: 16133 - RNA, 19 nt, Homo sapiens
ugacaaugcagaugaguua

SEQ ID NO: 16134 - RNA, 19 nt, Homo sapiens
caacaaguaugaaaguauc

SEQ ID NO: 16135 - RNA, 19 nt, Homo sapiens
gggcacaucuauauggaaa

SEQ ID NO: 16136 - RNA, 19 nt, Homo sapiens
cguaaacacuugccaauuc

SEQ ID NO: 16137 - RNA, 19 nt, Homo sapiens
ugaauuaugugguccaaga

SEQ ID NO: 16138 - RNA, 19 nt, Homo sapiens
gaaagugauugcugcuaug

SEQ ID NO: 16139 - RNA, 19 nt, Homo sapiens
aaugucagcuggcaucaua

SEQ ID NO: 16140 - RNA, 19 nt, Homo sapiens
gaauucuacuucccauaaa

SEQ ID NO: 16141 - RNA, 19 nt, Homo sapiens
gagaauaugcugaaagaau

SEQ ID NO: 16142 - RNA, 19 nt, Homo sapiens
gaacugaaagaauaugcua

SEQ ID NO: 16143 - RNA, 19 nt, Homo sapiens
uggacugccugucuaauua

SEQ ID NO: 16144 - RNA, 19 nt, Homo sapiens
gugaagauccuaauccuuu

SEQ ID NO: 16145 - RNA, 19 nt, Homo sapiens
gcuuagagauguugcaaau

SEQ ID NO: 16146 - RNA, 19 nt, Homo sapiens
caccaaagcugacagaagu

SEQ ID NO: 16147 - RNA, 19 nt, Homo sapiens
acaauaugcugcugaagaa

SEQ ID NO: 16148 - RNA, 19 nt, Homo sapiens
uaacuuaucuaacccucuu

SEQ ID NO: 16149 - RNA, 19 nt, Homo sapiens
guaaacacuugccaauuca

SEQ ID NO: 16150 - RNA, 19 nt, Homo sapiens
gcagagcgcuguguaagca

SEQ ID NO: 16151 - RNA, 19 nt, Homo sapiens
gaaguuggacaucaugauu

SEQ ID NO: 16152 - RNA, 19 nt, Homo sapiens
gaacaucaacuuaauuguc

SEQ ID NO: 16153 - RNA, 19 nt, Homo sapiens
cauuaaagauccaaaguca

SEQ ID NO: 16154 - RNA, 19 nt, Homo sapiens
gguggaagaucagggauuu

SEQ ID NO: 16155 - RNA, 19 nt, Homo sapiens
gagauuuccggaacauuua

SEQ ID NO: 16156 - RNA, 19 nt, Homo sapiens
gagcagcuaugauuuggau

SEQ ID NO: 16157 - RNA, 19 nt, Homo sapiens
gauguuaguucucucuuuc

SEQ ID NO: 16158 - RNA, 19 nt, Homo sapiens
gaaacagcauaggauugua

SEQ ID NO: 16159 - RNA, 19 nt, Homo sapiens
caagaaaccaucagaaaca

SEQ ID NO: 16160 - RNA, 19 nt, Homo sapiens
gcaagcagacaacacaauu

SEQ ID NO: 16161 - RNA, 19 nt, Homo sapiens
guucucaucucaaagcaaa

SEQ ID NO: 16162 - RNA, 19 nt, Homo sapiens
gagaugaagugagcuuaga

SEQ ID NO: 16163 - RNA, 19 nt, Homo sapiens
guggauauguggcuccuaa

SEQ ID NO: 16164 - RNA, 19 nt, Homo sapiens
agagguggauguugacuuu

SEQ ID NO: 16165 - RNA, 19 nt, Homo sapiens
gauucugacuacuacaaua

SEQ ID NO: 16166 - RNA, 19 nt, Homo sapiens
gcaacuuacuugaucugaa

SEQ ID NO: 16167 - RNA, 19 nt, Homo sapiens
ggauguuaguucucucuuu

SEQ ID NO: 16168 - RNA, 19 nt, Homo sapiens
ugaagucucucaauacauc

SEQ ID NO: 16169 - RNA, 19 nt, Homo sapiens
caauaucgaugucuucuac

SEQ ID NO: 16170 - RNA, 19 nt, Homo sapiens
gaagauggaaccucugaau

SEQ ID NO: 16171 - RNA, 19 nt, Homo sapiens
aaaggaggcugugaagaaa

SEQ ID NO: 16172 - RNA, 19 nt, Homo sapiens
gaagccaccucccaucaca

SEQ ID NO: 16173 - RNA, 19 nt, Homo sapiens
caaaauaccagccuguuua

SEQ ID NO: 16174 - RNA, 19 nt, Homo sapiens
ggaaggauguuaguucucu

SEQ ID NO: 16175 - RNA, 19 nt, Homo sapiens
ccaaguauuucacaaccaa

SEQ ID NO: 16176 - RNA, 19 nt, Homo sapiens
gaagguguagccaguguuu

SEQ ID NO: 16177 - RNA, 19 nt, Homo sapiens
gguggcagcugaauaucuu

SEQ ID NO: 16178 - RNA, 19 nt, Homo sapiens
ugaaugaccuguuugaacu

SEQ ID NO: 16179 - RNA, 19 nt, Homo sapiens
uguuacagcuaaagaagua

SEQ ID NO: 16180 - RNA, 19 nt, Homo sapiens
caaugcagaugaguuacua

SEQ ID NO: 16181 - RNA, 19 nt, Homo sapiens
gauguugacuuuguucgaa

SEQ ID NO: 16182 - RNA, 19 nt, Homo sapiens
gggaaauguugcccuaaga

SEQ ID NO: 16183 - RNA, 19 nt, Homo sapiens
gcaaauaguguucucaucu

SEQ ID NO: 16184 - RNA, 19 nt, Homo sapiens
ggaaacagcauaggauugu

SEQ ID NO: 16185 - RNA, 19 nt, Homo sapiens
cagaugcccugcuuaaauc

SEQ ID NO: 16186 - RNA, 19 nt, Homo sapiens
gaguugaaacagaguaaua

SEQ ID NO: 16187 - RNA, 19 nt, Homo sapiens
gcagagaugcaguuaccua

SEQ ID NO: 16188 - RNA, 19 nt, Homo sapiens
gaaggauauucccaaugaa

SEQ ID NO: 16189 - RNA, 19 nt, Homo sapiens
ccaaacagcaacuuacuug

SEQ ID NO: 16190 - RNA, 19 nt, Homo sapiens
ugacugacuccaaguauuu

SEQ ID NO: 16191 - RNA, 19 nt, Homo sapiens
ugacugagccaacccauga

SEQ ID NO: 16192 - RNA, 19 nt, Homo sapiens
ggauacaaguagugcagaa

SEQ ID NO: 16193 - RNA, 19 nt, Homo sapiens
gaacuuagacucgcuggau

SEQ ID NO: 16194 - RNA, 19 nt, Homo sapiens
agaccaaagugaauuaugu

SEQ ID NO: 16195 - RNA, 19 nt, Homo sapiens
ugaggaacaucaacuuaau

SEQ ID NO: 16196 - RNA, 19 nt, Homo sapiens
ucucauuccucuguucuua

SEQ ID NO: 16197 - RNA, 19 nt, Homo sapiens
gugaagcuguuucucaaga

SEQ ID NO: 16198 - RNA, 19 nt, Homo sapiens
acaaugaucccaucuaugu

SEQ ID NO: 16199 - RNA, 19 nt, Homo sapiens
caacuuacuugaucugaac

SEQ ID NO: 16200 - RNA, 19 nt, Homo sapiens
gaacuaaagaagcuugugu

SEQ ID NO: 16201 - RNA, 19 nt, Homo sapiens
ggaaauguugcccuaagaa

SEQ ID NO: 16202 - RNA, 19 nt, Homo sapiens
caaacacccagaacucuuu

SEQ ID NO: 16203 - RNA, 19 nt, Homo sapiens
gagcagaguuagggaggaa

SEQ ID NO: 16204 - RNA, 19 nt, Homo sapiens
ggagucaucuuaucuauua

SEQ ID NO: 16205 - RNA, 19 nt, Homo sapiens
ggaucaagcuuacauauaa

SEQ ID NO: 16206 - RNA, 19 nt, Homo sapiens
gaagauagaauucaccuuu

SEQ ID NO: 16207 - RNA, 19 nt, Homo sapiens
gcccauaacuugccuguuu

SEQ ID NO: 16208 - RNA, 19 nt, Homo sapiens
gaaagaaugugcugcaauc

SEQ ID NO: 16209 - RNA, 19 nt, Homo sapiens
gcaccauucucauucuuua

SEQ ID NO: 16210 - RNA, 19 nt, Homo sapiens
ggaagagccuauucaggua

SEQ ID NO: 16211 - RNA, 19 nt, Homo sapiens
ugaauagucuccaugauuu

SEQ ID NO: 16212 - RNA, 19 nt, Homo sapiens
gagaaugccugucauggaa

SEQ ID NO: 16213 - RNA, 19 nt, Homo sapiens
gaaguuauguucgugauga

SEQ ID NO: 16214 - RNA, 19 nt, Homo sapiens
caagaaauaugaccacaug

SEQ ID NO: 16215 - RNA, 19 nt, Homo sapiens
gaaagucucugcagcuugu

SEQ ID NO: 16216 - RNA, 19 nt, Homo sapiens
gaagaggaguucaccaguu

SEQ ID NO: 16217 - RNA, 19 nt, Homo sapiens
gagaaaugauccagaaaga

SEQ ID NO: 16218 - RNA, 19 nt, Homo sapiens
gagaagaagacaauacaua

SEQ ID NO: 16219 - RNA, 19 nt, Homo sapiens
gaaaugauccagaaagaau

SEQ ID NO: 16220 - RNA, 19 nt, Homo sapiens
gcacagagcuagauaugac

SEQ ID NO: 16221 - RNA, 19 nt, Homo sapiens
gaugaaguguuggauauuu

SEQ ID NO: 16222 - RNA, 19 nt, Homo sapiens
gaaaguguccuaaucucua

SEQ ID NO: 16223 - RNA, 19 nt, Homo sapiens
caaacgcauuggcuauuua

SEQ ID NO: 16224 - RNA, 19 nt, Homo sapiens
gcagagggcaguagaauau

SEQ ID NO: 16225 - RNA, 19 nt, Homo sapiens
gggcuacccugcucacuuu

SEQ ID NO: 16226 - RNA, 19 nt, Homo sapiens
ggaaggagguugugauugc

SEQ ID NO: 16227 - RNA, 19 nt, Homo sapiens
uagcacagguugccacuaa

SEQ ID NO: 16228 - RNA, 19 nt, Homo sapiens
uaaagaaccucaucauguc

SEQ ID NO: 16229 - RNA, 19 nt, Homo sapiens
uagcagaggugaacaacuu

SEQ ID NO: 16230 - RNA, 19 nt, Homo sapiens
cagccucucuucaaugaua

SEQ ID NO: 16231 - RNA, 19 nt, Homo sapiens
gcucugacaucuuuguuga

SEQ ID NO: 16232 - RNA, 19 nt, Homo sapiens
caagugaagcuaugaauga

SEQ ID NO: 16233 - RNA, 19 nt, Homo sapiens
gcacagguugccacuaaua

SEQ ID NO: 16234 - RNA, 19 nt, Homo sapiens
ccaacuguaucaagaauga

SEQ ID NO: 16235 - RNA, 19 nt, Homo sapiens
gggcaaugcugcuguuaga

SEQ ID NO: 16236 - RNA, 19 nt, Homo sapiens
gcaauccggucaucuuuua

SEQ ID NO: 16237 - RNA, 19 nt, Homo sapiens
guccuaaucucuaauaugu

SEQ ID NO: 16238 - RNA, 19 nt, Homo sapiens
uauccugggucguuucuua

SEQ ID NO: 16239 - RNA, 19 nt, Homo sapiens
gaacugcugaggaggauuu

SEQ ID NO: 16240 - RNA, 19 nt, Homo sapiens
aagaauggcuugaagauag

SEQ ID NO: 16241 - RNA, 19 nt, Homo sapiens
gggaggaaaugacauaaca

SEQ ID NO: 16242 - RNA, 19 nt, Homo sapiens
gcuguuagaugaaagacaa

SEQ ID NO: 16243 - RNA, 19 nt, Homo sapiens
gcagacaaauggagagaca

SEQ ID NO: 16244 - RNA, 19 nt, Homo sapiens
gaagcauuguuaaagacua

SEQ ID NO: 16245 - RNA, 19 nt, Homo sapiens
ucacacaagucauuaaagu

SEQ ID NO: 16246 - RNA, 19 nt, Homo sapiens
gugaagcuaugaaugauau

SEQ ID NO: 16247 - RNA, 19 nt, Homo sapiens
agauuuggaugucucaaua

SEQ ID NO: 16248 - RNA, 19 nt, Homo sapiens
gaaaugaugaugauucaag

SEQ ID NO: 16249 - RNA, 19 nt, Homo sapiens
aagaggaguucaccaguuu

SEQ ID NO: 16250 - RNA, 19 nt, Homo sapiens
ugaaggauauggugcucua

SEQ ID NO: 16251 - RNA, 19 nt, Homo sapiens
aagcaauucuuggugauua

SEQ ID NO: 16252 - RNA, 19 nt, Homo sapiens
gauauucaccagaacauga

SEQ ID NO: 16253 - RNA, 19 nt, Homo sapiens
caacugcgccuacaagcaa

SEQ ID NO: 16254 - RNA, 19 nt, Homo sapiens
ggaguucaccaguuucaaa

SEQ ID NO: 16255 - RNA, 19 nt, Homo sapiens
uaacuugccuguuugaacu

SEQ ID NO: 16256 - RNA, 19 nt, Homo sapiens
uaaaguuacugcugaccuu

SEQ ID NO: 16257 - RNA, 19 nt, Homo sapiens
cgaaugcggaucaagcuua

SEQ ID NO: 16258 - RNA, 19 nt, Homo sapiens
aaaguguccuaaucucuaa

SEQ ID NO: 16259 - RNA, 19 nt, Homo sapiens
uaaauauccugggucguuu

SEQ ID NO: 16260 - RNA, 19 nt, Homo sapiens
caaugcugcuguuagauga

SEQ ID NO: 16261 - RNA, 19 nt, Homo sapiens
gaaaaggacugcaauccau

SEQ ID NO: 16262 - RNA, 19 nt, Homo sapiens
uuaaagaaccucaucaugu

SEQ ID NO: 16263 - RNA, 19 nt, Homo sapiens
uguaaacacuggacagaug

SEQ ID NO: 16264 - RNA, 19 nt, Homo sapiens
gugcauugcuguauacaca

SEQ ID NO: 16265 - RNA, 19 nt, Homo sapiens
auaagcagcuggucuggaa

SEQ ID NO: 16266 - RNA, 19 nt, Homo sapiens
gauaugacggacuuuguuu

SEQ ID NO: 16267 - RNA, 19 nt, Homo sapiens
acaaauggcccuacugaga

SEQ ID NO: 16268 - RNA, 19 nt, Homo sapiens
caugaggucugcccuacuu

SEQ ID NO: 16269 - RNA, 19 nt, Homo sapiens
gaagagccuauucagguaa

SEQ ID NO: 16270 - RNA, 19 nt, Homo sapiens
guacagacagaucauaaug

SEQ ID NO: 16271 - RNA, 19 nt, Homo sapiens
uaacacuggcacugaaaua

SEQ ID NO: 16272 - RNA, 19 nt, Homo sapiens
gcaaaauggucaccuucua

SEQ ID NO: 16273 - RNA, 19 nt, Homo sapiens
gauuuggcaugaaggauau

SEQ ID NO: 16274 - RNA, 19 nt, Homo sapiens
uaacagugauaacgauaca

SEQ ID NO: 16275 - RNA, 19 nt, Homo sapiens
ccacaaauggcccuacuga

SEQ ID NO: 16276 - RNA, 19 nt, Homo sapiens
ucgauucacuuguacugua

SEQ ID NO: 16277 - RNA, 19 nt, Homo sapiens
ucaacaaccuuugguacaa

SEQ ID NO: 16278 - RNA, 19 nt, Homo sapiens
gaggcaugaugaaagaauu

SEQ ID NO: 16279 - RNA, 19 nt, Homo sapiens
ucagagaugugcagagauc

SEQ ID NO: 16280 - RNA, 19 nt, Homo sapiens
gcaaugcugcuguuagaug

SEQ ID NO: 16281 - RNA, 19 nt, Homo sapiens
acaaacgcauuggcuauuu

SEQ ID NO: 16282 - RNA, 19 nt, Homo sapiens
gaccaucacacaagucauu

SEQ ID NO: 16283 - RNA, 19 nt, Homo sapiens
cacagccucucuucaauga

SEQ ID NO: 16284 - RNA, 19 nt, Homo sapiens
agagggcaguagaauauaa

SEQ ID NO: 16285 - RNA, 19 nt, Homo sapiens
ggagaugcaugccuauacu

SEQ ID NO: 16286 - RNA, 19 nt, Homo sapiens
uggcauauagacacaauua

SEQ ID NO: 16287 - RNA, 19 nt, Homo sapiens
ucauggauauuaagucaga

SEQ ID NO: 16288 - RNA, 19 nt, Homo sapiens
gaccaacuguaucaagaau

SEQ ID NO: 16289 - RNA, 19 nt, Homo sapiens
ccuucuaacuggaacauuu

SEQ ID NO: 16290 - RNA, 19 nt, Homo sapiens
gaguauuggagucaucuua

SEQ ID NO: 16291 - RNA, 19 nt, Homo sapiens
agauagaauucaccuuuga

SEQ ID NO: 16292 - RNA, 19 nt, Homo sapiens
cagccaggccaaugauuua

SEQ ID NO: 16293 - RNA, 19 nt, Homo sapiens
ggucguuucuuauugaaca

SEQ ID NO: 16294 - RNA, 19 nt, Homo sapiens
ggaaaugcuauucuuuaug

SEQ ID NO: 16295 - RNA, 19 nt, Homo sapiens
gcucagcaaugcaagaucu

SEQ ID NO: 16296 - RNA, 19 nt, Homo sapiens
cgauucacuuguacuguaa

SEQ ID NO: 16297 - RNA, 19 nt, Homo sapiens
guacaaagcaauucuuggu

SEQ ID NO: 16298 - RNA, 19 nt, Homo sapiens
ccucagagaugugcagaga

SEQ ID NO: 16299 - RNA, 19 nt, Homo sapiens
caucacagccucucuucaa

SEQ ID NO: 16300 - RNA, 19 nt, Homo sapiens
gaggaugaaguguuggaua

SEQ ID NO: 16301 - RNA, 19 nt, Homo sapiens
gaagaggaagagccuauuc

SEQ ID NO: 16302 - RNA, 19 nt, Homo sapiens
guugaagacuguacagaca

SEQ ID NO: 16303 - RNA, 19 nt, Homo sapiens
guaggaaaugcuauucuuu

SEQ ID NO: 16304 - RNA, 19 nt, Homo sapiens
ucaaauaacuggcagaauc

SEQ ID NO: 16305 - RNA, 19 nt, Homo sapiens
gccaagaccugcaauguug

SEQ ID NO: 16306 - RNA, 19 nt, Homo sapiens
gcagaugggcucagaguuu

SEQ ID NO: 16307 - RNA, 19 nt, Homo sapiens
acgaugacauggacuauua

SEQ ID NO: 16308 - RNA, 19 nt, Homo sapiens
ugacauggacuauuacuuu

SEQ ID NO: 16309 - RNA, 19 nt, Homo sapiens
acacagagguggugacaga

SEQ ID NO: 16310 - RNA, 19 nt, Homo sapiens
ccaagaagcccaaagagaa

SEQ ID NO: 16311 - RNA, 19 nt, Homo sapiens
aaacaugacugggaccuaa

SEQ ID NO: 16312 - RNA, 19 nt, Homo sapiens
ggagggcuuugacaucuuu

SEQ ID NO: 16313 - RNA, 19 nt, Homo sapiens
ggagaaagaggaggagaua

SEQ ID NO: 16314 - RNA, 19 nt, Homo sapiens
ccaagaagcccaaggagaa

SEQ ID NO: 16315 - RNA, 19 nt, Homo sapiens
ggacuacaaugaccagauc

SEQ ID NO: 16316 - RNA, 19 nt, Homo sapiens
ggaagaaaggcaagaaaga

SEQ ID NO: 16317 - RNA, 19 nt, Homo sapiens
ggaccgggacuaucaauga

SEQ ID NO: 16318 - RNA, 19 nt, Homo sapiens
ggaggacuaugaggacuuu

SEQ ID NO: 16319 - RNA, 19 nt, Homo sapiens
ucaguuaccugcauaccaa

SEQ ID NO: 16320 - RNA, 19 nt, Homo sapiens
gacauggacuauuacuuug

SEQ ID NO: 16321 - RNA, 19 nt, Homo sapiens
gagccaaggucacuccaau

SEQ ID NO: 16322 - RNA, 19 nt, Homo sapiens
gaccugcaauguugacuau

SEQ ID NO: 16323 - RNA, 19 nt, Homo sapiens
caaguucccucaugagagu

SEQ ID NO: 16324 - RNA, 19 nt, Homo sapiens
caaggucacuccaauaaaa

SEQ ID NO: 16325 - RNA, 19 nt, Homo sapiens
caacggcuaugaggaaaug

SEQ ID NO: 16326 - RNA, 19 nt, Homo sapiens
ggauugagccuccugugaa

SEQ ID NO: 16327 - RNA, 19 nt, Homo sapiens
gaaaggcaagaaagacaaa

SEQ ID NO: 16328 - RNA, 19 nt, Homo sapiens
gccaaggucacuccaauaa

SEQ ID NO: 16329 - RNA, 19 nt, Homo sapiens
ucacaacaguagagaccua

SEQ ID NO: 16330 - RNA, 19 nt, Homo sapiens
ccacugaggacgacuacua

SEQ ID NO: 16331 - RNA, 19 nt, Homo sapiens
gaggagggcuuugacaucu

SEQ ID NO: 16332 - RNA, 19 nt, Homo sapiens
ggugguggcucguuucauc

SEQ ID NO: 16333 - RNA, 19 nt, Homo sapiens
gaggacgacuacuaugaug

SEQ ID NO: 16334 - RNA, 19 nt, Homo sapiens
ccaaggagaagccaccuaa

SEQ ID NO: 16335 - RNA, 19 nt, Homo sapiens
gcgagcggcuaguauccua

SEQ ID NO: 16336 - RNA, 19 nt, Homo sapiens
ccauggagaucucagacaa

SEQ ID NO: 16337 - RNA, 19 nt, Homo sapiens
gcaaugacagccagacaug

SEQ ID NO: 16338 - RNA, 19 nt, Homo sapiens
gugacaaguucccucauga

SEQ ID NO: 16339 - RNA, 19 nt, Homo sapiens
ggacugaggagggcuuuga

SEQ ID NO: 16340 - RNA, 19 nt, Homo sapiens
cagaugggcucagaguuug

SEQ ID NO: 16341 - RNA, 19 nt, Homo sapiens
aaaacaagcucauggcaaa

SEQ ID NO: 16342 - RNA, 19 nt, Homo sapiens
gaucagcguccuaccaaga

SEQ ID NO: 16343 - RNA, 19 nt, Homo sapiens
gaagggcaaggaccacaaa

SEQ ID NO: 16344 - RNA, 19 nt, Homo sapiens
ccugcaauguugacuauga

SEQ ID NO: 16345 - RNA, 19 nt, Homo sapiens
gcagaagugccuccggaaa

SEQ ID NO: 16346 - RNA, 19 nt, Homo sapiens
cacgaggccucaagaucua

SEQ ID NO: 16347 - RNA, 19 nt, Homo sapiens
gaaggaggagcugaagaaa

SEQ ID NO: 16348 - RNA, 19 nt, Homo sapiens
gagaucagcguccuaccaa

SEQ ID NO: 16349 - RNA, 19 nt, Homo sapiens
caagguggagcccgaguuu

SEQ ID NO: 16350 - RNA, 19 nt, Homo sapiens
agacugagaccuacacaga

SEQ ID NO: 16351 - RNA, 19 nt, Homo sapiens
ucaugaagguggugaacga

SEQ ID NO: 16352 - RNA, 19 nt, Homo sapiens
ggaaaagaccaaagacaaa

SEQ ID NO: 16353 - RNA, 19 nt, Homo sapiens
acacacccgugcugaguga

SEQ ID NO: 16354 - RNA, 19 nt, Homo sapiens
gagcugaggagaggaaaug

SEQ ID NO: 16355 - RNA, 19 nt, Homo sapiens
gaagaaaggcaagaaagac

SEQ ID NO: 16356 - RNA, 19 nt, Homo sapiens
agaaggaggagcugaagaa

SEQ ID NO: 16357 - RNA, 19 nt, Homo sapiens
gauugagccuccugugaag

SEQ ID NO: 16358 - RNA, 19 nt, Homo sapiens
ccaccaagaagcccaaaga

SEQ ID NO: 16359 - RNA, 19 nt, Homo sapiens
cagagguggugacagaguu

SEQ ID NO: 16360 - RNA, 19 nt, Homo sapiens
gacaaguucccucaugaga

SEQ ID NO: 16361 - RNA, 19 nt, Homo sapiens
caccuaaggccaccaagaa

SEQ ID NO: 16362 - RNA, 19 nt, Homo sapiens
cagcauccaugacgauuuu

SEQ ID NO: 16363 - RNA, 19 nt, Homo sapiens
gaaagggcgaggaguugga

SEQ ID NO: 16364 - RNA, 19 nt, Homo sapiens
ccaccgaugaccuggauuu

SEQ ID NO: 16365 - RNA, 19 nt, Homo sapiens
gcuacuacgcacagaauga

SEQ ID NO: 16366 - RNA, 19 nt, Homo sapiens
ggacacacccgugcugagu

SEQ ID NO: 16367 - RNA, 19 nt, Homo sapiens
guauggacacugaaaggaa

SEQ ID NO: 16368 - RNA, 19 nt, Homo sapiens
gacuucaguuaccugcaua

SEQ ID NO: 16369 - RNA, 19 nt, Homo sapiens
gacuaucaaugacuucagu

SEQ ID NO: 16370 - RNA, 19 nt, Homo sapiens
ccacacuggacuacaauga

SEQ ID NO: 16371 - RNA, 19 nt, Homo sapiens
gaccuacacagugaacuuu

SEQ ID NO: 16372 - RNA, 19 nt, Homo sapiens
ucccggaucucaacucugu

SEQ ID NO: 16373 - RNA, 19 nt, Homo sapiens
caagaagcccaaagagaag

SEQ ID NO: 16374 - RNA, 19 nt, Homo sapiens
ugacuucaguuaccugcau

SEQ ID NO: 16375 - RNA, 19 nt, Homo sapiens
caaagacaaagggaagaaa

SEQ ID NO: 16376 - RNA, 19 nt, Homo sapiens
ucacgaggccucaagaucu

SEQ ID NO: 16377 - RNA, 19 nt, Homo sapiens
ggacgacuacuaugauggu

SEQ ID NO: 16378 - RNA, 19 nt, Homo sapiens
gauggagucacaccguauu

SEQ ID NO: 16379 - RNA, 19 nt, Homo sapiens
gggcaaggaccacaaagag

SEQ ID NO: 16380 - RNA, 19 nt, Homo sapiens
ccaaggaggagaccgacaa

SEQ ID NO: 16381 - RNA, 19 nt, Homo sapiens
ccaaggucacuccaauaaa

SEQ ID NO: 16382 - RNA, 19 nt, Homo sapiens
acagucacaucacccauca

SEQ ID NO: 16383 - RNA, 19 nt, Homo sapiens
cgagguggagcccgaguuu

SEQ ID NO: 16384 - RNA, 19 nt, Homo sapiens
gggaagaaaggcaagaaag

SEQ ID NO: 16385 - RNA, 19 nt, Homo sapiens
gaacguggacaaggacaca

SEQ ID NO: 16386 - RNA, 19 nt, Homo sapiens
uaacuugcccaucccugaa

SEQ ID NO: 16387 - RNA, 19 nt, Homo sapiens
cagcgcagaugggcucaga

SEQ ID NO: 16388 - RNA, 19 nt, Homo sapiens
acuaugaggacuuugagua

SEQ ID NO: 16389 - RNA, 19 nt, Homo sapiens
gagcaaggcauccccauug

SEQ ID NO: 16390 - RNA, 19 nt, Homo sapiens
ccaaagacaaagggaagaa

SEQ ID NO: 16391 - RNA, 19 nt, Homo sapiens
cuaucaaugacuucaguua

SEQ ID NO: 16392 - RNA, 19 nt, Homo sapiens
ccaccaagaagcccaagga

SEQ ID NO: 16393 - RNA, 19 nt, Homo sapiens
caccaacggcuaugaggaa

SEQ ID NO: 16394 - RNA, 19 nt, Homo sapiens
gauguacaccaacggcuau

SEQ ID NO: 16395 - RNA, 19 nt, Homo sapiens
ggacgccuacggagaaagu

SEQ ID NO: 16396 - RNA, 19 nt, Homo sapiens
ugacuauggugaugguuac

SEQ ID NO: 16397 - RNA, 19 nt, Homo sapiens
ccaccaagaagcccaagga

SEQ ID NO: 16398 - RNA, 19 nt, Homo sapiens
uugcugcaguguuggagua

SEQ ID NO: 16399 - RNA, 19 nt, Homo sapiens
ccaccugccagucucguaa

SEQ ID NO: 16400 - RNA, 19 nt, Homo sapiens
ggaacccgaguuugaggaa

SEQ ID NO: 16401 - RNA, 19 nt, Homo sapiens
gcgagugggagaacaacaa

SEQ ID NO: 16402 - RNA, 19 nt, Homo sapiens
ugugacaaguucccucaug

SEQ ID NO: 16403 - RNA, 19 nt, Homo sapiens
acgacgagaucgaggaguu

SEQ ID NO: 16404 - RNA, 19 nt, Homo sapiens
ggagagaaaggaauguuua

SEQ ID NO: 16405 - RNA, 19 nt, Homo sapiens
uggcuaaacucccauagua

SEQ ID NO: 16406 - RNA, 19 nt, Homo sapiens
gcucgaaugugacaaguug

SEQ ID NO: 16407 - RNA, 19 nt, Homo sapiens
gcuaaacucccauaguauu

SEQ ID NO: 16408 - RNA, 19 nt, Homo sapiens
aaaggaauguuuagcacaa

SEQ ID NO: 16409 - RNA, 19 nt, Homo sapiens
caaagacgaauuucagcua

SEQ ID NO: 16410 - RNA, 19 nt, Homo sapiens
gcacaaacaggcugagauc

SEQ ID NO: 16411 - RNA, 19 nt, Homo sapiens
gcacggagagaaaggaaug

SEQ ID NO: 16412 - RNA, 19 nt, Homo sapiens
gccucaagcucgaauguga

SEQ ID NO: 16413 - RNA, 19 nt, Homo sapiens
guggauaccugcccugaca

SEQ ID NO: 16414 - RNA, 19 nt, Homo sapiens
gagaaaggaauguuuagca

SEQ ID NO: 16415 - RNA, 19 nt, Homo sapiens
gugacaaguuggccaguga

SEQ ID NO: 16416 - RNA, 19 nt, Homo sapiens
gcaggccaccucuagcuuu

SEQ ID NO: 16417 - RNA, 19 nt, Homo sapiens
uaccugcccugacauguga

SEQ ID NO: 16418 - RNA, 19 nt, Homo sapiens
ggaggaugauggcgagaag

SEQ ID NO: 16419 - RNA, 19 nt, Homo sapiens
cuaaacucccauaguauuu

SEQ ID NO: 16420 - RNA, 19 nt, Homo sapiens
ccgcaucaaagacgaauuu

SEQ ID NO: 16421 - RNA, 19 nt, Homo sapiens
ccacucaccaccucugcua

SEQ ID NO: 16422 - RNA, 19 nt, Homo sapiens
cucccgagcugaacucuau

SEQ ID NO: 16423 - RNA, 19 nt, Homo sapiens
gagagaaaggaauguuuag

SEQ ID NO: 16424 - RNA, 19 nt, Homo sapiens
caucaaagacgaauuucag

SEQ ID NO: 16425 - RNA, 19 nt, Homo sapiens
gagauguccuacggcuuga

SEQ ID NO: 16426 - RNA, 19 nt, Homo sapiens
caaguuggccagugagaag

SEQ ID NO: 16427 - RNA, 19 nt, Homo sapiens
gcacgagggacgagcuuag

SEQ ID NO: 16428 - RNA, 19 nt, Homo sapiens
ugacaugugaggcaagcua

SEQ ID NO: 16429 - RNA, 19 nt, Homo sapiens
gcgagaagucggauuagca

SEQ ID NO: 16430 - RNA, 19 nt, Homo sapiens
gaugcagcgucacuaugug

SEQ ID NO: 16431 - RNA, 19 nt, Homo sapiens
gagaugcagcgucacuaug

SEQ ID NO: 16432 - RNA, 19 nt, Homo sapiens
ggccaccucuagcuuucuu

SEQ ID NO: 16433 - RNA, 19 nt, Homo sapiens
gguacugcaugcacgcaau

SEQ ID NO: 16434 - RNA, 19 nt, Homo sapiens
aaauaaagaugaggguacu

SEQ ID NO: 16435 - RNA, 19 nt, Homo sapiens
gacaugugaggcaagcuaa

SEQ ID NO: 16436 - RNA, 19 nt, Homo sapiens
ccagugagaagucagagau

SEQ ID NO: 16437 - RNA, 19 nt, Homo sapiens
gcaucaaagacgaauuuca

SEQ ID NO: 16438 - RNA, 19 nt, Homo sapiens
gcucgggauuggcuaaacu

SEQ ID NO: 16439 - RNA, 19 nt, Homo sapiens
acagaggcacggagagaaa

SEQ ID NO: 16440 - RNA, 19 nt, Homo sapiens
ggagcucgggauuggcuaa

SEQ ID NO: 16441 - RNA, 19 nt, Homo sapiens
ugcccuaccucucccaaga

SEQ ID NO: 16442 - RNA, 19 nt, Homo sapiens
ggauaccugcccugacaug

SEQ ID NO: 16443 - RNA, 19 nt, Homo sapiens
caggccaccucuagcuuuc

SEQ ID NO: 16444 - RNA, 19 nt, Homo sapiens
cggagagaaaggaauguuu

SEQ ID NO: 16445 - RNA, 19 nt, Homo sapiens
agacgaauuucagcuacug

SEQ ID NO: 16446 - RNA, 19 nt, Homo sapiens
accucuagcuuucuuccua

SEQ ID NO: 16447 - RNA, 19 nt, Homo sapiens
gacagaggcacggagagaa

SEQ ID NO: 16448 - RNA, 19 nt, Homo sapiens
caugauguuuccacaaagc

SEQ ID NO: 16449 - RNA, 19 nt, Homo sapiens
caagaacgggcacgauggu

SEQ ID NO: 16450 - RNA, 19 nt, Homo sapiens
agacagaggcacggagaga

SEQ ID NO: 16451 - RNA, 19 nt, Homo sapiens
acuaugugauguacuacga

SEQ ID NO: 16452 - RNA, 19 nt, Homo sapiens
guacugcaugcacgcaaug

SEQ ID NO: 16453 - RNA, 19 nt, Homo sapiens
ggcuaaacucccauaguau

SEQ ID NO: 16454 - RNA, 19 nt, Homo sapiens
aggaauguuuagcacaaga

SEQ ID NO: 16455 - RNA, 19 nt, Homo sapiens
gcaggucuugggagccauu

SEQ ID NO: 16456 - RNA, 19 nt, Homo sapiens
agaugcagcgucacuaugu

SEQ ID NO: 16457 - RNA, 19 nt, Homo sapiens
cagccugguuagguggaua

SEQ ID NO: 16458 - RNA, 19 nt, Homo sapiens
gaauguuuagcacaagaca

SEQ ID NO: 16459 - RNA, 19 nt, Homo sapiens
caacuaacauccaguaaua

SEQ ID NO: 16460 - RNA, 19 nt, Homo sapiens
gaaauuaagucccuaaaga

SEQ ID NO: 16461 - RNA, 19 nt, Homo sapiens
gaaaugauccugaaacaaa

SEQ ID NO: 16462 - RNA, 19 nt, Homo sapiens
gagaggagacuuccaaaua

SEQ ID NO: 16463 - RNA, 19 nt, Homo sapiens
gaaaucagcuagagaccaa

SEQ ID NO: 16464 - RNA, 19 nt, Homo sapiens
gaaugaaccuuauaagaca

SEQ ID NO: 16465 - RNA, 19 nt, Homo sapiens
ggagaugucuguuggauuc

SEQ ID NO: 16466 - RNA, 19 nt, Homo sapiens
cauacaagaugcauguuua

SEQ ID NO: 16467 - RNA, 19 nt, Homo sapiens
ggaaguaguuuaaaugucu

SEQ ID NO: 16468 - RNA, 19 nt, Homo sapiens
gaagagaucguuaauauac

SEQ ID NO: 16469 - RNA, 19 nt, Homo sapiens
caacuauccuauucuguaa

SEQ ID NO: 16470 - RNA, 19 nt, Homo sapiens
caaauacacuacauagaga

SEQ ID NO: 16471 - RNA, 19 nt, Homo sapiens
gagcauaaauagcuucugu

SEQ ID NO: 16472 - RNA, 19 nt, Homo sapiens
caacaaggaucaccucgau

SEQ ID NO: 16473 - RNA, 19 nt, Homo sapiens
auaaauagcuucuguuugg

SEQ ID NO: 16474 - RNA, 19 nt, Homo sapiens
caacaccugccuuaaauuu

SEQ ID NO: 16475 - RNA, 19 nt, Homo sapiens
ccugauacauccugaagua

SEQ ID NO: 16476 - RNA, 19 nt, Homo sapiens
ggccacaucuuaccugauu

SEQ ID NO: 16477 - RNA, 19 nt, Homo sapiens
ggacaacaacggaugauga

SEQ ID NO: 16478 - RNA, 19 nt, Homo sapiens
gcuagagaccaauuuaaua

SEQ ID NO: 16479 - RNA, 19 nt, Homo sapiens
gcauaaauagcuucuguuu

SEQ ID NO: 16480 - RNA, 19 nt, Homo sapiens
uuaagucccuaaagacaua

SEQ ID NO: 16481 - RNA, 19 nt, Homo sapiens
gcacaacuaacauccagua

SEQ ID NO: 16482 - RNA, 19 nt, Homo sapiens
aggaacaucuucugaguaa

SEQ ID NO: 16483 - RNA, 19 nt, Homo sapiens
caacaacuauccuauucug

SEQ ID NO: 16484 - RNA, 19 nt, Homo sapiens
uaucuucccugcacaacua

SEQ ID NO: 16485 - RNA, 19 nt, Homo sapiens
caaccacucugauuaucuu

SEQ ID NO: 16486 - RNA, 19 nt, Homo sapiens
uaugacaucuuauccugua

SEQ ID NO: 16487 - RNA, 19 nt, Homo sapiens
gcacaaauacacuacauag

SEQ ID NO: 16488 - RNA, 19 nt, Homo sapiens
aaacaggguugcaaagguu

SEQ ID NO: 16489 - RNA, 19 nt, Homo sapiens
gaagaugaguuggagugaa

SEQ ID NO: 16490 - RNA, 19 nt, Homo sapiens
aaauaggucuuaugugguu

SEQ ID NO: 16491 - RNA, 19 nt, Homo sapiens
ccacaaagcaaacagaguu

SEQ ID NO: 16492 - RNA, 19 nt, Homo sapiens
gggaaaugauccugaaaca

SEQ ID NO: 16493 - RNA, 19 nt, Homo sapiens
gaaauuaaacaccucuugu

SEQ ID NO: 16494 - RNA, 19 nt, Homo sapiens
uaaagccacuugucugugu

SEQ ID NO: 16495 - RNA, 19 nt, Homo sapiens
ccaaguaacugugaagaca

SEQ ID NO: 16496 - RNA, 19 nt, Homo sapiens
aaaaugcacugaagccuua

SEQ ID NO: 16497 - RNA, 19 nt, Homo sapiens
caaacagaguucagucuca

SEQ ID NO: 16498 - RNA, 19 nt, Homo sapiens
ugugaagccugcccaagua

SEQ ID NO: 16499 - RNA, 19 nt, Homo sapiens
caauggaagagcacaguua

SEQ ID NO: 16500 - RNA, 19 nt, Homo sapiens
ccacuacacucagauuguu

SEQ ID NO: 16501 - RNA, 19 nt, Homo sapiens
guacaagaagagaucguua

SEQ ID NO: 16502 - RNA, 19 nt, Homo sapiens
gaacaucuucugaguaaac

SEQ ID NO: 16503 - RNA, 19 nt, Homo sapiens
gauacauccugaaguaaca

SEQ ID NO: 16504 - RNA, 19 nt, Homo sapiens
caucuuauccuguaucaug

SEQ ID NO: 16505 - RNA, 19 nt, Homo sapiens
caagaagagaucguuaaua

SEQ ID NO: 16506 - RNA, 19 nt, Homo sapiens
ggucacauauuauuauugc

SEQ ID NO: 16507 - RNA, 19 nt, Homo sapiens
agacaggcgucccauguga

SEQ ID NO: 16508 - RNA, 19 nt, Homo sapiens
aacaacggaugaugacaua

SEQ ID NO: 16509 - RNA, 19 nt, Homo sapiens
ggaaauuaaacaccucuug

SEQ ID NO: 16510 - RNA, 19 nt, Homo sapiens
gcaacaugcugaagaugag

SEQ ID NO: 16511 - RNA, 19 nt, Homo sapiens
cuacuaugaugaauacuuc

SEQ ID NO: 16512 - RNA, 19 nt, Homo sapiens
agucucaucuugcaaggua

SEQ ID NO: 16513 - RNA, 19 nt, Homo sapiens
uaaaggcuguguggacuug

SEQ ID NO: 16514 - RNA, 19 nt, Homo sapiens
caacuguucuaugcuguga

SEQ ID NO: 16515 - RNA, 19 nt, Homo sapiens
ugacauacaaguccauuau

SEQ ID NO: 16516 - RNA, 19 nt, Homo sapiens
uaaacaggguugcaaaggu

SEQ ID NO: 16517 - RNA, 19 nt, Homo sapiens
gcugugccauugcaucuug

SEQ ID NO: 16518 - RNA, 19 nt, Homo sapiens
guaucauggucaaguguaa

SEQ ID NO: 16519 - RNA, 19 nt, Homo sapiens
acaacuauccuauucugua

SEQ ID NO: 16520 - RNA, 19 nt, Homo sapiens
ugagggaaaugauccugaa

SEQ ID NO: 16521 - RNA, 19 nt, Homo sapiens
guucuuaucaggacacaaa

SEQ ID NO: 16522 - RNA, 19 nt, Homo sapiens
gguugcugcugcuugcuua

SEQ ID NO: 16523 - RNA, 19 nt, Homo sapiens
gaggaacaucuucugagua

SEQ ID NO: 16524 - RNA, 19 nt, Homo sapiens
ggucuuaugugguucaacu

SEQ ID NO: 16525 - RNA, 19 nt, Homo sapiens
gaggagaugucuguuggau

SEQ ID NO: 16526 - RNA, 19 nt, Homo sapiens
aaaguuauacccaguucua

SEQ ID NO: 16527 - RNA, 19 nt, Homo sapiens
cuucguaugccauuaauuu

SEQ ID NO: 16528 - RNA, 19 nt, Homo sapiens
ccaaaguuauacccaguuc

SEQ ID NO: 16529 - RNA, 19 nt, Homo sapiens
gagauucaggaaagccuua

SEQ ID NO: 16530 - RNA, 19 nt, Homo sapiens
agaguucagucucaucuug

SEQ ID NO: 16531 - RNA, 19 nt, Homo sapiens
uccaacaccugccuuaaau

SEQ ID NO: 16532 - RNA, 19 nt, Homo sapiens
auacuucgacugugacaua

SEQ ID NO: 16533 - RNA, 19 nt, Homo sapiens
acagugagucuacaaguuu

SEQ ID NO: 16534 - RNA, 19 nt, Homo sapiens
agaggagacuuccaaauac

SEQ ID NO: 16535 - RNA, 19 nt, Homo sapiens
cuaccuacuuguauauuuc

SEQ ID NO: 16536 - RNA, 19 nt, Homo sapiens
ugaggaacaucuucugagu

SEQ ID NO: 16537 - RNA, 19 nt, Homo sapiens
ggaaagccuuaggguggaa

SEQ ID NO: 16538 - RNA, 19 nt, Homo sapiens
ugaagaggcugcacaaaau

SEQ ID NO: 16539 - RNA, 19 nt, Homo sapiens
cugcuaaauuucacugauu

SEQ ID NO: 16540 - RNA, 19 nt, Homo sapiens
ugcaaccacucaacaacua

SEQ ID NO: 16541 - RNA, 19 nt, Homo sapiens
ggaaaugauccugaaacaa

SEQ ID NO: 16542 - RNA, 19 nt, Homo sapiens
gaugaugacauaacuacug

SEQ ID NO: 16543 - RNA, 19 nt, Homo sapiens
ucaccgacuugccaaaugu

SEQ ID NO: 16544 - RNA, 19 nt, Homo sapiens
ccaguucuaccuacuugua

SEQ ID NO: 16545 - RNA, 19 nt, Homo sapiens
acugaagccuuagggaaua

SEQ ID NO: 16546 - RNA, 19 nt, Homo sapiens
gugaagcaagaaacaauaa

SEQ ID NO: 16547 - RNA, 19 nt, Homo sapiens
ucagcuagagaccaauuua

SEQ ID NO: 16548 - RNA, 19 nt, Homo sapiens
acaaggaucaccucgauau

SEQ ID NO: 16549 - RNA, 19 nt, Homo sapiens
guacugauugcauacaaga

SEQ ID NO: 16550 - RNA, 19 nt, Homo sapiens
cugggucccucaacaguaa

SEQ ID NO: 16551 - RNA, 19 nt, Homo sapiens
uaacucccauccugauaca

SEQ ID NO: 16552 - RNA, 19 nt, Homo sapiens
acaaauacacuacauagag

SEQ ID NO: 16553 - RNA, 19 nt, Homo sapiens
uaagacaggcgucccaugu

SEQ ID NO: 16554 - RNA, 19 nt, Homo sapiens
cucgauaucucuacguuug

SEQ ID NO: 16555 - RNA, 19 nt, Homo sapiens
cauggagaauggacaacaa

SEQ ID NO: 16556 - RNA, 19 nt, Homo sapiens
uuucaaacauggagaaugg

SEQ ID NO: 16557 - RNA, 19 nt, Homo sapiens
uacagugagucuacaaguu

SEQ ID NO: 16558 - RNA, 19 nt, Homo sapiens
guugcaaagguuaugauua

SEQ ID NO: 16559 - RNA, 19 nt, Homo sapiens
caacuaacauccaguaaua

SEQ ID NO: 16560 - RNA, 19 nt, Homo sapiens
gaaauuaagucccuaaaga

SEQ ID NO: 16561 - RNA, 19 nt, Homo sapiens
gagaggagacuuccaaaua

SEQ ID NO: 16562 - RNA, 19 nt, Homo sapiens
gaaaucagcuagagaccaa

SEQ ID NO: 16563 - RNA, 19 nt, Homo sapiens
ggagaugucuguuggauuc

SEQ ID NO: 16564 - RNA, 19 nt, Homo sapiens
cauacaagaugcauguuua

SEQ ID NO: 16565 - RNA, 19 nt, Homo sapiens
ggaaguaguuuaaaugucu

SEQ ID NO: 16566 - RNA, 19 nt, Homo sapiens
gaagagaucguuaauauac

SEQ ID NO: 16567 - RNA, 19 nt, Homo sapiens
caacuauccuauucuguaa

SEQ ID NO: 16568 - RNA, 19 nt, Homo sapiens
caaauacacuacauagaga

SEQ ID NO: 16569 - RNA, 19 nt, Homo sapiens
gagcauaaauagcuucugu

SEQ ID NO: 16570 - RNA, 19 nt, Homo sapiens
caacaaggaucaccucgau

SEQ ID NO: 16571 - RNA, 19 nt, Homo sapiens
auaaauagcuucuguuugg

SEQ ID NO: 16572 - RNA, 19 nt, Homo sapiens
caacaccugccuuaaauuu

SEQ ID NO: 16573 - RNA, 19 nt, Homo sapiens
ccugauacauccugaagua

SEQ ID NO: 16574 - RNA, 19 nt, Homo sapiens
ggccacaucuuaccugauu

SEQ ID NO: 16575 - RNA, 19 nt, Homo sapiens
ggacaacaacggaugauga

SEQ ID NO: 16576 - RNA, 19 nt, Homo sapiens
gcuagagaccaauuuaaua

SEQ ID NO: 16577 - RNA, 19 nt, Homo sapiens
gcauaaauagcuucuguuu

SEQ ID NO: 16578 - RNA, 19 nt, Homo sapiens
uuaagucccuaaagacaua

SEQ ID NO: 16579 - RNA, 19 nt, Homo sapiens
gcacaacuaacauccagua

SEQ ID NO: 16580 - RNA, 19 nt, Homo sapiens
aggaacaucuucugaguaa

SEQ ID NO: 16581 - RNA, 19 nt, Homo sapiens
caacaacuauccuauucug

SEQ ID NO: 16582 - RNA, 19 nt, Homo sapiens
uaucuucccugcacaacua

SEQ ID NO: 16583 - RNA, 19 nt, Homo sapiens
caaccacucugauuaucuu

SEQ ID NO: 16584 - RNA, 19 nt, Homo sapiens
gcacaaauacacuacauag

SEQ ID NO: 16585 - RNA, 19 nt, Homo sapiens
uaugacaucuuauccugua

SEQ ID NO: 16586 - RNA, 19 nt, Homo sapiens
aaacaggguugcaaagguu

SEQ ID NO: 16587 - RNA, 19 nt, Homo sapiens
gaagaugaguuggagugaa

SEQ ID NO: 16588 - RNA, 19 nt, Homo sapiens
aaauaggucuuaugugguu

SEQ ID NO: 16589 - RNA, 19 nt, Homo sapiens
ucacuauugucaugacuaa

SEQ ID NO: 16590 - RNA, 19 nt, Homo sapiens
ccacaaagcaaacagaguu

SEQ ID NO: 16591 - RNA, 19 nt, Homo sapiens
gaaauuaaacaccucuugu

SEQ ID NO: 16592 - RNA, 19 nt, Homo sapiens
uaaagccacuugucugugu

SEQ ID NO: 16593 - RNA, 19 nt, Homo sapiens
aaaaugcacugaagccuua

SEQ ID NO: 16594 - RNA, 19 nt, Homo sapiens
caaacagaguucagucuca

SEQ ID NO: 16595 - RNA, 19 nt, Homo sapiens
caauggaagagcacaguua

SEQ ID NO: 16596 - RNA, 19 nt, Homo sapiens
ccacuacacucagauuguu

SEQ ID NO: 16597 - RNA, 19 nt, Homo sapiens
guacaagaagagaucguua

SEQ ID NO: 16598 - RNA, 19 nt, Homo sapiens
gaacaucuucugaguaaac

SEQ ID NO: 16599 - RNA, 19 nt, Homo sapiens
gauacauccugaaguaaca

SEQ ID NO: 16600 - RNA, 19 nt, Homo sapiens
caucuuauccuguaucaug

SEQ ID NO: 16601 - RNA, 19 nt, Homo sapiens
caagaagagaucguuaaua

SEQ ID NO: 16602 - RNA, 19 nt, Homo sapiens
ggucacauauuauuauugc

SEQ ID NO: 16603 - RNA, 19 nt, Homo sapiens
aacaacggaugaugacaua

SEQ ID NO: 16604 - RNA, 19 nt, Homo sapiens
gcaacaugcugaagaugag

SEQ ID NO: 16605 - RNA, 19 nt, Homo sapiens
ggaaauuaaacaccucuug

SEQ ID NO: 16606 - RNA, 19 nt, Homo sapiens
cuacuaugaugaauacuuc

SEQ ID NO: 16607 - RNA, 19 nt, Homo sapiens
agucucaucuugcaaggua

SEQ ID NO: 16608 - RNA, 19 nt, Homo sapiens
uaaaggcuguguggacuug

SEQ ID NO: 16609 - RNA, 19 nt, Homo sapiens
caacuguucuaugcuguga

SEQ ID NO: 16610 - RNA, 19 nt, Homo sapiens
ugacauacaaguccauuau

SEQ ID NO: 16611 - RNA, 19 nt, Homo sapiens
uaaacaggguugcaaaggu

SEQ ID NO: 16612 - RNA, 19 nt, Homo sapiens
gcugugccauugcaucuug

SEQ ID NO: 16613 - RNA, 19 nt, Homo sapiens
guaucauggucaaguguaa

SEQ ID NO: 16614 - RNA, 19 nt, Homo sapiens
acaacuauccuauucugua

SEQ ID NO: 16615 - RNA, 19 nt, Homo sapiens
gguugcugcugcuugcuua

SEQ ID NO: 16616 - RNA, 19 nt, Homo sapiens
guucuuaucaggacacaaa

SEQ ID NO: 16617 - RNA, 19 nt, Homo sapiens
gaggaacaucuucugagua

SEQ ID NO: 16618 - RNA, 19 nt, Homo sapiens
ggucuuaugugguucaacu

SEQ ID NO: 16619 - RNA, 19 nt, Homo sapiens
gaggagaugucuguuggau

SEQ ID NO: 16620 - RNA, 19 nt, Homo sapiens
aaaguuauacccaguucua

SEQ ID NO: 16621 - RNA, 19 nt, Homo sapiens
cuucguaugccauuaauuu

SEQ ID NO: 16622 - RNA, 19 nt, Homo sapiens
ccaaaguuauacccaguuc

SEQ ID NO: 16623 - RNA, 19 nt, Homo sapiens
gagauucaggaaagccuua

SEQ ID NO: 16624 - RNA, 19 nt, Homo sapiens
agaguucagucucaucuug

SEQ ID NO: 16625 - RNA, 19 nt, Homo sapiens
uccaacaccugccuuaaau

SEQ ID NO: 16626 - RNA, 19 nt, Homo sapiens
auacuucgacugugacaua

SEQ ID NO: 16627 - RNA, 19 nt, Homo sapiens
acagugagucuacaaguuu

SEQ ID NO: 16628 - RNA, 19 nt, Homo sapiens
agaggagacuuccaaauac

SEQ ID NO: 16629 - RNA, 19 nt, Homo sapiens
cuaccuacuuguauauuuc

SEQ ID NO: 16630 - RNA, 19 nt, Homo sapiens
ugaggaacaucuucugagu

SEQ ID NO: 16631 - RNA, 19 nt, Homo sapiens
ggaaagccuuaggguggaa

SEQ ID NO: 16632 - RNA, 19 nt, Homo sapiens
ugaagaggcugcacaaaau

SEQ ID NO: 16633 - RNA, 19 nt, Homo sapiens
cugcuaaauuucacugauu

SEQ ID NO: 16634 - RNA, 19 nt, Homo sapiens
ucaccgacuugccaaaugu

SEQ ID NO: 16635 - RNA, 19 nt, Homo sapiens
ugcaaccacucaacaacua

SEQ ID NO: 16636 - RNA, 19 nt, Homo sapiens
gaugaugacauaacuacug

SEQ ID NO: 16637 - RNA, 19 nt, Homo sapiens
ccaguucuaccuacuugua

SEQ ID NO: 16638 - RNA, 19 nt, Homo sapiens
ucagcuagagaccaauuua

SEQ ID NO: 16639 - RNA, 19 nt, Homo sapiens
acugaagccuuagggaaua

SEQ ID NO: 16640 - RNA, 19 nt, Homo sapiens
gugaagcaagaaacaauaa

SEQ ID NO: 16641 - RNA, 19 nt, Homo sapiens
acaaggaucaccucgauau

SEQ ID NO: 16642 - RNA, 19 nt, Homo sapiens
guacugauugcauacaaga

SEQ ID NO: 16643 - RNA, 19 nt, Homo sapiens
acaaauacacuacauagag

SEQ ID NO: 16644 - RNA, 19 nt, Homo sapiens
cugggucccucaacaguaa

SEQ ID NO: 16645 - RNA, 19 nt, Homo sapiens
uaacucccauccugauaca

SEQ ID NO: 16646 - RNA, 19 nt, Homo sapiens
cucgauaucucuacguuug

SEQ ID NO: 16647 - RNA, 19 nt, Homo sapiens
cauggagaauggacaacaa

SEQ ID NO: 16648 - RNA, 19 nt, Homo sapiens
uuucaaacauggagaaugg

SEQ ID NO: 16649 - RNA, 19 nt, Homo sapiens
uacagugagucuacaaguu

SEQ ID NO: 16650 - RNA, 19 nt, Homo sapiens
guugcaaagguuaugauua

SEQ ID NO: 16651 - RNA, 19 nt, Homo sapiens
ugccagaugagcauaaaua

SEQ ID NO: 16652 - RNA, 19 nt, Homo sapiens
ucucuacguuugucacuau

SEQ ID NO: 16653 - RNA, 19 nt, Homo sapiens
gacaucuuauccuguauca

SEQ ID NO: 16654 - RNA, 19 nt, Homo sapiens
caacaacggaugaugacau

SEQ ID NO: 16655 - RNA, 19 nt, Homo sapiens
gaguaaacaggguugcaaa

SEQ ID NO: 16656 - RNA, 19 nt, Homo sapiens
gaaaggcuugguucuuauc

SEQ ID NO: 16657 - RNA, 19 nt, Homo sapiens
gagaaauuaagucccuaaa

SEQ ID NO: 16658 - RNA, 19 nt, Homo sapiens
auacauuugugaagcaaga

SEQ ID NO: 16659 - RNA, 19 nt, Homo sapiens
gaagagaaaucacguggaa

SEQ ID NO: 16660 - RNA, 19 nt, Homo sapiens
caacagagaugacuuugau

SEQ ID NO: 16661 - RNA, 19 nt, Homo sapiens
gaaaugggaguuaacuaua

SEQ ID NO: 16662 - RNA, 19 nt, Homo sapiens
ggaagcacuuuguacagua

SEQ ID NO: 16663 - RNA, 19 nt, Homo sapiens
caacaugggugaaccuaga

SEQ ID NO: 16664 - RNA, 19 nt, Homo sapiens
cugcagagaugacuuagua

SEQ ID NO: 16665 - RNA, 19 nt, Homo sapiens
gaacacaaacugagaaaca

SEQ ID NO: 16666 - RNA, 19 nt, Homo sapiens
cagcagggaugacucagua

SEQ ID NO: 16667 - RNA, 19 nt, Homo sapiens
uuacagagaugauggaaau

SEQ ID NO: 16668 - RNA, 19 nt, Homo sapiens
ugugaaaugugcagaauaa

SEQ ID NO: 16669 - RNA, 19 nt, Homo sapiens
ggaaaugggaguuaacuau

SEQ ID NO: 16670 - RNA, 19 nt, Homo sapiens
guagucacauucagcuaua

SEQ ID NO: 16671 - RNA, 19 nt, Homo sapiens
ggaguuaacuauaaauugc

SEQ ID NO: 16672 - RNA, 19 nt, Homo sapiens
ggacagacaugaggugagu

SEQ ID NO: 16673 - RNA, 19 nt, Homo sapiens
gcaagaagccaggcacaaa

SEQ ID NO: 16674 - RNA, 19 nt, Homo sapiens
ggaauaaaguaucgaugca

SEQ ID NO: 16675 - RNA, 19 nt, Homo sapiens
gaagcacuuuguacaguau

SEQ ID NO: 16676 - RNA, 19 nt, Homo sapiens
gacaagagccucaauaagg

SEQ ID NO: 16677 - RNA, 19 nt, Homo sapiens
acucagggauggcuuagua

SEQ ID NO: 16678 - RNA, 19 nt, Homo sapiens
acucagggauggcuuagua

SEQ ID NO: 16679 - RNA, 19 nt, Homo sapiens
acucagggauggcuuagua

SEQ ID NO: 16680 - RNA, 19 nt, Homo sapiens
acucagggauggcuuagua

SEQ ID NO: 16681 - RNA, 19 nt, Homo sapiens
acaagagccucaauaagga

SEQ ID NO: 16682 - RNA, 19 nt, Homo sapiens
gaaguggaaaugggaguua

SEQ ID NO: 16683 - RNA, 19 nt, Homo sapiens
gcaggugaauggccaaagu

SEQ ID NO: 16684 - RNA, 19 nt, Homo sapiens
ggcagguccuccaucuuua

SEQ ID NO: 16685 - RNA, 19 nt, Homo sapiens
gaaggaacacaaacugaga

SEQ ID NO: 16686 - RNA, 19 nt, Homo sapiens
gcacuacgugaucaguuua

SEQ ID NO: 16687 - RNA, 19 nt, Homo sapiens
ccaaagugguauauacugu

SEQ ID NO: 16688 - RNA, 19 nt, Homo sapiens
gaggagggaagcaggauaa

SEQ ID NO: 16689 - RNA, 19 nt, Homo sapiens
gugaauggccaaaguggua

SEQ ID NO: 16690 - RNA, 19 nt, Homo sapiens
gguauauacuguagucaca

SEQ ID NO: 16691 - RNA, 19 nt, Homo sapiens
caggguaccuuacagagau

SEQ ID NO: 16692 - RNA, 19 nt, Homo sapiens
gcacaggguaccuuacaga

SEQ ID NO: 16693 - RNA, 19 nt, Homo sapiens
caaagugguauauacugua

SEQ ID NO: 16694 - RNA, 19 nt, Homo sapiens
ggacaagagccucaauaag

SEQ ID NO: 16695 - RNA, 19 nt, Homo sapiens
gcagguccuccaucuuuaa

SEQ ID NO: 16696 - RNA, 19 nt, Homo sapiens
aaaagagacuggugaacua

SEQ ID NO: 16697 - RNA, 19 nt, Homo sapiens
cuacgugaucaguuuauua

SEQ ID NO: 16698 - RNA, 19 nt, Homo sapiens
gacagaagaagcuaggaaa

SEQ ID NO: 16699 - RNA, 19 nt, Homo sapiens
gcaaggcccgacagaagaa

SEQ ID NO: 16700 - RNA, 19 nt, Homo sapiens
uagaauagcaaaucuguag

SEQ ID NO: 16701 - RNA, 19 nt, Homo sapiens
gguuucaucgccagauuua

SEQ ID NO: 16702 - RNA, 19 nt, Homo sapiens
ggaaauguccuaaaacuag

SEQ ID NO: 16703 - RNA, 19 nt, Homo sapiens
gggaguuaacuauaaauug

SEQ ID NO: 16704 - RNA, 19 nt, Homo sapiens
ggaugauucagcagagaua

SEQ ID NO: 16705 - RNA, 19 nt, Homo sapiens
ggaguggaaggaacacaaa

SEQ ID NO: 16706 - RNA, 19 nt, Homo sapiens
gcagggaugacucagcauu

SEQ ID NO: 16707 - RNA, 19 nt, Homo sapiens
gaugacacagcaaggauga

SEQ ID NO: 16708 - RNA, 19 nt, Homo sapiens
gaugacacagcaaggauga

SEQ ID NO: 16709 - RNA, 19 nt, Homo sapiens
gaugacacagcaaggauga

SEQ ID NO: 16710 - RNA, 19 nt, Homo sapiens
gaugacacagcaaggauga

SEQ ID NO: 16711 - RNA, 19 nt, Homo sapiens
gaaauguccuaaaacuaga

SEQ ID NO: 16712 - RNA, 19 nt, Homo sapiens
caaaaggccacauaguaua

SEQ ID NO: 16713 - RNA, 19 nt, Homo sapiens
ccugguggcuguguucaaa

SEQ ID NO: 16714 - RNA, 19 nt, Homo sapiens
ggcaagaccgacguuauuu

SEQ ID NO: 16715 - RNA, 19 nt, Homo sapiens
aaagugguauauacuguag

SEQ ID NO: 16716 - RNA, 19 nt, Homo sapiens
cagcagggaugagucuguu

SEQ ID NO: 16717 - RNA, 19 nt, Homo sapiens
acagagaugacuuugauga

SEQ ID NO: 16718 - RNA, 19 nt, Homo sapiens
uagauuauggcaauaguug

SEQ ID NO: 16719 - RNA, 19 nt, Homo sapiens
ugcacuacgugaucaguuu

SEQ ID NO: 16720 - RNA, 19 nt, Homo sapiens
cgacagaagaagcuaggaa

SEQ ID NO: 16721 - RNA, 19 nt, Homo sapiens
agagaugacucagcacugu

SEQ ID NO: 16722 - RNA, 19 nt, Homo sapiens
agagaugacucagcacugu

SEQ ID NO: 16723 - RNA, 19 nt, Homo sapiens
aaaggcagguccuccaucu

SEQ ID NO: 16724 - RNA, 19 nt, Homo sapiens
ggaagucgugaacaaacaa

SEQ ID NO: 16725 - RNA, 19 nt, Homo sapiens
aaacaucaacagcaccaaa

SEQ ID NO: 16726 - RNA, 19 nt, Homo sapiens
gaauggccaaagugguaua

SEQ ID NO: 16727 - RNA, 19 nt, Homo sapiens
uggacaagagccucaauaa

SEQ ID NO: 16728 - RNA, 19 nt, Homo sapiens
ggcaaggcccgacagaaga

SEQ ID NO: 16729 - RNA, 19 nt, Homo sapiens
cacugaagcuggacaagag

SEQ ID NO: 16730 - RNA, 19 nt, Homo sapiens
aggcagguccuccaucuuu

SEQ ID NO: 16731 - RNA, 19 nt, Homo sapiens
gagggaagcaggauaacgu

SEQ ID NO: 16732 - RNA, 19 nt, Homo sapiens
guugauguguguguguaaa

SEQ ID NO: 16733 - RNA, 19 nt, Homo sapiens
ggugagugguugccagaag

SEQ ID NO: 16734 - RNA, 19 nt, Homo sapiens
cacaaaaggccacauagua

SEQ ID NO: 16735 - RNA, 19 nt, Homo sapiens
ugacacagcaaggaugauu

SEQ ID NO: 16736 - RNA, 19 nt, Homo sapiens
ccucaacagagaugacuuu

SEQ ID NO: 16737 - RNA, 19 nt, Homo sapiens
ugauggaaauguccuaaaa

SEQ ID NO: 16738 - RNA, 19 nt, Homo sapiens
aaacugagaaacaucaaca

SEQ ID NO: 16739 - RNA, 19 nt, Homo sapiens
gcaggcaagaccgacguua

SEQ ID NO: 16740 - RNA, 19 nt, Homo sapiens
ugacucagcagggaugauu

SEQ ID NO: 16741 - RNA, 19 nt, Homo sapiens
ggaugacucagcagagaug

SEQ ID NO: 16742 - RNA, 19 nt, Homo sapiens
gguccuccaucuuuaaggu

SEQ ID NO: 16743 - RNA, 19 nt, Homo sapiens
gaugauggaaauguccuaa

SEQ ID NO: 16744 - RNA, 19 nt, Homo sapiens
cagagaugauggaaauguc

SEQ ID NO: 16745 - RNA, 19 nt, Homo sapiens
uaugugaaaugugcagaau

SEQ ID NO: 16746 - RNA, 19 nt, Homo sapiens
ggaugacucagcagacuca

SEQ ID NO: 16747 - RNA, 19 nt, Homo sapiens
gcucaacagacaugacuca

SEQ ID NO: 16748 - RNA, 19 nt, Homo sapiens
gcucaacagacaugacuca

SEQ ID NO: 16749 - RNA, 19 nt, Homo sapiens
gcucaacagacaugacuca

SEQ ID NO: 16750 - RNA, 19 nt, Homo sapiens
ggcuggaagucgugaacaa

SEQ ID NO: 16751 - RNA, 19 nt, Homo sapiens
uauguucccauuuauguga

SEQ ID NO: 16752 - RNA, 19 nt, Homo sapiens
ugacucugauuguccuuca

SEQ ID NO: 16753 - RNA, 19 nt, Homo sapiens
acucagcacugucccuuag

SEQ ID NO: 16754 - RNA, 19 nt, Homo sapiens
acucagcacugucccuuag

SEQ ID NO: 16755 - RNA, 19 nt, Homo sapiens
acucagcacugucccuuag

SEQ ID NO: 16756 - RNA, 19 nt, Homo sapiens
acucagcacugucccuuag

SEQ ID NO: 16757 - RNA, 19 nt, Homo sapiens
ccacugaagcuggacaaga

SEQ ID NO: 16758 - RNA, 19 nt, Homo sapiens
ucgagauccuggaagagaa

SEQ ID NO: 16759 - RNA, 19 nt, Homo sapiens
ugaaagacaugguagaaua

SEQ ID NO: 16760 - RNA, 19 nt, Homo sapiens
gaagacaaauucaaugaga

SEQ ID NO: 16761 - RNA, 19 nt, Homo sapiens
ggaaggaugguuugaaaua

SEQ ID NO: 16762 - RNA, 19 nt, Homo sapiens
gagcugcagucuuuguuua

SEQ ID NO: 16763 - RNA, 19 nt, Homo sapiens
gaagcaaccuuugaagaaa

SEQ ID NO: 16764 - RNA, 19 nt, Homo sapiens
caaaucauguugugaagaa

SEQ ID NO: 16765 - RNA, 19 nt, Homo sapiens
gaaauaccauuaccucauc

SEQ ID NO: 16766 - RNA, 19 nt, Homo sapiens
ccaaaggauuuaucucuaa

SEQ ID NO: 16767 - RNA, 19 nt, Homo sapiens
ggaagcaaccuuugaagaa

SEQ ID NO: 16768 - RNA, 19 nt, Homo sapiens
gaugauagaccaaaggauu

SEQ ID NO: 16769 - RNA, 19 nt, Homo sapiens
caauaccugucacacaaua

SEQ ID NO: 16770 - RNA, 19 nt, Homo sapiens
aaagucaacugccuucaaa

SEQ ID NO: 16771 - RNA, 19 nt, Homo sapiens
ggcaauaccugucacacaa

SEQ ID NO: 16772 - RNA, 19 nt, Homo sapiens
gaagucugcuuuaaugaag

SEQ ID NO: 16773 - RNA, 19 nt, Homo sapiens
gagcuuauuucucuuguag

SEQ ID NO: 16774 - RNA, 19 nt, Homo sapiens
gaauacaucaccaucauug

SEQ ID NO: 16775 - RNA, 19 nt, Homo sapiens
gaacuucaauaguacucaa

SEQ ID NO: 16776 - RNA, 19 nt, Homo sapiens
gagaaucccuuuuaaauca

SEQ ID NO: 16777 - RNA, 19 nt, Homo sapiens
guaacugucaccugaaaua

SEQ ID NO: 16778 - RNA, 19 nt, Homo sapiens
uagugaagcugaagcauga

SEQ ID NO: 16779 - RNA, 19 nt, Homo sapiens
ggagaguuauguggaguaa

SEQ ID NO: 16780 - RNA, 19 nt, Homo sapiens
gaagauagcuccccaacuc

SEQ ID NO: 16781 - RNA, 19 nt, Homo sapiens
acugucaccugaaauaaua

SEQ ID NO: 16782 - RNA, 19 nt, Homo sapiens
gaguuugccuguguugaua

SEQ ID NO: 16783 - RNA, 19 nt, Homo sapiens
ucgcaaauguaguggauaa

SEQ ID NO: 16784 - RNA, 19 nt, Homo sapiens
ccugaagucugcuuuaaug

SEQ ID NO: 16785 - RNA, 19 nt, Homo sapiens
caaauguaguggauaagug

SEQ ID NO: 16786 - RNA, 19 nt, Homo sapiens
ugacagcuuucacuacuug

SEQ ID NO: 16787 - RNA, 19 nt, Homo sapiens
uaacagagaaucccuuuua

SEQ ID NO: 16788 - RNA, 19 nt, Homo sapiens
gugaagaguuugccugugu

SEQ ID NO: 16789 - RNA, 19 nt, Homo sapiens
agaguuauguggaguaaau

SEQ ID NO: 16790 - RNA, 19 nt, Homo sapiens
gaaggaugguuugaaauac

SEQ ID NO: 16791 - RNA, 19 nt, Homo sapiens
cuacaaagaugaaacuacu

SEQ ID NO: 16792 - RNA, 19 nt, Homo sapiens
gaaaugccaggcuuaugaa

SEQ ID NO: 16793 - RNA, 19 nt, Homo sapiens
ccaccuuucucucaagauu

SEQ ID NO: 16794 - RNA, 19 nt, Homo sapiens
cuggagauauguaaagaaa

SEQ ID NO: 16795 - RNA, 19 nt, Homo sapiens
caccugaaauaauacauug

SEQ ID NO: 16796 - RNA, 19 nt, Homo sapiens
agaaggcccugcuuugaga

SEQ ID NO: 16797 - RNA, 19 nt, Homo sapiens
gaaggaaaauuuacugaca

SEQ ID NO: 16798 - RNA, 19 nt, Homo sapiens
gaaggaacccauuugucuu

SEQ ID NO: 16799 - RNA, 19 nt, Homo sapiens
gaggaagacagacagguuu

SEQ ID NO: 16800 - RNA, 19 nt, Homo sapiens
agaaaugccaggcuuauga

SEQ ID NO: 16801 - RNA, 19 nt, Homo sapiens
guaaaugugguuucuacaa

SEQ ID NO: 16802 - RNA, 19 nt, Homo sapiens
cacacaaccucgggauaua

SEQ ID NO: 16803 - RNA, 19 nt, Homo sapiens
caagaugguacaacaagaa

SEQ ID NO: 16804 - RNA, 19 nt, Homo sapiens
uggaaaagcuggugaaaga

SEQ ID NO: 16805 - RNA, 19 nt, Homo sapiens
ggagcuuauuucucuugua

SEQ ID NO: 16806 - RNA, 19 nt, Homo sapiens
ggauauagagaacuucaau

SEQ ID NO: 16807 - RNA, 19 nt, Homo sapiens
ggagguggccaaaucaugu

SEQ ID NO: 16808 - RNA, 19 nt, Homo sapiens
uaacuguugcuguucauuu

SEQ ID NO: 16809 - RNA, 19 nt, Homo sapiens
gcucaaagaagacucuguu

SEQ ID NO: 16810 - RNA, 19 nt, Homo sapiens
agcaugaacucacagauga

SEQ ID NO: 16811 - RNA, 19 nt, Homo sapiens
cagguuucuugucaacuua

SEQ ID NO: 16812 - RNA, 19 nt, Homo sapiens
caaaggauuuaucucuaag

SEQ ID NO: 16813 - RNA, 19 nt, Homo sapiens
caaagaugauagaccaaag

SEQ ID NO: 16814 - RNA, 19 nt, Homo sapiens
gaaucgcauuuccugagaa

SEQ ID NO: 16815 - RNA, 19 nt, Homo sapiens
ucaaugagacaacugagaa

SEQ ID NO: 16816 - RNA, 19 nt, Homo sapiens
gaaaaugugugucaagaac

SEQ ID NO: 16817 - RNA, 19 nt, Homo sapiens
gcugaagcaugaacucaca

SEQ ID NO: 16818 - RNA, 19 nt, Homo sapiens
augaggagcuucagaggaa

SEQ ID NO: 16819 - RNA, 19 nt, Homo sapiens
uauaugaaguugccagaag

SEQ ID NO: 16820 - RNA, 19 nt, Homo sapiens
gaaagacaugguagaauac

SEQ ID NO: 16821 - RNA, 19 nt, Homo sapiens
guccugaagucugcuuuaa

SEQ ID NO: 16822 - RNA, 19 nt, Homo sapiens
guugauaauuuggcagauu

SEQ ID NO: 16823 - RNA, 19 nt, Homo sapiens
cugaagaacuggugucucu

SEQ ID NO: 16824 - RNA, 19 nt, Homo sapiens
gaugguacaacaagaaugu

SEQ ID NO: 16825 - RNA, 19 nt, Homo sapiens
gaccaaaggauuuaucucu

SEQ ID NO: 16826 - RNA, 19 nt, Homo sapiens
ugaaucgcauuuccugaga

SEQ ID NO: 16827 - RNA, 19 nt, Homo sapiens
ucaagaugguacaacaaga

SEQ ID NO: 16828 - RNA, 19 nt, Homo sapiens
ucaacugccuucaaacaag

SEQ ID NO: 16829 - RNA, 19 nt, Homo sapiens
gacucuguuucuucuauaa

SEQ ID NO: 16830 - RNA, 19 nt, Homo sapiens
guggauaagugcugcaaag

SEQ ID NO: 16831 - RNA, 19 nt, Homo sapiens
ccacacaaccucgggauau

SEQ ID NO: 16832 - RNA, 19 nt, Homo sapiens
cauaugugccuccaccuuu

SEQ ID NO: 16833 - RNA, 19 nt, Homo sapiens
gcuguacgcuaagugaaga

SEQ ID NO: 16834 - RNA, 19 nt, Homo sapiens
uaccagagcuuuuaagaau

SEQ ID NO: 16835 - RNA, 19 nt, Homo sapiens
uaacugucaccugaaauaa

SEQ ID NO: 16836 - RNA, 19 nt, Homo sapiens
uaugauggaugcugugaag

SEQ ID NO: 16837 - RNA, 19 nt, Homo sapiens
caaagucaacugccuucaa

SEQ ID NO: 16838 - RNA, 19 nt, Homo sapiens
ggccaaaucauguugugaa

SEQ ID NO: 16839 - RNA, 19 nt, Homo sapiens
gguagaauacaaagacaga

SEQ ID NO: 16840 - RNA, 19 nt, Homo sapiens
gcagcaagcaauaaacaca

SEQ ID NO: 16841 - RNA, 19 nt, Homo sapiens
gcaaauguaguggauaagu

SEQ ID NO: 16842 - RNA, 19 nt, Homo sapiens
accuuucucucaagauuua

SEQ ID NO: 16843 - RNA, 19 nt, Homo sapiens
ucagaaggcccugcuuuga

SEQ ID NO: 16844 - RNA, 19 nt, Homo sapiens
uacgcuaagugaagaguuu

SEQ ID NO: 16845 - RNA, 19 nt, Homo sapiens
caaauucaaugagacaacu

SEQ ID NO: 16846 - RNA, 19 nt, Homo sapiens
ugauagaccaaaggauuua

SEQ ID NO: 16847 - RNA, 19 nt, Homo sapiens
agacucuguuucuucuaua

SEQ ID NO: 16848 - RNA, 19 nt, Homo sapiens
acagauguauggcugacaa

SEQ ID NO: 16849 - RNA, 19 nt, Homo sapiens
ugaagucugcuuuaaugaa

SEQ ID NO: 16850 - RNA, 19 nt, Homo sapiens
ucauugcauuugcucagua

SEQ ID NO: 16851 - RNA, 19 nt, Homo sapiens
acagguuucuugucaacuu

SEQ ID NO: 16852 - RNA, 19 nt, Homo sapiens
ggugaaagacaugguagaa

SEQ ID NO: 16853 - RNA, 19 nt, Homo sapiens
ggggaaggaugguuugaaa

SEQ ID NO: 16854 - RNA, 19 nt, Homo sapiens
uagagaacuucaauaguac

SEQ ID NO: 16855 - RNA, 19 nt, Homo sapiens
uaacaagaaaucugaugug

SEQ ID NO: 16856 - RNA, 19 nt, Homo sapiens
agacaugguagaauacaaa

SEQ ID NO: 16857 - RNA, 19 nt, Homo sapiens
uugccuguguugauaauuu

SEQ ID NO: 16858 - RNA, 19 nt, Homo sapiens
gaagaguuugccuguguug

SEQ ID NO: 16859 - RNA, 19 nt, Homo sapiens
ccagaacacugcauagaaa

SEQ ID NO: 16860 - RNA, 19 nt, Homo sapiens
gaacguggucaauguauaa

SEQ ID NO: 16861 - RNA, 19 nt, Homo sapiens
gaggagaugugcuggauug

SEQ ID NO: 16862 - RNA, 19 nt, Homo sapiens
ccaauguacugcagagaua

SEQ ID NO: 16863 - RNA, 19 nt, Homo sapiens
aagcaagaguuucucauua

SEQ ID NO: 16864 - RNA, 19 nt, Homo sapiens
gaagaacuuugccaugaga

SEQ ID NO: 16865 - RNA, 19 nt, Homo sapiens
gaaggucuaucuccaaauc

SEQ ID NO: 16866 - RNA, 19 nt, Homo sapiens
ggaacguggucaauguaua

SEQ ID NO: 16867 - RNA, 19 nt, Homo sapiens
ugaccuggcuaccauauuu

SEQ ID NO: 16868 - RNA, 19 nt, Homo sapiens
gaaacccacuggagaugaa

SEQ ID NO: 16869 - RNA, 19 nt, Homo sapiens
gagauuuccuuaucacaga

SEQ ID NO: 16870 - RNA, 19 nt, Homo sapiens
gcaguugaaugcuuccaaa

SEQ ID NO: 16871 - RNA, 19 nt, Homo sapiens
gaagcaagaguuucucauu

SEQ ID NO: 16872 - RNA, 19 nt, Homo sapiens
gggagcggcugacauuauu

SEQ ID NO: 16873 - RNA, 19 nt, Homo sapiens
uaaaggauaccaggaguua

SEQ ID NO: 16874 - RNA, 19 nt, Homo sapiens
ugaaaugacuccaguaaac

SEQ ID NO: 16875 - RNA, 19 nt, Homo sapiens
gaacacugcauagaaauga

SEQ ID NO: 16876 - RNA, 19 nt, Homo sapiens
acagaaugcugcaaacuga

SEQ ID NO: 16877 - RNA, 19 nt, Homo sapiens
gcaccuacaauucuucuuu

SEQ ID NO: 16878 - RNA, 19 nt, Homo sapiens
gaacaggaagucugcuuug

SEQ ID NO: 16879 - RNA, 19 nt, Homo sapiens
ggugguggaugaaacauau

SEQ ID NO: 16880 - RNA, 19 nt, Homo sapiens
gaaacuaggagaauauuac

SEQ ID NO: 16881 - RNA, 19 nt, Homo sapiens
agacauaacuguuuucuug

SEQ ID NO: 16882 - RNA, 19 nt, Homo sapiens
gagaugugcuggauugucu

SEQ ID NO: 16883 - RNA, 19 nt, Homo sapiens
ugaaguggguggaaucaau

SEQ ID NO: 16884 - RNA, 19 nt, Homo sapiens
uggaagaacuuugccauga

SEQ ID NO: 16885 - RNA, 19 nt, Homo sapiens
gcuuugggaguuuaaauua

SEQ ID NO: 16886 - RNA, 19 nt, Homo sapiens
ucuaagaguugcuaaagga

SEQ ID NO: 16887 - RNA, 19 nt, Homo sapiens
guugaaugcuuccaaacaa

SEQ ID NO: 16888 - RNA, 19 nt, Homo sapiens
ggugaaagaugcauugacu

SEQ ID NO: 16889 - RNA, 19 nt, Homo sapiens
ggugugaacuuuucucuuu

SEQ ID NO: 16890 - RNA, 19 nt, Homo sapiens
agcaagaguuucucauuaa

SEQ ID NO: 16891 - RNA, 19 nt, Homo sapiens
gcuggaacguggucaaugu

SEQ ID NO: 16892 - RNA, 19 nt, Homo sapiens
ggaagaacuuugccaugag

SEQ ID NO: 16893 - RNA, 19 nt, Homo sapiens
uaacagaggaacaacuuga

SEQ ID NO: 16894 - RNA, 19 nt, Homo sapiens
gaaguggguggaaucaauu

SEQ ID NO: 16895 - RNA, 19 nt, Homo sapiens
gcagcuuggugguggauga

SEQ ID NO: 16896 - RNA, 19 nt, Homo sapiens
ggagaaguguuuccagacu

SEQ ID NO: 16897 - RNA, 19 nt, Homo sapiens
uaugugagauuuccuuauc

SEQ ID NO: 16898 - RNA, 19 nt, Homo sapiens
gagaagaagaauuacagaa

SEQ ID NO: 16899 - RNA, 19 nt, Homo sapiens
acaaaggcagcaacaguua

SEQ ID NO: 16900 - RNA, 19 nt, Homo sapiens
guacugcagagauaaguuu

SEQ ID NO: 16901 - RNA, 19 nt, Homo sapiens
ucauuaaccuugugaagca

SEQ ID NO: 16902 - RNA, 19 nt, Homo sapiens
gcaagaguuucucauuaac

SEQ ID NO: 16903 - RNA, 19 nt, Homo sapiens
gaagagggaagacauaacu

SEQ ID NO: 16904 - RNA, 19 nt, Homo sapiens
ggagaaguacggacauuca

SEQ ID NO: 16905 - RNA, 19 nt, Homo sapiens
ggaacaggaagucugcuuu

SEQ ID NO: 16906 - RNA, 19 nt, Homo sapiens
gaagacagggagacauuca

SEQ ID NO: 16907 - RNA, 19 nt, Homo sapiens
caugaaaugacuccaguaa

SEQ ID NO: 16908 - RNA, 19 nt, Homo sapiens
cgagggagcggcugacauu

SEQ ID NO: 16909 - RNA, 19 nt, Homo sapiens
agaagccacuuacaaggaa

SEQ ID NO: 16910 - RNA, 19 nt, Homo sapiens
uaucagacaugaaaugacu

SEQ ID NO: 16911 - RNA, 19 nt, Homo sapiens
aagaagacauccucagcuu

SEQ ID NO: 16912 - RNA, 19 nt, Homo sapiens
gggagacauucaugaacaa

SEQ ID NO: 16913 - RNA, 19 nt, Homo sapiens
ggaagucugcuuugcugaa

SEQ ID NO: 16914 - RNA, 19 nt, Homo sapiens
gugccaagcucagggugua

SEQ ID NO: 16915 - RNA, 19 nt, Homo sapiens
ccacagcagccacuuguug

SEQ ID NO: 16916 - RNA, 19 nt, Homo sapiens
uaagaguugcuaaaggaua

SEQ ID NO: 16917 - RNA, 19 nt, Homo sapiens
gaauccagaacacugcaua

SEQ ID NO: 16918 - RNA, 19 nt, Homo sapiens
gaagucugcuuugcugaag

SEQ ID NO: 16919 - RNA, 19 nt, Homo sapiens
caaaauaacuagcaaccau

SEQ ID NO: 16920 - RNA, 19 nt, Homo sapiens
agaaguguuuccagacuga

SEQ ID NO: 16921 - RNA, 19 nt, Homo sapiens
ucagaaguuuaccaaaguu

SEQ ID NO: 16922 - RNA, 19 nt, Homo sapiens
ccagaaacuaggagaauau

SEQ ID NO: 16923 - RNA, 19 nt, Homo sapiens
uuacugaaauccagaaacu

SEQ ID NO: 16924 - RNA, 19 nt, Homo sapiens
gucagaaguuuaccaaagu

SEQ ID NO: 16925 - RNA, 19 nt, Homo sapiens
gaagcaaaagccacaaaua

SEQ ID NO: 16926 - RNA, 19 nt, Homo sapiens
gggaagacauaacuguuuu

SEQ ID NO: 16927 - RNA, 19 nt, Homo sapiens
ucaagaagccacuuacaag

SEQ ID NO: 16928 - RNA, 19 nt, Homo sapiens
ugcaaacgaugaagcaaga

SEQ ID NO: 16929 - RNA, 19 nt, Homo sapiens
cuccaaaucuaaacagguu

SEQ ID NO: 16930 - RNA, 19 nt, Homo sapiens
cguggucaauguauaauuc

SEQ ID NO: 16931 - RNA, 19 nt, Homo sapiens
aaacaaaggcagcaacagu

SEQ ID NO: 16932 - RNA, 19 nt, Homo sapiens
caccuacaauucuucuuug

SEQ ID NO: 16933 - RNA, 19 nt, Homo sapiens
uccagaaacuaggagaaua

SEQ ID NO: 16934 - RNA, 19 nt, Homo sapiens
ggagaagaagaauuacaga

SEQ ID NO: 16935 - RNA, 19 nt, Homo sapiens
guaugcaccuacaauucuu

SEQ ID NO: 16936 - RNA, 19 nt, Homo sapiens
agauaaaggagaagaagaa

SEQ ID NO: 16937 - RNA, 19 nt, Homo sapiens
cugaaggucuaucuccaaa

SEQ ID NO: 16938 - RNA, 19 nt, Homo sapiens
acaaauaacagaggaacaa

SEQ ID NO: 16939 - RNA, 19 nt, Homo sapiens
guguagcgcugcaaacgau

SEQ ID NO: 16940 - RNA, 19 nt, Homo sapiens
ucaguaauucuaagaguug

SEQ ID NO: 16941 - RNA, 19 nt, Homo sapiens
gaaacuaguccuggaugug

SEQ ID NO: 16942 - RNA, 19 nt, Homo sapiens
agucagaaguuuaccaaag

SEQ ID NO: 16943 - RNA, 19 nt, Homo sapiens
cagcaucgaucccacuuuu

SEQ ID NO: 16944 - RNA, 19 nt, Homo sapiens
gagggaagacauaacuguu

SEQ ID NO: 16945 - RNA, 19 nt, Homo sapiens
ccagcuaccugccuuucug

SEQ ID NO: 16946 - RNA, 19 nt, Homo sapiens
caaaacgagucuuucauuc

SEQ ID NO: 16947 - RNA, 19 nt, Homo sapiens
gagcggcugacauuauuau

SEQ ID NO: 16948 - RNA, 19 nt, Homo sapiens
gcugcggccucuuccagaa

SEQ ID NO: 16949 - RNA, 19 nt, Homo sapiens
cagaggagaugugcuggau

SEQ ID NO: 16950 - RNA, 19 nt, Homo sapiens
cagaaguuuaccaaaguua

SEQ ID NO: 16951 - RNA, 19 nt, Homo sapiens
ugaagcauaugaagaagac

SEQ ID NO: 16952 - RNA, 19 nt, Homo sapiens
ggagcggcugacauuauua

SEQ ID NO: 16953 - RNA, 19 nt, Homo sapiens
ucagugaggacaaacuauu

SEQ ID NO: 16954 - RNA, 19 nt, Homo sapiens
aaggauaccaggaguuauu

SEQ ID NO: 16955 - RNA, 19 nt, Homo sapiens
cagcaacaguuacaaaaga

SEQ ID NO: 16956 - RNA, 19 nt, Homo sapiens
gugcugcuuugggaguuua

SEQ ID NO: 16957 - RNA, 19 nt, Homo sapiens
gcaaaagccacaaauaaca

SEQ ID NO: 16958 - RNA, 19 nt, Homo sapiens
gagaaacccacuggagaug

SEQ ID NO: 16959 - RNA, 19 nt, Homo sapiens
gaaggaagaugauagaaca

SEQ ID NO: 16960 - RNA, 19 nt, Homo sapiens
ggagaucucagacgaauua

SEQ ID NO: 16961 - RNA, 19 nt, Homo sapiens
gaaauggguuguuuagcuu

SEQ ID NO: 16962 - RNA, 19 nt, Homo sapiens
gcaauuagaagucaagaaa

SEQ ID NO: 16963 - RNA, 19 nt, Homo sapiens
gaugauagaacaugagaua

SEQ ID NO: 16964 - RNA, 19 nt, Homo sapiens
ggaagaugauagaacauga

SEQ ID NO: 16965 - RNA, 19 nt, Homo sapiens
ggaaaguacuggaacauac

SEQ ID NO: 16966 - RNA, 19 nt, Homo sapiens
gaacaugagauacucuuug

SEQ ID NO: 16967 - RNA, 19 nt, Homo sapiens
gaauauguauguggcugua

SEQ ID NO: 16968 - RNA, 19 nt, Homo sapiens
gcugguacaucuacaaaug

SEQ ID NO: 16969 - RNA, 19 nt, Homo sapiens
ggagaaaccacacuagaug

SEQ ID NO: 16970 - RNA, 19 nt, Homo sapiens
ugacggcucuguaggcuuu

SEQ ID NO: 16971 - RNA, 19 nt, Homo sapiens
gaacuugaucuguacugua

SEQ ID NO: 16972 - RNA, 19 nt, Homo sapiens
gaauuggcacuuucuauau

SEQ ID NO: 16973 - RNA, 19 nt, Homo sapiens
ugaauuggcacuuucuaua

SEQ ID NO: 16974 - RNA, 19 nt, Homo sapiens
caugagauacucuuuguuu

SEQ ID NO: 16975 - RNA, 19 nt, Homo sapiens
guaggagacucaccaauac

SEQ ID NO: 16976 - RNA, 19 nt, Homo sapiens
aggagaagauccaaccaua

SEQ ID NO: 16977 - RNA, 19 nt, Homo sapiens
acacuuggauuucugauca

SEQ ID NO: 16978 - RNA, 19 nt, Homo sapiens
gaagaugaauauguaugug

SEQ ID NO: 16979 - RNA, 19 nt, Homo sapiens
gaauggugauauauugaug

SEQ ID NO: 16980 - RNA, 19 nt, Homo sapiens
gaugagcaauuguguugau

SEQ ID NO: 16981 - RNA, 19 nt, Homo sapiens
cauaagacaggacauauug

SEQ ID NO: 16982 - RNA, 19 nt, Homo sapiens
gucaagaaauggguuguuu

SEQ ID NO: 16983 - RNA, 19 nt, Homo sapiens
caguuuaguuucaugguuu

SEQ ID NO: 16984 - RNA, 19 nt, Homo sapiens
caagaauccagaagcauuu

SEQ ID NO: 16985 - RNA, 19 nt, Homo sapiens
acacuuggcccuuuaagaa

SEQ ID NO: 16986 - RNA, 19 nt, Homo sapiens
ggaaucaucauauuuggau

SEQ ID NO: 16987 - RNA, 19 nt, Homo sapiens
gaacuugccugugcuucuc

SEQ ID NO: 16988 - RNA, 19 nt, Homo sapiens
gaucauggauggcacuacu

SEQ ID NO: 16989 - RNA, 19 nt, Homo sapiens
uguaggagacucaccaaua

SEQ ID NO: 16990 - RNA, 19 nt, Homo sapiens
uagcacugauuauugguuu

SEQ ID NO: 16991 - RNA, 19 nt, Homo sapiens
ggacauauugcugcuggua

SEQ ID NO: 16992 - RNA, 19 nt, Homo sapiens
gaaaguacuggaacauaca

SEQ ID NO: 16993 - RNA, 19 nt, Homo sapiens
caagaaauggguuguuuag

SEQ ID NO: 16994 - RNA, 19 nt, Homo sapiens
ucaagaaauggguuguuua

SEQ ID NO: 16995 - RNA, 19 nt, Homo sapiens
aacuugaucuguacuguaa

SEQ ID NO: 16996 - RNA, 19 nt, Homo sapiens
gauagaacaugagauacuc

SEQ ID NO: 16997 - RNA, 19 nt, Homo sapiens
ccacagugauauauuaaac

SEQ ID NO: 16998 - RNA, 19 nt, Homo sapiens
aaaguggacugcaucuaau

SEQ ID NO: 16999 - RNA, 19 nt, Homo sapiens
gagcggcugugccaugugu

SEQ ID NO: 17000 - RNA, 19 nt, Homo sapiens
gucaacacuuggcccuuua

SEQ ID NO: 17001 - RNA, 19 nt, Homo sapiens
gagcaauuguguugauuuu

SEQ ID NO: 17002 - RNA, 19 nt, Homo sapiens
gaaagaaacaaaggcugaa

SEQ ID NO: 17003 - RNA, 19 nt, Homo sapiens
uaauccaucuuuacuguca

SEQ ID NO: 17004 - RNA, 19 nt, Homo sapiens
cugauuaacucucuguaug

SEQ ID NO: 17005 - RNA, 19 nt, Homo sapiens
agaaauggguuguuuagcu

SEQ ID NO: 17006 - RNA, 19 nt, Homo sapiens
cgucaacacuuggcccuuu

SEQ ID NO: 17007 - RNA, 19 nt, Homo sapiens
ccaaugugacuggaaguua

SEQ ID NO: 17008 - RNA, 19 nt, Homo sapiens
ucaagaauccagaagcauu

SEQ ID NO: 17009 - RNA, 19 nt, Homo sapiens
gaagauccaaccauagcuu

SEQ ID NO: 17010 - RNA, 19 nt, Homo sapiens
ugggaauggugauauauug

SEQ ID NO: 17011 - RNA, 19 nt, Homo sapiens
uaugacaacucuacagaag

SEQ ID NO: 17012 - RNA, 19 nt, Homo sapiens
caucuaguguuccucaugu

SEQ ID NO: 17013 - RNA, 19 nt, Homo sapiens
caacauuuacucaguuuag

SEQ ID NO: 17014 - RNA, 19 nt, Homo sapiens
gaggaaggaagaugauaga

SEQ ID NO: 17015 - RNA, 19 nt, Homo sapiens
ucuaauccaucuuuacugu

SEQ ID NO: 17016 - RNA, 19 nt, Homo sapiens
gagagcggcugugccaugu

SEQ ID NO: 17017 - RNA, 19 nt, Homo sapiens
guacaucuacaaaugguau

SEQ ID NO: 17018 - RNA, 19 nt, Homo sapiens
gagagucagccaccacauu

SEQ ID NO: 17019 - RNA, 19 nt, Homo sapiens
ggaacuugaucuguacugu

SEQ ID NO: 17020 - RNA, 19 nt, Homo sapiens
caucuuuacugucaacauc

SEQ ID NO: 17021 - RNA, 19 nt, Homo sapiens
gcuguuauaugugccaaug

SEQ ID NO: 17022 - RNA, 19 nt, Homo sapiens
ggauggcacuacuauggau

SEQ ID NO: 17023 - RNA, 19 nt, Homo sapiens
uucccuaacuucugauuaa

SEQ ID NO: 17024 - RNA, 19 nt, Homo sapiens
auacagcuaucuccugaug

SEQ ID NO: 17025 - RNA, 19 nt, Homo sapiens
agauuuauuuccacaguga

SEQ ID NO: 17026 - RNA, 19 nt, Homo sapiens
caaugugacuggaaguuac

SEQ ID NO: 17027 - RNA, 19 nt, Homo sapiens
gaucucagacgaauuaaaa

SEQ ID NO: 17028 - RNA, 19 nt, Homo sapiens
gaaguugugcgcgugcuuu

SEQ ID NO: 17029 - RNA, 19 nt, Homo sapiens
uuaacucucuguaugacaa

SEQ ID NO: 17030 - RNA, 19 nt, Homo sapiens
ccucauguguucuaaaguc

SEQ ID NO: 17031 - RNA, 19 nt, Homo sapiens
ggauguaggagcaguagga

SEQ ID NO: 17032 - RNA, 19 nt, Homo sapiens
gagguggguauggcaauua

SEQ ID NO: 17033 - RNA, 19 nt, Homo sapiens
ggaauggugauauauugau

SEQ ID NO: 17034 - RNA, 19 nt, Homo sapiens
ggagaagauccaaccauag

SEQ ID NO: 17035 - RNA, 19 nt, Homo sapiens
ccauaagacaggacauauu

SEQ ID NO: 17036 - RNA, 19 nt, Homo sapiens
cucaagcucuucauucaga

SEQ ID NO: 17037 - RNA, 19 nt, Homo sapiens
ggaaggaagaugauagaac

SEQ ID NO: 17038 - RNA, 19 nt, Homo sapiens
gcagugugacggcucugua

SEQ ID NO: 17039 - RNA, 19 nt, Homo sapiens
uauguugaauuggcacuuu

SEQ ID NO: 17040 - RNA, 19 nt, Homo sapiens
agagucagccaccacauuu

SEQ ID NO: 17041 - RNA, 19 nt, Homo sapiens
uaggagaucucagacgaau

SEQ ID NO: 17042 - RNA, 19 nt, Homo sapiens
cuugaucuguacuguaauu

SEQ ID NO: 17043 - RNA, 19 nt, Homo sapiens
ucaguuuaguuucaugguu

SEQ ID NO: 17044 - RNA, 19 nt, Homo sapiens
gagaagaggagaagaucca

SEQ ID NO: 17045 - RNA, 19 nt, Homo sapiens
uaccagaucccucaaaaua

SEQ ID NO: 17046 - RNA, 19 nt, Homo sapiens
aaugaagacuuaucuacca

SEQ ID NO: 17047 - RNA, 19 nt, Homo sapiens
cacacuagaugccaugauc

SEQ ID NO: 17048 - RNA, 19 nt, Homo sapiens
gcaauuguguugauuuucu

SEQ ID NO: 17049 - RNA, 19 nt, Homo sapiens
aacaugagauacucuuugu

SEQ ID NO: 17050 - RNA, 19 nt, Homo sapiens
gagaagauccaaccauagc

SEQ ID NO: 17051 - RNA, 19 nt, Homo sapiens
gggaauggugauauauuga

SEQ ID NO: 17052 - RNA, 19 nt, Homo sapiens
cacugggaauggugauaua

SEQ ID NO: 17053 - RNA, 19 nt, Homo sapiens
ugauuaacucucuguauga

SEQ ID NO: 17054 - RNA, 19 nt, Homo sapiens
gcuaucuccugaugagcaa

SEQ ID NO: 17055 - RNA, 19 nt, Homo sapiens
ugagauuuauuuccacagu

SEQ ID NO: 17056 - RNA, 19 nt, Homo sapiens
gcugcucacucucaucauc

SEQ ID NO: 17057 - RNA, 19 nt, Homo sapiens
uuacggugcugcuugcaau

SEQ ID NO: 17058 - RNA, 19 nt, Homo sapiens
caaauuauuggaggaaugu

SEQ ID NO: 17059 - RNA, 19 nt, Homo sapiens
ggaaauaccuggacucuuu

SEQ ID NO: 17060 - RNA, 19 nt, Homo sapiens
caaccagccugacaacuuu

SEQ ID NO: 17061 - RNA, 19 nt, Homo sapiens
cuacacaggugaagacuuu

SEQ ID NO: 17062 - RNA, 19 nt, Homo sapiens
gcagaacagugccaucauu

SEQ ID NO: 17063 - RNA, 19 nt, Homo sapiens
gaacuuugguggaaucugu

SEQ ID NO: 17064 - RNA, 19 nt, Homo sapiens
uaaagaagaagaaggcuua

SEQ ID NO: 17065 - RNA, 19 nt, Homo sapiens
ggucuucccucuggauuua

SEQ ID NO: 17066 - RNA, 19 nt, Homo sapiens
ggaaacaucuggagugacu

SEQ ID NO: 17067 - RNA, 19 nt, Homo sapiens
gaauagaggaugucaguga

SEQ ID NO: 17068 - RNA, 19 nt, Homo sapiens
caacagagaccuacgaugu

SEQ ID NO: 17069 - RNA, 19 nt, Homo sapiens
ggugaacuaugaccacuuu

SEQ ID NO: 17070 - RNA, 19 nt, Homo sapiens
gcacuggaguucugugaau

SEQ ID NO: 17071 - RNA, 19 nt, Homo sapiens
gcuacucgcugaccuuuga

SEQ ID NO: 17072 - RNA, 19 nt, Homo sapiens
gaggagcccuucacguuug

SEQ ID NO: 17073 - RNA, 19 nt, Homo sapiens
gaggagggcuggaacaagu

SEQ ID NO: 17074 - RNA, 19 nt, Homo sapiens
ucgcugagguugagaauga

SEQ ID NO: 17075 - RNA, 19 nt, Homo sapiens
agacagaacuuugguggaa

SEQ ID NO: 17076 - RNA, 19 nt, Homo sapiens
gaagagccguauacaccuu

SEQ ID NO: 17077 - RNA, 19 nt, Homo sapiens
ggagacuacugccauccua

SEQ ID NO: 17078 - RNA, 19 nt, Homo sapiens
cauauaaggaaucccauua

SEQ ID NO: 17079 - RNA, 19 nt, Homo sapiens
gagaagagacucacacagu

SEQ ID NO: 17080 - RNA, 19 nt, Homo sapiens
gcagagacgcaucuagaaa

SEQ ID NO: 17081 - RNA, 19 nt, Homo sapiens
ggagaggccucaggacuuc

SEQ ID NO: 17082 - RNA, 19 nt, Homo sapiens
ccacacgccuugagcaguu

SEQ ID NO: 17083 - RNA, 19 nt, Homo sapiens
gauggagggugaggucuuu

SEQ ID NO: 17084 - RNA, 19 nt, Homo sapiens
gcuacacccucgacuuuga

SEQ ID NO: 17085 - RNA, 19 nt, Homo sapiens
agacgcaucuagaaauuga

SEQ ID NO: 17086 - RNA, 19 nt, Homo sapiens
ccuaguggauucuacauug

SEQ ID NO: 17087 - RNA, 19 nt, Homo sapiens
gaccucugcuucuggagua

SEQ ID NO: 17088 - RNA, 19 nt, Homo sapiens
cggcagcacuuugacauuu

SEQ ID NO: 17089 - RNA, 19 nt, Homo sapiens
ccacgaagcuaaccuugag

SEQ ID NO: 17090 - RNA, 19 nt, Homo sapiens
caacaacaaugcccaagac

SEQ ID NO: 17091 - RNA, 19 nt, Homo sapiens
ugagaacggucuaccucua

SEQ ID NO: 17092 - RNA, 19 nt, Homo sapiens
gcacagccaccaccuacaa

SEQ ID NO: 17093 - RNA, 19 nt, Homo sapiens
ggagaagcaucuggaguuc

SEQ ID NO: 17094 - RNA, 19 nt, Homo sapiens
ggacaagccaggcgugaga

SEQ ID NO: 17095 - RNA, 19 nt, Homo sapiens
ggaauucaguggccuacca

SEQ ID NO: 17096 - RNA, 19 nt, Homo sapiens
gcagaucugucaggcaaau

SEQ ID NO: 17097 - RNA, 19 nt, Homo sapiens
uggcauaacugaucugagu

SEQ ID NO: 17098 - RNA, 19 nt, Homo sapiens
cgaggcagcgugauccuua

SEQ ID NO: 17099 - RNA, 19 nt, Homo sapiens
ggacagccaucaggguuuc

SEQ ID NO: 17100 - RNA, 19 nt, Homo sapiens
caacaaugcccaagacuac

SEQ ID NO: 17101 - RNA, 19 nt, Homo sapiens
ggaauggaaacgugaauca

SEQ ID NO: 17102 - RNA, 19 nt, Homo sapiens
agagacgcaucuagaaauu

SEQ ID NO: 17103 - RNA, 19 nt, Homo sapiens
cagcacagcccacugagaa

SEQ ID NO: 17104 - RNA, 19 nt, Homo sapiens
aagcuaaccuugagagauc

SEQ ID NO: 17105 - RNA, 19 nt, Homo sapiens
gaucgugacccaagugguu

SEQ ID NO: 17106 - RNA, 19 nt, Homo sapiens
gaaacgugaaucagaauca

SEQ ID NO: 17107 - RNA, 19 nt, Homo sapiens
caucaguggugcaggagaa

SEQ ID NO: 17108 - RNA, 19 nt, Homo sapiens
caacgagaccuaugaugug

SEQ ID NO: 17109 - RNA, 19 nt, Homo sapiens
uuuaaucacuucugaguuc

SEQ ID NO: 17110 - RNA, 19 nt, Homo sapiens
gagcaggaguuugucaaca

SEQ ID NO: 17111 - RNA, 19 nt, Homo sapiens
gaguagaaguaucaucagu

SEQ ID NO: 17112 - RNA, 19 nt, Homo sapiens
caccagguacuccauauuu

SEQ ID NO: 17113 - RNA, 19 nt, Homo sapiens
agucaacccuuuggcauaa

SEQ ID NO: 17114 - RNA, 19 nt, Homo sapiens
gagaagggcgaguggaaug

SEQ ID NO: 17115 - RNA, 19 nt, Homo sapiens
caucuggaguucuuuaugg

SEQ ID NO: 17116 - RNA, 19 nt, Homo sapiens
gaaauaccuggacucuuug

SEQ ID NO: 17117 - RNA, 19 nt, Homo sapiens
caaacugccuucuggaacu

SEQ ID NO: 17118 - RNA, 19 nt, Homo sapiens
ccagggauccuuccuacuu

SEQ ID NO: 17119 - RNA, 19 nt, Homo sapiens
gcagcacuuugacauuuca

SEQ ID NO: 17120 - RNA, 19 nt, Homo sapiens
cuacugccauccuagaguu

SEQ ID NO: 17121 - RNA, 19 nt, Homo sapiens
gaacucaguggugcucauu

SEQ ID NO: 17122 - RNA, 19 nt, Homo sapiens
gggaccagaccgucagaua

SEQ ID NO: 17123 - RNA, 19 nt, Homo sapiens
ccuaugauguguacugcuu

SEQ ID NO: 17124 - RNA, 19 nt, Homo sapiens
gcacagcccacugagaaga

SEQ ID NO: 17125 - RNA, 19 nt, Homo sapiens
ccaaccagccugacaacuu

SEQ ID NO: 17126 - RNA, 19 nt, Homo sapiens
gaacuaugaccacuuuacu

SEQ ID NO: 17127 - RNA, 19 nt, Homo sapiens
ggagacaggacugaaauca

SEQ ID NO: 17128 - RNA, 19 nt, Homo sapiens
uaucaucagucccagaauc

SEQ ID NO: 17129 - RNA, 19 nt, Homo sapiens
ccaacgagaccuaugaugu

SEQ ID NO: 17130 - RNA, 19 nt, Homo sapiens
gaaugauguucccugcaau

SEQ ID NO: 17131 - RNA, 19 nt, Homo sapiens
gaagcuaaccuugagagau

SEQ ID NO: 17132 - RNA, 19 nt, Homo sapiens
aauagaggaugucagugaa

SEQ ID NO: 17133 - RNA, 19 nt, Homo sapiens
ggaaccaucagccucagaa

SEQ ID NO: 17134 - RNA, 19 nt, Homo sapiens
acagugaccuggccugaca

SEQ ID NO: 17135 - RNA, 19 nt, Homo sapiens
uguagaaacuucagaccau

SEQ ID NO: 17136 - RNA, 19 nt, Homo sapiens
guuacugaaccaacuauuu

SEQ ID NO: 17137 - RNA, 19 nt, Homo sapiens
gagaucagcgggcuuccuu

SEQ ID NO: 17138 - RNA, 19 nt, Homo sapiens
gagaucagcgggcuuccuu

SEQ ID NO: 17139 - RNA, 19 nt, Homo sapiens
cagggauccuuccuacuug

SEQ ID NO: 17140 - RNA, 19 nt, Homo sapiens
cgaggagcccuucacguuu

SEQ ID NO: 17141 - RNA, 19 nt, Homo sapiens
gaacgacaggaccaucgaa

SEQ ID NO: 17142 - RNA, 19 nt, Homo sapiens
caauguaaguggagaaucc

SEQ ID NO: 17143 - RNA, 19 nt, Homo sapiens
ccgaggagcccuucacguu

SEQ ID NO: 17144 - RNA, 19 nt, Homo sapiens
ggugaaaggcaucguguuc

SEQ ID NO: 17145 - RNA, 19 nt, Homo sapiens
aaacgugaaucagaaucaa

SEQ ID NO: 17146 - RNA, 19 nt, Homo sapiens
cacugcagcugucacugua

SEQ ID NO: 17147 - RNA, 19 nt, Homo sapiens
ugaaaccaccucugcauuc

SEQ ID NO: 17148 - RNA, 19 nt, Homo sapiens
aaucugggaugguggaugu

SEQ ID NO: 17149 - RNA, 19 nt, Homo sapiens
ggaagggagggucuagaga

SEQ ID NO: 17150 - RNA, 19 nt, Homo sapiens
gagagguuguagagacuuc

SEQ ID NO: 17151 - RNA, 19 nt, Homo sapiens
uuacugaaccaacuauuuc

SEQ ID NO: 17152 - RNA, 19 nt, Homo sapiens
ggagcauucuggauuucug

SEQ ID NO: 17153 - RNA, 19 nt, Homo sapiens
cuucugggauuacauuugu

SEQ ID NO: 17154 - RNA, 19 nt, Homo sapiens
gacauuagugggagagcua

SEQ ID NO: 17155 - RNA, 19 nt, Homo sapiens
ugggcaagcuccagaaaca

SEQ ID NO: 17156 - RNA, 19 nt, Homo sapiens
gauuucugccucuggauuu

SEQ ID NO: 17157 - RNA, 19 nt, Homo sapiens
ggacuccaguggucuuacu

SEQ ID NO: 17158 - RNA, 19 nt, Homo sapiens
gaaugggaaccagccuaua

SEQ ID NO: 17159 - RNA, 19 nt, Homo sapiens
ggaaauaccuggacucuuu

SEQ ID NO: 17160 - RNA, 19 nt, Homo sapiens
caaccagccugacaacuuu

SEQ ID NO: 17161 - RNA, 19 nt, Homo sapiens
cuacacaggugaagacuuu

SEQ ID NO: 17162 - RNA, 19 nt, Homo sapiens
gcagaacagugccaucauu

SEQ ID NO: 17163 - RNA, 19 nt, Homo sapiens
gaacuuugguggaaucugu

SEQ ID NO: 17164 - RNA, 19 nt, Homo sapiens
uaaagaagaagaaggcuua

SEQ ID NO: 17165 - RNA, 19 nt, Homo sapiens
ggucuucccucuggauuua

SEQ ID NO: 17166 - RNA, 19 nt, Homo sapiens
ggaaacaucuggagugacu

SEQ ID NO: 17167 - RNA, 19 nt, Homo sapiens
gaauagaggaugucaguga

SEQ ID NO: 17168 - RNA, 19 nt, Homo sapiens
caacagagaccuacgaugu

SEQ ID NO: 17169 - RNA, 19 nt, Homo sapiens
ggugaacuaugaccacuuu

SEQ ID NO: 17170 - RNA, 19 nt, Homo sapiens
gcacuggaguucugugaau

SEQ ID NO: 17171 - RNA, 19 nt, Homo sapiens
gcuacucgcugaccuuuga

SEQ ID NO: 17172 - RNA, 19 nt, Homo sapiens
gaggagcccuucacguuug

SEQ ID NO: 17173 - RNA, 19 nt, Homo sapiens
gaggagggcuggaacaagu

SEQ ID NO: 17174 - RNA, 19 nt, Homo sapiens
uaacauagaccaggaggua

SEQ ID NO: 17175 - RNA, 19 nt, Homo sapiens
ucgcugagguugagaauga

SEQ ID NO: 17176 - RNA, 19 nt, Homo sapiens
agacagaacuuugguggaa

SEQ ID NO: 17177 - RNA, 19 nt, Homo sapiens
gaagagccguauacaccuu

SEQ ID NO: 17178 - RNA, 19 nt, Homo sapiens
ggagacuacugccauccua

SEQ ID NO: 17179 - RNA, 19 nt, Homo sapiens
cauauaaggaaucccauua

SEQ ID NO: 17180 - RNA, 19 nt, Homo sapiens
gagaagagacucacacagu

SEQ ID NO: 17181 - RNA, 19 nt, Homo sapiens
gcagagacgcaucuagaaa

SEQ ID NO: 17182 - RNA, 19 nt, Homo sapiens
ggagaggccucaggacuuc

SEQ ID NO: 17183 - RNA, 19 nt, Homo sapiens
ccacacgccuugagcaguu

SEQ ID NO: 17184 - RNA, 19 nt, Homo sapiens
gauggagggugaggucuuu

SEQ ID NO: 17185 - RNA, 19 nt, Homo sapiens
gcuacacccucgacuuuga

SEQ ID NO: 17186 - RNA, 19 nt, Homo sapiens
agacgcaucuagaaauuga

SEQ ID NO: 17187 - RNA, 19 nt, Homo sapiens
ccuaguggauucuacauug

SEQ ID NO: 17188 - RNA, 19 nt, Homo sapiens
gaccucugcuucuggagua

SEQ ID NO: 17189 - RNA, 19 nt, Homo sapiens
cggcagcacuuugacauuu

SEQ ID NO: 17190 - RNA, 19 nt, Homo sapiens
caacaacaaugcccaagac

SEQ ID NO: 17191 - RNA, 19 nt, Homo sapiens
ugagaacggucuaccucua

SEQ ID NO: 17192 - RNA, 19 nt, Homo sapiens
ggagaagcaucuggaguuc

SEQ ID NO: 17193 - RNA, 19 nt, Homo sapiens
ggacaagccaggcgugaga

SEQ ID NO: 17194 - RNA, 19 nt, Homo sapiens
ggaauucaguggccuacca

SEQ ID NO: 17195 - RNA, 19 nt, Homo sapiens
gcagaucugucaggcaaau

SEQ ID NO: 17196 - RNA, 19 nt, Homo sapiens
uggcauaacugaucugagu

SEQ ID NO: 17197 - RNA, 19 nt, Homo sapiens
cgaggcagcgugauccuua

SEQ ID NO: 17198 - RNA, 19 nt, Homo sapiens
ggacagccaucaggguuuc

SEQ ID NO: 17199 - RNA, 19 nt, Homo sapiens
caacaaugcccaagacuac

SEQ ID NO: 17200 - RNA, 19 nt, Homo sapiens
ggaauggaaacgugaauca

SEQ ID NO: 17201 - RNA, 19 nt, Homo sapiens
agagacgcaucuagaaauu

SEQ ID NO: 17202 - RNA, 19 nt, Homo sapiens
cagcacagcccacugagaa

SEQ ID NO: 17203 - RNA, 19 nt, Homo sapiens
gaucgugacccaagugguu

SEQ ID NO: 17204 - RNA, 19 nt, Homo sapiens
gaaacgugaaucagaauca

SEQ ID NO: 17205 - RNA, 19 nt, Homo sapiens
caucaguggugcaggagaa

SEQ ID NO: 17206 - RNA, 19 nt, Homo sapiens
caacgagaccuaugaugug

SEQ ID NO: 17207 - RNA, 19 nt, Homo sapiens
ggcgagcacuguaacauag

SEQ ID NO: 17208 - RNA, 19 nt, Homo sapiens
uuuaaucacuucugaguuc

SEQ ID NO: 17209 - RNA, 19 nt, Homo sapiens
gagcaggaguuugucaaca

SEQ ID NO: 17210 - RNA, 19 nt, Homo sapiens
aagcuaaccucgagagauc

SEQ ID NO: 17211 - RNA, 19 nt, Homo sapiens
gaguagaaguaucaucagu

SEQ ID NO: 17212 - RNA, 19 nt, Homo sapiens
caccagguacuccauauuu

SEQ ID NO: 17213 - RNA, 19 nt, Homo sapiens
agucaacccuuuggcauaa

SEQ ID NO: 17214 - RNA, 19 nt, Homo sapiens
gcacagaccccaccaccua

SEQ ID NO: 17215 - RNA, 19 nt, Homo sapiens
gagaagggcgaguggaaug

SEQ ID NO: 17216 - RNA, 19 nt, Homo sapiens
gacagagggacacgucaua

SEQ ID NO: 17217 - RNA, 19 nt, Homo sapiens
caucuggaguucuuuaugg

SEQ ID NO: 17218 - RNA, 19 nt, Homo sapiens
gaaauaccuggacucuuug

SEQ ID NO: 17219 - RNA, 19 nt, Homo sapiens
caaacugccuucuggaacu

SEQ ID NO: 17220 - RNA, 19 nt, Homo sapiens
ccagggauccuuccuacuu

SEQ ID NO: 17221 - RNA, 19 nt, Homo sapiens
gcagcacuuugacauuuca

SEQ ID NO: 17222 - RNA, 19 nt, Homo sapiens
cuacugccauccuagaguu

SEQ ID NO: 17223 - RNA, 19 nt, Homo sapiens
gaacucaguggugcucauu

SEQ ID NO: 17224 - RNA, 19 nt, Homo sapiens
gggaccagaccgucagaua

SEQ ID NO: 17225 - RNA, 19 nt, Homo sapiens
ccuaugauguguacugcuu

SEQ ID NO: 17226 - RNA, 19 nt, Homo sapiens
gcacagcccacugagaaga

SEQ ID NO: 17227 - RNA, 19 nt, Homo sapiens
ggaccgguaugagaucaau

SEQ ID NO: 17228 - RNA, 19 nt, Homo sapiens
ccaaccagccugacaacuu

SEQ ID NO: 17229 - RNA, 19 nt, Homo sapiens
gaacuaugaccacuuuacu

SEQ ID NO: 17230 - RNA, 19 nt, Homo sapiens
ggagacaggacugaaauca

SEQ ID NO: 17231 - RNA, 19 nt, Homo sapiens
uaucaucagucccagaauc

SEQ ID NO: 17232 - RNA, 19 nt, Homo sapiens
ccaacgagaccuaugaugu

SEQ ID NO: 17233 - RNA, 19 nt, Homo sapiens
gaaugauguucccugcaau

SEQ ID NO: 17234 - RNA, 19 nt, Homo sapiens
aauagaggaugucagugaa

SEQ ID NO: 17235 - RNA, 19 nt, Homo sapiens
ggaaccaucagccucagaa

SEQ ID NO: 17236 - RNA, 19 nt, Homo sapiens
acagugaccuggccugaca

SEQ ID NO: 17237 - RNA, 19 nt, Homo sapiens
uguagaaacuucagaccau

SEQ ID NO: 17238 - RNA, 19 nt, Homo sapiens
guuacugaaccaacuauuu

SEQ ID NO: 17239 - RNA, 19 nt, Homo sapiens
gagaucagcgggcuuccuu

SEQ ID NO: 17240 - RNA, 19 nt, Homo sapiens
gagaucagcgggcuuccuu

SEQ ID NO: 17241 - RNA, 19 nt, Homo sapiens
cagggauccuuccuacuug

SEQ ID NO: 17242 - RNA, 19 nt, Homo sapiens
cgaggagcccuucacguuu

SEQ ID NO: 17243 - RNA, 19 nt, Homo sapiens
gaacgacaggaccaucgaa

SEQ ID NO: 17244 - RNA, 19 nt, Homo sapiens
caauguaaguggagaaucc

SEQ ID NO: 17245 - RNA, 19 nt, Homo sapiens
ccgaggagcccuucacguu

SEQ ID NO: 17246 - RNA, 19 nt, Homo sapiens
ggugaaaggcaucguguuc

SEQ ID NO: 17247 - RNA, 19 nt, Homo sapiens
aaacgugaaucagaaucaa

SEQ ID NO: 17248 - RNA, 19 nt, Homo sapiens
gaagcuaaccucgagagau

SEQ ID NO: 17249 - RNA, 19 nt, Homo sapiens
ugaaaccaccucugcauuc

SEQ ID NO: 17250 - RNA, 19 nt, Homo sapiens
aaucugggaugguggaugu

SEQ ID NO: 17251 - RNA, 19 nt, Homo sapiens
ggaagggagggucuagaga

SEQ ID NO: 17252 - RNA, 19 nt, Homo sapiens
cacugcagcugucacugua

SEQ ID NO: 17253 - RNA, 19 nt, Homo sapiens
gagagguuguagagacuuc

SEQ ID NO: 17254 - RNA, 19 nt, Homo sapiens
gcagaagaaggaccgguau

SEQ ID NO: 17255 - RNA, 19 nt, Homo sapiens
uuacugaaccaacuauuuc

SEQ ID NO: 17256 - RNA, 19 nt, Homo sapiens
ggagcauucuggauuucug

SEQ ID NO: 17257 - RNA, 19 nt, Homo sapiens
cuucugggauuacauuugu

SEQ ID NO: 17258 - RNA, 19 nt, Homo sapiens
gacauuagugggagagcua

SEQ ID NO: 17259 - RNA, 19 nt, Homo sapiens
ccaacucucuccuguauaa

SEQ ID NO: 17260 - RNA, 19 nt, Homo sapiens
gaccaacucucuccuguau

SEQ ID NO: 17261 - RNA, 19 nt, Homo sapiens
gaaaggagaccaaguccaa

SEQ ID NO: 17262 - RNA, 19 nt, Homo sapiens
uauaaucucucuccuguau

SEQ ID NO: 17263 - RNA, 19 nt, Homo sapiens
uaaucucucuccuguauaa

SEQ ID NO: 17264 - RNA, 19 nt, Homo sapiens
ccacaaugaugauuaaaca

SEQ ID NO: 17265 - RNA, 19 nt, Homo sapiens
gcaaugaacaggaauggaa

SEQ ID NO: 17266 - RNA, 19 nt, Homo sapiens
gccagaagguggagcagua

SEQ ID NO: 17267 - RNA, 19 nt, Homo sapiens
gggaguaucugugaaggaa

SEQ ID NO: 17268 - RNA, 19 nt, Homo sapiens
gcccagcccucuccucaaa

SEQ ID NO: 17269 - RNA, 19 nt, Homo sapiens
gagaagggaguaucuguga

SEQ ID NO: 17270 - RNA, 19 nt, Homo sapiens
gaacacaggccggacagaa

SEQ ID NO: 17271 - RNA, 19 nt, Homo sapiens
gaucagggcugggaacucu

SEQ ID NO: 17272 - RNA, 19 nt, Homo sapiens
cggcugguguucccaauaa

SEQ ID NO: 17273 - RNA, 19 nt, Homo sapiens
agacagaucccauccauca

SEQ ID NO: 17274 - RNA, 19 nt, Homo sapiens
uuaaacaccugacacaucu

SEQ ID NO: 17275 - RNA, 19 nt, Homo sapiens
agacagggcucuucacacu

SEQ ID NO: 17276 - RNA, 19 nt, Homo sapiens
ggaggagcgugcagaacug

SEQ ID NO: 17277 - RNA, 19 nt, Homo sapiens
gaguaucugugaaggaaca

SEQ ID NO: 17278 - RNA, 19 nt, Homo sapiens
gccaagcuuucuucuacaa

SEQ ID NO: 17279 - RNA, 19 nt, Homo sapiens
gaagggaguaucugugaag

SEQ ID NO: 17280 - RNA, 19 nt, Homo sapiens
caacggcucccucuuccuu

SEQ ID NO: 17281 - RNA, 19 nt, Homo sapiens
ggacagaagcuuggaaggu

SEQ ID NO: 17282 - RNA, 19 nt, Homo sapiens
cggcuggaauggaaacuga

SEQ ID NO: 17283 - RNA, 19 nt, Homo sapiens
aaacaucacagcccggauu

SEQ ID NO: 17284 - RNA, 19 nt, Homo sapiens
ccguaacccugaccuguga

SEQ ID NO: 17285 - RNA, 19 nt, Homo sapiens
ggaagccccuggugccuaa

SEQ ID NO: 17286 - RNA, 19 nt, Homo sapiens
gccaggcaaugaacaggaa

SEQ ID NO: 17287 - RNA, 19 nt, Homo sapiens
gcugauccucccugagaua

SEQ ID NO: 17288 - RNA, 19 nt, Homo sapiens
gugcugauccucccugaga

SEQ ID NO: 17289 - RNA, 19 nt, Homo sapiens
agccagaaauuguagauuc

SEQ ID NO: 17290 - RNA, 19 nt, Homo sapiens
gcgagccacuggugcugaa

SEQ ID NO: 17291 - RNA, 19 nt, Homo sapiens
gaggcaggcgagaguagua

SEQ ID NO: 17292 - RNA, 19 nt, Homo sapiens
cgucccaccuucuccugua

SEQ ID NO: 17293 - RNA, 19 nt, Homo sapiens
ggaauggaaaggagaccaa

SEQ ID NO: 17294 - RNA, 19 nt, Homo sapiens
caggaaagccgugcuguca

SEQ ID NO: 17295 - RNA, 19 nt, Homo sapiens
caaugaacaggaauggaaa

SEQ ID NO: 17296 - RNA, 19 nt, Homo sapiens
acagacagaucccauccau

SEQ ID NO: 17297 - RNA, 19 nt, Homo sapiens
caguguggcucguguccuu

SEQ ID NO: 17298 - RNA, 19 nt, Homo sapiens
acacugcagucggagcuaa

SEQ ID NO: 17299 - RNA, 19 nt, Homo sapiens
gaagccagaaauuguagau

SEQ ID NO: 17300 - RNA, 19 nt, Homo sapiens
uugccaagcuuucuucuac

SEQ ID NO: 17301 - RNA, 19 nt, Homo sapiens
caucagcucccuuuucuuu

SEQ ID NO: 17302 - RNA, 19 nt, Homo sapiens
ccagcccucuccucaaauc

SEQ ID NO: 17303 - RNA, 19 nt, Homo sapiens
aaacaccugacacaucuug

SEQ ID NO: 17304 - RNA, 19 nt, Homo sapiens
agaagggaguaucugugaa

SEQ ID NO: 17305 - RNA, 19 nt, Homo sapiens
guccgugucuaccagauuc

SEQ ID NO: 17306 - RNA, 19 nt, Homo sapiens
gcaguaguaggugcucaaa

SEQ ID NO: 17307 - RNA, 19 nt, Homo sapiens
gauucugccucugaacuca

SEQ ID NO: 17308 - RNA, 19 nt, Homo sapiens
ccaauaagguggggacaug

SEQ ID NO: 17309 - RNA, 19 nt, Homo sapiens
uguagauucugccucugaa

SEQ ID NO: 17310 - RNA, 19 nt, Homo sapiens
ugggaagccagaaauugua

SEQ ID NO: 17311 - RNA, 19 nt, Homo sapiens
ggagcgugcagaacugaau

SEQ ID NO: 17312 - RNA, 19 nt, Homo sapiens
cagcaucagcaucaucgaa

SEQ ID NO: 17313 - RNA, 19 nt, Homo sapiens
gugcugguccucagucugu

SEQ ID NO: 17314 - RNA, 19 nt, Homo sapiens
ggggucaucuuguggcaaa

SEQ ID NO: 17315 - RNA, 19 nt, Homo sapiens
ggaauggaaacugaacaca

SEQ ID NO: 17316 - RNA, 19 nt, Homo sapiens
ugauuaaacaccugacaca

SEQ ID NO: 17317 - RNA, 19 nt, Homo sapiens
gaggagcgugcagaacuga

SEQ ID NO: 17318 - RNA, 19 nt, Homo sapiens
caggauggcagccggaaca

SEQ ID NO: 17319 - RNA, 19 nt, Homo sapiens
gggaagccagaaauuguag

SEQ ID NO: 17320 - RNA, 19 nt, Homo sapiens
ggagaccaaguccaacuac

SEQ ID NO: 17321 - RNA, 19 nt, Homo sapiens
guauaaucucucuccugua

SEQ ID NO: 17322 - RNA, 19 nt, Homo sapiens
ugagacagggcucuucaca

SEQ ID NO: 17323 - RNA, 19 nt, Homo sapiens
ggaagccagaaauuguaga

SEQ ID NO: 17324 - RNA, 19 nt, Homo sapiens
ccaacucucuccuguauaa

SEQ ID NO: 17325 - RNA, 19 nt, Homo sapiens
gaccaacucucuccuguau

SEQ ID NO: 17326 - RNA, 19 nt, Homo sapiens
gaaaggagaccaaguccaa

SEQ ID NO: 17327 - RNA, 19 nt, Homo sapiens
uauaaucucucuccuguau

SEQ ID NO: 17328 - RNA, 19 nt, Homo sapiens
uaaucucucuccuguauaa

SEQ ID NO: 17329 - RNA, 19 nt, Homo sapiens
ccacaaugaugauuaaaca

SEQ ID NO: 17330 - RNA, 19 nt, Homo sapiens
gcaaugaacaggaauggaa

SEQ ID NO: 17331 - RNA, 19 nt, Homo sapiens
gccagaagguggagcagua

SEQ ID NO: 17332 - RNA, 19 nt, Homo sapiens
gggaguaucugugaaggaa

SEQ ID NO: 17333 - RNA, 19 nt, Homo sapiens
gcccagcccucuccucaaa

SEQ ID NO: 17334 - RNA, 19 nt, Homo sapiens
gagaagggaguaucuguga

SEQ ID NO: 17335 - RNA, 19 nt, Homo sapiens
gaucagggcugggaacucu

SEQ ID NO: 17336 - RNA, 19 nt, Homo sapiens
cggcugguguucccaauaa

SEQ ID NO: 17337 - RNA, 19 nt, Homo sapiens
agacagaucccauccauca

SEQ ID NO: 17338 - RNA, 19 nt, Homo sapiens
ggaugaaggaugugaguga

SEQ ID NO: 17339 - RNA, 19 nt, Homo sapiens
uuaaacaccugacacaucu

SEQ ID NO: 17340 - RNA, 19 nt, Homo sapiens
agacagggcucuucacacu

SEQ ID NO: 17341 - RNA, 19 nt, Homo sapiens
ggaggagcgugcagaacug

SEQ ID NO: 17342 - RNA, 19 nt, Homo sapiens
gaguaucugugaaggaaca

SEQ ID NO: 17343 - RNA, 19 nt, Homo sapiens
gccaagcuuucuucuacaa

SEQ ID NO: 17344 - RNA, 19 nt, Homo sapiens
gaagggaguaucugugaag

SEQ ID NO: 17345 - RNA, 19 nt, Homo sapiens
caacggcucccucuuccuu

SEQ ID NO: 17346 - RNA, 19 nt, Homo sapiens
aaacaucacagcccggauu

SEQ ID NO: 17347 - RNA, 19 nt, Homo sapiens
ccguaacccugaccuguga

SEQ ID NO: 17348 - RNA, 19 nt, Homo sapiens
ggaagccccuggugccuaa

SEQ ID NO: 17349 - RNA, 19 nt, Homo sapiens
gccaggcaaugaacaggaa

SEQ ID NO: 17350 - RNA, 19 nt, Homo sapiens
gcgagccacuggugcugaa

SEQ ID NO: 17351 - RNA, 19 nt, Homo sapiens
agccagaaauuguagauuc

SEQ ID NO: 17352 - RNA, 19 nt, Homo sapiens
gaggcaggcgagaguagua

SEQ ID NO: 17353 - RNA, 19 nt, Homo sapiens
cgucccaccuucuccugua

SEQ ID NO: 17354 - RNA, 19 nt, Homo sapiens
ggaauggaaaggagaccaa

SEQ ID NO: 17355 - RNA, 19 nt, Homo sapiens
caaugaacaggaauggaaa

SEQ ID NO: 17356 - RNA, 19 nt, Homo sapiens
acagacagaucccauccau

SEQ ID NO: 17357 - RNA, 19 nt, Homo sapiens
caguguggcucguguccuu

SEQ ID NO: 17358 - RNA, 19 nt, Homo sapiens
acacugcagucggagcuaa

SEQ ID NO: 17359 - RNA, 19 nt, Homo sapiens
gaagccagaaauuguagau

SEQ ID NO: 17360 - RNA, 19 nt, Homo sapiens
uugccaagcuuucuucuac

SEQ ID NO: 17361 - RNA, 19 nt, Homo sapiens
caucagcucccuuuucuuu

SEQ ID NO: 17362 - RNA, 19 nt, Homo sapiens
ccagcccucuccucaaauc

SEQ ID NO: 17363 - RNA, 19 nt, Homo sapiens
aaacaccugacacaucuug

SEQ ID NO: 17364 - RNA, 19 nt, Homo sapiens
agaagggaguaucugugaa

SEQ ID NO: 17365 - RNA, 19 nt, Homo sapiens
guccgugucuaccagauuc

SEQ ID NO: 17366 - RNA, 19 nt, Homo sapiens
gcaguaguaggugcucaaa

SEQ ID NO: 17367 - RNA, 19 nt, Homo sapiens
gauucugccucugaacuca

SEQ ID NO: 17368 - RNA, 19 nt, Homo sapiens
ccaauaagguggggacaug

SEQ ID NO: 17369 - RNA, 19 nt, Homo sapiens
uguagauucugccucugaa

SEQ ID NO: 17370 - RNA, 19 nt, Homo sapiens
ugggaagccagaaauugua

SEQ ID NO: 17371 - RNA, 19 nt, Homo sapiens
ggagcgugcagaacugaau

SEQ ID NO: 17372 - RNA, 19 nt, Homo sapiens
gugcugguccucagucugu

SEQ ID NO: 17373 - RNA, 19 nt, Homo sapiens
ggggucaucuuguggcaaa

SEQ ID NO: 17374 - RNA, 19 nt, Homo sapiens
ugauuaaacaccugacaca

SEQ ID NO: 17375 - RNA, 19 nt, Homo sapiens
gaggagcgugcagaacuga

SEQ ID NO: 17376 - RNA, 19 nt, Homo sapiens
caggauggcagccggaaca

SEQ ID NO: 17377 - RNA, 19 nt, Homo sapiens
gggaagccagaaauuguag

SEQ ID NO: 17378 - RNA, 19 nt, Homo sapiens
ggagaccaaguccaacuac

SEQ ID NO: 17379 - RNA, 19 nt, Homo sapiens
guauaaucucucuccugua

SEQ ID NO: 17380 - RNA, 19 nt, Homo sapiens
ugagacagggcucuucaca

SEQ ID NO: 17381 - RNA, 19 nt, Homo sapiens
ggaagccagaaauuguaga

SEQ ID NO: 17382 - RNA, 19 nt, Homo sapiens
gaaaucaucugacacaauu

SEQ ID NO: 17383 - RNA, 19 nt, Homo sapiens
gcaacaaucugguucauuu

SEQ ID NO: 17384 - RNA, 19 nt, Homo sapiens
gcacagauguucaaacuau

SEQ ID NO: 17385 - RNA, 19 nt, Homo sapiens
caaugcagauccuauauua

SEQ ID NO: 17386 - RNA, 19 nt, Homo sapiens
gggaauaccugcuuugauu

SEQ ID NO: 17387 - RNA, 19 nt, Homo sapiens
gggagacaguguuaaauua

SEQ ID NO: 17388 - RNA, 19 nt, Homo sapiens
gaacauggguaacucauuc

SEQ ID NO: 17389 - RNA, 19 nt, Homo sapiens
gaaauaagaccaaagaaug

SEQ ID NO: 17390 - RNA, 19 nt, Homo sapiens
gauaaugaguguccuauug

SEQ ID NO: 17391 - RNA, 19 nt, Homo sapiens
ccaaguagaugucaacaaa

SEQ ID NO: 17392 - RNA, 19 nt, Homo sapiens
gaagagggcagauuaguuu

SEQ ID NO: 17393 - RNA, 19 nt, Homo sapiens
gaagggaaauacaaagaaa

SEQ ID NO: 17394 - RNA, 19 nt, Homo sapiens
gaacuuauuuccuagauag

SEQ ID NO: 17395 - RNA, 19 nt, Homo sapiens
gcaaugagugcauauaaua

SEQ ID NO: 17396 - RNA, 19 nt, Homo sapiens
ggacgaagguuuuaauaua

SEQ ID NO: 17397 - RNA, 19 nt, Homo sapiens
gagaacauauucagcuuaa

SEQ ID NO: 17398 - RNA, 19 nt, Homo sapiens
guagaaugcuucauacuug

SEQ ID NO: 17399 - RNA, 19 nt, Homo sapiens
ugacagagcuagaaacaga

SEQ ID NO: 17400 - RNA, 19 nt, Homo sapiens
ggagauugcccaccuguua

SEQ ID NO: 17401 - RNA, 19 nt, Homo sapiens
gagauuggaugauugacua

SEQ ID NO: 17402 - RNA, 19 nt, Homo sapiens
ggagaaacauuuaauagag

SEQ ID NO: 17403 - RNA, 19 nt, Homo sapiens
ugaccuugcuuuagaaaua

SEQ ID NO: 17404 - RNA, 19 nt, Homo sapiens
gcaaggucaucauauguaa

SEQ ID NO: 17405 - RNA, 19 nt, Homo sapiens
guagaagccaggaauauua

SEQ ID NO: 17406 - RNA, 19 nt, Homo sapiens
ccagauagaucgaaacaug

SEQ ID NO: 17407 - RNA, 19 nt, Homo sapiens
cuauaaaggucucauauga

SEQ ID NO: 17408 - RNA, 19 nt, Homo sapiens
gcaaggaagugccucaaau

SEQ ID NO: 17409 - RNA, 19 nt, Homo sapiens
gugaagaucuggacaaugu

SEQ ID NO: 17410 - RNA, 19 nt, Homo sapiens
guacagagguagauuucaa

SEQ ID NO: 17411 - RNA, 19 nt, Homo sapiens
ugaagcagaucccacguua

SEQ ID NO: 17412 - RNA, 19 nt, Homo sapiens
gcagauuaguuuaccgaua

SEQ ID NO: 17413 - RNA, 19 nt, Homo sapiens
gaagaaugcuguaauuggu

SEQ ID NO: 17414 - RNA, 19 nt, Homo sapiens
ggaauggaauguuauuugu

SEQ ID NO: 17415 - RNA, 19 nt, Homo sapiens
gaaaguauaccuggaauga

SEQ ID NO: 17416 - RNA, 19 nt, Homo sapiens
cuugaaagcucguguaauu

SEQ ID NO: 17417 - RNA, 19 nt, Homo sapiens
acacaagccuggucaauug

SEQ ID NO: 17418 - RNA, 19 nt, Homo sapiens
gaaugugccuauaaucuug

SEQ ID NO: 17419 - RNA, 19 nt, Homo sapiens
gaaaguaguggcaagaauu

SEQ ID NO: 17420 - RNA, 19 nt, Homo sapiens
gcaaagcauuaggaaauuu

SEQ ID NO: 17421 - RNA, 19 nt, Homo sapiens
gaacauauucagcuuaaug

SEQ ID NO: 17422 - RNA, 19 nt, Homo sapiens
ccuauaaucuugugaauuc

SEQ ID NO: 17423 - RNA, 19 nt, Homo sapiens
ugaaagcucguguaauuua

SEQ ID NO: 17424 - RNA, 19 nt, Homo sapiens
gaaaggacuuccagaacug

SEQ ID NO: 17425 - RNA, 19 nt, Homo sapiens
caacuacaaucuugcuaaa

SEQ ID NO: 17426 - RNA, 19 nt, Homo sapiens
acaagucgcuguuggaauu

SEQ ID NO: 17427 - RNA, 19 nt, Homo sapiens
aaacacaggugaaguuaau

SEQ ID NO: 17428 - RNA, 19 nt, Homo sapiens
aagaggcuaugaugaauua

SEQ ID NO: 17429 - RNA, 19 nt, Homo sapiens
guaaauggauccaggaaca

SEQ ID NO: 17430 - RNA, 19 nt, Homo sapiens
gaaucaggcuacaacauga

SEQ ID NO: 17431 - RNA, 19 nt, Homo sapiens
gaugagaauucaaucaaug

SEQ ID NO: 17432 - RNA, 19 nt, Homo sapiens
ugauucaucugccaaauaa

SEQ ID NO: 17433 - RNA, 19 nt, Homo sapiens
ggucauauuucuagaacuu

SEQ ID NO: 17434 - RNA, 19 nt, Homo sapiens
gcaacccaauuuauaugua

SEQ ID NO: 17435 - RNA, 19 nt, Homo sapiens
agagguagauuucaauuug

SEQ ID NO: 17436 - RNA, 19 nt, Homo sapiens
acaaagcgguugagcaauu

SEQ ID NO: 17437 - RNA, 19 nt, Homo sapiens
gcagacuaaucucuuguaa

SEQ ID NO: 17438 - RNA, 19 nt, Homo sapiens
gagcacagauguucaaacu

SEQ ID NO: 17439 - RNA, 19 nt, Homo sapiens
gaaguuuccaucuacaaua

SEQ ID NO: 17440 - RNA, 19 nt, Homo sapiens
guaaaugguugcaggcuau

SEQ ID NO: 17441 - RNA, 19 nt, Homo sapiens
gaagaacgguuuuacacua

SEQ ID NO: 17442 - RNA, 19 nt, Homo sapiens
cagauuaguuuaccgauau

SEQ ID NO: 17443 - RNA, 19 nt, Homo sapiens
gagaagcaucgacucauua

SEQ ID NO: 17444 - RNA, 19 nt, Homo sapiens
ugagagaaccauuaguuua

SEQ ID NO: 17445 - RNA, 19 nt, Homo sapiens
gagaugauccucuucgaaa

SEQ ID NO: 17446 - RNA, 19 nt, Homo sapiens
aguaaucgcugacaguuaa

SEQ ID NO: 17447 - RNA, 19 nt, Homo sapiens
ggauaugaauucaguagau

SEQ ID NO: 17448 - RNA, 19 nt, Homo sapiens
aaaccuacauugacaaguu

SEQ ID NO: 17449 - RNA, 19 nt, Homo sapiens
ucacaaacguggcauauac

SEQ ID NO: 17450 - RNA, 19 nt, Homo sapiens
gcacauggauggauaaaau

SEQ ID NO: 17451 - RNA, 19 nt, Homo sapiens
gcagaaauaagaccaaaga

SEQ ID NO: 17452 - RNA, 19 nt, Homo sapiens
gagagaaccauuaguuuau

SEQ ID NO: 17453 - RNA, 19 nt, Homo sapiens
acaguaaucugaccacuau

SEQ ID NO: 17454 - RNA, 19 nt, Homo sapiens
gcacaugcccuguuuaugg

SEQ ID NO: 17455 - RNA, 19 nt, Homo sapiens
ucacguagcugaguacaug

SEQ ID NO: 17456 - RNA, 19 nt, Homo sapiens
gauccaaaccaacaccuua

SEQ ID NO: 17457 - RNA, 19 nt, Homo sapiens
gaaaagcaguuaccgugua

SEQ ID NO: 17458 - RNA, 19 nt, Homo sapiens
gaaauugugggccugagua

SEQ ID NO: 17459 - RNA, 19 nt, Homo sapiens
caaaagggcccaaugaaua

SEQ ID NO: 17460 - RNA, 19 nt, Homo sapiens
gauaugaacauugcacuaa

SEQ ID NO: 17461 - RNA, 19 nt, Homo sapiens
gccuagaaauccauaguuu

SEQ ID NO: 17462 - RNA, 19 nt, Homo sapiens
gcuaaagguuucaauuauc

SEQ ID NO: 17463 - RNA, 19 nt, Homo sapiens
gaucagccauuguuugaag

SEQ ID NO: 17464 - RNA, 19 nt, Homo sapiens
ggugguggcugcaguguau

SEQ ID NO: 17465 - RNA, 19 nt, Homo sapiens
ggcauggucucauuccuaa

SEQ ID NO: 17466 - RNA, 19 nt, Homo sapiens
gcaauguuguguuucucua

SEQ ID NO: 17467 - RNA, 19 nt, Homo sapiens
ggucagcccuuaaauaugc

SEQ ID NO: 17468 - RNA, 19 nt, Homo sapiens
acaauucaguccucacuuu

SEQ ID NO: 17469 - RNA, 19 nt, Homo sapiens
caaagcgguugagcaauuu

SEQ ID NO: 17470 - RNA, 19 nt, Homo sapiens
gauauuguguugcacuaga

SEQ ID NO: 17471 - RNA, 19 nt, Homo sapiens
cuagaacuauugagagaaa

SEQ ID NO: 17472 - RNA, 19 nt, Homo sapiens
ucugauaugucuugaacua

SEQ ID NO: 17473 - RNA, 19 nt, Homo sapiens
caaauacccaugcuugaaa

SEQ ID NO: 17474 - RNA, 19 nt, Homo sapiens
auaaaggucucauaugaug

SEQ ID NO: 17475 - RNA, 19 nt, Homo sapiens
gaaugggaaagcagacuua

SEQ ID NO: 17476 - RNA, 19 nt, Homo sapiens
gcaguuaccguguauacaa

SEQ ID NO: 17477 - RNA, 19 nt, Homo sapiens
ugaggaagauuaaugaaag

SEQ ID NO: 17478 - RNA, 19 nt, Homo sapiens
ggacaguugugacaguaau

SEQ ID NO: 17479 - RNA, 19 nt, Homo sapiens
ggaaauugucggucauauu

SEQ ID NO: 17480 - RNA, 19 nt, Homo sapiens
gaagcuagaacuauugaga

SEQ ID NO: 17481 - RNA, 19 nt, Homo sapiens
gccaaucaguuagaauuaa

SEQ ID NO: 17482 - RNA, 19 nt, Homo sapiens
gaaaucaucugacacaauu

SEQ ID NO: 17483 - RNA, 19 nt, Homo sapiens
gcaacaaucugguucauuu

SEQ ID NO: 17484 - RNA, 19 nt, Homo sapiens
gcacagauguucaaacuau

SEQ ID NO: 17485 - RNA, 19 nt, Homo sapiens
caaugcagauccuauauua

SEQ ID NO: 17486 - RNA, 19 nt, Homo sapiens
gggaauaccugcuuugauu

SEQ ID NO: 17487 - RNA, 19 nt, Homo sapiens
gggagacaguguuaaauua

SEQ ID NO: 17488 - RNA, 19 nt, Homo sapiens
gaaauaagaccaaagaaug

SEQ ID NO: 17489 - RNA, 19 nt, Homo sapiens
gauaaugaguguccuauug

SEQ ID NO: 17490 - RNA, 19 nt, Homo sapiens
ccaaguagaugucaacaaa

SEQ ID NO: 17491 - RNA, 19 nt, Homo sapiens
gaagagggcagauuaguuu

SEQ ID NO: 17492 - RNA, 19 nt, Homo sapiens
gaagggaaauacaaagaaa

SEQ ID NO: 17493 - RNA, 19 nt, Homo sapiens
gaacuuauuuccuagauag

SEQ ID NO: 17494 - RNA, 19 nt, Homo sapiens
gcaaugagugcauauaaua

SEQ ID NO: 17495 - RNA, 19 nt, Homo sapiens
ggacgaagguuuuaauaua

SEQ ID NO: 17496 - RNA, 19 nt, Homo sapiens
gagaacauauucagcuuaa

SEQ ID NO: 17497 - RNA, 19 nt, Homo sapiens
guagaaugcuucauacuug

SEQ ID NO: 17498 - RNA, 19 nt, Homo sapiens
ugacagagcuagaaacaga

SEQ ID NO: 17499 - RNA, 19 nt, Homo sapiens
gagauuggaugauugacua

SEQ ID NO: 17500 - RNA, 19 nt, Homo sapiens
ggagaaacauuuaauagag

SEQ ID NO: 17501 - RNA, 19 nt, Homo sapiens
ugaccuugcuuuagaaaua

SEQ ID NO: 17502 - RNA, 19 nt, Homo sapiens
gcaaggucaucauauguaa

SEQ ID NO: 17503 - RNA, 19 nt, Homo sapiens
guagaagccaggaauauua

SEQ ID NO: 17504 - RNA, 19 nt, Homo sapiens
ccagauagaucgaaacaug

SEQ ID NO: 17505 - RNA, 19 nt, Homo sapiens
cuauaaaggucucauauga

SEQ ID NO: 17506 - RNA, 19 nt, Homo sapiens
gcaaggaagugccucaaau

SEQ ID NO: 17507 - RNA, 19 nt, Homo sapiens
gugaagaucuggacaaugu

SEQ ID NO: 17508 - RNA, 19 nt, Homo sapiens
guacagagguagauuucaa

SEQ ID NO: 17509 - RNA, 19 nt, Homo sapiens
ugaagcagaucccacguua

SEQ ID NO: 17510 - RNA, 19 nt, Homo sapiens
gcagauuaguuuaccgaua

SEQ ID NO: 17511 - RNA, 19 nt, Homo sapiens
gaagaaugcuguaauuggu

SEQ ID NO: 17512 - RNA, 19 nt, Homo sapiens
ggaauggaauguuauuugu

SEQ ID NO: 17513 - RNA, 19 nt, Homo sapiens
gaaaguauaccuggaauga

SEQ ID NO: 17514 - RNA, 19 nt, Homo sapiens
cuugaaagcucguguaauu

SEQ ID NO: 17515 - RNA, 19 nt, Homo sapiens
acacaagccuggucaauug

SEQ ID NO: 17516 - RNA, 19 nt, Homo sapiens
gaaugugccuauaaucuug

SEQ ID NO: 17517 - RNA, 19 nt, Homo sapiens
gaaaguaguggcaagaauu

SEQ ID NO: 17518 - RNA, 19 nt, Homo sapiens
gcaaagcauuaggaaauuu

SEQ ID NO: 17519 - RNA, 19 nt, Homo sapiens
gaacauauucagcuuaaug

SEQ ID NO: 17520 - RNA, 19 nt, Homo sapiens
ccuauaaucuugugaauuc

SEQ ID NO: 17521 - RNA, 19 nt, Homo sapiens
ugaaagcucguguaauuua

SEQ ID NO: 17522 - RNA, 19 nt, Homo sapiens
gaaaggacuuccagaacug

SEQ ID NO: 17523 - RNA, 19 nt, Homo sapiens
caacuacaaucuugcuaaa

SEQ ID NO: 17524 - RNA, 19 nt, Homo sapiens
acaagucgcuguuggaauu

SEQ ID NO: 17525 - RNA, 19 nt, Homo sapiens
aaacacaggugaaguuaau

SEQ ID NO: 17526 - RNA, 19 nt, Homo sapiens
aagaggcuaugaugaauua

SEQ ID NO: 17527 - RNA, 19 nt, Homo sapiens
guaaauggauccaggaaca

SEQ ID NO: 17528 - RNA, 19 nt, Homo sapiens
gaaucaggcuacaacauga

SEQ ID NO: 17529 - RNA, 19 nt, Homo sapiens
gaugagaauucaaucaaug

SEQ ID NO: 17530 - RNA, 19 nt, Homo sapiens
ugauucaucugccaaauaa

SEQ ID NO: 17531 - RNA, 19 nt, Homo sapiens
ggucauauuucuagaacuu

SEQ ID NO: 17532 - RNA, 19 nt, Homo sapiens
gcaacccaauuuauaugua

SEQ ID NO: 17533 - RNA, 19 nt, Homo sapiens
agagguagauuucaauuug

SEQ ID NO: 17534 - RNA, 19 nt, Homo sapiens
acaaagcgguugagcaauu

SEQ ID NO: 17535 - RNA, 19 nt, Homo sapiens
gagcacagauguucaaacu

SEQ ID NO: 17536 - RNA, 19 nt, Homo sapiens
gaaguuuccaucuacaaua

SEQ ID NO: 17537 - RNA, 19 nt, Homo sapiens
guaaaugguugcaggcuau

SEQ ID NO: 17538 - RNA, 19 nt, Homo sapiens
gaagaacgguuuuacacua

SEQ ID NO: 17539 - RNA, 19 nt, Homo sapiens
cagauuaguuuaccgauau

SEQ ID NO: 17540 - RNA, 19 nt, Homo sapiens
gagaagcaucgacucauua

SEQ ID NO: 17541 - RNA, 19 nt, Homo sapiens
ugagagaaccauuaguuua

SEQ ID NO: 17542 - RNA, 19 nt, Homo sapiens
gagaugauccucuucgaaa

SEQ ID NO: 17543 - RNA, 19 nt, Homo sapiens
aguaaucgcugacaguuaa

SEQ ID NO: 17544 - RNA, 19 nt, Homo sapiens
ggauaugaauucaguagau

SEQ ID NO: 17545 - RNA, 19 nt, Homo sapiens
aaaccuacauugacaaguu

SEQ ID NO: 17546 - RNA, 19 nt, Homo sapiens
ucacaaacguggcauauac

SEQ ID NO: 17547 - RNA, 19 nt, Homo sapiens
gcacauggauggauaaaau

SEQ ID NO: 17548 - RNA, 19 nt, Homo sapiens
gcagaaauaagaccaaaga

SEQ ID NO: 17549 - RNA, 19 nt, Homo sapiens
gagagaaccauuaguuuau

SEQ ID NO: 17550 - RNA, 19 nt, Homo sapiens
acaguaaucugaccacuau

SEQ ID NO: 17551 - RNA, 19 nt, Homo sapiens
gcacaugcccuguuuaugg

SEQ ID NO: 17552 - RNA, 19 nt, Homo sapiens
ucacguagcugaguacaug

SEQ ID NO: 17553 - RNA, 19 nt, Homo sapiens
gauccaaaccaacaccuua

SEQ ID NO: 17554 - RNA, 19 nt, Homo sapiens
gaaaagcaguuaccgugua

SEQ ID NO: 17555 - RNA, 19 nt, Homo sapiens
gaaauugugggccugagua

SEQ ID NO: 17556 - RNA, 19 nt, Homo sapiens
caaaagggcccaaugaaua

SEQ ID NO: 17557 - RNA, 19 nt, Homo sapiens
gauaugaacauugcacuaa

SEQ ID NO: 17558 - RNA, 19 nt, Homo sapiens
gccuagaaauccauaguuu

SEQ ID NO: 17559 - RNA, 19 nt, Homo sapiens
gcuaaagguuucaauuauc

SEQ ID NO: 17560 - RNA, 19 nt, Homo sapiens
gaucagccauuguuugaag

SEQ ID NO: 17561 - RNA, 19 nt, Homo sapiens
ggugguggcugcaguguau

SEQ ID NO: 17562 - RNA, 19 nt, Homo sapiens
ggcauggucucauuccuaa

SEQ ID NO: 17563 - RNA, 19 nt, Homo sapiens
gcaauguuguguuucucua

SEQ ID NO: 17564 - RNA, 19 nt, Homo sapiens
ggucagcccuuaaauaugc

SEQ ID NO: 17565 - RNA, 19 nt, Homo sapiens
acaauucaguccucacuuu

SEQ ID NO: 17566 - RNA, 19 nt, Homo sapiens
caaagcgguugagcaauuu

SEQ ID NO: 17567 - RNA, 19 nt, Homo sapiens
gauauuguguugcacuaga

SEQ ID NO: 17568 - RNA, 19 nt, Homo sapiens
cuagaacuauugagagaaa

SEQ ID NO: 17569 - RNA, 19 nt, Homo sapiens
ucugauaugucuugaacua

SEQ ID NO: 17570 - RNA, 19 nt, Homo sapiens
caaauacccaugcuugaaa

SEQ ID NO: 17571 - RNA, 19 nt, Homo sapiens
auaaaggucucauaugaug

SEQ ID NO: 17572 - RNA, 19 nt, Homo sapiens
gaaugggaaagcagacuua

SEQ ID NO: 17573 - RNA, 19 nt, Homo sapiens
gcaguuaccguguauacaa

SEQ ID NO: 17574 - RNA, 19 nt, Homo sapiens
ugaggaagauuaaugaaag

SEQ ID NO: 17575 - RNA, 19 nt, Homo sapiens
ggacaguugugacaguaau

SEQ ID NO: 17576 - RNA, 19 nt, Homo sapiens
ggaaauugucggucauauu

SEQ ID NO: 17577 - RNA, 19 nt, Homo sapiens
gaagcuagaacuauugaga

SEQ ID NO: 17578 - RNA, 19 nt, Homo sapiens
gccaaucaguuagaauuaa

SEQ ID NO: 17579 - RNA, 19 nt, Homo sapiens
caacagaaagagaagauga

SEQ ID NO: 17580 - RNA, 19 nt, Homo sapiens
gaggaagauuaaugaaaga

SEQ ID NO: 17581 - RNA, 19 nt, Homo sapiens
ccaaugagaaugcccagua

SEQ ID NO: 17582 - RNA, 19 nt, Homo sapiens
gaaaucaucugacacaauu

SEQ ID NO: 17583 - RNA, 19 nt, Homo sapiens
gcaacaaucugguucauuu

SEQ ID NO: 17584 - RNA, 19 nt, Homo sapiens
gcacagauguucaaacuau

SEQ ID NO: 17585 - RNA, 19 nt, Homo sapiens
caaugcagauccuauauua

SEQ ID NO: 17586 - RNA, 19 nt, Homo sapiens
gggaauaccugcuuugauu

SEQ ID NO: 17587 - RNA, 19 nt, Homo sapiens
gggagacaguguuaaauua

SEQ ID NO: 17588 - RNA, 19 nt, Homo sapiens
gaaauaagaccaaagaaug

SEQ ID NO: 17589 - RNA, 19 nt, Homo sapiens
gauaaugaguguccuauug

SEQ ID NO: 17590 - RNA, 19 nt, Homo sapiens
ccaaguagaugucaacaaa

SEQ ID NO: 17591 - RNA, 19 nt, Homo sapiens
gaagagggcagauuaguuu

SEQ ID NO: 17592 - RNA, 19 nt, Homo sapiens
gaagggaaauacaaagaaa

SEQ ID NO: 17593 - RNA, 19 nt, Homo sapiens
gaacuuauuuccuagauag

SEQ ID NO: 17594 - RNA, 19 nt, Homo sapiens
gcaaugagugcauauaaua

SEQ ID NO: 17595 - RNA, 19 nt, Homo sapiens
ggacgaagguuuuaauaua

SEQ ID NO: 17596 - RNA, 19 nt, Homo sapiens
gagaacauauucagcuuaa

SEQ ID NO: 17597 - RNA, 19 nt, Homo sapiens
guagaaugcuucauacuug

SEQ ID NO: 17598 - RNA, 19 nt, Homo sapiens
ugacagagcuagaaacaga

SEQ ID NO: 17599 - RNA, 19 nt, Homo sapiens
ggagauugcccaccuguua

SEQ ID NO: 17600 - RNA, 19 nt, Homo sapiens
gagauuggaugauugacua

SEQ ID NO: 17601 - RNA, 19 nt, Homo sapiens
ggagaaacauuuaauagag

SEQ ID NO: 17602 - RNA, 19 nt, Homo sapiens
ugaccuugcuuuagaaaua

SEQ ID NO: 17603 - RNA, 19 nt, Homo sapiens
gcaaggucaucauauguaa

SEQ ID NO: 17604 - RNA, 19 nt, Homo sapiens
guagaagccaggaauauua

SEQ ID NO: 17605 - RNA, 19 nt, Homo sapiens
ccagauagaucgaaacaug

SEQ ID NO: 17606 - RNA, 19 nt, Homo sapiens
agacuaaucucuuggguaa

SEQ ID NO: 17607 - RNA, 19 nt, Homo sapiens
cuauaaaggucucauauga

SEQ ID NO: 17608 - RNA, 19 nt, Homo sapiens
gcaaggaagugccucaaau

SEQ ID NO: 17609 - RNA, 19 nt, Homo sapiens
gugaagaucuggacaaugu

SEQ ID NO: 17610 - RNA, 19 nt, Homo sapiens
guacagagguagauuucaa

SEQ ID NO: 17611 - RNA, 19 nt, Homo sapiens
ugaagcagaucccacguua

SEQ ID NO: 17612 - RNA, 19 nt, Homo sapiens
gcagauuaguuuaccgaua

SEQ ID NO: 17613 - RNA, 19 nt, Homo sapiens
gaagaaugcuguaauuggu

SEQ ID NO: 17614 - RNA, 19 nt, Homo sapiens
ggaauggaauguuauuugu

SEQ ID NO: 17615 - RNA, 19 nt, Homo sapiens
gaaaguauaccuggaauga

SEQ ID NO: 17616 - RNA, 19 nt, Homo sapiens
cuugaaagcucguguaauu

SEQ ID NO: 17617 - RNA, 19 nt, Homo sapiens
acacaagccuggucaauug

SEQ ID NO: 17618 - RNA, 19 nt, Homo sapiens
gaaugugccuauaaucuug

SEQ ID NO: 17619 - RNA, 19 nt, Homo sapiens
gaaaguaguggcaagaauu

SEQ ID NO: 17620 - RNA, 19 nt, Homo sapiens
gcaaagcauuaggaaauuu

SEQ ID NO: 17621 - RNA, 19 nt, Homo sapiens
gaacauauucagcuuaaug

SEQ ID NO: 17622 - RNA, 19 nt, Homo sapiens
ccuauaaucuugugaauuc

SEQ ID NO: 17623 - RNA, 19 nt, Homo sapiens
ugaaagcucguguaauuua

SEQ ID NO: 17624 - RNA, 19 nt, Homo sapiens
gaaaggacuuccagaacug

SEQ ID NO: 17625 - RNA, 19 nt, Homo sapiens
caacuacaaucuugcuaaa

SEQ ID NO: 17626 - RNA, 19 nt, Homo sapiens
acaagucgcuguuggaauu

SEQ ID NO: 17627 - RNA, 19 nt, Homo sapiens
aaacacaggugaaguuaau

SEQ ID NO: 17628 - RNA, 19 nt, Homo sapiens
aagaggcuaugaugaauua

SEQ ID NO: 17629 - RNA, 19 nt, Homo sapiens
guaaauggauccaggaaca

SEQ ID NO: 17630 - RNA, 19 nt, Homo sapiens
gaaucaggcuacaacauga

SEQ ID NO: 17631 - RNA, 19 nt, Homo sapiens
gaugagaauucaaucaaug

SEQ ID NO: 17632 - RNA, 19 nt, Homo sapiens
ugauucaucugccaaauaa

SEQ ID NO: 17633 - RNA, 19 nt, Homo sapiens
ggucauauuucuagaacuu

SEQ ID NO: 17634 - RNA, 19 nt, Homo sapiens
gcaacccaauuuauaugua

SEQ ID NO: 17635 - RNA, 19 nt, Homo sapiens
agagguagauuucaauuug

SEQ ID NO: 17636 - RNA, 19 nt, Homo sapiens
acaaagcgguugagcaauu

SEQ ID NO: 17637 - RNA, 19 nt, Homo sapiens
gagcacagauguucaaacu

SEQ ID NO: 17638 - RNA, 19 nt, Homo sapiens
gaaguuuccaucuacaaua

SEQ ID NO: 17639 - RNA, 19 nt, Homo sapiens
guaaaugguugcaggcuau

SEQ ID NO: 17640 - RNA, 19 nt, Homo sapiens
gaagaacgguuuuacacua

SEQ ID NO: 17641 - RNA, 19 nt, Homo sapiens
cagauuaguuuaccgauau

SEQ ID NO: 17642 - RNA, 19 nt, Homo sapiens
gagaagcaucgacucauua

SEQ ID NO: 17643 - RNA, 19 nt, Homo sapiens
ugagagaaccauuaguuua

SEQ ID NO: 17644 - RNA, 19 nt, Homo sapiens
gagaugauccucuucgaaa

SEQ ID NO: 17645 - RNA, 19 nt, Homo sapiens
aguaaucgcugacaguuaa

SEQ ID NO: 17646 - RNA, 19 nt, Homo sapiens
ggauaugaauucaguagau

SEQ ID NO: 17647 - RNA, 19 nt, Homo sapiens
aaaccuacauugacaaguu

SEQ ID NO: 17648 - RNA, 19 nt, Homo sapiens
ucacaaacguggcauauac

SEQ ID NO: 17649 - RNA, 19 nt, Homo sapiens
gcacauggauggauaaaau

SEQ ID NO: 17650 - RNA, 19 nt, Homo sapiens
gcagaaauaagaccaaaga

SEQ ID NO: 17651 - RNA, 19 nt, Homo sapiens
gagagaaccauuaguuuau

SEQ ID NO: 17652 - RNA, 19 nt, Homo sapiens
acaguaaucugaccacuau

SEQ ID NO: 17653 - RNA, 19 nt, Homo sapiens
gcacaugcccuguuuaugg

SEQ ID NO: 17654 - RNA, 19 nt, Homo sapiens
ucacguagcugaguacaug

SEQ ID NO: 17655 - RNA, 19 nt, Homo sapiens
gauccaaaccaacaccuua

SEQ ID NO: 17656 - RNA, 19 nt, Homo sapiens
gaaaagcaguuaccgugua

SEQ ID NO: 17657 - RNA, 19 nt, Homo sapiens
gaaauugugggccugagua

SEQ ID NO: 17658 - RNA, 19 nt, Homo sapiens
caaaagggcccaaugaaua

SEQ ID NO: 17659 - RNA, 19 nt, Homo sapiens
gauaugaacauugcacuaa

SEQ ID NO: 17660 - RNA, 19 nt, Homo sapiens
gccuagaaauccauaguuu

SEQ ID NO: 17661 - RNA, 19 nt, Homo sapiens
gcuaaagguuucaauuauc

SEQ ID NO: 17662 - RNA, 19 nt, Homo sapiens
gaucagccauuguuugaag

SEQ ID NO: 17663 - RNA, 19 nt, Homo sapiens
ggugguggcugcaguguau

SEQ ID NO: 17664 - RNA, 19 nt, Homo sapiens
ggcauggucucauuccuaa

SEQ ID NO: 17665 - RNA, 19 nt, Homo sapiens
gcaauguuguguuucucua

SEQ ID NO: 17666 - RNA, 19 nt, Homo sapiens
ggucagcccuuaaauaugc

SEQ ID NO: 17667 - RNA, 19 nt, Homo sapiens
acaauucaguccucacuuu

SEQ ID NO: 17668 - RNA, 19 nt, Homo sapiens
caaagcgguugagcaauuu

SEQ ID NO: 17669 - RNA, 19 nt, Homo sapiens
gauauuguguugcacuaga

SEQ ID NO: 17670 - RNA, 19 nt, Homo sapiens
cuagaacuauugagagaaa

SEQ ID NO: 17671 - RNA, 19 nt, Homo sapiens
ucugauaugucuugaacua

SEQ ID NO: 17672 - RNA, 19 nt, Homo sapiens
caaauacccaugcuugaaa

SEQ ID NO: 17673 - RNA, 19 nt, Homo sapiens
auaaaggucucauaugaug

SEQ ID NO: 17674 - RNA, 19 nt, Homo sapiens
gaaugggaaagcagacuua

SEQ ID NO: 17675 - RNA, 19 nt, Homo sapiens
gcaguuaccguguauacaa

SEQ ID NO: 17676 - RNA, 19 nt, Homo sapiens
ugaggaagauuaaugaaag

SEQ ID NO: 17677 - RNA, 19 nt, Homo sapiens
ggacaguugugacaguaau

SEQ ID NO: 17678 - RNA, 19 nt, Homo sapiens
ggaaauugucggucauauu

SEQ ID NO: 17679 - RNA, 19 nt, Homo sapiens
gaagcuagaacuauugaga

SEQ ID NO: 17680 - RNA, 19 nt, Homo sapiens
gccaaucaguuagaauuaa

SEQ ID NO: 17681 - RNA, 19 nt, Homo sapiens
caacagaaagagaagauga

SEQ ID NO: 17682 - RNA, 19 nt, Homo sapiens
gaaaucaucugacacaauu

SEQ ID NO: 17683 - RNA, 19 nt, Homo sapiens
gcaacaaucugguucauuu

SEQ ID NO: 17684 - RNA, 19 nt, Homo sapiens
gcacagauguucaaacuau

SEQ ID NO: 17685 - RNA, 19 nt, Homo sapiens
caaugcagauccuauauua

SEQ ID NO: 17686 - RNA, 19 nt, Homo sapiens
gggaauaccugcuuugauu

SEQ ID NO: 17687 - RNA, 19 nt, Homo sapiens
gggagacaguguuaaauua

SEQ ID NO: 17688 - RNA, 19 nt, Homo sapiens
gaaauaagaccaaagaaug

SEQ ID NO: 17689 - RNA, 19 nt, Homo sapiens
gauaaugaguguccuauug

SEQ ID NO: 17690 - RNA, 19 nt, Homo sapiens
ccaaguagaugucaacaaa

SEQ ID NO: 17691 - RNA, 19 nt, Homo sapiens
gaagagggcagauuaguuu

SEQ ID NO: 17692 - RNA, 19 nt, Homo sapiens
gaagggaaauacaaagaaa

SEQ ID NO: 17693 - RNA, 19 nt, Homo sapiens
gaacuuauuuccuagauag

SEQ ID NO: 17694 - RNA, 19 nt, Homo sapiens
gcaaugagugcauauaaua

SEQ ID NO: 17695 - RNA, 19 nt, Homo sapiens
ggacgaagguuuuaauaua

SEQ ID NO: 17696 - RNA, 19 nt, Homo sapiens
gagaacauauucagcuuaa

SEQ ID NO: 17697 - RNA, 19 nt, Homo sapiens
guagaaugcuucauacuug

SEQ ID NO: 17698 - RNA, 19 nt, Homo sapiens
ugacagagcuagaaacaga

SEQ ID NO: 17699 - RNA, 19 nt, Homo sapiens
ggagauugcccaccuguua

SEQ ID NO: 17700 - RNA, 19 nt, Homo sapiens
gagauuggaugauugacua

SEQ ID NO: 17701 - RNA, 19 nt, Homo sapiens
ggagaaacauuuaauagag

SEQ ID NO: 17702 - RNA, 19 nt, Homo sapiens
ugaccuugcuuuagaaaua

SEQ ID NO: 17703 - RNA, 19 nt, Homo sapiens
gcaaggucaucauauguaa

SEQ ID NO: 17704 - RNA, 19 nt, Homo sapiens
guagaagccaggaauauua

SEQ ID NO: 17705 - RNA, 19 nt, Homo sapiens
ccagauagaucgaaacaug

SEQ ID NO: 17706 - RNA, 19 nt, Homo sapiens
cuauaaaggucucauauga

SEQ ID NO: 17707 - RNA, 19 nt, Homo sapiens
gcaaggaagugccucaaau

SEQ ID NO: 17708 - RNA, 19 nt, Homo sapiens
gugaagaucuggacaaugu

SEQ ID NO: 17709 - RNA, 19 nt, Homo sapiens
guacagagguagauuucaa

SEQ ID NO: 17710 - RNA, 19 nt, Homo sapiens
ugaagcagaucccacguua

SEQ ID NO: 17711 - RNA, 19 nt, Homo sapiens
gcagauuaguuuaccgaua

SEQ ID NO: 17712 - RNA, 19 nt, Homo sapiens
gaagaaugcuguaauuggu

SEQ ID NO: 17713 - RNA, 19 nt, Homo sapiens
ggaauggaauguuauuugu

SEQ ID NO: 17714 - RNA, 19 nt, Homo sapiens
gaaaguauaccuggaauga

SEQ ID NO: 17715 - RNA, 19 nt, Homo sapiens
cuugaaagcucguguaauu

SEQ ID NO: 17716 - RNA, 19 nt, Homo sapiens
acacaagccuggucaauug

SEQ ID NO: 17717 - RNA, 19 nt, Homo sapiens
gaaugugccuauaaucuug

SEQ ID NO: 17718 - RNA, 19 nt, Homo sapiens
gaaaguaguggcaagaauu

SEQ ID NO: 17719 - RNA, 19 nt, Homo sapiens
gcaaagcauuaggaaauuu

SEQ ID NO: 17720 - RNA, 19 nt, Homo sapiens
gaacauauucagcuuaaug

SEQ ID NO: 17721 - RNA, 19 nt, Homo sapiens
ccuauaaucuugugaauuc

SEQ ID NO: 17722 - RNA, 19 nt, Homo sapiens
ugaaagcucguguaauuua

SEQ ID NO: 17723 - RNA, 19 nt, Homo sapiens
gaaaggacuuccagaacug

SEQ ID NO: 17724 - RNA, 19 nt, Homo sapiens
caacuacaaucuugcuaaa

SEQ ID NO: 17725 - RNA, 19 nt, Homo sapiens
acaagucgcuguuggaauu

SEQ ID NO: 17726 - RNA, 19 nt, Homo sapiens
aaacacaggugaaguuaau

SEQ ID NO: 17727 - RNA, 19 nt, Homo sapiens
aagaggcuaugaugaauua

SEQ ID NO: 17728 - RNA, 19 nt, Homo sapiens
guaaauggauccaggaaca

SEQ ID NO: 17729 - RNA, 19 nt, Homo sapiens
gaaucaggcuacaacauga

SEQ ID NO: 17730 - RNA, 19 nt, Homo sapiens
gaugagaauucaaucaaug

SEQ ID NO: 17731 - RNA, 19 nt, Homo sapiens
ugauucaucugccaaauaa

SEQ ID NO: 17732 - RNA, 19 nt, Homo sapiens
ggucauauuucuagaacuu

SEQ ID NO: 17733 - RNA, 19 nt, Homo sapiens
gcaacccaauuuauaugua

SEQ ID NO: 17734 - RNA, 19 nt, Homo sapiens
agagguagauuucaauuug

SEQ ID NO: 17735 - RNA, 19 nt, Homo sapiens
acaaagcgguugagcaauu

SEQ ID NO: 17736 - RNA, 19 nt, Homo sapiens
gagcacagauguucaaacu

SEQ ID NO: 17737 - RNA, 19 nt, Homo sapiens
gaaguuuccaucuacaaua

SEQ ID NO: 17738 - RNA, 19 nt, Homo sapiens
guaaaugguugcaggcuau

SEQ ID NO: 17739 - RNA, 19 nt, Homo sapiens
gaagaacgguuuuacacua

SEQ ID NO: 17740 - RNA, 19 nt, Homo sapiens
cagauuaguuuaccgauau

SEQ ID NO: 17741 - RNA, 19 nt, Homo sapiens
gagaagcaucgacucauua

SEQ ID NO: 17742 - RNA, 19 nt, Homo sapiens
ugagagaaccauuaguuua

SEQ ID NO: 17743 - RNA, 19 nt, Homo sapiens
gagaugauccucuucgaaa

SEQ ID NO: 17744 - RNA, 19 nt, Homo sapiens
aguaaucgcugacaguuaa

SEQ ID NO: 17745 - RNA, 19 nt, Homo sapiens
ggauaugaauucaguagau

SEQ ID NO: 17746 - RNA, 19 nt, Homo sapiens
aaaccuacauugacaaguu

SEQ ID NO: 17747 - RNA, 19 nt, Homo sapiens
ucacaaacguggcauauac

SEQ ID NO: 17748 - RNA, 19 nt, Homo sapiens
gcacauggauggauaaaau

SEQ ID NO: 17749 - RNA, 19 nt, Homo sapiens
gcagaaauaagaccaaaga

SEQ ID NO: 17750 - RNA, 19 nt, Homo sapiens
gagagaaccauuaguuuau

SEQ ID NO: 17751 - RNA, 19 nt, Homo sapiens
acaguaaucugaccacuau

SEQ ID NO: 17752 - RNA, 19 nt, Homo sapiens
gcacaugcccuguuuaugg

SEQ ID NO: 17753 - RNA, 19 nt, Homo sapiens
ucacguagcugaguacaug

SEQ ID NO: 17754 - RNA, 19 nt, Homo sapiens
gauccaaaccaacaccuua

SEQ ID NO: 17755 - RNA, 19 nt, Homo sapiens
gaaaagcaguuaccgugua

SEQ ID NO: 17756 - RNA, 19 nt, Homo sapiens
gaaauugugggccugagua

SEQ ID NO: 17757 - RNA, 19 nt, Homo sapiens
caaaagggcccaaugaaua

SEQ ID NO: 17758 - RNA, 19 nt, Homo sapiens
gauaugaacauugcacuaa

SEQ ID NO: 17759 - RNA, 19 nt, Homo sapiens
gccuagaaauccauaguuu

SEQ ID NO: 17760 - RNA, 19 nt, Homo sapiens
gcuaaagguuucaauuauc

SEQ ID NO: 17761 - RNA, 19 nt, Homo sapiens
gaucagccauuguuugaag

SEQ ID NO: 17762 - RNA, 19 nt, Homo sapiens
ggugguggcugcaguguau

SEQ ID NO: 17763 - RNA, 19 nt, Homo sapiens
ggcauggucucauuccuaa

SEQ ID NO: 17764 - RNA, 19 nt, Homo sapiens
gcaauguuguguuucucua

SEQ ID NO: 17765 - RNA, 19 nt, Homo sapiens
ggucagcccuuaaauaugc

SEQ ID NO: 17766 - RNA, 19 nt, Homo sapiens
acaauucaguccucacuuu

SEQ ID NO: 17767 - RNA, 19 nt, Homo sapiens
ugagcagacuaaucucuua

SEQ ID NO: 17768 - RNA, 19 nt, Homo sapiens
caaagcgguugagcaauuu

SEQ ID NO: 17769 - RNA, 19 nt, Homo sapiens
gauauuguguugcacuaga

SEQ ID NO: 17770 - RNA, 19 nt, Homo sapiens
cuagaacuauugagagaaa

SEQ ID NO: 17771 - RNA, 19 nt, Homo sapiens
ucugauaugucuugaacua

SEQ ID NO: 17772 - RNA, 19 nt, Homo sapiens
caaauacccaugcuugaaa

SEQ ID NO: 17773 - RNA, 19 nt, Homo sapiens
auaaaggucucauaugaug

SEQ ID NO: 17774 - RNA, 19 nt, Homo sapiens
gaaugggaaagcagacuua

SEQ ID NO: 17775 - RNA, 19 nt, Homo sapiens
gcaguuaccguguauacaa

SEQ ID NO: 17776 - RNA, 19 nt, Homo sapiens
ugaggaagauuaaugaaag

SEQ ID NO: 17777 - RNA, 19 nt, Homo sapiens
ggacaguugugacaguaau

SEQ ID NO: 17778 - RNA, 19 nt, Homo sapiens
ggaaauugucggucauauu

SEQ ID NO: 17779 - RNA, 19 nt, Homo sapiens
gaagcuagaacuauugaga

SEQ ID NO: 17780 - RNA, 19 nt, Homo sapiens
gccaaucaguuagaauuaa

SEQ ID NO: 17781 - RNA, 19 nt, Homo sapiens
caacagaaagagaagauga

SEQ ID NO: 17782 - RNA, 19 nt, Homo sapiens
gaaaucaucugacacaauu

SEQ ID NO: 17783 - RNA, 19 nt, Homo sapiens
gcaacaaucugguucauuu

SEQ ID NO: 17784 - RNA, 19 nt, Homo sapiens
gcacagauguucaaacuau

SEQ ID NO: 17785 - RNA, 19 nt, Homo sapiens
caaugcagauccuauauua

SEQ ID NO: 17786 - RNA, 19 nt, Homo sapiens
gggaauaccugcuuugauu

SEQ ID NO: 17787 - RNA, 19 nt, Homo sapiens
gggagacaguguuaaauua

SEQ ID NO: 17788 - RNA, 19 nt, Homo sapiens
gaaauaagaccaaagaaug

SEQ ID NO: 17789 - RNA, 19 nt, Homo sapiens
gauaaugaguguccuauug

SEQ ID NO: 17790 - RNA, 19 nt, Homo sapiens
ccaaguagaugucaacaaa

SEQ ID NO: 17791 - RNA, 19 nt, Homo sapiens
gcagacagcucuaugaugu

SEQ ID NO: 17792 - RNA, 19 nt, Homo sapiens
gaagagggcagauuaguuu

SEQ ID NO: 17793 - RNA, 19 nt, Homo sapiens
gaagggaaauacaaagaaa

SEQ ID NO: 17794 - RNA, 19 nt, Homo sapiens
gaacuuauuuccuagauag

SEQ ID NO: 17795 - RNA, 19 nt, Homo sapiens
gcaaugagugcauauaaua

SEQ ID NO: 17796 - RNA, 19 nt, Homo sapiens
ggacgaagguuuuaauaua

SEQ ID NO: 17797 - RNA, 19 nt, Homo sapiens
gagaacauauucagcuuaa

SEQ ID NO: 17798 - RNA, 19 nt, Homo sapiens
guagaaugcuucauacuug

SEQ ID NO: 17799 - RNA, 19 nt, Homo sapiens
ugacagagcuagaaacaga

SEQ ID NO: 17800 - RNA, 19 nt, Homo sapiens
gagauuggaugauugacua

SEQ ID NO: 17801 - RNA, 19 nt, Homo sapiens
ggagaaacauuuaauagag

SEQ ID NO: 17802 - RNA, 19 nt, Homo sapiens
ugaccuugcuuuagaaaua

SEQ ID NO: 17803 - RNA, 19 nt, Homo sapiens
gcaaggucaucauauguaa

SEQ ID NO: 17804 - RNA, 19 nt, Homo sapiens
guagaagccaggaauauua

SEQ ID NO: 17805 - RNA, 19 nt, Homo sapiens
ccagauagaucgaaacaug

SEQ ID NO: 17806 - RNA, 19 nt, Homo sapiens
cuauaaaggucucauauga

SEQ ID NO: 17807 - RNA, 19 nt, Homo sapiens
gcaaggaagugccucaaau

SEQ ID NO: 17808 - RNA, 19 nt, Homo sapiens
gugaagaucuggacaaugu

SEQ ID NO: 17809 - RNA, 19 nt, Homo sapiens
guacagagguagauuucaa

SEQ ID NO: 17810 - RNA, 19 nt, Homo sapiens
ugaagcagaucccacguua

SEQ ID NO: 17811 - RNA, 19 nt, Homo sapiens
gcagauuaguuuaccgaua

SEQ ID NO: 17812 - RNA, 19 nt, Homo sapiens
gaagaaugcuguaauuggu

SEQ ID NO: 17813 - RNA, 19 nt, Homo sapiens
ggaauggaauguuauuugu

SEQ ID NO: 17814 - RNA, 19 nt, Homo sapiens
gaaaguauaccuggaauga

SEQ ID NO: 17815 - RNA, 19 nt, Homo sapiens
cuugaaagcucguguaauu

SEQ ID NO: 17816 - RNA, 19 nt, Homo sapiens
acacaagccuggucaauug

SEQ ID NO: 17817 - RNA, 19 nt, Homo sapiens
gaaugugccuauaaucuug

SEQ ID NO: 17818 - RNA, 19 nt, Homo sapiens
gaaaguaguggcaagaauu

SEQ ID NO: 17819 - RNA, 19 nt, Homo sapiens
gcaaagcauuaggaaauuu

SEQ ID NO: 17820 - RNA, 19 nt, Homo sapiens
gaacauauucagcuuaaug

SEQ ID NO: 17821 - RNA, 19 nt, Homo sapiens
ccuauaaucuugugaauuc

SEQ ID NO: 17822 - RNA, 19 nt, Homo sapiens
ugaaagcucguguaauuua

SEQ ID NO: 17823 - RNA, 19 nt, Homo sapiens
gaaaggacuuccagaacug

SEQ ID NO: 17824 - RNA, 19 nt, Homo sapiens
caacuacaaucuugcuaaa

SEQ ID NO: 17825 - RNA, 19 nt, Homo sapiens
acaagucgcuguuggaauu

SEQ ID NO: 17826 - RNA, 19 nt, Homo sapiens
aaacacaggugaaguuaau

SEQ ID NO: 17827 - RNA, 19 nt, Homo sapiens
aagaggcuaugaugaauua

SEQ ID NO: 17828 - RNA, 19 nt, Homo sapiens
guaaauggauccaggaaca

SEQ ID NO: 17829 - RNA, 19 nt, Homo sapiens
gaaucaggcuacaacauga

SEQ ID NO: 17830 - RNA, 19 nt, Homo sapiens
gaugagaauucaaucaaug

SEQ ID NO: 17831 - RNA, 19 nt, Homo sapiens
ugauucaucugccaaauaa

SEQ ID NO: 17832 - RNA, 19 nt, Homo sapiens
ggucauauuucuagaacuu

SEQ ID NO: 17833 - RNA, 19 nt, Homo sapiens
gcaacccaauuuauaugua

SEQ ID NO: 17834 - RNA, 19 nt, Homo sapiens
agagguagauuucaauuug

SEQ ID NO: 17835 - RNA, 19 nt, Homo sapiens
acaaagcgguugagcaauu

SEQ ID NO: 17836 - RNA, 19 nt, Homo sapiens
gaauaggaauguacguuuc

SEQ ID NO: 17837 - RNA, 19 nt, Homo sapiens
gagcacagauguucaaacu

SEQ ID NO: 17838 - RNA, 19 nt, Homo sapiens
gaaguuuccaucuacaaua

SEQ ID NO: 17839 - RNA, 19 nt, Homo sapiens
guaaaugguugcaggcuau

SEQ ID NO: 17840 - RNA, 19 nt, Homo sapiens
gaagaacgguuuuacacua

SEQ ID NO: 17841 - RNA, 19 nt, Homo sapiens
cagauuaguuuaccgauau

SEQ ID NO: 17842 - RNA, 19 nt, Homo sapiens
gagaagcaucgacucauua

SEQ ID NO: 17843 - RNA, 19 nt, Homo sapiens
ugagagaaccauuaguuua

SEQ ID NO: 17844 - RNA, 19 nt, Homo sapiens
gagaugauccucuucgaaa

SEQ ID NO: 17845 - RNA, 19 nt, Homo sapiens
aguaaucgcugacaguuaa

SEQ ID NO: 17846 - RNA, 19 nt, Homo sapiens
ggauaugaauucaguagau

SEQ ID NO: 17847 - RNA, 19 nt, Homo sapiens
aaaccuacauugacaaguu

SEQ ID NO: 17848 - RNA, 19 nt, Homo sapiens
ucacaaacguggcauauac

SEQ ID NO: 17849 - RNA, 19 nt, Homo sapiens
gcacauggauggauaaaau

SEQ ID NO: 17850 - RNA, 19 nt, Homo sapiens
gcagaaauaagaccaaaga

SEQ ID NO: 17851 - RNA, 19 nt, Homo sapiens
gagagaaccauuaguuuau

SEQ ID NO: 17852 - RNA, 19 nt, Homo sapiens
acaguaaucugaccacuau

SEQ ID NO: 17853 - RNA, 19 nt, Homo sapiens
gcacaugcccuguuuaugg

SEQ ID NO: 17854 - RNA, 19 nt, Homo sapiens
ucacguagcugaguacaug

SEQ ID NO: 17855 - RNA, 19 nt, Homo sapiens
gauccaaaccaacaccuua

SEQ ID NO: 17856 - RNA, 19 nt, Homo sapiens
gaaaagcaguuaccgugua

SEQ ID NO: 17857 - RNA, 19 nt, Homo sapiens
gaaauugugggccugagua

SEQ ID NO: 17858 - RNA, 19 nt, Homo sapiens
caaaagggcccaaugaaua

SEQ ID NO: 17859 - RNA, 19 nt, Homo sapiens
gauaugaacauugcacuaa

SEQ ID NO: 17860 - RNA, 19 nt, Homo sapiens
ccaaguugcuaugugaaua

SEQ ID NO: 17861 - RNA, 19 nt, Homo sapiens
gcucuaugauguuuacuau

SEQ ID NO: 17862 - RNA, 19 nt, Homo sapiens
gccuagaaauccauaguuu

SEQ ID NO: 17863 - RNA, 19 nt, Homo sapiens
gcuaaagguuucaauuauc

SEQ ID NO: 17864 - RNA, 19 nt, Homo sapiens
gaucagccauuguuugaag

SEQ ID NO: 17865 - RNA, 19 nt, Homo sapiens
ggugguggcugcaguguau

SEQ ID NO: 17866 - RNA, 19 nt, Homo sapiens
ggcauggucucauuccuaa

SEQ ID NO: 17867 - RNA, 19 nt, Homo sapiens
gcaauguuguguuucucua

SEQ ID NO: 17868 - RNA, 19 nt, Homo sapiens
ggucagcccuuaaauaugc

SEQ ID NO: 17869 - RNA, 19 nt, Homo sapiens
acaauucaguccucacuuu

SEQ ID NO: 17870 - RNA, 19 nt, Homo sapiens
caaagcgguugagcaauuu

SEQ ID NO: 17871 - RNA, 19 nt, Homo sapiens
gauauuguguugcacuaga

SEQ ID NO: 17872 - RNA, 19 nt, Homo sapiens
ggaaggagaaagagacauu

SEQ ID NO: 17873 - RNA, 19 nt, Homo sapiens
cuagaacuauugagagaaa

SEQ ID NO: 17874 - RNA, 19 nt, Homo sapiens
ucugauaugucuugaacua

SEQ ID NO: 17875 - RNA, 19 nt, Homo sapiens
caaauacccaugcuugaaa

SEQ ID NO: 17876 - RNA, 19 nt, Homo sapiens
auaaaggucucauaugaug

SEQ ID NO: 17877 - RNA, 19 nt, Homo sapiens
gaaugggaaagcagacuua

SEQ ID NO: 17878 - RNA, 19 nt, Homo sapiens
gcaguuaccguguauacaa

SEQ ID NO: 17879 - RNA, 19 nt, Homo sapiens
ugaggaagauuaaugaaag

SEQ ID NO: 17880 - RNA, 19 nt, Homo sapiens
ggacaguugugacaguaau

SEQ ID NO: 17881 - RNA, 19 nt, Homo sapiens
ggaaauugucggucauauu

SEQ ID NO: 17882 - RNA, 19 nt, Homo sapiens
gaaaucaucugacacaauu

SEQ ID NO: 17883 - RNA, 19 nt, Homo sapiens
gcaacaaucugguucauuu

SEQ ID NO: 17884 - RNA, 19 nt, Homo sapiens
gcacagauguucaaacuau

SEQ ID NO: 17885 - RNA, 19 nt, Homo sapiens
caaugcagauccuauauua

SEQ ID NO: 17886 - RNA, 19 nt, Homo sapiens
gggaauaccugcuuugauu

SEQ ID NO: 17887 - RNA, 19 nt, Homo sapiens
gggagacaguguuaaauua

SEQ ID NO: 17888 - RNA, 19 nt, Homo sapiens
gaaauaagaccaaagaaug

SEQ ID NO: 17889 - RNA, 19 nt, Homo sapiens
gauaaugaguguccuauug

SEQ ID NO: 17890 - RNA, 19 nt, Homo sapiens
ccaaguagaugucaacaaa

SEQ ID NO: 17891 - RNA, 19 nt, Homo sapiens
gaagagggcagauuaguuu

SEQ ID NO: 17892 - RNA, 19 nt, Homo sapiens
gaagggaaauacaaagaaa

SEQ ID NO: 17893 - RNA, 19 nt, Homo sapiens
gaacuuauuuccuagauag

SEQ ID NO: 17894 - RNA, 19 nt, Homo sapiens
gcaaugagugcauauaaua

SEQ ID NO: 17895 - RNA, 19 nt, Homo sapiens
ggacgaagguuuuaauaua

SEQ ID NO: 17896 - RNA, 19 nt, Homo sapiens
gagaacauauucagcuuaa

SEQ ID NO: 17897 - RNA, 19 nt, Homo sapiens
guagaaugcuucauacuug

SEQ ID NO: 17898 - RNA, 19 nt, Homo sapiens
ugacagagcuagaaacaga

SEQ ID NO: 17899 - RNA, 19 nt, Homo sapiens
gagauuggaugauugacua

SEQ ID NO: 17900 - RNA, 19 nt, Homo sapiens
ggagaaacauuuaauagag

SEQ ID NO: 17901 - RNA, 19 nt, Homo sapiens
ugaccuugcuuuagaaaua

SEQ ID NO: 17902 - RNA, 19 nt, Homo sapiens
gcaaggucaucauauguaa

SEQ ID NO: 17903 - RNA, 19 nt, Homo sapiens
guagaagccaggaauauua

SEQ ID NO: 17904 - RNA, 19 nt, Homo sapiens
ccagauagaucgaaacaug

SEQ ID NO: 17905 - RNA, 19 nt, Homo sapiens
cuauaaaggucucauauga

SEQ ID NO: 17906 - RNA, 19 nt, Homo sapiens
gcaaggaagugccucaaau

SEQ ID NO: 17907 - RNA, 19 nt, Homo sapiens
gugaagaucuggacaaugu

SEQ ID NO: 17908 - RNA, 19 nt, Homo sapiens
guacagagguagauuucaa

SEQ ID NO: 17909 - RNA, 19 nt, Homo sapiens
ugaagcagaucccacguua

SEQ ID NO: 17910 - RNA, 19 nt, Homo sapiens
gcagauuaguuuaccgaua

SEQ ID NO: 17911 - RNA, 19 nt, Homo sapiens
gaagaaugcuguaauuggu

SEQ ID NO: 17912 - RNA, 19 nt, Homo sapiens
ggaauggaauguuauuugu

SEQ ID NO: 17913 - RNA, 19 nt, Homo sapiens
gaaaguauaccuggaauga

SEQ ID NO: 17914 - RNA, 19 nt, Homo sapiens
cuugaaagcucguguaauu

SEQ ID NO: 17915 - RNA, 19 nt, Homo sapiens
acacaagccuggucaauug

SEQ ID NO: 17916 - RNA, 19 nt, Homo sapiens
gaaugugccuauaaucuug

SEQ ID NO: 17917 - RNA, 19 nt, Homo sapiens
gaaaguaguggcaagaauu

SEQ ID NO: 17918 - RNA, 19 nt, Homo sapiens
gcaaagcauuaggaaauuu

SEQ ID NO: 17919 - RNA, 19 nt, Homo sapiens
gaacauauucagcuuaaug

SEQ ID NO: 17920 - RNA, 19 nt, Homo sapiens
ccuauaaucuugugaauuc

SEQ ID NO: 17921 - RNA, 19 nt, Homo sapiens
ugaaagcucguguaauuua

SEQ ID NO: 17922 - RNA, 19 nt, Homo sapiens
gaaaggacuuccagaacug

SEQ ID NO: 17923 - RNA, 19 nt, Homo sapiens
caacuacaaucuugcuaaa

SEQ ID NO: 17924 - RNA, 19 nt, Homo sapiens
acaagucgcuguuggaauu

SEQ ID NO: 17925 - RNA, 19 nt, Homo sapiens
aaacacaggugaaguuaau

SEQ ID NO: 17926 - RNA, 19 nt, Homo sapiens
aagaggcuaugaugaauua

SEQ ID NO: 17927 - RNA, 19 nt, Homo sapiens
guaaauggauccaggaaca

SEQ ID NO: 17928 - RNA, 19 nt, Homo sapiens
gaaucaggcuacaacauga

SEQ ID NO: 17929 - RNA, 19 nt, Homo sapiens
gaugagaauucaaucaaug

SEQ ID NO: 17930 - RNA, 19 nt, Homo sapiens
ugauucaucugccaaauaa

SEQ ID NO: 17931 - RNA, 19 nt, Homo sapiens
gaaacugggucucacuaug

SEQ ID NO: 17932 - RNA, 19 nt, Homo sapiens
ggucauauuucuagaacuu

SEQ ID NO: 17933 - RNA, 19 nt, Homo sapiens
gcaacccaauuuauaugua

SEQ ID NO: 17934 - RNA, 19 nt, Homo sapiens
agagguagauuucaauuug

SEQ ID NO: 17935 - RNA, 19 nt, Homo sapiens
acaaagcgguugagcaauu

SEQ ID NO: 17936 - RNA, 19 nt, Homo sapiens
gagcacagauguucaaacu

SEQ ID NO: 17937 - RNA, 19 nt, Homo sapiens
gaaguuuccaucuacaaua

SEQ ID NO: 17938 - RNA, 19 nt, Homo sapiens
guaaaugguugcaggcuau

SEQ ID NO: 17939 - RNA, 19 nt, Homo sapiens
gaagaacgguuuuacacua

SEQ ID NO: 17940 - RNA, 19 nt, Homo sapiens
cagauuaguuuaccgauau

SEQ ID NO: 17941 - RNA, 19 nt, Homo sapiens
gagaagcaucgacucauua

SEQ ID NO: 17942 - RNA, 19 nt, Homo sapiens
ugagagaaccauuaguuua

SEQ ID NO: 17943 - RNA, 19 nt, Homo sapiens
gagaugauccucuucgaaa

SEQ ID NO: 17944 - RNA, 19 nt, Homo sapiens
aguaaucgcugacaguuaa

SEQ ID NO: 17945 - RNA, 19 nt, Homo sapiens
ggauaugaauucaguagau

SEQ ID NO: 17946 - RNA, 19 nt, Homo sapiens
aaaccuacauugacaaguu

SEQ ID NO: 17947 - RNA, 19 nt, Homo sapiens
ucacaaacguggcauauac

SEQ ID NO: 17948 - RNA, 19 nt, Homo sapiens
gcacauggauggauaaaau

SEQ ID NO: 17949 - RNA, 19 nt, Homo sapiens
gcagaaauaagaccaaaga

SEQ ID NO: 17950 - RNA, 19 nt, Homo sapiens
gagagaaccauuaguuuau

SEQ ID NO: 17951 - RNA, 19 nt, Homo sapiens
acaguaaucugaccacuau

SEQ ID NO: 17952 - RNA, 19 nt, Homo sapiens
gcacaugcccuguuuaugg

SEQ ID NO: 17953 - RNA, 19 nt, Homo sapiens
ucacguagcugaguacaug

SEQ ID NO: 17954 - RNA, 19 nt, Homo sapiens
gauccaaaccaacaccuua

SEQ ID NO: 17955 - RNA, 19 nt, Homo sapiens
gaaaagcaguuaccgugua

SEQ ID NO: 17956 - RNA, 19 nt, Homo sapiens
gaaauugugggccugagua

SEQ ID NO: 17957 - RNA, 19 nt, Homo sapiens
caaaagggcccaaugaaua

SEQ ID NO: 17958 - RNA, 19 nt, Homo sapiens
gauaugaacauugcacuaa

SEQ ID NO: 17959 - RNA, 19 nt, Homo sapiens
gccuagaaauccauaguuu

SEQ ID NO: 17960 - RNA, 19 nt, Homo sapiens
gcuaaagguuucaauuauc

SEQ ID NO: 17961 - RNA, 19 nt, Homo sapiens
gaucagccauuguuugaag

SEQ ID NO: 17962 - RNA, 19 nt, Homo sapiens
ggugguggcugcaguguau

SEQ ID NO: 17963 - RNA, 19 nt, Homo sapiens
ggcauggucucauuccuaa

SEQ ID NO: 17964 - RNA, 19 nt, Homo sapiens
gcaauguuguguuucucua

SEQ ID NO: 17965 - RNA, 19 nt, Homo sapiens
ggucagcccuuaaauaugc

SEQ ID NO: 17966 - RNA, 19 nt, Homo sapiens
acaauucaguccucacuuu

SEQ ID NO: 17967 - RNA, 19 nt, Homo sapiens
caaagcgguugagcaauuu

SEQ ID NO: 17968 - RNA, 19 nt, Homo sapiens
gauauuguguugcacuaga

SEQ ID NO: 17969 - RNA, 19 nt, Homo sapiens
cuagaacuauugagagaaa

SEQ ID NO: 17970 - RNA, 19 nt, Homo sapiens
ucugauaugucuugaacua

SEQ ID NO: 17971 - RNA, 19 nt, Homo sapiens
caaauacccaugcuugaaa

SEQ ID NO: 17972 - RNA, 19 nt, Homo sapiens
auaaaggucucauaugaug

SEQ ID NO: 17973 - RNA, 19 nt, Homo sapiens
gaaugggaaagcagacuua

SEQ ID NO: 17974 - RNA, 19 nt, Homo sapiens
gcaguuaccguguauacaa

SEQ ID NO: 17975 - RNA, 19 nt, Homo sapiens
gaaaguacugggauuacaa

SEQ ID NO: 17976 - RNA, 19 nt, Homo sapiens
ugaggaagauuaaugaaag

SEQ ID NO: 17977 - RNA, 19 nt, Homo sapiens
ggacaguugugacaguaau

SEQ ID NO: 17978 - RNA, 19 nt, Homo sapiens
ggaaauugucggucauauu

SEQ ID NO: 17979 - RNA, 19 nt, Homo sapiens
gaagcuagaacuauugaga

SEQ ID NO: 17980 - RNA, 19 nt, Homo sapiens
gccaaucaguuagaauuaa

SEQ ID NO: 17981 - RNA, 19 nt, Homo sapiens
caacagaaagagaagauga

SEQ ID NO: 17982 - RNA, 19 nt, Homo sapiens
gauaggcacuccucuugua

SEQ ID NO: 17983 - RNA, 19 nt, Homo sapiens
caaggaaacucgaauaaag

SEQ ID NO: 17984 - RNA, 19 nt, Homo sapiens
gaagacaacugcagaacag

SEQ ID NO: 17985 - RNA, 19 nt, Homo sapiens
gcaccuagcuggccaacgu

SEQ ID NO: 17986 - RNA, 19 nt, Homo sapiens
gcacuccucuuguagaaca

SEQ ID NO: 17987 - RNA, 19 nt, Homo sapiens
gcaaggaaacucgaauaaa

SEQ ID NO: 17988 - RNA, 19 nt, Homo sapiens
gagauaggcacuccucuug

SEQ ID NO: 17989 - RNA, 19 nt, Homo sapiens
gaagaagacaacugcagaa

SEQ ID NO: 17990 - RNA, 19 nt, Homo sapiens
ggaacucucuaggcaagaa

SEQ ID NO: 17991 - RNA, 19 nt, Homo sapiens
gggcaaggaaacucgaaua

SEQ ID NO: 17992 - RNA, 19 nt, Homo sapiens
auuaggcccugccauauaa

SEQ ID NO: 17993 - RNA, 19 nt, Homo sapiens
ggcaaggaaacucgaauaa

SEQ ID NO: 17994 - RNA, 19 nt, Homo sapiens
cauuaggcccugccauaua

SEQ ID NO: 17995 - RNA, 19 nt, Homo sapiens
uaaaggaugggaccaacaa

SEQ ID NO: 17996 - RNA, 19 nt, Homo sapiens
gaauaaaggaugggaccaa

SEQ ID NO: 17997 - RNA, 19 nt, Homo sapiens
ggagugagggccugaacug

SEQ ID NO: 17998 - RNA, 19 nt, Homo sapiens
gcuggguacugccaugaau

SEQ ID NO: 17999 - RNA, 19 nt, Homo sapiens
ggaaaccucaccccaaauu

SEQ ID NO: 18000 - RNA, 19 nt, Homo sapiens
uuaaucggcuccuggaaac

SEQ ID NO: 18001 - RNA, 19 nt, Homo sapiens
aggcacuccucuuguagaa

SEQ ID NO: 18002 - RNA, 19 nt, Homo sapiens
cacguguggcccuucauua

SEQ ID NO: 18003 - RNA, 19 nt, Homo sapiens
ccuguccuguggaaauuug

SEQ ID NO: 18004 - RNA, 19 nt, Homo sapiens
ggccuuggcagagguacua

SEQ ID NO: 18005 - RNA, 19 nt, Homo sapiens
ucacguguggcccuucauu

SEQ ID NO: 18006 - RNA, 19 nt, Homo sapiens
uuuaaucggcuccuggaaa

SEQ ID NO: 18007 - RNA, 19 nt, Homo sapiens
cuacugccgcuucuucaau

SEQ ID NO: 18008 - RNA, 19 nt, Homo sapiens
uacugccgcuucuucaaug

SEQ ID NO: 18009 - RNA, 19 nt, Homo sapiens
ccacugaagaagacaacug

SEQ ID NO: 18010 - RNA, 19 nt, Homo sapiens
ucauuaggcccugccauau

SEQ ID NO: 18011 - RNA, 19 nt, Homo sapiens
uucauuaggcccugccaua

SEQ ID NO: 18012 - RNA, 19 nt, Homo sapiens
caaggaaacucgaauaaag

SEQ ID NO: 18013 - RNA, 19 nt, Homo sapiens
gaagacaacugcagaacag

SEQ ID NO: 18014 - RNA, 19 nt, Homo sapiens
gcaccuagcuggccaacgu

SEQ ID NO: 18015 - RNA, 19 nt, Homo sapiens
gcaaggaaacucgaauaaa

SEQ ID NO: 18016 - RNA, 19 nt, Homo sapiens
gaagaagacaacugcagaa

SEQ ID NO: 18017 - RNA, 19 nt, Homo sapiens
gggcaaggaaacucgaaua

SEQ ID NO: 18018 - RNA, 19 nt, Homo sapiens
ggcaaggaaacucgaauaa

SEQ ID NO: 18019 - RNA, 19 nt, Homo sapiens
uaaaggaugggaccaacaa

SEQ ID NO: 18020 - RNA, 19 nt, Homo sapiens
gaauaaaggaugggaccaa

SEQ ID NO: 18021 - RNA, 19 nt, Homo sapiens
gcuggguacugccaugaau

SEQ ID NO: 18022 - RNA, 19 nt, Homo sapiens
ggccuuggcagagguacua

SEQ ID NO: 18023 - RNA, 19 nt, Homo sapiens
cuacugccgcuucuucaau

SEQ ID NO: 18024 - RNA, 19 nt, Homo sapiens
ccacugaagaagacaacug

SEQ ID NO: 18025 - RNA, 19 nt, Homo sapiens
uacugccgcuucuucaaug

SEQ ID NO: 18026 - RNA, 19 nt, Homo sapiens
ggaaaucacugacaaaaua

SEQ ID NO: 18027 - RNA, 19 nt, Homo sapiens
gaacaucacauuuaccuuu

SEQ ID NO: 18028 - RNA, 19 nt, Homo sapiens
gaagcgaucagaauaauaa

SEQ ID NO: 18029 - RNA, 19 nt, Homo sapiens
ggaacaaccuguaacauag

SEQ ID NO: 18030 - RNA, 19 nt, Homo sapiens
cgacaaggcugcaguccua

SEQ ID NO: 18031 - RNA, 19 nt, Homo sapiens
gaacucuucucauuacuug

SEQ ID NO: 18032 - RNA, 19 nt, Homo sapiens
cagcaacgaucacaaauga

SEQ ID NO: 18033 - RNA, 19 nt, Homo sapiens
caaagaagcgaucagaaua

SEQ ID NO: 18034 - RNA, 19 nt, Homo sapiens
gaacagaacagauuuccuu

SEQ ID NO: 18035 - RNA, 19 nt, Homo sapiens
ggaaaucaaagugcuauua

SEQ ID NO: 18036 - RNA, 19 nt, Homo sapiens
ggaacaaguugagcuauga

SEQ ID NO: 18037 - RNA, 19 nt, Homo sapiens
gggauuugguuaaugguua

SEQ ID NO: 18038 - RNA, 19 nt, Homo sapiens
acaaagaucucaauuacug

SEQ ID NO: 18039 - RNA, 19 nt, Homo sapiens
ugacaaagaucucaauuac

SEQ ID NO: 18040 - RNA, 19 nt, Homo sapiens
gaaucccuguguuaauuua

SEQ ID NO: 18041 - RNA, 19 nt, Homo sapiens
caaaugggaugaugacugu

SEQ ID NO: 18042 - RNA, 19 nt, Homo sapiens
ccaguuagaugcaaaugaa

SEQ ID NO: 18043 - RNA, 19 nt, Homo sapiens
aaacaccacuggauuaaug

SEQ ID NO: 18044 - RNA, 19 nt, Homo sapiens
ggacccaacugugaaauug

SEQ ID NO: 18045 - RNA, 19 nt, Homo sapiens
acaccaaucugacuuugua

SEQ ID NO: 18046 - RNA, 19 nt, Homo sapiens
ggaacauacugccaugaaa

SEQ ID NO: 18047 - RNA, 19 nt, Homo sapiens
caacaaaacuugcauggaa

SEQ ID NO: 18048 - RNA, 19 nt, Homo sapiens
ggaaagugcccagagcuua

SEQ ID NO: 18049 - RNA, 19 nt, Homo sapiens
uaacauagcccgaaacagu

SEQ ID NO: 18050 - RNA, 19 nt, Homo sapiens
gaacugcucacaccugaaa

SEQ ID NO: 18051 - RNA, 19 nt, Homo sapiens
ugaggcaguuugaggauua

SEQ ID NO: 18052 - RNA, 19 nt, Homo sapiens
gaaagugcccagagcuuaa

SEQ ID NO: 18053 - RNA, 19 nt, Homo sapiens
gaugacuguucuccuaaua

SEQ ID NO: 18054 - RNA, 19 nt, Homo sapiens
gaauguaacagagcuauuu

SEQ ID NO: 18055 - RNA, 19 nt, Homo sapiens
ccagaauacugauggaauu

SEQ ID NO: 18056 - RNA, 19 nt, Homo sapiens
gaauaaacaccacuggauu

SEQ ID NO: 18057 - RNA, 19 nt, Homo sapiens
cuucugagcuuacguaguu

SEQ ID NO: 18058 - RNA, 19 nt, Homo sapiens
uaauggugaugcagucuua

SEQ ID NO: 18059 - RNA, 19 nt, Homo sapiens
gaauacugcuugaauaaac

SEQ ID NO: 18060 - RNA, 19 nt, Homo sapiens
uaagcuaguugaauacuug

SEQ ID NO: 18061 - RNA, 19 nt, Homo sapiens
uagaaucccuguguuaauu

SEQ ID NO: 18062 - RNA, 19 nt, Homo sapiens
gacacacaauucugaagua

SEQ ID NO: 18063 - RNA, 19 nt, Homo sapiens
gaagaauguuuccgcugaa

SEQ ID NO: 18064 - RNA, 19 nt, Homo sapiens
ucaaugacuucuacuguga

SEQ ID NO: 18065 - RNA, 19 nt, Homo sapiens
ggaccugguuaacggauuu

SEQ ID NO: 18066 - RNA, 19 nt, Homo sapiens
ggcaaggccuguacuguga

SEQ ID NO: 18067 - RNA, 19 nt, Homo sapiens
gaugcagucuuagaucaua

SEQ ID NO: 18068 - RNA, 19 nt, Homo sapiens
ggacaaacaccagcagaaa

SEQ ID NO: 18069 - RNA, 19 nt, Homo sapiens
gcaccucugacuccuauua

SEQ ID NO: 18070 - RNA, 19 nt, Homo sapiens
gagcaacccuuguagaaac

SEQ ID NO: 18071 - RNA, 19 nt, Homo sapiens
guugaauacuugaaccaua

SEQ ID NO: 18072 - RNA, 19 nt, Homo sapiens
ggccaaaccuuguguaaac

SEQ ID NO: 18073 - RNA, 19 nt, Homo sapiens
gagagcaacccuuguagaa

SEQ ID NO: 18074 - RNA, 19 nt, Homo sapiens
aaaugugagugguugaaua

SEQ ID NO: 18075 - RNA, 19 nt, Homo sapiens
gaauggaguacaucguaua

SEQ ID NO: 18076 - RNA, 19 nt, Homo sapiens
ucaaggaaaucacugacaa

SEQ ID NO: 18077 - RNA, 19 nt, Homo sapiens
gaagauauacgggaugaug

SEQ ID NO: 18078 - RNA, 19 nt, Homo sapiens
ugaaauacauguggccauu

SEQ ID NO: 18079 - RNA, 19 nt, Homo sapiens
gagcacauuugcagugaau

SEQ ID NO: 18080 - RNA, 19 nt, Homo sapiens
aaagugcuauuacgaaguu

SEQ ID NO: 18081 - RNA, 19 nt, Homo sapiens
ggcagacgcugaagcagaa

SEQ ID NO: 18082 - RNA, 19 nt, Homo sapiens
gggagcagcugaaccagau

SEQ ID NO: 18083 - RNA, 19 nt, Homo sapiens
aauaaacaccacuggauua

SEQ ID NO: 18084 - RNA, 19 nt, Homo sapiens
ugugaauacugcuugaaua

SEQ ID NO: 18085 - RNA, 19 nt, Homo sapiens
caucuggaguucucaaaga

SEQ ID NO: 18086 - RNA, 19 nt, Homo sapiens
ggaacccgaucaaggaaau

SEQ ID NO: 18087 - RNA, 19 nt, Homo sapiens
gaauguuuccgcugaauau

SEQ ID NO: 18088 - RNA, 19 nt, Homo sapiens
agagagacaucgaugaaug

SEQ ID NO: 18089 - RNA, 19 nt, Homo sapiens
caaccugacaguauuauug

SEQ ID NO: 18090 - RNA, 19 nt, Homo sapiens
cugaaccacuuguagauuu

SEQ ID NO: 18091 - RNA, 19 nt, Homo sapiens
gcacaccaaucugacuuug

SEQ ID NO: 18092 - RNA, 19 nt, Homo sapiens
ggccguugcugacuuagaa

SEQ ID NO: 18093 - RNA, 19 nt, Homo sapiens
gggaacaaguugagcuaug

SEQ ID NO: 18094 - RNA, 19 nt, Homo sapiens
acaaguaguucuguauuug

SEQ ID NO: 18095 - RNA, 19 nt, Homo sapiens
gaaaucgagugccgcaucu

SEQ ID NO: 18096 - RNA, 19 nt, Homo sapiens
uuuaaacugucgugucaua

SEQ ID NO: 18097 - RNA, 19 nt, Homo sapiens
gcacauuugcagugaauug

SEQ ID NO: 18098 - RNA, 19 nt, Homo sapiens
gcagaauaaacaucaauga

SEQ ID NO: 18099 - RNA, 19 nt, Homo sapiens
gaaggaacaaccuguaaca

SEQ ID NO: 18100 - RNA, 19 nt, Homo sapiens
gugaauacugcuugaauaa

SEQ ID NO: 18101 - RNA, 19 nt, Homo sapiens
gugacaaagaucucaauua

SEQ ID NO: 18102 - RNA, 19 nt, Homo sapiens
caaggccuguacugugaua

SEQ ID NO: 18103 - RNA, 19 nt, Homo sapiens
aaagaagcgaucagaauaa

SEQ ID NO: 18104 - RNA, 19 nt, Homo sapiens
gcaguaagggaacaaguug

SEQ ID NO: 18105 - RNA, 19 nt, Homo sapiens
gcaguuugaggauuaguuu

SEQ ID NO: 18106 - RNA, 19 nt, Homo sapiens
ccacagcaacgaucacaaa

SEQ ID NO: 18107 - RNA, 19 nt, Homo sapiens
ugaggccguugcugacuua

SEQ ID NO: 18108 - RNA, 19 nt, Homo sapiens
ggacaacagagacuuggaa

SEQ ID NO: 18109 - RNA, 19 nt, Homo sapiens
gaugaugacuguaauaccu

SEQ ID NO: 18110 - RNA, 19 nt, Homo sapiens
guacgacgucagauguuua

SEQ ID NO: 18111 - RNA, 19 nt, Homo sapiens
gcugagcucugucuuaacu

SEQ ID NO: 18112 - RNA, 19 nt, Homo sapiens
cauuucugcugaagauaua

SEQ ID NO: 18113 - RNA, 19 nt, Homo sapiens
acagagggauggaggaaga

SEQ ID NO: 18114 - RNA, 19 nt, Homo sapiens
uuacgaaguucaagaucaa

SEQ ID NO: 18115 - RNA, 19 nt, Homo sapiens
gaaaucaaagugcuauuac

SEQ ID NO: 18116 - RNA, 19 nt, Homo sapiens
cauaaaauguccaguaaga

SEQ ID NO: 18117 - RNA, 19 nt, Homo sapiens
gaacaagaacuccaaaaug

SEQ ID NO: 18118 - RNA, 19 nt, Homo sapiens
ucaaagaagcgaucagaau

SEQ ID NO: 18119 - RNA, 19 nt, Homo sapiens
gaccuugccugcuccacaa

SEQ ID NO: 18120 - RNA, 19 nt, Homo sapiens
guuaaugguuaucgcugua

SEQ ID NO: 18121 - RNA, 19 nt, Homo sapiens
aaacaaacaggacaacaga

SEQ ID NO: 18122 - RNA, 19 nt, Homo sapiens
caucaaggauuacgagaac

SEQ ID NO: 18123 - RNA, 19 nt, Homo sapiens
cacaugcucuacaaacauu

SEQ ID NO: 18124 - RNA, 19 nt, Homo sapiens
ugaccagaauggcaacaaa

SEQ ID NO: 18125 - RNA, 19 nt, Homo sapiens
ugacuucuuuggacacuau

SEQ ID NO: 18126 - RNA, 19 nt, Homo sapiens
gaacaugaccuccguguag

SEQ ID NO: 18127 - RNA, 19 nt, Homo sapiens
caaaugcaccucccaguuu

SEQ ID NO: 18128 - RNA, 19 nt, Homo sapiens
gcaagcaccugaauuucug

SEQ ID NO: 18129 - RNA, 19 nt, Homo sapiens
gaugcaagcaccugaauuu

SEQ ID NO: 18130 - RNA, 19 nt, Homo sapiens
gaacaauacgugaaagaug

SEQ ID NO: 18131 - RNA, 19 nt, Homo sapiens
cuucauaccugcuccaauu

SEQ ID NO: 18132 - RNA, 19 nt, Homo sapiens
gcaccugaauuucuguuug

SEQ ID NO: 18133 - RNA, 19 nt, Homo sapiens
ggagugacauccaggacaa

SEQ ID NO: 18134 - RNA, 19 nt, Homo sapiens
gaaccgcccauuccuguuu

SEQ ID NO: 18135 - RNA, 19 nt, Homo sapiens
gcggaacaauagcugguua

SEQ ID NO: 18136 - RNA, 19 nt, Homo sapiens
ggacaaaucagcgaugugu

SEQ ID NO: 18137 - RNA, 19 nt, Homo sapiens
ccgaccagcuuguuuguga

SEQ ID NO: 18138 - RNA, 19 nt, Homo sapiens
ucuaaugagucgacuuuga

SEQ ID NO: 18139 - RNA, 19 nt, Homo sapiens
caccugaauuucuguuuga

SEQ ID NO: 18140 - RNA, 19 nt, Homo sapiens
uauauggcaugcacaguga

SEQ ID NO: 18141 - RNA, 19 nt, Homo sapiens
caacagcaccucagugucu

SEQ ID NO: 18142 - RNA, 19 nt, Homo sapiens
cugagaagauugacagguu

SEQ ID NO: 18143 - RNA, 19 nt, Homo sapiens
ggauguugcugcugagaag

SEQ ID NO: 18144 - RNA, 19 nt, Homo sapiens
gaggcaagaaccaguguuu

SEQ ID NO: 18145 - RNA, 19 nt, Homo sapiens
gcaaaggccagcagcagau

SEQ ID NO: 18146 - RNA, 19 nt, Homo sapiens
acaaugagaguaccuguga

SEQ ID NO: 18147 - RNA, 19 nt, Homo sapiens
uuauuucucccuuguguua

SEQ ID NO: 18148 - RNA, 19 nt, Homo sapiens
ugccuucgguuuguauuua

SEQ ID NO: 18149 - RNA, 19 nt, Homo sapiens
ggucucacuuuccagcaaa

SEQ ID NO: 18150 - RNA, 19 nt, Homo sapiens
gacaacagcaccucagugu

SEQ ID NO: 18151 - RNA, 19 nt, Homo sapiens
caaccgaccagcuuguuug

SEQ ID NO: 18152 - RNA, 19 nt, Homo sapiens
aaaugcaccucccaguuug

SEQ ID NO: 18153 - RNA, 19 nt, Homo sapiens
ccacagagucuacccaaca

SEQ ID NO: 18154 - RNA, 19 nt, Homo sapiens
ggacuucacagaacuggau

SEQ ID NO: 18155 - RNA, 19 nt, Homo sapiens
cugaauuucuguuugaaug

SEQ ID NO: 18156 - RNA, 19 nt, Homo sapiens
gagucuacccaacagcuua

SEQ ID NO: 18157 - RNA, 19 nt, Homo sapiens
gguuauuucucccuugugu

SEQ ID NO: 18158 - RNA, 19 nt, Homo sapiens
gcuagucgcugcaaaacuu

SEQ ID NO: 18159 - RNA, 19 nt, Homo sapiens
ucaacuggaugaagaaacu

SEQ ID NO: 18160 - RNA, 19 nt, Homo sapiens
gguggagggucucacuuuc

SEQ ID NO: 18161 - RNA, 19 nt, Homo sapiens
ggacagcacccuggcuuuc

SEQ ID NO: 18162 - RNA, 19 nt, Homo sapiens
gcauugccuucgguuugua

SEQ ID NO: 18163 - RNA, 19 nt, Homo sapiens
caacaccuacguccacuuc

SEQ ID NO: 18164 - RNA, 19 nt, Homo sapiens
ggcaagaaccaguguuuag

SEQ ID NO: 18165 - RNA, 19 nt, Homo sapiens
guuugaaugcggaacaaua

SEQ ID NO: 18166 - RNA, 19 nt, Homo sapiens
uagugucuguaauaccuua

SEQ ID NO: 18167 - RNA, 19 nt, Homo sapiens
gaugcuggccaacuucuug

SEQ ID NO: 18168 - RNA, 19 nt, Homo sapiens
caaaggccagcagcagaua

SEQ ID NO: 18169 - RNA, 19 nt, Homo sapiens
ucccuuguguuaguaauaa

SEQ ID NO: 18170 - RNA, 19 nt, Homo sapiens
gaagauugacagguucaug

SEQ ID NO: 18171 - RNA, 19 nt, Homo sapiens
ugacaccgaagacaaguug

SEQ ID NO: 18172 - RNA, 19 nt, Homo sapiens
guauuuagugucuugaaug

SEQ ID NO: 18173 - RNA, 19 nt, Homo sapiens
acaaaucagcgauguguca

SEQ ID NO: 18174 - RNA, 19 nt, Homo sapiens
caaagaccccaccuucaua

SEQ ID NO: 18175 - RNA, 19 nt, Homo sapiens
gaccagcuuguuugugaaa

SEQ ID NO: 18176 - RNA, 19 nt, Homo sapiens
ucccucaacuggaugaaga

SEQ ID NO: 18177 - RNA, 19 nt, Homo sapiens
acaaaugcaccucccaguu

SEQ ID NO: 18178 - RNA, 19 nt, Homo sapiens
caacuggugcugcaaggau

SEQ ID NO: 18179 - RNA, 19 nt, Homo sapiens
guuuguauuuagugucuug

SEQ ID NO: 18180 - RNA, 19 nt, Homo sapiens
cgaccagcuuguuugugaa

SEQ ID NO: 18181 - RNA, 19 nt, Homo sapiens
ugacauccaggacaacuuc

SEQ ID NO: 18182 - RNA, 19 nt, Homo sapiens
ccguguagugucuguaaua

SEQ ID NO: 18183 - RNA, 19 nt, Homo sapiens
caauucaggccaagacauc

SEQ ID NO: 18184 - RNA, 19 nt, Homo sapiens
ccaaccgaccagcuuguuu

SEQ ID NO: 18185 - RNA, 19 nt, Homo sapiens
cuucuaaugagucgacuuu

SEQ ID NO: 18186 - RNA, 19 nt, Homo sapiens
uuaacaagccugaggucuu

SEQ ID NO: 18187 - RNA, 19 nt, Homo sapiens
gagaagauugacagguuca

SEQ ID NO: 18188 - RNA, 19 nt, Homo sapiens
ccugugagcagcuggcaaa

SEQ ID NO: 18189 - RNA, 19 nt, Homo sapiens
gggucucacuuuccagcaa

SEQ ID NO: 18190 - RNA, 19 nt, Homo sapiens
cuucuugggcuuccguaua

SEQ ID NO: 18191 - RNA, 19 nt, Homo sapiens
gcaagaaccaguguuuagc

SEQ ID NO: 18192 - RNA, 19 nt, Homo sapiens
uaacaaccccggacaaauc

SEQ ID NO: 18193 - RNA, 19 nt, Homo sapiens
gagagagagcccacagagu

SEQ ID NO: 18194 - RNA, 19 nt, Homo sapiens
cagcaaaacucccucaacu

SEQ ID NO: 18195 - RNA, 19 nt, Homo sapiens
acagcacccuggcuuucaa

SEQ ID NO: 18196 - RNA, 19 nt, Homo sapiens
ccacugcccugcacuuccu

SEQ ID NO: 18197 - RNA, 19 nt, Homo sapiens
gagagagcccacagagucu

SEQ ID NO: 18198 - RNA, 19 nt, Homo sapiens
ugucuguaauaccuuaguu

SEQ ID NO: 18199 - RNA, 19 nt, Homo sapiens
ugaccuccguguagugucu

SEQ ID NO: 18200 - RNA, 19 nt, Homo sapiens
gcgggacuacuguuccaaa

SEQ ID NO: 18201 - RNA, 19 nt, Homo sapiens
gauaacaaccccggacaaa

SEQ ID NO: 18202 - RNA, 19 nt, Homo sapiens
cacccuggccucucucuau

SEQ ID NO: 18203 - RNA, 19 nt, Homo sapiens
uucuugggcuuccguauau

SEQ ID NO: 18204 - RNA, 19 nt, Homo sapiens
ucgggaugcuggccaacuu

SEQ ID NO: 18205 - RNA, 19 nt, Homo sapiens
ucuuggaggugacccugaa

SEQ ID NO: 18206 - RNA, 19 nt, Homo sapiens
uguagugucuguaauaccu

SEQ ID NO: 18207 - RNA, 19 nt, Homo sapiens
cuaaugagucgacuuugag

SEQ ID NO: 18208 - RNA, 19 nt, Homo sapiens
guuaguaauaaacgucuug

SEQ ID NO: 18209 - RNA, 19 nt, Homo sapiens
ugaacaauacgugaaagau

SEQ ID NO: 18210 - RNA, 19 nt, Homo sapiens
cuacccaacagcuuaacaa

SEQ ID NO: 18211 - RNA, 19 nt, Homo sapiens
caacuucucggugacucaa

SEQ ID NO: 18212 - RNA, 19 nt, Homo sapiens
gacagcacccuggcuuuca

SEQ ID NO: 18213 - RNA, 19 nt, Homo sapiens
gggccuggcucucuauacc

SEQ ID NO: 18214 - RNA, 19 nt, Homo sapiens
gcaccugaagcagccguuu

SEQ ID NO: 18215 - RNA, 19 nt, Homo sapiens
aaagaugcaagcaccugaa

SEQ ID NO: 18216 - RNA, 19 nt, Homo sapiens
aggcaagaaccaguguuua

SEQ ID NO: 18217 - RNA, 19 nt, Homo sapiens
gcacuucacuaccaaauga

SEQ ID NO: 18218 - RNA, 19 nt, Homo sapiens
gcacuggucccaaguagua

SEQ ID NO: 18219 - RNA, 19 nt, Homo sapiens
gaaacucgaugaauguguu

SEQ ID NO: 18220 - RNA, 19 nt, Homo sapiens
gaacaccaauauuacaguu

SEQ ID NO: 18221 - RNA, 19 nt, Homo sapiens
gaaagaaggagcaagagaa

SEQ ID NO: 18222 - RNA, 19 nt, Homo sapiens
gaauaccgcuggcccuuug

SEQ ID NO: 18223 - RNA, 19 nt, Homo sapiens
ccaaagggcaguaaaguuu

SEQ ID NO: 18224 - RNA, 19 nt, Homo sapiens
gaugagaguuccagauugu

SEQ ID NO: 18225 - RNA, 19 nt, Homo sapiens
acucaaaccuuucaacaaa

SEQ ID NO: 18226 - RNA, 19 nt, Homo sapiens
caagaagccugcaccaugu

SEQ ID NO: 18227 - RNA, 19 nt, Homo sapiens
gaagaacaaugucagaaac

SEQ ID NO: 18228 - RNA, 19 nt, Homo sapiens
gaacaaaccaagaaaugau

SEQ ID NO: 18229 - RNA, 19 nt, Homo sapiens
cuaaacugcuguuaauuga

SEQ ID NO: 18230 - RNA, 19 nt, Homo sapiens
gaugacggcugcucgaaga

SEQ ID NO: 18231 - RNA, 19 nt, Homo sapiens
guaguguccuccuaguaua

SEQ ID NO: 18232 - RNA, 19 nt, Homo sapiens
gagaugagaguuccagauu

SEQ ID NO: 18233 - RNA, 19 nt, Homo sapiens
auacgugacuguagaauug

SEQ ID NO: 18234 - RNA, 19 nt, Homo sapiens
guucgaaaccuguccauaa

SEQ ID NO: 18235 - RNA, 19 nt, Homo sapiens
caucauacgugacuguaga

SEQ ID NO: 18236 - RNA, 19 nt, Homo sapiens
cgaugaauguguugauuug

SEQ ID NO: 18237 - RNA, 19 nt, Homo sapiens
aaauucaaccugugucuua

SEQ ID NO: 18238 - RNA, 19 nt, Homo sapiens
aaguaugccuuccuguuua

SEQ ID NO: 18239 - RNA, 19 nt, Homo sapiens
uauacuggguuuccuguuu

SEQ ID NO: 18240 - RNA, 19 nt, Homo sapiens
gcuauaauccaucgaaaug

SEQ ID NO: 18241 - RNA, 19 nt, Homo sapiens
ccaagaugauugucccaaa

SEQ ID NO: 18242 - RNA, 19 nt, Homo sapiens
ucucuaaacugcuguuaau

SEQ ID NO: 18243 - RNA, 19 nt, Homo sapiens
gucagaaacucgaugaaug

SEQ ID NO: 18244 - RNA, 19 nt, Homo sapiens
gaagaacaaaccaagaaau

SEQ ID NO: 18245 - RNA, 19 nt, Homo sapiens
aaagucaccugcaucauca

SEQ ID NO: 18246 - RNA, 19 nt, Homo sapiens
ggugauagucauuuacuuu

SEQ ID NO: 18247 - RNA, 19 nt, Homo sapiens
ugucaugauuccuacuuua

SEQ ID NO: 18248 - RNA, 19 nt, Homo sapiens
gcuaguguguuucuacuca

SEQ ID NO: 18249 - RNA, 19 nt, Homo sapiens
uggaaggcauaauuacaua

SEQ ID NO: 18250 - RNA, 19 nt, Homo sapiens
cgaaaccuguccauaaagu

SEQ ID NO: 18251 - RNA, 19 nt, Homo sapiens
gagguugagugacauguuc

SEQ ID NO: 18252 - RNA, 19 nt, Homo sapiens
ucacgugucucagcauuga

SEQ ID NO: 18253 - RNA, 19 nt, Homo sapiens
ccuguacgcuaguguguuu

SEQ ID NO: 18254 - RNA, 19 nt, Homo sapiens
guacaaagauaugcuaagc

SEQ ID NO: 18255 - RNA, 19 nt, Homo sapiens
cuaaagaaggcuuaugaaa

SEQ ID NO: 18256 - RNA, 19 nt, Homo sapiens
acaccaauauuacaguuug

SEQ ID NO: 18257 - RNA, 19 nt, Homo sapiens
aaaguaugccuuccuguuu

SEQ ID NO: 18258 - RNA, 19 nt, Homo sapiens
aaacaaugcccguaagaug

SEQ ID NO: 18259 - RNA, 19 nt, Homo sapiens
cgaagaacaaugucagaaa

SEQ ID NO: 18260 - RNA, 19 nt, Homo sapiens
gaaaccuguccauaaagua

SEQ ID NO: 18261 - RNA, 19 nt, Homo sapiens
ucucaacucuucuacugaa

SEQ ID NO: 18262 - RNA, 19 nt, Homo sapiens
cagaagaacaaaccaagaa

SEQ ID NO: 18263 - RNA, 19 nt, Homo sapiens
ggccaugccuaucaccauu

SEQ ID NO: 18264 - RNA, 19 nt, Homo sapiens
caaagucaccugcaucauc

SEQ ID NO: 18265 - RNA, 19 nt, Homo sapiens
ucaccugcaucaucauuug

SEQ ID NO: 18266 - RNA, 19 nt, Homo sapiens
caagaugauugucccaaag

SEQ ID NO: 18267 - RNA, 19 nt, Homo sapiens
cuacacagcuauggaauac

SEQ ID NO: 18268 - RNA, 19 nt, Homo sapiens
uuacugacuuugccacuau

SEQ ID NO: 18269 - RNA, 19 nt, Homo sapiens
uaaaguaugccuuccuguu

SEQ ID NO: 18270 - RNA, 19 nt, Homo sapiens
caacugugcuacacuugca

SEQ ID NO: 18271 - RNA, 19 nt, Homo sapiens
ugaauguguugauuugaga

SEQ ID NO: 18272 - RNA, 19 nt, Homo sapiens
auaugaagcugaagacugu

SEQ ID NO: 18273 - RNA, 19 nt, Homo sapiens
aaaccuguccauaaaguaa

SEQ ID NO: 18274 - RNA, 19 nt, Homo sapiens
caacaggagaugagaguuc

SEQ ID NO: 18275 - RNA, 19 nt, Homo sapiens
gcaacaagacaaagcaaag

SEQ ID NO: 18276 - RNA, 19 nt, Homo sapiens
agauuguucuguccaguuu

SEQ ID NO: 18277 - RNA, 19 nt, Homo sapiens
uucgaaaccuguccauaaa

SEQ ID NO: 18278 - RNA, 19 nt, Homo sapiens
ccagguguauuugauauag

SEQ ID NO: 18279 - RNA, 19 nt, Homo sapiens
gaaacagcuugguggugau

SEQ ID NO: 18280 - RNA, 19 nt, Homo sapiens
ucuaaacugcuguuaauug

SEQ ID NO: 18281 - RNA, 19 nt, Homo sapiens
acaaagcaaagccacauuu

SEQ ID NO: 18282 - RNA, 19 nt, Homo sapiens
aaauucaacccuuccgaua

SEQ ID NO: 18283 - RNA, 19 nt, Homo sapiens
aagcuggaaggcauaauua

SEQ ID NO: 18284 - RNA, 19 nt, Homo sapiens
aaaugauucucaacucuuc

SEQ ID NO: 18285 - RNA, 19 nt, Homo sapiens
cagcuauaauccaucgaaa

SEQ ID NO: 18286 - RNA, 19 nt, Homo sapiens
ucagaaacucgaugaaugu

SEQ ID NO: 18287 - RNA, 19 nt, Homo sapiens
caugauuccuacuuuauac

SEQ ID NO: 18288 - RNA, 19 nt, Homo sapiens
gaucgauaccuggcuauug

SEQ ID NO: 18289 - RNA, 19 nt, Homo sapiens
ucugagaaguguauauagu

SEQ ID NO: 18290 - RNA, 19 nt, Homo sapiens
guaagcucauccaccaaga

SEQ ID NO: 18291 - RNA, 19 nt, Homo sapiens
caguuugugcuuuccauua

SEQ ID NO: 18292 - RNA, 19 nt, Homo sapiens
gcuggcccuuuggcaauua

SEQ ID NO: 18293 - RNA, 19 nt, Homo sapiens
ggaauaccgcuggcccuuu

SEQ ID NO: 18294 - RNA, 19 nt, Homo sapiens
gagaaguguauauaguuug

SEQ ID NO: 18295 - RNA, 19 nt, Homo sapiens
gaaauucaaccugugucuu

SEQ ID NO: 18296 - RNA, 19 nt, Homo sapiens
aagcaguagucgucaaguu

SEQ ID NO: 18297 - RNA, 19 nt, Homo sapiens
gcuaagcaguagucgucaa

SEQ ID NO: 18298 - RNA, 19 nt, Homo sapiens
gaaggagcaagagaacauu

SEQ ID NO: 18299 - RNA, 19 nt, Homo sapiens
ugagugacauguucgaaac

SEQ ID NO: 18300 - RNA, 19 nt, Homo sapiens
aaaucccacucaaaccuuu

SEQ ID NO: 18301 - RNA, 19 nt, Homo sapiens
gcaauugugcuuuucuuuu

SEQ ID NO: 18302 - RNA, 19 nt, Homo sapiens
aagaacaaaccaagaaaug

SEQ ID NO: 18303 - RNA, 19 nt, Homo sapiens
caaauucgacccaggugau

SEQ ID NO: 18304 - RNA, 19 nt, Homo sapiens
acuaugggcugucuacaca

SEQ ID NO: 18305 - RNA, 19 nt, Homo sapiens
aaagccacauuuugcauua

SEQ ID NO: 18306 - RNA, 19 nt, Homo sapiens
cuaaagcucugaacaaaag

SEQ ID NO: 18307 - RNA, 19 nt, Homo sapiens
ggaaggcauaauuacauau

SEQ ID NO: 18308 - RNA, 19 nt, Homo sapiens
aguaugccuuccuguuuaa

SEQ ID NO: 18309 - RNA, 19 nt, Homo sapiens
guguauauaguuuguggua

SEQ ID NO: 18310 - RNA, 19 nt, Homo sapiens
guaguaguguccuccuagu

SEQ ID NO: 18311 - RNA, 19 nt, Homo sapiens
agaugagaguuccagauug

SEQ ID NO: 18312 - RNA, 19 nt, Homo sapiens
cuacugaagaugguauuaa

SEQ ID NO: 18313 - RNA, 19 nt, Homo sapiens
ugaaagaaggagcaagaga

SEQ ID NO: 18314 - RNA, 19 nt, Homo sapiens
gugggaauauuuggaaaca

SEQ ID NO: 18315 - RNA, 19 nt, Homo sapiens
ccaugccuaucaccauuug

SEQ ID NO: 18316 - RNA, 19 nt, Homo sapiens
agaacaaaccaagaaauga

SEQ ID NO: 18317 - RNA, 19 nt, Homo sapiens
gcacuucacuaccaaauga

SEQ ID NO: 18318 - RNA, 19 nt, Homo sapiens
gcacuggucccaaguagua

SEQ ID NO: 18319 - RNA, 19 nt, Homo sapiens
gaaacucgaugaauguguu

SEQ ID NO: 18320 - RNA, 19 nt, Homo sapiens
gaacaccaauauuacaguu

SEQ ID NO: 18321 - RNA, 19 nt, Homo sapiens
gaaagaaggagcaagagaa

SEQ ID NO: 18322 - RNA, 19 nt, Homo sapiens
gaauaccgcuggcccuuug

SEQ ID NO: 18323 - RNA, 19 nt, Homo sapiens
ccaaagggcaguaaaguuu

SEQ ID NO: 18324 - RNA, 19 nt, Homo sapiens
gcucagaggagguguauuu

SEQ ID NO: 18325 - RNA, 19 nt, Homo sapiens
gaugagaguuccagauugu

SEQ ID NO: 18326 - RNA, 19 nt, Homo sapiens
acucaaaccuuucaacaaa

SEQ ID NO: 18327 - RNA, 19 nt, Homo sapiens
caagaagccugcaccaugu

SEQ ID NO: 18328 - RNA, 19 nt, Homo sapiens
gaagaacaaugucagaaac

SEQ ID NO: 18329 - RNA, 19 nt, Homo sapiens
gaacaaaccaagaaaugau

SEQ ID NO: 18330 - RNA, 19 nt, Homo sapiens
cuaaacugcuguuaauuga

SEQ ID NO: 18331 - RNA, 19 nt, Homo sapiens
gaugacggcugcucgaaga

SEQ ID NO: 18332 - RNA, 19 nt, Homo sapiens
gaaaaugaaucacaaguca

SEQ ID NO: 18333 - RNA, 19 nt, Homo sapiens
guaguguccuccuaguaua

SEQ ID NO: 18334 - RNA, 19 nt, Homo sapiens
gagaugagaguuccagauu

SEQ ID NO: 18335 - RNA, 19 nt, Homo sapiens
auacgugacuguagaauug

SEQ ID NO: 18336 - RNA, 19 nt, Homo sapiens
guucgaaaccuguccauaa

SEQ ID NO: 18337 - RNA, 19 nt, Homo sapiens
caucauacgugacuguaga

SEQ ID NO: 18338 - RNA, 19 nt, Homo sapiens
cgaugaauguguugauuug

SEQ ID NO: 18339 - RNA, 19 nt, Homo sapiens
gaggagguguauuugauau

SEQ ID NO: 18340 - RNA, 19 nt, Homo sapiens
aaauucaaccugugucuua

SEQ ID NO: 18341 - RNA, 19 nt, Homo sapiens
ggagguguauuugauauag

SEQ ID NO: 18342 - RNA, 19 nt, Homo sapiens
aaguaugccuuccuguuua

SEQ ID NO: 18343 - RNA, 19 nt, Homo sapiens
uauacuggguuuccuguuu

SEQ ID NO: 18344 - RNA, 19 nt, Homo sapiens
gcuauaauccaucgaaaug

SEQ ID NO: 18345 - RNA, 19 nt, Homo sapiens
ccaagaugauugucccaaa

SEQ ID NO: 18346 - RNA, 19 nt, Homo sapiens
cagaggagguguauuugau

SEQ ID NO: 18347 - RNA, 19 nt, Homo sapiens
ucucuaaacugcuguuaau

SEQ ID NO: 18348 - RNA, 19 nt, Homo sapiens
gucagaaacucgaugaaug

SEQ ID NO: 18349 - RNA, 19 nt, Homo sapiens
gaagaacaaaccaagaaau

SEQ ID NO: 18350 - RNA, 19 nt, Homo sapiens
aaagucaccugcaucauca

SEQ ID NO: 18351 - RNA, 19 nt, Homo sapiens
ggugauagucauuuacuuu

SEQ ID NO: 18352 - RNA, 19 nt, Homo sapiens
ugucaugauuccuacuuua

SEQ ID NO: 18353 - RNA, 19 nt, Homo sapiens
gcuaguguguuucuacuca

SEQ ID NO: 18354 - RNA, 19 nt, Homo sapiens
uggaaggcauaauuacaua

SEQ ID NO: 18355 - RNA, 19 nt, Homo sapiens
cgaaaccuguccauaaagu

SEQ ID NO: 18356 - RNA, 19 nt, Homo sapiens
gagguugagugacauguuc

SEQ ID NO: 18357 - RNA, 19 nt, Homo sapiens
ucacgugucucagcauuga

SEQ ID NO: 18358 - RNA, 19 nt, Homo sapiens
ccuguacgcuaguguguuu

SEQ ID NO: 18359 - RNA, 19 nt, Homo sapiens
guacaaagauaugcuaagc

SEQ ID NO: 18360 - RNA, 19 nt, Homo sapiens
cuaaagaaggcuuaugaaa

SEQ ID NO: 18361 - RNA, 19 nt, Homo sapiens
acaccaauauuacaguuug

SEQ ID NO: 18362 - RNA, 19 nt, Homo sapiens
aaaguaugccuuccuguuu

SEQ ID NO: 18363 - RNA, 19 nt, Homo sapiens
aaacaaugcccguaagaug

SEQ ID NO: 18364 - RNA, 19 nt, Homo sapiens
cgaagaacaaugucagaaa

SEQ ID NO: 18365 - RNA, 19 nt, Homo sapiens
gaaaccuguccauaaagua

SEQ ID NO: 18366 - RNA, 19 nt, Homo sapiens
cagaagaacaaaccaagaa

SEQ ID NO: 18367 - RNA, 19 nt, Homo sapiens
ucucaacucuucuacugaa

SEQ ID NO: 18368 - RNA, 19 nt, Homo sapiens
ggccaugccuaucaccauu

SEQ ID NO: 18369 - RNA, 19 nt, Homo sapiens
caaagucaccugcaucauc

SEQ ID NO: 18370 - RNA, 19 nt, Homo sapiens
ucaccugcaucaucauuug

SEQ ID NO: 18371 - RNA, 19 nt, Homo sapiens
cuacacagcuauggaauac

SEQ ID NO: 18372 - RNA, 19 nt, Homo sapiens
uuacugacuuugccacuau

SEQ ID NO: 18373 - RNA, 19 nt, Homo sapiens
caagaugauugucccaaag

SEQ ID NO: 18374 - RNA, 19 nt, Homo sapiens
uaaaguaugccuuccuguu

SEQ ID NO: 18375 - RNA, 19 nt, Homo sapiens
caacugugcuacacuugca

SEQ ID NO: 18376 - RNA, 19 nt, Homo sapiens
ugaauguguugauuugaga

SEQ ID NO: 18377 - RNA, 19 nt, Homo sapiens
auaugaagcugaagacugu

SEQ ID NO: 18378 - RNA, 19 nt, Homo sapiens
aaaccuguccauaaaguaa

SEQ ID NO: 18379 - RNA, 19 nt, Homo sapiens
caacaggagaugagaguuc

SEQ ID NO: 18380 - RNA, 19 nt, Homo sapiens
gcaacaagacaaagcaaag

SEQ ID NO: 18381 - RNA, 19 nt, Homo sapiens
agauuguucuguccaguuu

SEQ ID NO: 18382 - RNA, 19 nt, Homo sapiens
uucgaaaccuguccauaaa

SEQ ID NO: 18383 - RNA, 19 nt, Homo sapiens
gaaacagcuugguggugau

SEQ ID NO: 18384 - RNA, 19 nt, Homo sapiens
ucuaaacugcuguuaauug

SEQ ID NO: 18385 - RNA, 19 nt, Homo sapiens
acaaagcaaagccacauuu

SEQ ID NO: 18386 - RNA, 19 nt, Homo sapiens
aaauucaacccuuccgaua

SEQ ID NO: 18387 - RNA, 19 nt, Homo sapiens
aagcuggaaggcauaauua

SEQ ID NO: 18388 - RNA, 19 nt, Homo sapiens
aaaugauucucaacucuuc

SEQ ID NO: 18389 - RNA, 19 nt, Homo sapiens
cagcuauaauccaucgaaa

SEQ ID NO: 18390 - RNA, 19 nt, Homo sapiens
ucagaaacucgaugaaugu

SEQ ID NO: 18391 - RNA, 19 nt, Homo sapiens
gaucgauaccuggcuauug

SEQ ID NO: 18392 - RNA, 19 nt, Homo sapiens
caugauuccuacuuuauac

SEQ ID NO: 18393 - RNA, 19 nt, Homo sapiens
ucugagaaguguauauagu

SEQ ID NO: 18394 - RNA, 19 nt, Homo sapiens
guaagcucauccaccaaga

SEQ ID NO: 18395 - RNA, 19 nt, Homo sapiens
caguuugugcuuuccauua

SEQ ID NO: 18396 - RNA, 19 nt, Homo sapiens
gcuggcccuuuggcaauua

SEQ ID NO: 18397 - RNA, 19 nt, Homo sapiens
ggaauaccgcuggcccuuu

SEQ ID NO: 18398 - RNA, 19 nt, Homo sapiens
gagaaguguauauaguuug

SEQ ID NO: 18399 - RNA, 19 nt, Homo sapiens
gaaauucaaccugugucuu

SEQ ID NO: 18400 - RNA, 19 nt, Homo sapiens
aagcaguagucgucaaguu

SEQ ID NO: 18401 - RNA, 19 nt, Homo sapiens
gcuaagcaguagucgucaa

SEQ ID NO: 18402 - RNA, 19 nt, Homo sapiens
gaaggagcaagagaacauu

SEQ ID NO: 18403 - RNA, 19 nt, Homo sapiens
caaauucgacccaggugau

SEQ ID NO: 18404 - RNA, 19 nt, Homo sapiens
ugagugacauguucgaaac

SEQ ID NO: 18405 - RNA, 19 nt, Homo sapiens
aaaucccacucaaaccuuu

SEQ ID NO: 18406 - RNA, 19 nt, Homo sapiens
gcaauugugcuuuucuuuu

SEQ ID NO: 18407 - RNA, 19 nt, Homo sapiens
aagaacaaaccaagaaaug

SEQ ID NO: 18408 - RNA, 19 nt, Homo sapiens
acuaugggcugucuacaca

SEQ ID NO: 18409 - RNA, 19 nt, Homo sapiens
ggaaggcauaauuacauau

SEQ ID NO: 18410 - RNA, 19 nt, Homo sapiens
aaagccacauuuugcauua

SEQ ID NO: 18411 - RNA, 19 nt, Homo sapiens
cuaaagcucugaacaaaag

SEQ ID NO: 18412 - RNA, 19 nt, Homo sapiens
aguaugccuuccuguuuaa

SEQ ID NO: 18413 - RNA, 19 nt, Homo sapiens
guguauauaguuuguggua

SEQ ID NO: 18414 - RNA, 19 nt, Homo sapiens
guaguaguguccuccuagu

SEQ ID NO: 18415 - RNA, 19 nt, Homo sapiens
agaugagaguuccagauug

SEQ ID NO: 18416 - RNA, 19 nt, Homo sapiens
cuacugaagaugguauuaa

SEQ ID NO: 18417 - RNA, 19 nt, Homo sapiens
gcacuucacuaccaaauga

SEQ ID NO: 18418 - RNA, 19 nt, Homo sapiens
gcacuggucccaaguagua

SEQ ID NO: 18419 - RNA, 19 nt, Homo sapiens
gaaacucgaugaauguguu

SEQ ID NO: 18420 - RNA, 19 nt, Homo sapiens
gaacaccaauauuacaguu

SEQ ID NO: 18421 - RNA, 19 nt, Homo sapiens
gaaagaaggagcaagagaa

SEQ ID NO: 18422 - RNA, 19 nt, Homo sapiens
gaauaccgcuggcccuuug

SEQ ID NO: 18423 - RNA, 19 nt, Homo sapiens
ccaaagggcaguaaaguuu

SEQ ID NO: 18424 - RNA, 19 nt, Homo sapiens
gaugagaguuccagauugu

SEQ ID NO: 18425 - RNA, 19 nt, Homo sapiens
acucaaaccuuucaacaaa

SEQ ID NO: 18426 - RNA, 19 nt, Homo sapiens
caagaagccugcaccaugu

SEQ ID NO: 18427 - RNA, 19 nt, Homo sapiens
gaagaacaaugucagaaac

SEQ ID NO: 18428 - RNA, 19 nt, Homo sapiens
gaacaaaccaagaaaugau

SEQ ID NO: 18429 - RNA, 19 nt, Homo sapiens
cuaaacugcuguuaauuga

SEQ ID NO: 18430 - RNA, 19 nt, Homo sapiens
gaugacggcugcucgaaga

SEQ ID NO: 18431 - RNA, 19 nt, Homo sapiens
guaguguccuccuaguaua

SEQ ID NO: 18432 - RNA, 19 nt, Homo sapiens
gagaugagaguuccagauu

SEQ ID NO: 18433 - RNA, 19 nt, Homo sapiens
auacgugacuguagaauug

SEQ ID NO: 18434 - RNA, 19 nt, Homo sapiens
guucgaaaccuguccauaa

SEQ ID NO: 18435 - RNA, 19 nt, Homo sapiens
caucauacgugacuguaga

SEQ ID NO: 18436 - RNA, 19 nt, Homo sapiens
cgaugaauguguugauuug

SEQ ID NO: 18437 - RNA, 19 nt, Homo sapiens
aaauucaaccugugucuua

SEQ ID NO: 18438 - RNA, 19 nt, Homo sapiens
aaguaugccuuccuguuua

SEQ ID NO: 18439 - RNA, 19 nt, Homo sapiens
uauacuggguuuccuguuu

SEQ ID NO: 18440 - RNA, 19 nt, Homo sapiens
gcuauaauccaucgaaaug

SEQ ID NO: 18441 - RNA, 19 nt, Homo sapiens
ccaagaugauugucccaaa

SEQ ID NO: 18442 - RNA, 19 nt, Homo sapiens
ucucuaaacugcuguuaau

SEQ ID NO: 18443 - RNA, 19 nt, Homo sapiens
gucagaaacucgaugaaug

SEQ ID NO: 18444 - RNA, 19 nt, Homo sapiens
gaagaacaaaccaagaaau

SEQ ID NO: 18445 - RNA, 19 nt, Homo sapiens
aaagucaccugcaucauca

SEQ ID NO: 18446 - RNA, 19 nt, Homo sapiens
ggugauagucauuuacuuu

SEQ ID NO: 18447 - RNA, 19 nt, Homo sapiens
ugucaugauuccuacuuua

SEQ ID NO: 18448 - RNA, 19 nt, Homo sapiens
gcuaguguguuucuacuca

SEQ ID NO: 18449 - RNA, 19 nt, Homo sapiens
uggaaggcauaauuacaua

SEQ ID NO: 18450 - RNA, 19 nt, Homo sapiens
cgaaaccuguccauaaagu

SEQ ID NO: 18451 - RNA, 19 nt, Homo sapiens
gagguugagugacauguuc

SEQ ID NO: 18452 - RNA, 19 nt, Homo sapiens
ucacgugucucagcauuga

SEQ ID NO: 18453 - RNA, 19 nt, Homo sapiens
ccuguacgcuaguguguuu

SEQ ID NO: 18454 - RNA, 19 nt, Homo sapiens
guacaaagauaugcuaagc

SEQ ID NO: 18455 - RNA, 19 nt, Homo sapiens
cuaaagaaggcuuaugaaa

SEQ ID NO: 18456 - RNA, 19 nt, Homo sapiens
acaccaauauuacaguuug

SEQ ID NO: 18457 - RNA, 19 nt, Homo sapiens
aaaguaugccuuccuguuu

SEQ ID NO: 18458 - RNA, 19 nt, Homo sapiens
aaacaaugcccguaagaug

SEQ ID NO: 18459 - RNA, 19 nt, Homo sapiens
cgaagaacaaugucagaaa

SEQ ID NO: 18460 - RNA, 19 nt, Homo sapiens
gaaaccuguccauaaagua

SEQ ID NO: 18461 - RNA, 19 nt, Homo sapiens
ucucaacucuucuacugaa

SEQ ID NO: 18462 - RNA, 19 nt, Homo sapiens
cagaagaacaaaccaagaa

SEQ ID NO: 18463 - RNA, 19 nt, Homo sapiens
ggccaugccuaucaccauu

SEQ ID NO: 18464 - RNA, 19 nt, Homo sapiens
caaagucaccugcaucauc

SEQ ID NO: 18465 - RNA, 19 nt, Homo sapiens
caagaugauugucccaaag

SEQ ID NO: 18466 - RNA, 19 nt, Homo sapiens
ucaccugcaucaucauuug

SEQ ID NO: 18467 - RNA, 19 nt, Homo sapiens
cuacacagcuauggaauac

SEQ ID NO: 18468 - RNA, 19 nt, Homo sapiens
uuacugacuuugccacuau

SEQ ID NO: 18469 - RNA, 19 nt, Homo sapiens
uaaaguaugccuuccuguu

SEQ ID NO: 18470 - RNA, 19 nt, Homo sapiens
caacugugcuacacuugca

SEQ ID NO: 18471 - RNA, 19 nt, Homo sapiens
ugaauguguugauuugaga

SEQ ID NO: 18472 - RNA, 19 nt, Homo sapiens
auaugaagcugaagacugu

SEQ ID NO: 18473 - RNA, 19 nt, Homo sapiens
aaaccuguccauaaaguaa

SEQ ID NO: 18474 - RNA, 19 nt, Homo sapiens
caacaggagaugagaguuc

SEQ ID NO: 18475 - RNA, 19 nt, Homo sapiens
gcaacaagacaaagcaaag

SEQ ID NO: 18476 - RNA, 19 nt, Homo sapiens
agauuguucuguccaguuu

SEQ ID NO: 18477 - RNA, 19 nt, Homo sapiens
uucgaaaccuguccauaaa

SEQ ID NO: 18478 - RNA, 19 nt, Homo sapiens
gaaacagcuugguggugau

SEQ ID NO: 18479 - RNA, 19 nt, Homo sapiens
ucuaaacugcuguuaauug

SEQ ID NO: 18480 - RNA, 19 nt, Homo sapiens
aagcuggaaggcauaauua

SEQ ID NO: 18481 - RNA, 19 nt, Homo sapiens
ggguguauuugauauagug

SEQ ID NO: 18482 - RNA, 19 nt, Homo sapiens
acaaagcaaagccacauuu

SEQ ID NO: 18483 - RNA, 19 nt, Homo sapiens
aaauucaacccuuccgaua

SEQ ID NO: 18484 - RNA, 19 nt, Homo sapiens
aaaugauucucaacucuuc

SEQ ID NO: 18485 - RNA, 19 nt, Homo sapiens
cagcuauaauccaucgaaa

SEQ ID NO: 18486 - RNA, 19 nt, Homo sapiens
ucagaaacucgaugaaugu

SEQ ID NO: 18487 - RNA, 19 nt, Homo sapiens
gaucgauaccuggcuauug

SEQ ID NO: 18488 - RNA, 19 nt, Homo sapiens
caugauuccuacuuuauac

SEQ ID NO: 18489 - RNA, 19 nt, Homo sapiens
ucugagaaguguauauagu

SEQ ID NO: 18490 - RNA, 19 nt, Homo sapiens
guaagcucauccaccaaga

SEQ ID NO: 18491 - RNA, 19 nt, Homo sapiens
caguuugugcuuuccauua

SEQ ID NO: 18492 - RNA, 19 nt, Homo sapiens
gcuggcccuuuggcaauua

SEQ ID NO: 18493 - RNA, 19 nt, Homo sapiens
ggaauaccgcuggcccuuu

SEQ ID NO: 18494 - RNA, 19 nt, Homo sapiens
gagaaguguauauaguuug

SEQ ID NO: 18495 - RNA, 19 nt, Homo sapiens
gaaauucaaccugugucuu

SEQ ID NO: 18496 - RNA, 19 nt, Homo sapiens
aagcaguagucgucaaguu

SEQ ID NO: 18497 - RNA, 19 nt, Homo sapiens
gcuaagcaguagucgucaa

SEQ ID NO: 18498 - RNA, 19 nt, Homo sapiens
gaaggagcaagagaacauu

SEQ ID NO: 18499 - RNA, 19 nt, Homo sapiens
caaauucgacccaggugau

SEQ ID NO: 18500 - RNA, 19 nt, Homo sapiens
ugagugacauguucgaaac

SEQ ID NO: 18501 - RNA, 19 nt, Homo sapiens
aaaucccacucaaaccuuu

SEQ ID NO: 18502 - RNA, 19 nt, Homo sapiens
gcaauugugcuuuucuuuu

SEQ ID NO: 18503 - RNA, 19 nt, Homo sapiens
gcggguguauuugauauag

SEQ ID NO: 18504 - RNA, 19 nt, Homo sapiens
aagaacaaaccaagaaaug

SEQ ID NO: 18505 - RNA, 19 nt, Homo sapiens
acuaugggcugucuacaca

SEQ ID NO: 18506 - RNA, 19 nt, Homo sapiens
ggaaggcauaauuacauau

SEQ ID NO: 18507 - RNA, 19 nt, Homo sapiens
aaagccacauuuugcauua

SEQ ID NO: 18508 - RNA, 19 nt, Homo sapiens
cuaaagcucugaacaaaag

SEQ ID NO: 18509 - RNA, 19 nt, Homo sapiens
aguaugccuuccuguuuaa

SEQ ID NO: 18510 - RNA, 19 nt, Homo sapiens
guguauauaguuuguggua

SEQ ID NO: 18511 - RNA, 19 nt, Homo sapiens
guaguaguguccuccuagu

SEQ ID NO: 18512 - RNA, 19 nt, Homo sapiens
agaugagaguuccagauug

SEQ ID NO: 18513 - RNA, 19 nt, Homo sapiens
cuacugaagaugguauuaa

SEQ ID NO: 18514 - RNA, 19 nt, Homo sapiens
ugaaagaaggagcaagaga

SEQ ID NO: 18515 - RNA, 19 nt, Homo sapiens
ccaugccuaucaccauuug

SEQ ID NO: 18516 - RNA, 19 nt, Homo sapiens
agaacaaaccaagaaauga

SEQ ID NO: 18517 - RNA, 19 nt, Homo sapiens
gcacuucacuaccaaauga

SEQ ID NO: 18518 - RNA, 19 nt, Homo sapiens
gcacuggucccaaguagua

SEQ ID NO: 18519 - RNA, 19 nt, Homo sapiens
gaaacucgaugaauguguu

SEQ ID NO: 18520 - RNA, 19 nt, Homo sapiens
gaacaccaauauuacaguu

SEQ ID NO: 18521 - RNA, 19 nt, Homo sapiens
gaaagaaggagcaagagaa

SEQ ID NO: 18522 - RNA, 19 nt, Homo sapiens
gaauaccgcuggcccuuug

SEQ ID NO: 18523 - RNA, 19 nt, Homo sapiens
ccaaagggcaguaaaguuu

SEQ ID NO: 18524 - RNA, 19 nt, Homo sapiens
gcucagaggagguguauuu

SEQ ID NO: 18525 - RNA, 19 nt, Homo sapiens
gaugagaguuccagauugu

SEQ ID NO: 18526 - RNA, 19 nt, Homo sapiens
acucaaaccuuucaacaaa

SEQ ID NO: 18527 - RNA, 19 nt, Homo sapiens
caagaagccugcaccaugu

SEQ ID NO: 18528 - RNA, 19 nt, Homo sapiens
gaagaacaaugucagaaac

SEQ ID NO: 18529 - RNA, 19 nt, Homo sapiens
gaacaaaccaagaaaugau

SEQ ID NO: 18530 - RNA, 19 nt, Homo sapiens
cuaaacugcuguuaauuga

SEQ ID NO: 18531 - RNA, 19 nt, Homo sapiens
gaugacggcugcucgaaga

SEQ ID NO: 18532 - RNA, 19 nt, Homo sapiens
gaaaaugaaucacaaguca

SEQ ID NO: 18533 - RNA, 19 nt, Homo sapiens
guaguguccuccuaguaua

SEQ ID NO: 18534 - RNA, 19 nt, Homo sapiens
gaaagucggcaccagauga

SEQ ID NO: 18535 - RNA, 19 nt, Homo sapiens
gagaugagaguuccagauu

SEQ ID NO: 18536 - RNA, 19 nt, Homo sapiens
auacgugacuguagaauug

SEQ ID NO: 18537 - RNA, 19 nt, Homo sapiens
guucgaaaccuguccauaa

SEQ ID NO: 18538 - RNA, 19 nt, Homo sapiens
caucauacgugacuguaga

SEQ ID NO: 18539 - RNA, 19 nt, Homo sapiens
cgaugaauguguugauuug

SEQ ID NO: 18540 - RNA, 19 nt, Homo sapiens
gaggagguguauuugauau

SEQ ID NO: 18541 - RNA, 19 nt, Homo sapiens
aaauucaaccugugucuua

SEQ ID NO: 18542 - RNA, 19 nt, Homo sapiens
ggagguguauuugauauag

SEQ ID NO: 18543 - RNA, 19 nt, Homo sapiens
aaguaugccuuccuguuua

SEQ ID NO: 18544 - RNA, 19 nt, Homo sapiens
uauacuggguuuccuguuu

SEQ ID NO: 18545 - RNA, 19 nt, Homo sapiens
gcuauaauccaucgaaaug

SEQ ID NO: 18546 - RNA, 19 nt, Homo sapiens
ccaagaugauugucccaaa

SEQ ID NO: 18547 - RNA, 19 nt, Homo sapiens
cagaggagguguauuugau

SEQ ID NO: 18548 - RNA, 19 nt, Homo sapiens
ucucuaaacugcuguuaau

SEQ ID NO: 18549 - RNA, 19 nt, Homo sapiens
gucagaaacucgaugaaug

SEQ ID NO: 18550 - RNA, 19 nt, Homo sapiens
gaagaacaaaccaagaaau

SEQ ID NO: 18551 - RNA, 19 nt, Homo sapiens
aaagucaccugcaucauca

SEQ ID NO: 18552 - RNA, 19 nt, Homo sapiens
ggugauagucauuuacuuu

SEQ ID NO: 18553 - RNA, 19 nt, Homo sapiens
ugucaugauuccuacuuua

SEQ ID NO: 18554 - RNA, 19 nt, Homo sapiens
gcuaguguguuucuacuca

SEQ ID NO: 18555 - RNA, 19 nt, Homo sapiens
uggaaggcauaauuacaua

SEQ ID NO: 18556 - RNA, 19 nt, Homo sapiens
cgaaaccuguccauaaagu

SEQ ID NO: 18557 - RNA, 19 nt, Homo sapiens
gagguugagugacauguuc

SEQ ID NO: 18558 - RNA, 19 nt, Homo sapiens
ucacgugucucagcauuga

SEQ ID NO: 18559 - RNA, 19 nt, Homo sapiens
ccuguacgcuaguguguuu

SEQ ID NO: 18560 - RNA, 19 nt, Homo sapiens
guacaaagauaugcuaagc

SEQ ID NO: 18561 - RNA, 19 nt, Homo sapiens
cuaaagaaggcuuaugaaa

SEQ ID NO: 18562 - RNA, 19 nt, Homo sapiens
acaccaauauuacaguuug

SEQ ID NO: 18563 - RNA, 19 nt, Homo sapiens
aaaguaugccuuccuguuu

SEQ ID NO: 18564 - RNA, 19 nt, Homo sapiens
aaacaaugcccguaagaug

SEQ ID NO: 18565 - RNA, 19 nt, Homo sapiens
cgaagaacaaugucagaaa

SEQ ID NO: 18566 - RNA, 19 nt, Homo sapiens
gaaaccuguccauaaagua

SEQ ID NO: 18567 - RNA, 19 nt, Homo sapiens
cagaagaacaaaccaagaa

SEQ ID NO: 18568 - RNA, 19 nt, Homo sapiens
ucucaacucuucuacugaa

SEQ ID NO: 18569 - RNA, 19 nt, Homo sapiens
ggccaugccuaucaccauu

SEQ ID NO: 18570 - RNA, 19 nt, Homo sapiens
caaagucaccugcaucauc

SEQ ID NO: 18571 - RNA, 19 nt, Homo sapiens
ucaccugcaucaucauuug

SEQ ID NO: 18572 - RNA, 19 nt, Homo sapiens
cuacacagcuauggaauac

SEQ ID NO: 18573 - RNA, 19 nt, Homo sapiens
uuacugacuuugccacuau

SEQ ID NO: 18574 - RNA, 19 nt, Homo sapiens
caagaugauugucccaaag

SEQ ID NO: 18575 - RNA, 19 nt, Homo sapiens
uaaaguaugccuuccuguu

SEQ ID NO: 18576 - RNA, 19 nt, Homo sapiens
caacugugcuacacuugca

SEQ ID NO: 18577 - RNA, 19 nt, Homo sapiens
ugaauguguugauuugaga

SEQ ID NO: 18578 - RNA, 19 nt, Homo sapiens
auaugaagcugaagacugu

SEQ ID NO: 18579 - RNA, 19 nt, Homo sapiens
aaaccuguccauaaaguaa

SEQ ID NO: 18580 - RNA, 19 nt, Homo sapiens
caacaggagaugagaguuc

SEQ ID NO: 18581 - RNA, 19 nt, Homo sapiens
gcaacaagacaaagcaaag

SEQ ID NO: 18582 - RNA, 19 nt, Homo sapiens
agauuguucuguccaguuu

SEQ ID NO: 18583 - RNA, 19 nt, Homo sapiens
uucgaaaccuguccauaaa

SEQ ID NO: 18584 - RNA, 19 nt, Homo sapiens
gaaacagcuugguggugau

SEQ ID NO: 18585 - RNA, 19 nt, Homo sapiens
ucuaaacugcuguuaauug

SEQ ID NO: 18586 - RNA, 19 nt, Homo sapiens
acaaagcaaagccacauuu

SEQ ID NO: 18587 - RNA, 19 nt, Homo sapiens
aaauucaacccuuccgaua

SEQ ID NO: 18588 - RNA, 19 nt, Homo sapiens
aagcuggaaggcauaauua

SEQ ID NO: 18589 - RNA, 19 nt, Homo sapiens
aaaugauucucaacucuuc

SEQ ID NO: 18590 - RNA, 19 nt, Homo sapiens
cagcuauaauccaucgaaa

SEQ ID NO: 18591 - RNA, 19 nt, Homo sapiens
ucagaaacucgaugaaugu

SEQ ID NO: 18592 - RNA, 19 nt, Homo sapiens
gaucgauaccuggcuauug

SEQ ID NO: 18593 - RNA, 19 nt, Homo sapiens
caugauuccuacuuuauac

SEQ ID NO: 18594 - RNA, 19 nt, Homo sapiens
ucugagaaguguauauagu

SEQ ID NO: 18595 - RNA, 19 nt, Homo sapiens
guaagcucauccaccaaga

SEQ ID NO: 18596 - RNA, 19 nt, Homo sapiens
caguuugugcuuuccauua

SEQ ID NO: 18597 - RNA, 19 nt, Homo sapiens
gcuggcccuuuggcaauua

SEQ ID NO: 18598 - RNA, 19 nt, Homo sapiens
ggaauaccgcuggcccuuu

SEQ ID NO: 18599 - RNA, 19 nt, Homo sapiens
gagaaguguauauaguuug

SEQ ID NO: 18600 - RNA, 19 nt, Homo sapiens
gaaauucaaccugugucuu

SEQ ID NO: 18601 - RNA, 19 nt, Homo sapiens
aagcaguagucgucaaguu

SEQ ID NO: 18602 - RNA, 19 nt, Homo sapiens
gcuaagcaguagucgucaa

SEQ ID NO: 18603 - RNA, 19 nt, Homo sapiens
gaaggagcaagagaacauu

SEQ ID NO: 18604 - RNA, 19 nt, Homo sapiens
ugagugacauguucgaaac

SEQ ID NO: 18605 - RNA, 19 nt, Homo sapiens
aaaucccacucaaaccuuu

SEQ ID NO: 18606 - RNA, 19 nt, Homo sapiens
gcaauugugcuuuucuuuu

SEQ ID NO: 18607 - RNA, 19 nt, Homo sapiens
aagaacaaaccaagaaaug

SEQ ID NO: 18608 - RNA, 19 nt, Homo sapiens
caaauucgacccaggugau

SEQ ID NO: 18609 - RNA, 19 nt, Homo sapiens
acuaugggcugucuacaca

SEQ ID NO: 18610 - RNA, 19 nt, Homo sapiens
aaagccacauuuugcauua

SEQ ID NO: 18611 - RNA, 19 nt, Homo sapiens
ggaaggcauaauuacauau

SEQ ID NO: 18612 - RNA, 19 nt, Homo sapiens
cuaaagcucugaacaaaag

SEQ ID NO: 18613 - RNA, 19 nt, Homo sapiens
aguaugccuuccuguuuaa

SEQ ID NO: 18614 - RNA, 19 nt, Homo sapiens
guguauauaguuuguggua

SEQ ID NO: 18615 - RNA, 19 nt, Homo sapiens
guaguaguguccuccuagu

SEQ ID NO: 18616 - RNA, 19 nt, Homo sapiens
agaugagaguuccagauug

SEQ ID NO: 18617 - RNA, 19 nt, Homo sapiens
gcacuucacuaccaaauga

SEQ ID NO: 18618 - RNA, 19 nt, Homo sapiens
gcacuggucccaaguagua

SEQ ID NO: 18619 - RNA, 19 nt, Homo sapiens
gaaacucgaugaauguguu

SEQ ID NO: 18620 - RNA, 19 nt, Homo sapiens
gaacaccaauauuacaguu

SEQ ID NO: 18621 - RNA, 19 nt, Homo sapiens
gaaagaaggagcaagagaa

SEQ ID NO: 18622 - RNA, 19 nt, Homo sapiens
gaauaccgcuggcccuuug

SEQ ID NO: 18623 - RNA, 19 nt, Homo sapiens
ccaaagggcaguaaaguuu

SEQ ID NO: 18624 - RNA, 19 nt, Homo sapiens
gaugagaguuccagauugu

SEQ ID NO: 18625 - RNA, 19 nt, Homo sapiens
acucaaaccuuucaacaaa

SEQ ID NO: 18626 - RNA, 19 nt, Homo sapiens
caagaagccugcaccaugu

SEQ ID NO: 18627 - RNA, 19 nt, Homo sapiens
gaagaacaaugucagaaac

SEQ ID NO: 18628 - RNA, 19 nt, Homo sapiens
gaacaaaccaagaaaugau

SEQ ID NO: 18629 - RNA, 19 nt, Homo sapiens
cuaaacugcuguuaauuga

SEQ ID NO: 18630 - RNA, 19 nt, Homo sapiens
gaugacggcugcucgaaga

SEQ ID NO: 18631 - RNA, 19 nt, Homo sapiens
guaguguccuccuaguaua

SEQ ID NO: 18632 - RNA, 19 nt, Homo sapiens
gagaugagaguuccagauu

SEQ ID NO: 18633 - RNA, 19 nt, Homo sapiens
auacgugacuguagaauug

SEQ ID NO: 18634 - RNA, 19 nt, Homo sapiens
guucgaaaccuguccauaa

SEQ ID NO: 18635 - RNA, 19 nt, Homo sapiens
caucauacgugacuguaga

SEQ ID NO: 18636 - RNA, 19 nt, Homo sapiens
cgaugaauguguugauuug

SEQ ID NO: 18637 - RNA, 19 nt, Homo sapiens
aaauucaaccugugucuua

SEQ ID NO: 18638 - RNA, 19 nt, Homo sapiens
aaguaugccuuccuguuua

SEQ ID NO: 18639 - RNA, 19 nt, Homo sapiens
uauacuggguuuccuguuu

SEQ ID NO: 18640 - RNA, 19 nt, Homo sapiens
gcuauaauccaucgaaaug

SEQ ID NO: 18641 - RNA, 19 nt, Homo sapiens
ccaagaugauugucccaaa

SEQ ID NO: 18642 - RNA, 19 nt, Homo sapiens
ucucuaaacugcuguuaau

SEQ ID NO: 18643 - RNA, 19 nt, Homo sapiens
gucagaaacucgaugaaug

SEQ ID NO: 18644 - RNA, 19 nt, Homo sapiens
gaagaacaaaccaagaaau

SEQ ID NO: 18645 - RNA, 19 nt, Homo sapiens
aaagucaccugcaucauca

SEQ ID NO: 18646 - RNA, 19 nt, Homo sapiens
ggugauagucauuuacuuu

SEQ ID NO: 18647 - RNA, 19 nt, Homo sapiens
ugucaugauuccuacuuua

SEQ ID NO: 18648 - RNA, 19 nt, Homo sapiens
gcuaguguguuucuacuca

SEQ ID NO: 18649 - RNA, 19 nt, Homo sapiens
uggaaggcauaauuacaua

SEQ ID NO: 18650 - RNA, 19 nt, Homo sapiens
cgaaaccuguccauaaagu

SEQ ID NO: 18651 - RNA, 19 nt, Homo sapiens
gagguugagugacauguuc

SEQ ID NO: 18652 - RNA, 19 nt, Homo sapiens
ucacgugucucagcauuga

SEQ ID NO: 18653 - RNA, 19 nt, Homo sapiens
ccuguacgcuaguguguuu

SEQ ID NO: 18654 - RNA, 19 nt, Homo sapiens
guacaaagauaugcuaagc

SEQ ID NO: 18655 - RNA, 19 nt, Homo sapiens
cuaaagaaggcuuaugaaa

SEQ ID NO: 18656 - RNA, 19 nt, Homo sapiens
acaccaauauuacaguuug

SEQ ID NO: 18657 - RNA, 19 nt, Homo sapiens
aaaguaugccuuccuguuu

SEQ ID NO: 18658 - RNA, 19 nt, Homo sapiens
aaacaaugcccguaagaug

SEQ ID NO: 18659 - RNA, 19 nt, Homo sapiens
cgaagaacaaugucagaaa

SEQ ID NO: 18660 - RNA, 19 nt, Homo sapiens
gaaaccuguccauaaagua

SEQ ID NO: 18661 - RNA, 19 nt, Homo sapiens
cagcaccacugcccaccua

SEQ ID NO: 18662 - RNA, 19 nt, Homo sapiens
cagaagaacaaaccaagaa

SEQ ID NO: 18663 - RNA, 19 nt, Homo sapiens
ucucaacucuucuacugaa

SEQ ID NO: 18664 - RNA, 19 nt, Homo sapiens
ggccaugccuaucaccauu

SEQ ID NO: 18665 - RNA, 19 nt, Homo sapiens
caaagucaccugcaucauc

SEQ ID NO: 18666 - RNA, 19 nt, Homo sapiens
ucaccugcaucaucauuug

SEQ ID NO: 18667 - RNA, 19 nt, Homo sapiens
cuacacagcuauggaauac

SEQ ID NO: 18668 - RNA, 19 nt, Homo sapiens
uuacugacuuugccacuau

SEQ ID NO: 18669 - RNA, 19 nt, Homo sapiens
caagaugauugucccaaag

SEQ ID NO: 18670 - RNA, 19 nt, Homo sapiens
uaaaguaugccuuccuguu

SEQ ID NO: 18671 - RNA, 19 nt, Homo sapiens
caacugugcuacacuugca

SEQ ID NO: 18672 - RNA, 19 nt, Homo sapiens
ugaauguguugauuugaga

SEQ ID NO: 18673 - RNA, 19 nt, Homo sapiens
auaugaagcugaagacugu

SEQ ID NO: 18674 - RNA, 19 nt, Homo sapiens
aaaccuguccauaaaguaa

SEQ ID NO: 18675 - RNA, 19 nt, Homo sapiens
caacaggagaugagaguuc

SEQ ID NO: 18676 - RNA, 19 nt, Homo sapiens
gcaacaagacaaagcaaag

SEQ ID NO: 18677 - RNA, 19 nt, Homo sapiens
gcucagccauguucaucug

SEQ ID NO: 18678 - RNA, 19 nt, Homo sapiens
agauuguucuguccaguuu

SEQ ID NO: 18679 - RNA, 19 nt, Homo sapiens
uucgaaaccuguccauaaa

SEQ ID NO: 18680 - RNA, 19 nt, Homo sapiens
gaaacagcuugguggugau

SEQ ID NO: 18681 - RNA, 19 nt, Homo sapiens
ucuaaacugcuguuaauug

SEQ ID NO: 18682 - RNA, 19 nt, Homo sapiens
acaaagcaaagccacauuu

SEQ ID NO: 18683 - RNA, 19 nt, Homo sapiens
aaauucaacccuuccgaua

SEQ ID NO: 18684 - RNA, 19 nt, Homo sapiens
aagcuggaaggcauaauua

SEQ ID NO: 18685 - RNA, 19 nt, Homo sapiens
ggcaugccauugcaagaga

SEQ ID NO: 18686 - RNA, 19 nt, Homo sapiens
cagcuauaauccaucgaaa

SEQ ID NO: 18687 - RNA, 19 nt, Homo sapiens
aaaugauucucaacucuuc

SEQ ID NO: 18688 - RNA, 19 nt, Homo sapiens
ucagaaacucgaugaaugu

SEQ ID NO: 18689 - RNA, 19 nt, Homo sapiens
cacauucgguguauuugau

SEQ ID NO: 18690 - RNA, 19 nt, Homo sapiens
gaucgauaccuggcuauug

SEQ ID NO: 18691 - RNA, 19 nt, Homo sapiens
caugauuccuacuuuauac

SEQ ID NO: 18692 - RNA, 19 nt, Homo sapiens
ucugagaaguguauauagu

SEQ ID NO: 18693 - RNA, 19 nt, Homo sapiens
guaagcucauccaccaaga

SEQ ID NO: 18694 - RNA, 19 nt, Homo sapiens
caguuugugcuuuccauua

SEQ ID NO: 18695 - RNA, 19 nt, Homo sapiens
gcuggcccuuuggcaauua

SEQ ID NO: 18696 - RNA, 19 nt, Homo sapiens
ggaauaccgcuggcccuuu

SEQ ID NO: 18697 - RNA, 19 nt, Homo sapiens
gagaaguguauauaguuug

SEQ ID NO: 18698 - RNA, 19 nt, Homo sapiens
gaaauucaaccugugucuu

SEQ ID NO: 18699 - RNA, 19 nt, Homo sapiens
aagcaguagucgucaaguu

SEQ ID NO: 18700 - RNA, 19 nt, Homo sapiens
gcuaagcaguagucgucaa

SEQ ID NO: 18701 - RNA, 19 nt, Homo sapiens
gaaggagcaagagaacauu

SEQ ID NO: 18702 - RNA, 19 nt, Homo sapiens
ugagugacauguucgaaac

SEQ ID NO: 18703 - RNA, 19 nt, Homo sapiens
aaaucccacucaaaccuuu

SEQ ID NO: 18704 - RNA, 19 nt, Homo sapiens
gcaauugugcuuuucuuuu

SEQ ID NO: 18705 - RNA, 19 nt, Homo sapiens
aagaacaaaccaagaaaug

SEQ ID NO: 18706 - RNA, 19 nt, Homo sapiens
caaauucgacccaggugau

SEQ ID NO: 18707 - RNA, 19 nt, Homo sapiens
gaccuucaccucagagugu

SEQ ID NO: 18708 - RNA, 19 nt, Homo sapiens
acuaugggcugucuacaca

SEQ ID NO: 18709 - RNA, 19 nt, Homo sapiens
guagagcaauaggaucugu

SEQ ID NO: 18710 - RNA, 19 nt, Homo sapiens
aaagccacauuuugcauua

SEQ ID NO: 18711 - RNA, 19 nt, Homo sapiens
cuaaagcucugaacaaaag

SEQ ID NO: 18712 - RNA, 19 nt, Homo sapiens
ggaaggcauaauuacauau

SEQ ID NO: 18713 - RNA, 19 nt, Homo sapiens
aguaugccuuccuguuuaa

SEQ ID NO: 18714 - RNA, 19 nt, Homo sapiens
guguauauaguuuguggua

SEQ ID NO: 18715 - RNA, 19 nt, Homo sapiens
guaguaguguccuccuagu

SEQ ID NO: 18716 - RNA, 19 nt, Homo sapiens
agaugagaguuccagauug

SEQ ID NO: 18717 - RNA, 19 nt, Homo sapiens
gcaagcaucuuauauaguu

SEQ ID NO: 18718 - RNA, 19 nt, Homo sapiens
gaacaucucuggcaacaau

SEQ ID NO: 18719 - RNA, 19 nt, Homo sapiens
gaguggagguuuauaguua

SEQ ID NO: 18720 - RNA, 19 nt, Homo sapiens
caacauggcuacuugcuuu

SEQ ID NO: 18721 - RNA, 19 nt, Homo sapiens
uaagcaagcugauuuauga

SEQ ID NO: 18722 - RNA, 19 nt, Homo sapiens
agaaguaacuggugauaua

SEQ ID NO: 18723 - RNA, 19 nt, Homo sapiens
gaauagggcuaggaauaua

SEQ ID NO: 18724 - RNA, 19 nt, Homo sapiens
gcacagaauucaaagcauu

SEQ ID NO: 18725 - RNA, 19 nt, Homo sapiens
ggugauauaucucaaauug

SEQ ID NO: 18726 - RNA, 19 nt, Homo sapiens
gaacauguuugcaagcauu

SEQ ID NO: 18727 - RNA, 19 nt, Homo sapiens
gaaccagucuuucaacuca

SEQ ID NO: 18728 - RNA, 19 nt, Homo sapiens
aaagagacccagucaauua

SEQ ID NO: 18729 - RNA, 19 nt, Homo sapiens
gaaaugguauccagaaugg

SEQ ID NO: 18730 - RNA, 19 nt, Homo sapiens
gcacuaagcaagcugauuu

SEQ ID NO: 18731 - RNA, 19 nt, Homo sapiens
gauaacugcuuuaaacuuc

SEQ ID NO: 18732 - RNA, 19 nt, Homo sapiens
gcaaagagacccagucaau

SEQ ID NO: 18733 - RNA, 19 nt, Homo sapiens
gaaaccaaauguaacuaug

SEQ ID NO: 18734 - RNA, 19 nt, Homo sapiens
auuaauagcugcgaaguua

SEQ ID NO: 18735 - RNA, 19 nt, Homo sapiens
ucacagaaaccaucagaua

SEQ ID NO: 18736 - RNA, 19 nt, Homo sapiens
uagaugugcugcuuugaua

SEQ ID NO: 18737 - RNA, 19 nt, Homo sapiens
gaaagcaagauguacuaua

SEQ ID NO: 18738 - RNA, 19 nt, Homo sapiens
guucuggccuucaucauuu

SEQ ID NO: 18739 - RNA, 19 nt, Homo sapiens
ggauucagauuucucuuug

SEQ ID NO: 18740 - RNA, 19 nt, Homo sapiens
cagaaccauugaauacuua

SEQ ID NO: 18741 - RNA, 19 nt, Homo sapiens
gcaugaguguugauaggua

SEQ ID NO: 18742 - RNA, 19 nt, Homo sapiens
gauuaguacuggauuauuc

SEQ ID NO: 18743 - RNA, 19 nt, Homo sapiens
uaagagagaugagcacuuc

SEQ ID NO: 18744 - RNA, 19 nt, Homo sapiens
gggcuaggaauauagauua

SEQ ID NO: 18745 - RNA, 19 nt, Homo sapiens
guaccaaucugucaucuac

SEQ ID NO: 18746 - RNA, 19 nt, Homo sapiens
gaaaagcaguucucuuaga

SEQ ID NO: 18747 - RNA, 19 nt, Homo sapiens
gaguaugucuugccggaaa

SEQ ID NO: 18748 - RNA, 19 nt, Homo sapiens
acuaggagcugcugacauu

SEQ ID NO: 18749 - RNA, 19 nt, Homo sapiens
caacucauugcaucauuua

SEQ ID NO: 18750 - RNA, 19 nt, Homo sapiens
gaaaccgguuccaacagaa

SEQ ID NO: 18751 - RNA, 19 nt, Homo sapiens
ggaugggugucauuaauag

SEQ ID NO: 18752 - RNA, 19 nt, Homo sapiens
ugagaaauaugcccaaugg

SEQ ID NO: 18753 - RNA, 19 nt, Homo sapiens
ccagugacuuucaggaauu

SEQ ID NO: 18754 - RNA, 19 nt, Homo sapiens
guuaauccguuucuguauu

SEQ ID NO: 18755 - RNA, 19 nt, Homo sapiens
ucagaaccauugaauacuu

SEQ ID NO: 18756 - RNA, 19 nt, Homo sapiens
gaugugcugcuuugauaua

SEQ ID NO: 18757 - RNA, 19 nt, Homo sapiens
uuaggcauaugcuucuuua

SEQ ID NO: 18758 - RNA, 19 nt, Homo sapiens
ccugugaugugcaaaguuu

SEQ ID NO: 18759 - RNA, 19 nt, Homo sapiens
ggaaaugguauccagaaug

SEQ ID NO: 18760 - RNA, 19 nt, Homo sapiens
ucacuaaacucugaauaag

SEQ ID NO: 18761 - RNA, 19 nt, Homo sapiens
gggcaaccuauuauucuua

SEQ ID NO: 18762 - RNA, 19 nt, Homo sapiens
guucuggguuguuuccuaa

SEQ ID NO: 18763 - RNA, 19 nt, Homo sapiens
gaaguuauagcagucauug

SEQ ID NO: 18764 - RNA, 19 nt, Homo sapiens
uaauagcugcgaaguuaua

SEQ ID NO: 18765 - RNA, 19 nt, Homo sapiens
gcaguacaaugugacuuug

SEQ ID NO: 18766 - RNA, 19 nt, Homo sapiens
ucaacucauugcaucauuu

SEQ ID NO: 18767 - RNA, 19 nt, Homo sapiens
uaaucaacauggcuacuug

SEQ ID NO: 18768 - RNA, 19 nt, Homo sapiens
guguuuaggguuccaauua

SEQ ID NO: 18769 - RNA, 19 nt, Homo sapiens
caaagagacccagucaauu

SEQ ID NO: 18770 - RNA, 19 nt, Homo sapiens
gaaauggagaccuuugugu

SEQ ID NO: 18771 - RNA, 19 nt, Homo sapiens
gcauauacaucuucaaccu

SEQ ID NO: 18772 - RNA, 19 nt, Homo sapiens
gaacgaguaagcacagaau

SEQ ID NO: 18773 - RNA, 19 nt, Homo sapiens
uuaauccguuucuguauug

SEQ ID NO: 18774 - RNA, 19 nt, Homo sapiens
cagcugggauugccuuaau

SEQ ID NO: 18775 - RNA, 19 nt, Homo sapiens
gagucuaccuugaacuguu

SEQ ID NO: 18776 - RNA, 19 nt, Homo sapiens
gaaguaacuggugauauau

SEQ ID NO: 18777 - RNA, 19 nt, Homo sapiens
gauaacccgugaccaaguc

SEQ ID NO: 18778 - RNA, 19 nt, Homo sapiens
uauucaggcuuuaggcaua

SEQ ID NO: 18779 - RNA, 19 nt, Homo sapiens
gagagaugagcacuucuaa

SEQ ID NO: 18780 - RNA, 19 nt, Homo sapiens
ugaaucuucugaaaccaaa

SEQ ID NO: 18781 - RNA, 19 nt, Homo sapiens
uggcaagcaucuuauauag

SEQ ID NO: 18782 - RNA, 19 nt, Homo sapiens
cacagaaaccaucagauaa

SEQ ID NO: 18783 - RNA, 19 nt, Homo sapiens
cccagucaauuacauguuu

SEQ ID NO: 18784 - RNA, 19 nt, Homo sapiens
ccuaugcuuuagcuuauuu

SEQ ID NO: 18785 - RNA, 19 nt, Homo sapiens
uuagagaaauggagaccuu

SEQ ID NO: 18786 - RNA, 19 nt, Homo sapiens
gggauugccuuaaugaaaa

SEQ ID NO: 18787 - RNA, 19 nt, Homo sapiens
agauaugacuggcucuuug

SEQ ID NO: 18788 - RNA, 19 nt, Homo sapiens
gaugcaauuccuauucuuu

SEQ ID NO: 18789 - RNA, 19 nt, Homo sapiens
ggcaaccuauuauucuuau

SEQ ID NO: 18790 - RNA, 19 nt, Homo sapiens
acuaaacucugaauaagca

SEQ ID NO: 18791 - RNA, 19 nt, Homo sapiens
ggcuaggaauauagauuaa

SEQ ID NO: 18792 - RNA, 19 nt, Homo sapiens
cggaaaagcaguucucuua

SEQ ID NO: 18793 - RNA, 19 nt, Homo sapiens
agaaaucccuggcaagcau

SEQ ID NO: 18794 - RNA, 19 nt, Homo sapiens
ggauuucuggucaauauug

SEQ ID NO: 18795 - RNA, 19 nt, Homo sapiens
caucagauaagcauuuaga

SEQ ID NO: 18796 - RNA, 19 nt, Homo sapiens
ggagguuuauaguuaaucu

SEQ ID NO: 18797 - RNA, 19 nt, Homo sapiens
gggauucagauuucucuuu

SEQ ID NO: 18798 - RNA, 19 nt, Homo sapiens
gcguuaauccguuucugua

SEQ ID NO: 18799 - RNA, 19 nt, Homo sapiens
uugaauagggcuaggaaua

SEQ ID NO: 18800 - RNA, 19 nt, Homo sapiens
ggcauaugcuucuuuaaaa

SEQ ID NO: 18801 - RNA, 19 nt, Homo sapiens
gagacauauuuacaaccua

SEQ ID NO: 18802 - RNA, 19 nt, Homo sapiens
cagcugcguuaauccguuu

SEQ ID NO: 18803 - RNA, 19 nt, Homo sapiens
acgaauagcuaugggaaga

SEQ ID NO: 18804 - RNA, 19 nt, Homo sapiens
uaccagcggucuucacuuc

SEQ ID NO: 18805 - RNA, 19 nt, Homo sapiens
ggucaauauugucgugguu

SEQ ID NO: 18806 - RNA, 19 nt, Homo sapiens
gugcugcuuugauauauag

SEQ ID NO: 18807 - RNA, 19 nt, Homo sapiens
ccucuugcauuucacuuga

SEQ ID NO: 18808 - RNA, 19 nt, Homo sapiens
ggugagacauauuuacaac

SEQ ID NO: 18809 - RNA, 19 nt, Homo sapiens
gaagcuccgcaguguguuu

SEQ ID NO: 18810 - RNA, 19 nt, Homo sapiens
agaaaacacuuacugaaga

SEQ ID NO: 18811 - RNA, 19 nt, Homo sapiens
cugcugacauuucaauaug

SEQ ID NO: 18812 - RNA, 19 nt, Homo sapiens
uaaaccaauugcaggucua

SEQ ID NO: 18813 - RNA, 19 nt, Homo sapiens
ggcaguacaaugugacuuu

SEQ ID NO: 18814 - RNA, 19 nt, Homo sapiens
cuucugaaaccaaauguaa

SEQ ID NO: 18815 - RNA, 19 nt, Homo sapiens
gaauagcuaugggaagaac

SEQ ID NO: 18816 - RNA, 19 nt, Homo sapiens
gaaaccaucagauaagcau

SEQ ID NO: 18817 - RNA, 19 nt, Homo sapiens
gcugauaucuucauugcua

SEQ ID NO: 18818 - RNA, 19 nt, Homo sapiens
gagaacagaugcacgagaa

SEQ ID NO: 18819 - RNA, 19 nt, Homo sapiens
gcacuggcccugugacuuu

SEQ ID NO: 18820 - RNA, 19 nt, Homo sapiens
gcgcucagcugauaucuuc

SEQ ID NO: 18821 - RNA, 19 nt, Homo sapiens
ggaggaagguggugauuuu

SEQ ID NO: 18822 - RNA, 19 nt, Homo sapiens
ccaucaugcugaccuguua

SEQ ID NO: 18823 - RNA, 19 nt, Homo sapiens
gaacagaugcacgagaaau

SEQ ID NO: 18824 - RNA, 19 nt, Homo sapiens
aagaggcgcucagcugaua

SEQ ID NO: 18825 - RNA, 19 nt, Homo sapiens
gacuaugacuggcccuuug

SEQ ID NO: 18826 - RNA, 19 nt, Homo sapiens
acacguaccgggacuauga

SEQ ID NO: 18827 - RNA, 19 nt, Homo sapiens
gaagucagccagcuacucu

SEQ ID NO: 18828 - RNA, 19 nt, Homo sapiens
gcagcuaccucaucuucgu

SEQ ID NO: 18829 - RNA, 19 nt, Homo sapiens
aaccaucgcuggccacuuc

SEQ ID NO: 18830 - RNA, 19 nt, Homo sapiens
gggcaaggguggagaacag

SEQ ID NO: 18831 - RNA, 19 nt, Homo sapiens
ugaagacgcuguacaugcu

SEQ ID NO: 18832 - RNA, 19 nt, Homo sapiens
gcugaccuguuacuucuuc

SEQ ID NO: 18833 - RNA, 19 nt, Homo sapiens
cagcugauaucuucauugc

SEQ ID NO: 18834 - RNA, 19 nt, Homo sapiens
ccucaucccugccaucuac

SEQ ID NO: 18835 - RNA, 19 nt, Homo sapiens
ggacuaugacuggcccuuu

SEQ ID NO: 18836 - RNA, 19 nt, Homo sapiens
gaagaggcgcucagcugau

SEQ ID NO: 18837 - RNA, 19 nt, Homo sapiens
aggagacccuugugguuga

SEQ ID NO: 18838 - RNA, 19 nt, Homo sapiens
ccaggagacccuugugguu

SEQ ID NO: 18839 - RNA, 19 nt, Homo sapiens
gggagaagucagccagcua

SEQ ID NO: 18840 - RNA, 19 nt, Homo sapiens
uuugaccucuuccucauga

SEQ ID NO: 18841 - RNA, 19 nt, Homo sapiens
cagcagcuaccucaucuuc

SEQ ID NO: 18842 - RNA, 19 nt, Homo sapiens
gcucagcagcuaccucauc

SEQ ID NO: 18843 - RNA, 19 nt, Homo sapiens
ugaguacacagacuggaaa

SEQ ID NO: 18844 - RNA, 19 nt, Homo sapiens
ccaucuacauguuggucuu

SEQ ID NO: 18845 - RNA, 19 nt, Homo sapiens
ucaucuucgucaacaugua

SEQ ID NO: 18846 - RNA, 19 nt, Homo sapiens
guacacagacuggaaaucc

SEQ ID NO: 18847 - RNA, 19 nt, Homo sapiens
gcaccugcaucagcuacgu

SEQ ID NO: 18848 - RNA, 19 nt, Homo sapiens
gugaguacacagacuggaa

SEQ ID NO: 18849 - RNA, 19 nt, Homo sapiens
caaggguggagaacagaug

SEQ ID NO: 18850 - RNA, 19 nt, Homo sapiens
uaaggugcagugcuacaug

SEQ ID NO: 18851 - RNA, 19 nt, Homo sapiens
acaaccagucugaguguga

SEQ ID NO: 18852 - RNA, 19 nt, Homo sapiens
uggcugaccugaccuucgu

SEQ ID NO: 18853 - RNA, 19 nt, Homo sapiens
gcaaggguggagaacagau

SEQ ID NO: 18854 - RNA, 19 nt, Homo sapiens
uaccucaucuucgucaaca

SEQ ID NO: 18855 - RNA, 19 nt, Homo sapiens
guggugauuuugacaacua

SEQ ID NO: 18856 - RNA, 19 nt, Homo sapiens
ucccugccaucuacauguu

SEQ ID NO: 18857 - RNA, 19 nt, Homo sapiens
ggugaagacgcuguacaug

SEQ ID NO: 18858 - RNA, 19 nt, Homo sapiens
caugcugaccuguuacuuc

SEQ ID NO: 18859 - RNA, 19 nt, Homo sapiens
ggagaaagcugaugggaaa

SEQ ID NO: 18860 - RNA, 19 nt, Homo sapiens
ggaagaagcuuaugaaacu

SEQ ID NO: 18861 - RNA, 19 nt, Homo sapiens
ggacagggcugcuuguuca

SEQ ID NO: 18862 - RNA, 19 nt, Homo sapiens
ucaauaagauucagaggaa

SEQ ID NO: 18863 - RNA, 19 nt, Homo sapiens
ggaacucuaucaagccaua

SEQ ID NO: 18864 - RNA, 19 nt, Homo sapiens
caacuuggcuucugaggau

SEQ ID NO: 18865 - RNA, 19 nt, Homo sapiens
ccacaugucucaccaggaa

SEQ ID NO: 18866 - RNA, 19 nt, Homo sapiens
gaaaauuagugacugguua

SEQ ID NO: 18867 - RNA, 19 nt, Homo sapiens
ggaggaggguggaggcuaa

SEQ ID NO: 18868 - RNA, 19 nt, Homo sapiens
gagggaagaccacacaaua

SEQ ID NO: 18869 - RNA, 19 nt, Homo sapiens
ucaaaucacuuucacaaca

SEQ ID NO: 18870 - RNA, 19 nt, Homo sapiens
ggaagucauucaaguuguu

SEQ ID NO: 18871 - RNA, 19 nt, Homo sapiens
ccaccuggcuuuacaaauc

SEQ ID NO: 18872 - RNA, 19 nt, Homo sapiens
ggagagaggcccagaggaa

SEQ ID NO: 18873 - RNA, 19 nt, Homo sapiens
cuauaaagcuggugguuuc

SEQ ID NO: 18874 - RNA, 19 nt, Homo sapiens
gcagagagaggcagaugaa

SEQ ID NO: 18875 - RNA, 19 nt, Homo sapiens
gcacagcccagagccaaua

SEQ ID NO: 18876 - RNA, 19 nt, Homo sapiens
cauagucccucaauaagau

SEQ ID NO: 18877 - RNA, 19 nt, Homo sapiens
agucagcucuccugccuua

SEQ ID NO: 18878 - RNA, 19 nt, Homo sapiens
guaccauagucccucaaua

SEQ ID NO: 18879 - RNA, 19 nt, Homo sapiens
ucacaugcuucccugguuu

SEQ ID NO: 18880 - RNA, 19 nt, Homo sapiens
uaccauagucccucaauaa

SEQ ID NO: 18881 - RNA, 19 nt, Homo sapiens
caguguggauggcaaagua

SEQ ID NO: 18882 - RNA, 19 nt, Homo sapiens
ccaaguggauucggcauau

SEQ ID NO: 18883 - RNA, 19 nt, Homo sapiens
guuaaggugugccacugua

SEQ ID NO: 18884 - RNA, 19 nt, Homo sapiens
gcacacauacaaggaguuu

SEQ ID NO: 18885 - RNA, 19 nt, Homo sapiens
gcaguauucucggcuguau

SEQ ID NO: 18886 - RNA, 19 nt, Homo sapiens
gcagucauaauuugagaaa

SEQ ID NO: 18887 - RNA, 19 nt, Homo sapiens
gcucaaaucccaccgaagu

SEQ ID NO: 18888 - RNA, 19 nt, Homo sapiens
ggaagaccacacaauauca

SEQ ID NO: 18889 - RNA, 19 nt, Homo sapiens
gggagaggaugcauucaag

SEQ ID NO: 18890 - RNA, 19 nt, Homo sapiens
ugggaaaccugugaguuaa

SEQ ID NO: 18891 - RNA, 19 nt, Homo sapiens
gaggaagaagcuuaugaaa

SEQ ID NO: 18892 - RNA, 19 nt, Homo sapiens
gagaagagauggggacuau

SEQ ID NO: 18893 - RNA, 19 nt, Homo sapiens
uaaagcuggugguuucuuc

SEQ ID NO: 18894 - RNA, 19 nt, Homo sapiens
gggaagaccacacaauauc

SEQ ID NO: 18895 - RNA, 19 nt, Homo sapiens
gaagagauggggacuauga

SEQ ID NO: 18896 - RNA, 19 nt, Homo sapiens
gggcuacucauuucauuga

SEQ ID NO: 18897 - RNA, 19 nt, Homo sapiens
caggcuggcuuuacuaaca

SEQ ID NO: 18898 - RNA, 19 nt, Homo sapiens
gcugcuuguucaguuauua

SEQ ID NO: 18899 - RNA, 19 nt, Homo sapiens
gaagaagcuuaugaaacug

SEQ ID NO: 18900 - RNA, 19 nt, Homo sapiens
gcagaugaacauaguuuua

SEQ ID NO: 18901 - RNA, 19 nt, Homo sapiens
caaaucacuuucacaacag

SEQ ID NO: 18902 - RNA, 19 nt, Homo sapiens
gaagaguccaaaugauuca

SEQ ID NO: 18903 - RNA, 19 nt, Homo sapiens
gaaggcagagcaagaacug

SEQ ID NO: 18904 - RNA, 19 nt, Homo sapiens
gagagaggcccagaggaaa

SEQ ID NO: 18905 - RNA, 19 nt, Homo sapiens
cauucaaguuguucucuga

SEQ ID NO: 18906 - RNA, 19 nt, Homo sapiens
gagagaggcagaugaacau

SEQ ID NO: 18907 - RNA, 19 nt, Homo sapiens
cuccaggucuuuccuaaug

SEQ ID NO: 18908 - RNA, 19 nt, Homo sapiens
gaaaccaggaagucauuca

SEQ ID NO: 18909 - RNA, 19 nt, Homo sapiens
ccaccuacucaauacuuua

SEQ ID NO: 18910 - RNA, 19 nt, Homo sapiens
gacuccaggucuuuccuaa

SEQ ID NO: 18911 - RNA, 19 nt, Homo sapiens
gaagaccacacaauaucau

SEQ ID NO: 18912 - RNA, 19 nt, Homo sapiens
cauaugaaccaccuacuca

SEQ ID NO: 18913 - RNA, 19 nt, Homo sapiens
ccacaacuuuucauuauuc

SEQ ID NO: 18914 - RNA, 19 nt, Homo sapiens
caggaagucauucaaguug

SEQ ID NO: 18915 - RNA, 19 nt, Homo sapiens
agucucagcuucggcagua

SEQ ID NO: 18916 - RNA, 19 nt, Homo sapiens
ugaaccaccuacucaauac

SEQ ID NO: 18917 - RNA, 19 nt, Homo sapiens
ccaggaagucauucaaguu

SEQ ID NO: 18918 - RNA, 19 nt, Homo sapiens
ggaaaccugugaguuaagc

SEQ ID NO: 18919 - RNA, 19 nt, Homo sapiens
ggagggaagaccacacaau

SEQ ID NO: 18920 - RNA, 19 nt, Homo sapiens
aaagacaacuuggcuucug

SEQ ID NO: 18921 - RNA, 19 nt, Homo sapiens
ucuaucaggcacacuauaa

SEQ ID NO: 18922 - RNA, 19 nt, Homo sapiens
ugaagaguccaaaugauuc

SEQ ID NO: 18923 - RNA, 19 nt, Homo sapiens
agaggcagaugaacauagu

SEQ ID NO: 18924 - RNA, 19 nt, Homo sapiens
ccauagucccucaauaaga

SEQ ID NO: 18925 - RNA, 19 nt, Homo sapiens
acucugguguugacaggua

SEQ ID NO: 18926 - RNA, 19 nt, Homo sapiens
augggaaaccugugaguua

SEQ ID NO: 18927 - RNA, 19 nt, Homo sapiens
aagacaacuuggcuucuga

SEQ ID NO: 18928 - RNA, 19 nt, Homo sapiens
caccuggcuuuacaaauca

SEQ ID NO: 18929 - RNA, 19 nt, Homo sapiens
cagaggaagaagcuuauga

SEQ ID NO: 18930 - RNA, 19 nt, Homo sapiens
caguugggcugaccugaca

SEQ ID NO: 18931 - RNA, 19 nt, Homo sapiens
aggaugagguggugagcuu

SEQ ID NO: 18932 - RNA, 19 nt, Homo sapiens
gguacaaggagaagagaug

SEQ ID NO: 18933 - RNA, 19 nt, Homo sapiens
uugaagaguccaaaugauu

SEQ ID NO: 18934 - RNA, 19 nt, Homo sapiens
cacuguacauaucaucauu

SEQ ID NO: 18935 - RNA, 19 nt, Homo sapiens
cagggcugcuuguucaguu

SEQ ID NO: 18936 - RNA, 19 nt, Homo sapiens
uuccuugccucuucauaaa

SEQ ID NO: 18937 - RNA, 19 nt, Homo sapiens
ggaggguggaggcuaagaa

SEQ ID NO: 18938 - RNA, 19 nt, Homo sapiens
ccaucucccuccagcuuug

SEQ ID NO: 18939 - RNA, 19 nt, Homo sapiens
guuguucucugaggccaaa

SEQ ID NO: 18940 - RNA, 19 nt, Homo sapiens
ugucucaccaggaauaauu

SEQ ID NO: 18941 - RNA, 19 nt, Homo sapiens
agaggaagaagcuuaugaa

SEQ ID NO: 18942 - RNA, 19 nt, Homo sapiens
caaguggauucggcauaug

SEQ ID NO: 18943 - RNA, 19 nt, Homo sapiens
acuaacagguucccagagu

SEQ ID NO: 18944 - RNA, 19 nt, Homo sapiens
cagcucuccugccuuacuu

SEQ ID NO: 18945 - RNA, 19 nt, Homo sapiens
ccaggaauguuuaaaaucu

SEQ ID NO: 18946 - RNA, 19 nt, Homo sapiens
gaugggaaaccugugaguu

SEQ ID NO: 18947 - RNA, 19 nt, Homo sapiens
gagaggcagaugaacauag

SEQ ID NO: 18948 - RNA, 19 nt, Homo sapiens
cuagaaggcagagcaagaa

SEQ ID NO: 18949 - RNA, 19 nt, Homo sapiens
gguggaggcuaagaacaca

SEQ ID NO: 18950 - RNA, 19 nt, Homo sapiens
gcccagagccaauaaaaga

SEQ ID NO: 18951 - RNA, 19 nt, Homo sapiens
gcugaugggaaaccuguga

SEQ ID NO: 18952 - RNA, 19 nt, Homo sapiens
ggugugccacuguacauau

SEQ ID NO: 18953 - RNA, 19 nt, Homo sapiens
gcccaggaauguuuaaaau

SEQ ID NO: 18954 - RNA, 19 nt, Homo sapiens
gaacacagaaaacacacaa

SEQ ID NO: 18955 - RNA, 19 nt, Homo sapiens
acaugucucaccaggaaua

SEQ ID NO: 18956 - RNA, 19 nt, Homo sapiens
gagcaguguggauggcaaa

SEQ ID NO: 18957 - RNA, 19 nt, Homo sapiens
gcauaugaaccaccuacuc

SEQ ID NO: 18958 - RNA, 19 nt, Homo sapiens
gucacaugcuucccugguu

SEQ ID NO: 18959 - RNA, 19 nt, Homo sapiens
ggagagacaucgucagcua

SEQ ID NO: 18960 - RNA, 19 nt, Homo sapiens
gcaaggauauguaccagau

SEQ ID NO: 18961 - RNA, 19 nt, Homo sapiens
ggaccucgcucaucuccuu

SEQ ID NO: 18962 - RNA, 19 nt, Homo sapiens
cccagugccuuccaaauga

SEQ ID NO: 18963 - RNA, 19 nt, Homo sapiens
ggaagcccauccaccaauc

SEQ ID NO: 18964 - RNA, 19 nt, Homo sapiens
ccagggaccucgcucaucu

SEQ ID NO: 18965 - RNA, 19 nt, Homo sapiens
ucccgggaauguuuaauaa

SEQ ID NO: 18966 - RNA, 19 nt, Homo sapiens
cagaugaucggguccauga

SEQ ID NO: 18967 - RNA, 19 nt, Homo sapiens
caucgucagcuacgucaua

SEQ ID NO: 18968 - RNA, 19 nt, Homo sapiens
gaccauggccucucacaag

SEQ ID NO: 18969 - RNA, 19 nt, Homo sapiens
ucaaggaaggcauccagua

SEQ ID NO: 18970 - RNA, 19 nt, Homo sapiens
gagccucccgggaauguuu

SEQ ID NO: 18971 - RNA, 19 nt, Homo sapiens
caccaauccucaccucuca

SEQ ID NO: 18972 - RNA, 19 nt, Homo sapiens
gagagagccuggcccucau

SEQ ID NO: 18973 - RNA, 19 nt, Homo sapiens
ccucaccucucaccucugu

SEQ ID NO: 18974 - RNA, 19 nt, Homo sapiens
aaggauauguaccagauca

SEQ ID NO: 18975 - RNA, 19 nt, Homo sapiens
cauagaccacuucgacauu

SEQ ID NO: 18976 - RNA, 19 nt, Homo sapiens
gcaucgacauccuguacuc

SEQ ID NO: 18977 - RNA, 19 nt, Homo sapiens
ccagugcugcuguucuuaa

SEQ ID NO: 18978 - RNA, 19 nt, Homo sapiens
gagcaaacagacccugcaa

SEQ ID NO: 18979 - RNA, 19 nt, Homo sapiens
ggcuaugacuggagagaca

SEQ ID NO: 18980 - RNA, 19 nt, Homo sapiens
ggcugcagcucuucgugaa

SEQ ID NO: 18981 - RNA, 19 nt, Homo sapiens
aagauguacucccgcaaga

SEQ ID NO: 18982 - RNA, 19 nt, Homo sapiens
caaggaaggcauccaguac

SEQ ID NO: 18983 - RNA, 19 nt, Homo sapiens
gggaucaggagcaaacaga

SEQ ID NO: 18984 - RNA, 19 nt, Homo sapiens
ggauauguaccagaucaug

SEQ ID NO: 18985 - RNA, 19 nt, Homo sapiens
ccaugagccucccgggaau

SEQ ID NO: 18986 - RNA, 19 nt, Homo sapiens
gcaaugccacccgcgagaa

SEQ ID NO: 18987 - RNA, 19 nt, Homo sapiens
uagaccacuucgacauuga

SEQ ID NO: 18988 - RNA, 19 nt, Homo sapiens
gaacucugccacagguaca

SEQ ID NO: 18989 - RNA, 19 nt, Homo sapiens
ccacuucgacauugagauc

SEQ ID NO: 18990 - RNA, 19 nt, Homo sapiens
auagaccacuucgacauug

SEQ ID NO: 18991 - RNA, 19 nt, Homo sapiens
gaaauauuccaggcuuugg

SEQ ID NO: 18992 - RNA, 19 nt, Homo sapiens
ggaccauggccucucacaa

SEQ ID NO: 18993 - RNA, 19 nt, Homo sapiens
gaccaggaacccacucaca

SEQ ID NO: 18994 - RNA, 19 nt, Homo sapiens
uguccgcccugcugggaaa

SEQ ID NO: 18995 - RNA, 19 nt, Homo sapiens
ccuucuaccuggacaucaa

SEQ ID NO: 18996 - RNA, 19 nt, Homo sapiens
ccaugagcaaggauaugua

SEQ ID NO: 18997 - RNA, 19 nt, Homo sapiens
acaagccagugcugcuguu

SEQ ID NO: 18998 - RNA, 19 nt, Homo sapiens
gagugcacccgaugaccaa

SEQ ID NO: 18999 - RNA, 19 nt, Homo sapiens
gagagccuggcccucauug

SEQ ID NO: 19000 - RNA, 19 nt, Homo sapiens
guacucgggcucccagaag

SEQ ID NO: 19001 - RNA, 19 nt, Homo sapiens
agccagugcugcuguucuu

SEQ ID NO: 19002 - RNA, 19 nt, Homo sapiens
gaaaugcucuguacaaaga

SEQ ID NO: 19003 - RNA, 19 nt, Homo sapiens
gaacuuaauaguacccuuu

SEQ ID NO: 19004 - RNA, 19 nt, Homo sapiens
gcauagcucuguacaucuu

SEQ ID NO: 19005 - RNA, 19 nt, Homo sapiens
cagcauggaugauaugaug

SEQ ID NO: 19006 - RNA, 19 nt, Homo sapiens
ccacacaagugcaguagug

SEQ ID NO: 19007 - RNA, 19 nt, Homo sapiens
ccagcacagucacaaauuu

SEQ ID NO: 19008 - RNA, 19 nt, Homo sapiens
auaaagagcugugggcaaa

SEQ ID NO: 19009 - RNA, 19 nt, Homo sapiens
guagugcaguucaccauga

SEQ ID NO: 19010 - RNA, 19 nt, Homo sapiens
uagcauagcucuguacauc

SEQ ID NO: 19011 - RNA, 19 nt, Homo sapiens
gccaucaagugcuuucuuu

SEQ ID NO: 19012 - RNA, 19 nt, Homo sapiens
caagugcuuucuuuccaaa

SEQ ID NO: 19013 - RNA, 19 nt, Homo sapiens
gaacguggcgcuccuguac

SEQ ID NO: 19014 - RNA, 19 nt, Homo sapiens
aaauuucucuguuccauag

SEQ ID NO: 19015 - RNA, 19 nt, Homo sapiens
gaugauaugaugcuggaaa

SEQ ID NO: 19016 - RNA, 19 nt, Homo sapiens
cugcugagauucaucaaug

SEQ ID NO: 19017 - RNA, 19 nt, Homo sapiens
ggaguacgccuaccucaag

SEQ ID NO: 19018 - RNA, 19 nt, Homo sapiens
acagauucaucgaacuuaa

SEQ ID NO: 19019 - RNA, 19 nt, Homo sapiens
uggaaaugcucuguacaaa

SEQ ID NO: 19020 - RNA, 19 nt, Homo sapiens
ggcaaaagaguguaaaaua

SEQ ID NO: 19021 - RNA, 19 nt, Homo sapiens
gcacagucagcauggauga

SEQ ID NO: 19022 - RNA, 19 nt, Homo sapiens
caaauuucucuguuccaua

SEQ ID NO: 19023 - RNA, 19 nt, Homo sapiens
ggaaaugcucuguacaaag

SEQ ID NO: 19024 - RNA, 19 nt, Homo sapiens
agacgcggcugguggauca

SEQ ID NO: 19025 - RNA, 19 nt, Homo sapiens
gcagcauccucuacagcuu

SEQ ID NO: 19026 - RNA, 19 nt, Homo sapiens
gcagcauccucuacaacau

SEQ ID NO: 19027 - RNA, 19 nt, Homo sapiens
ucaucgaacuuaauaguac

SEQ ID NO: 19028 - RNA, 19 nt, Homo sapiens
cucacuagcucaaagcaaa

SEQ ID NO: 19029 - RNA, 19 nt, Homo sapiens
caugagggaagaauaaaga

SEQ ID NO: 19030 - RNA, 19 nt, Homo sapiens
caccaugagggaagaauaa

SEQ ID NO: 19031 - RNA, 19 nt, Homo sapiens
ucaagugcuuucuuuccaa

SEQ ID NO: 19032 - RNA, 19 nt, Homo sapiens
gacagauucaucgaacuua

SEQ ID NO: 19033 - RNA, 19 nt, Homo sapiens
aagaagacauuugccaaca

SEQ ID NO: 19034 - RNA, 19 nt, Homo sapiens
agucacaaauuucucuguu

SEQ ID NO: 19035 - RNA, 19 nt, Homo sapiens
agacauuugccaacaggua

SEQ ID NO: 19036 - RNA, 19 nt, Homo sapiens
ggaacguggcgcuccugua

SEQ ID NO: 19037 - RNA, 19 nt, Homo sapiens
ugacagauucaucgaacuu

SEQ ID NO: 19038 - RNA, 19 nt, Homo sapiens
ggaacucagcaaauacuca

SEQ ID NO: 19039 - RNA, 19 nt, Homo sapiens
guggggaacucagcaaaua

SEQ ID NO: 19040 - RNA, 19 nt, Homo sapiens
acagucagcauggaugaua

SEQ ID NO: 19041 - RNA, 19 nt, Homo sapiens
ccacgcugcagcaccauuu

SEQ ID NO: 19042 - RNA, 19 nt, Homo sapiens
cagguagcauagcucugua

SEQ ID NO: 19043 - RNA, 19 nt, Homo sapiens
gcagcauccucuacagcau

SEQ ID NO: 19044 - RNA, 19 nt, Homo sapiens
uuucucuguuccauaguua

SEQ ID NO: 19045 - RNA, 19 nt, Homo sapiens
aaugcucuguacaaagaua

SEQ ID NO: 19046 - RNA, 19 nt, Homo sapiens
gauaugaugcuggaaaugc

SEQ ID NO: 19047 - RNA, 19 nt, Homo sapiens
cuuaugagcgcgaagcaaa

SEQ ID NO: 19048 - RNA, 19 nt, Homo sapiens
caaauacucagugaacaca

SEQ ID NO: 19049 - RNA, 19 nt, Homo sapiens
cagcaaauacucagugaac

SEQ ID NO: 19050 - RNA, 19 nt, Homo sapiens
cucuacagcuugcucacua

SEQ ID NO: 19051 - RNA, 19 nt, Homo sapiens
guuccauaguuaaagaaga

SEQ ID NO: 19052 - RNA, 19 nt, Homo sapiens
gcaaauacucagugaacac

SEQ ID NO: 19053 - RNA, 19 nt, Homo sapiens
ucuguuccauaguuaaaga

SEQ ID NO: 19054 - RNA, 19 nt, Homo sapiens
gucacaaauuucucuguuc

SEQ ID NO: 19055 - RNA, 19 nt, Homo sapiens
ucaccaugagggaagaaua

SEQ ID NO: 19056 - RNA, 19 nt, Homo sapiens
gcucuguacaaagauauaa

SEQ ID NO: 19057 - RNA, 19 nt, Homo sapiens
ggugggaccgcuccuacuu

SEQ ID NO: 19058 - RNA, 19 nt, Homo sapiens
gccaacagguagcauagcu

SEQ ID NO: 19059 - RNA, 19 nt, Homo sapiens
acaaauuucucuguuccau

SEQ ID NO: 19060 - RNA, 19 nt, Homo sapiens
cagcacagucacaaauuuc

SEQ ID NO: 19061 - RNA, 19 nt, Homo sapiens
cagcauccucuacaacaug

SEQ ID NO: 19062 - RNA, 19 nt, Homo sapiens
ggcagcauccucuacaaca

SEQ ID NO: 19063 - RNA, 19 nt, Homo sapiens
cagucagcauggaugauau

SEQ ID NO: 19064 - RNA, 19 nt, Homo sapiens
ucagugaacacaccaggau

SEQ ID NO: 19065 - RNA, 19 nt, Homo sapiens
cagauucaucgaacuuaau

SEQ ID NO: 19066 - RNA, 19 nt, Homo sapiens
gggccacacaagugcagua

SEQ ID NO: 19067 - RNA, 19 nt, Homo sapiens
cuggaaaugcucuguacaa

SEQ ID NO: 19068 - RNA, 19 nt, Homo sapiens
cgucccugcucaugcuuga

SEQ ID NO: 19069 - RNA, 19 nt, Homo sapiens
agaagacauuugccaacag

SEQ ID NO: 19070 - RNA, 19 nt, Homo sapiens
gcacagucacaaauuucuc

SEQ ID NO: 19071 - RNA, 19 nt, Homo sapiens
ucuacaacaugcuuaugag

SEQ ID NO: 19072 - RNA, 19 nt, Homo sapiens
gcaggaagguggguaaaua

SEQ ID NO: 19073 - RNA, 19 nt, Homo sapiens
gagaauaauuuggccuaua

SEQ ID NO: 19074 - RNA, 19 nt, Homo sapiens
gaugaaggaugaugccauu

SEQ ID NO: 19075 - RNA, 19 nt, Homo sapiens
acaaugagguuaguacuuu

SEQ ID NO: 19076 - RNA, 19 nt, Homo sapiens
ucaaguggcucaacgagaa

SEQ ID NO: 19077 - RNA, 19 nt, Homo sapiens
gaaaucugccaccacuuua

SEQ ID NO: 19078 - RNA, 19 nt, Homo sapiens
aagaggaacuguuguuuga

SEQ ID NO: 19079 - RNA, 19 nt, Homo sapiens
gaggaacuguuguuugaau

SEQ ID NO: 19080 - RNA, 19 nt, Homo sapiens
ugaccaagcuaacugagaa

SEQ ID NO: 19081 - RNA, 19 nt, Homo sapiens
gcaaagaggaacuguuguu

SEQ ID NO: 19082 - RNA, 19 nt, Homo sapiens
gaaggaugaugccauugug

SEQ ID NO: 19083 - RNA, 19 nt, Homo sapiens
caaggugccugccaucaau

SEQ ID NO: 19084 - RNA, 19 nt, Homo sapiens
gagcagacccuguacuuca

SEQ ID NO: 19085 - RNA, 19 nt, Homo sapiens
gggcaaagaggaacuguug

SEQ ID NO: 19086 - RNA, 19 nt, Homo sapiens
ggacccauccagacaagua

SEQ ID NO: 19087 - RNA, 19 nt, Homo sapiens
gcauugagcagacccugua

SEQ ID NO: 19088 - RNA, 19 nt, Homo sapiens
ggguuagaauagacuguua

SEQ ID NO: 19089 - RNA, 19 nt, Homo sapiens
ugaaaucugccaccacuuu

SEQ ID NO: 19090 - RNA, 19 nt, Homo sapiens
caccuggucuguggacuua

SEQ ID NO: 19091 - RNA, 19 nt, Homo sapiens
ggaacuguuguuugaauuu

SEQ ID NO: 19092 - RNA, 19 nt, Homo sapiens
gcuaauggcaccaacuuug

SEQ ID NO: 19093 - RNA, 19 nt, Homo sapiens
gccauuguguguaacauug

SEQ ID NO: 19094 - RNA, 19 nt, Homo sapiens
uggaacagcucacuaaguc

SEQ ID NO: 19095 - RNA, 19 nt, Homo sapiens
ccaaugggauccucaaggu

SEQ ID NO: 19096 - RNA, 19 nt, Homo sapiens
caaagaggaacuguuguuu

SEQ ID NO: 19097 - RNA, 19 nt, Homo sapiens
caagcuaacugagaagcaa

SEQ ID NO: 19098 - RNA, 19 nt, Homo sapiens
ccagaugguuccuuucaca

SEQ ID NO: 19099 - RNA, 19 nt, Homo sapiens
gugcugggccuucucuuaa

SEQ ID NO: 19100 - RNA, 19 nt, Homo sapiens
gcucaguggucuuggaaca

SEQ ID NO: 19101 - RNA, 19 nt, Homo sapiens
gcgaaacggacgaggagua

SEQ ID NO: 19102 - RNA, 19 nt, Homo sapiens
ccuggucuguggacuuaua

SEQ ID NO: 19103 - RNA, 19 nt, Homo sapiens
uggagaaggugaacaucaa

SEQ ID NO: 19104 - RNA, 19 nt, Homo sapiens
cacaaccucuacaagauga

SEQ ID NO: 19105 - RNA, 19 nt, Homo sapiens
gaguaccuguggugcauug

SEQ ID NO: 19106 - RNA, 19 nt, Homo sapiens
agaaagaacagagaaguga

SEQ ID NO: 19107 - RNA, 19 nt, Homo sapiens
ccaacuuugugacugguuu

SEQ ID NO: 19108 - RNA, 19 nt, Homo sapiens
gagaaagaacagagaagug

SEQ ID NO: 19109 - RNA, 19 nt, Homo sapiens
gagcuaauggcaccaacuu

SEQ ID NO: 19110 - RNA, 19 nt, Homo sapiens
caggaagguggguaaauaa

SEQ ID NO: 19111 - RNA, 19 nt, Homo sapiens
caugaaugcaggcagauuu

SEQ ID NO: 19112 - RNA, 19 nt, Homo sapiens
caagcugaaugugaaguug

SEQ ID NO: 19113 - RNA, 19 nt, Homo sapiens
ugacaaacugcccuacaaa

SEQ ID NO: 19114 - RNA, 19 nt, Homo sapiens
guuuacagguccagugguu

SEQ ID NO: 19115 - RNA, 19 nt, Homo sapiens
gucauacuguuccaaaugu

SEQ ID NO: 19116 - RNA, 19 nt, Homo sapiens
ucaccaagagcaaguuuga

SEQ ID NO: 19117 - RNA, 19 nt, Homo sapiens
ccagcuucgugaugaguaa

SEQ ID NO: 19118 - RNA, 19 nt, Homo sapiens
gguaucgguugaagaaugg

SEQ ID NO: 19119 - RNA, 19 nt, Homo sapiens
uugagcagaugaaggauga

SEQ ID NO: 19120 - RNA, 19 nt, Homo sapiens
ccaccucuccucccuaaga

SEQ ID NO: 19121 - RNA, 19 nt, Homo sapiens
gcaagcugaaugugaaguu

SEQ ID NO: 19122 - RNA, 19 nt, Homo sapiens
caaacugcccuacaaaguc

SEQ ID NO: 19123 - RNA, 19 nt, Homo sapiens
aaagaggaacuguuguuug

SEQ ID NO: 19124 - RNA, 19 nt, Homo sapiens
cugacaaacugcccuacaa

SEQ ID NO: 19125 - RNA, 19 nt, Homo sapiens
ugggcaagcugaaugugaa

SEQ ID NO: 19126 - RNA, 19 nt, Homo sapiens
cgguaucgguugaagaaug

SEQ ID NO: 19127 - RNA, 19 nt, Homo sapiens
gaugaugccauugugugua

SEQ ID NO: 19128 - RNA, 19 nt, Homo sapiens
acaagaugauggccaaugg

SEQ ID NO: 19129 - RNA, 19 nt, Homo sapiens
aaucugccaccacuuuaua

SEQ ID NO: 19130 - RNA, 19 nt, Homo sapiens
ccacaaccucuacaagaug

SEQ ID NO: 19131 - RNA, 19 nt, Homo sapiens
gagggcaacaucuuuguca

SEQ ID NO: 19132 - RNA, 19 nt, Homo sapiens
augaugccauuguguguaa

SEQ ID NO: 19133 - RNA, 19 nt, Homo sapiens
ucaggagggcaacaucuuu

SEQ ID NO: 19134 - RNA, 19 nt, Homo sapiens
caaguuugacaaccucuau

SEQ ID NO: 19135 - RNA, 19 nt, Homo sapiens
guccacaaccucuacaaga

SEQ ID NO: 19136 - RNA, 19 nt, Homo sapiens
ccaaguacccgcagcuucu

SEQ ID NO: 19137 - RNA, 19 nt, Homo sapiens
gguuagaauagacuguuaa

SEQ ID NO: 19138 - RNA, 19 nt, Homo sapiens
gagaaggggcuauauugaa

SEQ ID NO: 19139 - RNA, 19 nt, Homo sapiens
auaccugugugcuugguuu

SEQ ID NO: 19140 - RNA, 19 nt, Homo sapiens
gagcucaguggucuuggaa

SEQ ID NO: 19141 - RNA, 19 nt, Homo sapiens
guucauuuccugcccaaga

SEQ ID NO: 19142 - RNA, 19 nt, Homo sapiens
caagguagcggugguagca

SEQ ID NO: 19143 - RNA, 19 nt, Homo sapiens
gcaaguuugacaaccucua

SEQ ID NO: 19144 - RNA, 19 nt, Homo sapiens
uccacaaccucuacaagau

SEQ ID NO: 19145 - RNA, 19 nt, Homo sapiens
ggaagguggguaaauaaaa

SEQ ID NO: 19146 - RNA, 19 nt, Homo sapiens
gacaaacugcccuacaaag

SEQ ID NO: 19147 - RNA, 19 nt, Homo sapiens
ugaaggaugaugccauugu

SEQ ID NO: 19148 - RNA, 19 nt, Homo sapiens
cgucauacuguuccaaaug

SEQ ID NO: 19149 - RNA, 19 nt, Homo sapiens
ggaucacuaccgcuacuga

SEQ ID NO: 19150 - RNA, 19 nt, Homo sapiens
ggaugaugccauugugugu

SEQ ID NO: 19151 - RNA, 19 nt, Homo sapiens
acaaacugcccuacaaagu

SEQ ID NO: 19152 - RNA, 19 nt, Homo sapiens
ucaaggugccugccaucaa

SEQ ID NO: 19153 - RNA, 19 nt, Homo sapiens
cugagaagcaagcccagua

SEQ ID NO: 19154 - RNA, 19 nt, Homo sapiens
gagcagaugaaggaugaug

SEQ ID NO: 19155 - RNA, 19 nt, Homo sapiens
aggaacuguuguuugaauu

SEQ ID NO: 19156 - RNA, 19 nt, Homo sapiens
guaacuccuucaccaacca

SEQ ID NO: 19157 - RNA, 19 nt, Homo sapiens
gggcaacugagaaagaaca

SEQ ID NO: 19158 - RNA, 19 nt, Homo sapiens
cugcagccgucauacuguu

SEQ ID NO: 19159 - RNA, 19 nt, Homo sapiens
gggcugaucacuuaguuuu

SEQ ID NO: 19160 - RNA, 19 nt, Homo sapiens
cuaauggcaccaacuuugu

SEQ ID NO: 19161 - RNA, 19 nt, Homo sapiens
gagagccaggucugcguuu

SEQ ID NO: 19162 - RNA, 19 nt, Homo sapiens
caggagggcaacaucuuug

SEQ ID NO: 19163 - RNA, 19 nt, Homo sapiens
ccaagagcaaguuugacaa

SEQ ID NO: 19164 - RNA, 19 nt, Homo sapiens
gagccaggucugcguuuca

SEQ ID NO: 19165 - RNA, 19 nt, Homo sapiens
ggagaaggugaacaucaag

SEQ ID NO: 19166 - RNA, 19 nt, Homo sapiens
guggagaaggugaacauca

SEQ ID NO: 19167 - RNA, 19 nt, Homo sapiens
cgagaacgccguggagaag

SEQ ID NO: 19168 - RNA, 19 nt, Homo sapiens
agagaauaauuuggccuau

SEQ ID NO: 19169 - RNA, 19 nt, Homo sapiens
aggcuggcauuccggugua

SEQ ID NO: 19170 - RNA, 19 nt, Homo sapiens
gcuggcugccugcacauga

SEQ ID NO: 19171 - RNA, 19 nt, Homo sapiens
ucuuggaacagcucacuaa

SEQ ID NO: 19172 - RNA, 19 nt, Homo sapiens
gaacagagcauuuacgaaa

SEQ ID NO: 19173 - RNA, 19 nt, Homo sapiens
gaaaguggcaugauaguuu

SEQ ID NO: 19174 - RNA, 19 nt, Homo sapiens
ccagaggucuagauuaaua

SEQ ID NO: 19175 - RNA, 19 nt, Homo sapiens
gagaagcuguguuguauga

SEQ ID NO: 19176 - RNA, 19 nt, Homo sapiens
gcacuuaaauuccucaaca

SEQ ID NO: 19177 - RNA, 19 nt, Homo sapiens
gcaaguuaauggcauguuu

SEQ ID NO: 19178 - RNA, 19 nt, Homo sapiens
gcucugaacucaagcugua

SEQ ID NO: 19179 - RNA, 19 nt, Homo sapiens
uaaggugucugcuggauaa

SEQ ID NO: 19180 - RNA, 19 nt, Homo sapiens
gacaauagcacuuaaauuc

SEQ ID NO: 19181 - RNA, 19 nt, Homo sapiens
ggaaggaacagagcauuua

SEQ ID NO: 19182 - RNA, 19 nt, Homo sapiens
cagcugauaugcuuuauug

SEQ ID NO: 19183 - RNA, 19 nt, Homo sapiens
gaacucaagcuguauggua

SEQ ID NO: 19184 - RNA, 19 nt, Homo sapiens
gaaguugccuuuuauguuu

SEQ ID NO: 19185 - RNA, 19 nt, Homo sapiens
cauaauaacuccucagaca

SEQ ID NO: 19186 - RNA, 19 nt, Homo sapiens
cuacaaaucugaaauggau

SEQ ID NO: 19187 - RNA, 19 nt, Homo sapiens
caacagcugugucagaaga

SEQ ID NO: 19188 - RNA, 19 nt, Homo sapiens
gaaauacgaaguugccuuu

SEQ ID NO: 19189 - RNA, 19 nt, Homo sapiens
aaacuagacuucacaccua

SEQ ID NO: 19190 - RNA, 19 nt, Homo sapiens
gcaacaagaugagucuauu

SEQ ID NO: 19191 - RNA, 19 nt, Homo sapiens
gagaaggccugaacuuaca

SEQ ID NO: 19192 - RNA, 19 nt, Homo sapiens
ugagguaucuaaggauuua

SEQ ID NO: 19193 - RNA, 19 nt, Homo sapiens
gcaaagcacccauuucaau

SEQ ID NO: 19194 - RNA, 19 nt, Homo sapiens
caacgaaucuaugaaugaa

SEQ ID NO: 19195 - RNA, 19 nt, Homo sapiens
ggaaucaagucaaauccuu

SEQ ID NO: 19196 - RNA, 19 nt, Homo sapiens
aaagauggaucaauacuuc

SEQ ID NO: 19197 - RNA, 19 nt, Homo sapiens
gaaggagaauucuuauuac

SEQ ID NO: 19198 - RNA, 19 nt, Homo sapiens
gacaaucaguuauacaguu

SEQ ID NO: 19199 - RNA, 19 nt, Homo sapiens
gaacuuacaagaaggagaa

SEQ ID NO: 19200 - RNA, 19 nt, Homo sapiens
caacuuuacuguccuaaca

SEQ ID NO: 19201 - RNA, 19 nt, Homo sapiens
acugcaaccuuguuuauua

SEQ ID NO: 19202 - RNA, 19 nt, Homo sapiens
cuucauaccuucagauuau

SEQ ID NO: 19203 - RNA, 19 nt, Homo sapiens
agggaaagauggaucaaua

SEQ ID NO: 19204 - RNA, 19 nt, Homo sapiens
gaauggcuuuguauuaguu

SEQ ID NO: 19205 - RNA, 19 nt, Homo sapiens
cauagagaccgacuuaaua

SEQ ID NO: 19206 - RNA, 19 nt, Homo sapiens
aaacauauccagcugaauu

SEQ ID NO: 19207 - RNA, 19 nt, Homo sapiens
gcaagacccacaacaauau

SEQ ID NO: 19208 - RNA, 19 nt, Homo sapiens
ucagacacaugcagaauga

SEQ ID NO: 19209 - RNA, 19 nt, Homo sapiens
gaaauuggcaagauaauac

SEQ ID NO: 19210 - RNA, 19 nt, Homo sapiens
ccagaaaacucuccuuuaa

SEQ ID NO: 19211 - RNA, 19 nt, Homo sapiens
uaacuccacugcuuaccua

SEQ ID NO: 19212 - RNA, 19 nt, Homo sapiens
gcagaaauuggcaagauaa

SEQ ID NO: 19213 - RNA, 19 nt, Homo sapiens
caagaugagucuauuuauc

SEQ ID NO: 19214 - RNA, 19 nt, Homo sapiens
gaauccaacugcuuaaagu

SEQ ID NO: 19215 - RNA, 19 nt, Homo sapiens
gauuaagacuggagaaagu

SEQ ID NO: 19216 - RNA, 19 nt, Homo sapiens
gaccuauaauccuugauaa

SEQ ID NO: 19217 - RNA, 19 nt, Homo sapiens
ugaagcacaugcaaguuaa

SEQ ID NO: 19218 - RNA, 19 nt, Homo sapiens
caacaguccuuggcucuga

SEQ ID NO: 19219 - RNA, 19 nt, Homo sapiens
ugacguauguccaagauuc

SEQ ID NO: 19220 - RNA, 19 nt, Homo sapiens
gaaccaaacacaaacuaga

SEQ ID NO: 19221 - RNA, 19 nt, Homo sapiens
gcaccgaugggaaaugaua

SEQ ID NO: 19222 - RNA, 19 nt, Homo sapiens
uggagaaaguggcaugaua

SEQ ID NO: 19223 - RNA, 19 nt, Homo sapiens
ucccauauccgaaugauua

SEQ ID NO: 19224 - RNA, 19 nt, Homo sapiens
ugcaugcuauucacaauua

SEQ ID NO: 19225 - RNA, 19 nt, Homo sapiens
auacagaguuggaccguuu

SEQ ID NO: 19226 - RNA, 19 nt, Homo sapiens
gaaaucaaguaaugaaucc

SEQ ID NO: 19227 - RNA, 19 nt, Homo sapiens
auaccacucuuuaccuuua

SEQ ID NO: 19228 - RNA, 19 nt, Homo sapiens
gaugaaauccugacguaug

SEQ ID NO: 19229 - RNA, 19 nt, Homo sapiens
gcauagagaccgacuuaau

SEQ ID NO: 19230 - RNA, 19 nt, Homo sapiens
gaaggaaucaagucaaauc

SEQ ID NO: 19231 - RNA, 19 nt, Homo sapiens
uaaugaauccaacugcuua

SEQ ID NO: 19232 - RNA, 19 nt, Homo sapiens
guuaauggcauguuugaaa

SEQ ID NO: 19233 - RNA, 19 nt, Homo sapiens
caagggaaguuaaaguauc

SEQ ID NO: 19234 - RNA, 19 nt, Homo sapiens
gcaaaguauuguaaugagu

SEQ ID NO: 19235 - RNA, 19 nt, Homo sapiens
ugaaacauauccagcugaa

SEQ ID NO: 19236 - RNA, 19 nt, Homo sapiens
aaguaagucucccuucaua

SEQ ID NO: 19237 - RNA, 19 nt, Homo sapiens
gcuaccacauccacucuaa

SEQ ID NO: 19238 - RNA, 19 nt, Homo sapiens
cuucuuugauguugcauua

SEQ ID NO: 19239 - RNA, 19 nt, Homo sapiens
gagguugacuucagagaca

SEQ ID NO: 19240 - RNA, 19 nt, Homo sapiens
gcacgagaggcucagguua

SEQ ID NO: 19241 - RNA, 19 nt, Homo sapiens
gaaagauggaucaauacuu

SEQ ID NO: 19242 - RNA, 19 nt, Homo sapiens
cagcuacacugggcauuaa

SEQ ID NO: 19243 - RNA, 19 nt, Homo sapiens
cagagaaggccugaacuua

SEQ ID NO: 19244 - RNA, 19 nt, Homo sapiens
gagaccgacuuaauacaga

SEQ ID NO: 19245 - RNA, 19 nt, Homo sapiens
cuucagagacauugacuua

SEQ ID NO: 19246 - RNA, 19 nt, Homo sapiens
gagaggugcuucauauguc

SEQ ID NO: 19247 - RNA, 19 nt, Homo sapiens
ggagaggugcuucauaugu

SEQ ID NO: 19248 - RNA, 19 nt, Homo sapiens
cagaguguauaugaacuua

SEQ ID NO: 19249 - RNA, 19 nt, Homo sapiens
gcuacuggauucuuauuag

SEQ ID NO: 19250 - RNA, 19 nt, Homo sapiens
ccaguggauuccuguaauu

SEQ ID NO: 19251 - RNA, 19 nt, Homo sapiens
caacaagaugagucuauuu

SEQ ID NO: 19252 - RNA, 19 nt, Homo sapiens
gaguguauaugaacuuauc

SEQ ID NO: 19253 - RNA, 19 nt, Homo sapiens
ggccugaacuuacaagaag

SEQ ID NO: 19254 - RNA, 19 nt, Homo sapiens
gacuauaaauguugcuaug

SEQ ID NO: 19255 - RNA, 19 nt, Homo sapiens
gagcuggacuacccuaugg

SEQ ID NO: 19256 - RNA, 19 nt, Homo sapiens
uggagaagcuguguuguau

SEQ ID NO: 19257 - RNA, 19 nt, Homo sapiens
gaaagggaaagauggauca

SEQ ID NO: 19258 - RNA, 19 nt, Homo sapiens
guuaaaguaucuucaugga

SEQ ID NO: 19259 - RNA, 19 nt, Homo sapiens
gaaacggaggccaggauaa

SEQ ID NO: 19260 - RNA, 19 nt, Homo sapiens
caugagguaucuaaggauu

SEQ ID NO: 19261 - RNA, 19 nt, Homo sapiens
cuuuaaaccuguagaauca

SEQ ID NO: 19262 - RNA, 19 nt, Homo sapiens
ccaauaggcaaauuaauca

SEQ ID NO: 19263 - RNA, 19 nt, Homo sapiens
auugauaucuccaugauga

SEQ ID NO: 19264 - RNA, 19 nt, Homo sapiens
gagguaccgucuacauuuc

SEQ ID NO: 19265 - RNA, 19 nt, Homo sapiens
ccugaaacaugagcaaauu

SEQ ID NO: 19266 - RNA, 19 nt, Homo sapiens
gguuaucaguuuauucaug

SEQ ID NO: 19267 - RNA, 19 nt, Homo sapiens
ccacauaguucguuuaccu

SEQ ID NO: 19268 - RNA, 19 nt, Homo sapiens
uuaaauuccucaacagugu

SEQ ID NO: 19269 - RNA, 19 nt, Homo sapiens
ugagguaccgucuacauuu

SEQ ID NO: 19270 - RNA, 19 nt, Homo sapiens
ccacaacaauauaaugucu

SEQ ID NO: 19271 - RNA, 19 nt, Homo sapiens
gaacagcaacagcaacauc

SEQ ID NO: 19272 - RNA, 19 nt, Homo sapiens
ugaaagaccuuccuuaaua

SEQ ID NO: 19273 - RNA, 19 nt, Homo sapiens
gaaagaccuuccuuaauaa

SEQ ID NO: 19274 - RNA, 19 nt, Homo sapiens
gaacugcgaugauccagaa

SEQ ID NO: 19275 - RNA, 19 nt, Homo sapiens
gaaccagauugaugaagua

SEQ ID NO: 19276 - RNA, 19 nt, Homo sapiens
caugcgaucuacauuaaua

SEQ ID NO: 19277 - RNA, 19 nt, Homo sapiens
gaaaggugcucuugcuaag

SEQ ID NO: 19278 - RNA, 19 nt, Homo sapiens
gaaggagcaugcugucgaa

SEQ ID NO: 19279 - RNA, 19 nt, Homo sapiens
gcuuauaugugccuguuaa

SEQ ID NO: 19280 - RNA, 19 nt, Homo sapiens
gaaauagacacccuggaaa

SEQ ID NO: 19281 - RNA, 19 nt, Homo sapiens
cacaugcgaucuacauuaa

SEQ ID NO: 19282 - RNA, 19 nt, Homo sapiens
ggagagcuguuugagauug

SEQ ID NO: 19283 - RNA, 19 nt, Homo sapiens
gaacaacggcuccaauuuu

SEQ ID NO: 19284 - RNA, 19 nt, Homo sapiens
ucacaugcgaucuacauua

SEQ ID NO: 19285 - RNA, 19 nt, Homo sapiens
ggagcaugcugucgaagga

SEQ ID NO: 19286 - RNA, 19 nt, Homo sapiens
cgaaggagacugugauuuc

SEQ ID NO: 19287 - RNA, 19 nt, Homo sapiens
ccggagagcuguuugagau

SEQ ID NO: 19288 - RNA, 19 nt, Homo sapiens
ccagauugaugaaguaaag

SEQ ID NO: 19289 - RNA, 19 nt, Homo sapiens
gcacugacuguguugcuaa

SEQ ID NO: 19290 - RNA, 19 nt, Homo sapiens
gcuauagacuacaucaauc

SEQ ID NO: 19291 - RNA, 19 nt, Homo sapiens
gcgaugauccagaaacuga

SEQ ID NO: 19292 - RNA, 19 nt, Homo sapiens
uauaugugccuguuaauga

SEQ ID NO: 19293 - RNA, 19 nt, Homo sapiens
ugaaauagacacccuggaa

SEQ ID NO: 19294 - RNA, 19 nt, Homo sapiens
caaccgaacugcgaugauc

SEQ ID NO: 19295 - RNA, 19 nt, Homo sapiens
gaggagguuuggcacagaa

SEQ ID NO: 19296 - RNA, 19 nt, Homo sapiens
gcagagaugaggagguuug

SEQ ID NO: 19297 - RNA, 19 nt, Homo sapiens
gauacaaacacaccuugaa

SEQ ID NO: 19298 - RNA, 19 nt, Homo sapiens
ugaaaggugcucuugcuaa

SEQ ID NO: 19299 - RNA, 19 nt, Homo sapiens
gaaaacauagccaccauuu

SEQ ID NO: 19300 - RNA, 19 nt, Homo sapiens
gagagcuguuugagauuga

SEQ ID NO: 19301 - RNA, 19 nt, Homo sapiens
gaccuuccuuaauaaagaa

SEQ ID NO: 19302 - RNA, 19 nt, Homo sapiens
agaccuuccuuaauaaaga

SEQ ID NO: 19303 - RNA, 19 nt, Homo sapiens
ccugaaagaccuuccuuaa

SEQ ID NO: 19304 - RNA, 19 nt, Homo sapiens
cagaguggguggugguuau

SEQ ID NO: 19305 - RNA, 19 nt, Homo sapiens
ggaaaccaccugccaugug

SEQ ID NO: 19306 - RNA, 19 nt, Homo sapiens
aagcagcucugguggcuau

SEQ ID NO: 19307 - RNA, 19 nt, Homo sapiens
uaaugaaagugccugaaag

SEQ ID NO: 19308 - RNA, 19 nt, Homo sapiens
ccacagaggcagccaagug

SEQ ID NO: 19309 - RNA, 19 nt, Homo sapiens
cagaacaacggcuccaauu

SEQ ID NO: 19310 - RNA, 19 nt, Homo sapiens
ugaaccagauugaugaagu

SEQ ID NO: 19311 - RNA, 19 nt, Homo sapiens
ugacagaaggcauuagguu

SEQ ID NO: 19312 - RNA, 19 nt, Homo sapiens
aaacauagccaccauuuug

SEQ ID NO: 19313 - RNA, 19 nt, Homo sapiens
gaaggagacugugauuucc

SEQ ID NO: 19314 - RNA, 19 nt, Homo sapiens
uggcagagaugaggagguu

SEQ ID NO: 19315 - RNA, 19 nt, Homo sapiens
cccagacucccauguguua

SEQ ID NO: 19316 - RNA, 19 nt, Homo sapiens
caauauggcuuuuguaagg

SEQ ID NO: 19317 - RNA, 19 nt, Homo sapiens
acagaaggcauuagguuga

SEQ ID NO: 19318 - RNA, 19 nt, Homo sapiens
ggguggugguuauguuuga

SEQ ID NO: 19319 - RNA, 19 nt, Homo sapiens
gcagaguggguggugguua

SEQ ID NO: 19320 - RNA, 19 nt, Homo sapiens
cauuggaacugugacuuug

SEQ ID NO: 19321 - RNA, 19 nt, Homo sapiens
gguaagccaccaugauugu

SEQ ID NO: 19322 - RNA, 19 nt, Homo sapiens
cagaggcagccaaguguaa

SEQ ID NO: 19323 - RNA, 19 nt, Homo sapiens
agaacaacggcuccaauuu

SEQ ID NO: 19324 - RNA, 19 nt, Homo sapiens
uuaaugaaagugccugaaa

SEQ ID NO: 19325 - RNA, 19 nt, Homo sapiens
gugguuauguuugacagaa

SEQ ID NO: 19326 - RNA, 19 nt, Homo sapiens
ucauggguguggucucauu

SEQ ID NO: 19327 - RNA, 19 nt, Homo sapiens
cuaccuauguggaguuuac

SEQ ID NO: 19328 - RNA, 19 nt, Homo sapiens
gcuguuugagauugaaaua

SEQ ID NO: 19329 - RNA, 19 nt, Homo sapiens
ggauacaaacacaccuuga

SEQ ID NO: 19330 - RNA, 19 nt, Homo sapiens
ggcuauagacuacaucaau

SEQ ID NO: 19331 - RNA, 19 nt, Homo sapiens
ccauuggaacugugacuuu

SEQ ID NO: 19332 - RNA, 19 nt, Homo sapiens
gggaggaucagacacuuca

SEQ ID NO: 19333 - RNA, 19 nt, Homo sapiens
auaugugccuguuaaugaa

SEQ ID NO: 19334 - RNA, 19 nt, Homo sapiens
gccagugguuccuccaugu

SEQ ID NO: 19335 - RNA, 19 nt, Homo sapiens
accagaaggugccaaugaa

SEQ ID NO: 19336 - RNA, 19 nt, Homo sapiens
uauguggaguuuacagugu

SEQ ID NO: 19337 - RNA, 19 nt, Homo sapiens
caacuugucaugauuuuga

SEQ ID NO: 19338 - RNA, 19 nt, Homo sapiens
ccucccaccuucuaccuau

SEQ ID NO: 19339 - RNA, 19 nt, Homo sapiens
gaaggcauuagguugacaa

SEQ ID NO: 19340 - RNA, 19 nt, Homo sapiens
ggcacugacuguguugcua

SEQ ID NO: 19341 - RNA, 19 nt, Homo sapiens
gggcugauuuauagacaac

SEQ ID NO: 19342 - RNA, 19 nt, Homo sapiens
ggcuagacauggcagagau

SEQ ID NO: 19343 - RNA, 19 nt, Homo sapiens
ugacuguguugcuaaagag

SEQ ID NO: 19344 - RNA, 19 nt, Homo sapiens
cagcucugguggcuauaga

SEQ ID NO: 19345 - RNA, 19 nt, Homo sapiens
aaugaaagugccugaaaga

SEQ ID NO: 19346 - RNA, 19 nt, Homo sapiens
cugaaagaccuuccuuaau

SEQ ID NO: 19347 - RNA, 19 nt, Homo sapiens
aagcuuauaugugccuguu

SEQ ID NO: 19348 - RNA, 19 nt, Homo sapiens
gcgaucuacauuaauauca

SEQ ID NO: 19349 - RNA, 19 nt, Homo sapiens
guccugcuccuuugucuug

SEQ ID NO: 19350 - RNA, 19 nt, Homo sapiens
aaccagaaggugccaauga

SEQ ID NO: 19351 - RNA, 19 nt, Homo sapiens
cugacuguguugcuaaaga

SEQ ID NO: 19352 - RNA, 19 nt, Homo sapiens
uuggaacugugacuuugaa

SEQ ID NO: 19353 - RNA, 19 nt, Homo sapiens
cuucauggguguggucuca

SEQ ID NO: 19354 - RNA, 19 nt, Homo sapiens
gccugaaagaccuuccuua

SEQ ID NO: 19355 - RNA, 19 nt, Homo sapiens
ugaggagguuuggcacaga

SEQ ID NO: 19356 - RNA, 19 nt, Homo sapiens
cuacaucaaucaaaaccuu

SEQ ID NO: 19357 - RNA, 19 nt, Homo sapiens
gaccugcgccacaccuuca

SEQ ID NO: 19358 - RNA, 19 nt, Homo sapiens
acgguaagccaccaugauu

SEQ ID NO: 19359 - RNA, 19 nt, Homo sapiens
ccuugaaccagauugauga

SEQ ID NO: 19360 - RNA, 19 nt, Homo sapiens
cuucaacgcucagaacaac

SEQ ID NO: 19361 - RNA, 19 nt, Homo sapiens
ucugguggcuauagacuac

SEQ ID NO: 19362 - RNA, 19 nt, Homo sapiens
gaggaucagacacuucaag

SEQ ID NO: 19363 - RNA, 19 nt, Homo sapiens
ccaccaugauuguguucuc

SEQ ID NO: 19364 - RNA, 19 nt, Homo sapiens
uaagccaccaugauugugu

SEQ ID NO: 19365 - RNA, 19 nt, Homo sapiens
cuauagacuacaucaauca

SEQ ID NO: 19366 - RNA, 19 nt, Homo sapiens
gcucuugcuaagcuuauau

SEQ ID NO: 19367 - RNA, 19 nt, Homo sapiens
gacaaccgaacugcgauga

SEQ ID NO: 19368 - RNA, 19 nt, Homo sapiens
cacugacuguguugcuaaa

SEQ ID NO: 19369 - RNA, 19 nt, Homo sapiens
uccagaaacugaggaagca

SEQ ID NO: 19370 - RNA, 19 nt, Homo sapiens
cagggcugauuuauagaca

SEQ ID NO: 19371 - RNA, 19 nt, Homo sapiens
gacgguaagccaccaugau

SEQ ID NO: 19372 - RNA, 19 nt, Homo sapiens
caagagaucugccauccua

SEQ ID NO: 19373 - RNA, 19 nt, Homo sapiens
ggaaauggcgauauugaua

SEQ ID NO: 19374 - RNA, 19 nt, Homo sapiens
agaaauacauggaguuuga

SEQ ID NO: 19375 - RNA, 19 nt, Homo sapiens
gaaaagggaugaugggauu

SEQ ID NO: 19376 - RNA, 19 nt, Homo sapiens
uaauggaaauggcgauauu

SEQ ID NO: 19377 - RNA, 19 nt, Homo sapiens
gaagagaggcuggaugaga

SEQ ID NO: 19378 - RNA, 19 nt, Homo sapiens
ccuagacgaucccaaauau

SEQ ID NO: 19379 - RNA, 19 nt, Homo sapiens
ccaagaaagcuaucucuga

SEQ ID NO: 19380 - RNA, 19 nt, Homo sapiens
agaaagcuaucucugaguu

SEQ ID NO: 19381 - RNA, 19 nt, Homo sapiens
aaaugauccugauguauga

SEQ ID NO: 19382 - RNA, 19 nt, Homo sapiens
gaucaacaagcaauuccua

SEQ ID NO: 19383 - RNA, 19 nt, Homo sapiens
gagccaaaccagggauuua

SEQ ID NO: 19384 - RNA, 19 nt, Homo sapiens
ggaaacagaagacaaaauu

SEQ ID NO: 19385 - RNA, 19 nt, Homo sapiens
ugaaacgaaugcuggagaa

SEQ ID NO: 19386 - RNA, 19 nt, Homo sapiens
acauggaguuugaccuuaa

SEQ ID NO: 19387 - RNA, 19 nt, Homo sapiens
ucucugaguugcccugauu

SEQ ID NO: 19388 - RNA, 19 nt, Homo sapiens
agacucaccuagagcuaaa

SEQ ID NO: 19389 - RNA, 19 nt, Homo sapiens
gauaucaugucccugaaac

SEQ ID NO: 19390 - RNA, 19 nt, Homo sapiens
ccaaauauagcagugauga

SEQ ID NO: 19391 - RNA, 19 nt, Homo sapiens
accuagagcuaaagaaauu

SEQ ID NO: 19392 - RNA, 19 nt, Homo sapiens
uggaugagaucaacaagca

SEQ ID NO: 19393 - RNA, 19 nt, Homo sapiens
gaguugcccugauuugaag

SEQ ID NO: 19394 - RNA, 19 nt, Homo sapiens
ucaccuagagcuaaagaaa

SEQ ID NO: 19395 - RNA, 19 nt, Homo sapiens
aagagaggcuggaugagau

SEQ ID NO: 19396 - RNA, 19 nt, Homo sapiens
gaguuugaccuuaauggaa

SEQ ID NO: 19397 - RNA, 19 nt, Homo sapiens
aagccagagucaacaaauu

SEQ ID NO: 19398 - RNA, 19 nt, Homo sapiens
ucaaagagaaauacaugga

SEQ ID NO: 19399 - RNA, 19 nt, Homo sapiens
agccagagucaacaaauua

SEQ ID NO: 19400 - RNA, 19 nt, Homo sapiens
uauggaaacagaagacaaa

SEQ ID NO: 19401 - RNA, 19 nt, Homo sapiens
uagacgaucccaaauauag

SEQ ID NO: 19402 - RNA, 19 nt, Homo sapiens
gaugagaucaacaagcaau

SEQ ID NO: 19403 - RNA, 19 nt, Homo sapiens
gaaagcuaucucugaguug

SEQ ID NO: 19404 - RNA, 19 nt, Homo sapiens
gaaacgaaugcuggagaaa

SEQ ID NO: 19405 - RNA, 19 nt, Homo sapiens
uacauggaguuugaccuua

SEQ ID NO: 19406 - RNA, 19 nt, Homo sapiens
aguuugaccuuaauggaaa

SEQ ID NO: 19407 - RNA, 19 nt, Homo sapiens
ggaguuugaccuuaaugga

SEQ ID NO: 19408 - RNA, 19 nt, Homo sapiens
agacagaggccuccagcuu

SEQ ID NO: 19409 - RNA, 19 nt, Homo sapiens
acccagauauggaaacaga

SEQ ID NO: 19410 - RNA, 19 nt, Homo sapiens
ugaguugcccugauuugaa

SEQ ID NO: 19411 - RNA, 19 nt, Homo sapiens
gccagagucaacaaauuaa

SEQ ID NO: 19412 - RNA, 19 nt, Homo sapiens
ucaugucccugaaacgaau

SEQ ID NO: 19413 - RNA, 19 nt, Homo sapiens
cuaaugacccagauaugga

SEQ ID NO: 19414 - RNA, 19 nt, Homo sapiens
cagcuacccugacuuucuc

SEQ ID NO: 19415 - RNA, 19 nt, Homo sapiens
guaagccagagucaacaaa

SEQ ID NO: 19416 - RNA, 19 nt, Homo sapiens
gagaaauacauggaguuug

SEQ ID NO: 19417 - RNA, 19 nt, Homo sapiens
agagaaauacauggaguuu

SEQ ID NO: 19418 - RNA, 19 nt, Homo sapiens
ccagagucaacaaauuaaa

SEQ ID NO: 19419 - RNA, 19 nt, Homo sapiens
ggaugaugcugggcaagag

SEQ ID NO: 19420 - RNA, 19 nt, Homo sapiens
aggagagccugcagacaga

SEQ ID NO: 19421 - RNA, 19 nt, Homo sapiens
ucaacaagcaauuccuaga

SEQ ID NO: 19422 - RNA, 19 nt, Homo sapiens
aggaagagaggcuggauga

SEQ ID NO: 19423 - RNA, 19 nt, Homo sapiens
cauggaguuugaccuuaau

SEQ ID NO: 19424 - RNA, 19 nt, Homo sapiens
caacaagcaauuccuagac

SEQ ID NO: 19425 - RNA, 19 nt, Homo sapiens
uaaugacccagauauggaa

SEQ ID NO: 19426 - RNA, 19 nt, Homo sapiens
cuagacgaucccaaauaua

SEQ ID NO: 19427 - RNA, 19 nt, Homo sapiens
agagaucugccauccuaaa

SEQ ID NO: 19428 - RNA, 19 nt, Homo sapiens
caagacucaccuagagcua

SEQ ID NO: 19429 - RNA, 19 nt, Homo sapiens
ugaaggcccagcaggaaga

SEQ ID NO: 19430 - RNA, 19 nt, Homo sapiens
cgaaugcuggagaaacuug

SEQ ID NO: 19431 - RNA, 19 nt, Homo sapiens
cuucaaagagaaauacaug

SEQ ID NO: 19432 - RNA, 19 nt, Homo sapiens
ugacccagauauggaaaca

SEQ ID NO: 19433 - RNA, 19 nt, Homo sapiens
aaaaugauccugauguaug

SEQ ID NO: 19434 - RNA, 19 nt, Homo sapiens
gaaacagaagacaaaauug

SEQ ID NO: 19435 - RNA, 19 nt, Homo sapiens
gaaggagagccugcagaca

SEQ ID NO: 19436 - RNA, 19 nt, Homo sapiens
uaagccagagucaacaaau

SEQ ID NO: 19437 - RNA, 19 nt, Homo sapiens
gaugaugcugggcaagaga

SEQ ID NO: 19438 - RNA, 19 nt, Homo sapiens
ccagauauggaaacagaag

SEQ ID NO: 19439 - RNA, 19 nt, Homo sapiens
uaucaugucccugaaacga

SEQ ID NO: 19440 - RNA, 19 nt, Homo sapiens
ggaucugcccuccaaacug

SEQ ID NO: 19441 - RNA, 19 nt, Homo sapiens
aaagggaugaugggauuga

SEQ ID NO: 19442 - RNA, 19 nt, Homo sapiens
caagcaauuccuagacgau

SEQ ID NO: 19443 - RNA, 19 nt, Homo sapiens
aacgaaugcuggagaaacu

SEQ ID NO: 19444 - RNA, 19 nt, Homo sapiens
auacauggaguuugaccuu

SEQ ID NO: 19445 - RNA, 19 nt, Homo sapiens
caagagaucugccauccua

SEQ ID NO: 19446 - RNA, 19 nt, Homo sapiens
agaaauacauggaguuuga

SEQ ID NO: 19447 - RNA, 19 nt, Homo sapiens
gaaaagggaugaugggauu

SEQ ID NO: 19448 - RNA, 19 nt, Homo sapiens
uaauggaaauggcgauauu

SEQ ID NO: 19449 - RNA, 19 nt, Homo sapiens
gaagagaggcuggaugaga

SEQ ID NO: 19450 - RNA, 19 nt, Homo sapiens
ccuagacgaucccaaauau

SEQ ID NO: 19451 - RNA, 19 nt, Homo sapiens
ccaagaaagcuaucucuga

SEQ ID NO: 19452 - RNA, 19 nt, Homo sapiens
gguaggaggguuaggauuu

SEQ ID NO: 19453 - RNA, 19 nt, Homo sapiens
agaaagcuaucucugaguu

SEQ ID NO: 19454 - RNA, 19 nt, Homo sapiens
ucacucacccagagaaaua

SEQ ID NO: 19455 - RNA, 19 nt, Homo sapiens
ccuagcacccuaugauuua

SEQ ID NO: 19456 - RNA, 19 nt, Homo sapiens
guuaggauuuccacaagaa

SEQ ID NO: 19457 - RNA, 19 nt, Homo sapiens
gaucaacaagcaauuccua

SEQ ID NO: 19458 - RNA, 19 nt, Homo sapiens
ggaaacagaagacaaaauu

SEQ ID NO: 19459 - RNA, 19 nt, Homo sapiens
ugaaacgaaugcuggagaa

SEQ ID NO: 19460 - RNA, 19 nt, Homo sapiens
ggcaggaacagcagagaua

SEQ ID NO: 19461 - RNA, 19 nt, Homo sapiens
acauggaguuugaccuuaa

SEQ ID NO: 19462 - RNA, 19 nt, Homo sapiens
ucucugaguugcccugauu

SEQ ID NO: 19463 - RNA, 19 nt, Homo sapiens
agacucaccuagagcuaaa

SEQ ID NO: 19464 - RNA, 19 nt, Homo sapiens
gauaucaugucccugaaac

SEQ ID NO: 19465 - RNA, 19 nt, Homo sapiens
ccaaauauagcagugauga

SEQ ID NO: 19466 - RNA, 19 nt, Homo sapiens
accuagagcuaaagaaauu

SEQ ID NO: 19467 - RNA, 19 nt, Homo sapiens
gcaggaacagcagagauaa

SEQ ID NO: 19468 - RNA, 19 nt, Homo sapiens
guaggaggguuaggauuuc

SEQ ID NO: 19469 - RNA, 19 nt, Homo sapiens
uggaugagaucaacaagca

SEQ ID NO: 19470 - RNA, 19 nt, Homo sapiens
gaguugcccugauuugaag

SEQ ID NO: 19471 - RNA, 19 nt, Homo sapiens
ucaccuagagcuaaagaaa

SEQ ID NO: 19472 - RNA, 19 nt, Homo sapiens
guccacaggcucaacauuu

SEQ ID NO: 19473 - RNA, 19 nt, Homo sapiens
ggugagaaacgggugauuu

SEQ ID NO: 19474 - RNA, 19 nt, Homo sapiens
aagagaggcuggaugagau

SEQ ID NO: 19475 - RNA, 19 nt, Homo sapiens
gugagaaacgggugauuug

SEQ ID NO: 19476 - RNA, 19 nt, Homo sapiens
gaguuugaccuuaauggaa

SEQ ID NO: 19477 - RNA, 19 nt, Homo sapiens
aagccagagucaacaaauu

SEQ ID NO: 19478 - RNA, 19 nt, Homo sapiens
agccagagucaacaaauua

SEQ ID NO: 19479 - RNA, 19 nt, Homo sapiens
uagacgaucccaaauauag

SEQ ID NO: 19480 - RNA, 19 nt, Homo sapiens
uauggaaacagaagacaaa

SEQ ID NO: 19481 - RNA, 19 nt, Homo sapiens
gaugagaucaacaagcaau

SEQ ID NO: 19482 - RNA, 19 nt, Homo sapiens
gaaagcuaucucugaguug

SEQ ID NO: 19483 - RNA, 19 nt, Homo sapiens
gaaacgaaugcuggagaaa

SEQ ID NO: 19484 - RNA, 19 nt, Homo sapiens
gcuccauuccucaugauuu

SEQ ID NO: 19485 - RNA, 19 nt, Homo sapiens
uacauggaguuugaccuua

SEQ ID NO: 19486 - RNA, 19 nt, Homo sapiens
aguuugaccuuaauggaaa

SEQ ID NO: 19487 - RNA, 19 nt, Homo sapiens
ggaguuugaccuuaaugga

SEQ ID NO: 19488 - RNA, 19 nt, Homo sapiens
gguuaggauuuccacaaga

SEQ ID NO: 19489 - RNA, 19 nt, Homo sapiens
acccagauauggaaacaga

SEQ ID NO: 19490 - RNA, 19 nt, Homo sapiens
ugaguugcccugauuugaa

SEQ ID NO: 19491 - RNA, 19 nt, Homo sapiens
gccagagucaacaaauuaa

SEQ ID NO: 19492 - RNA, 19 nt, Homo sapiens
ucaugucccugaaacgaau

SEQ ID NO: 19493 - RNA, 19 nt, Homo sapiens
cuaaugacccagauaugga

SEQ ID NO: 19494 - RNA, 19 nt, Homo sapiens
ggguuaggauuuccacaag

SEQ ID NO: 19495 - RNA, 19 nt, Homo sapiens
cagcuacccugacuuucuc

SEQ ID NO: 19496 - RNA, 19 nt, Homo sapiens
ggaagugggagaggagaga

SEQ ID NO: 19497 - RNA, 19 nt, Homo sapiens
cuccauuccucaugauuug

SEQ ID NO: 19498 - RNA, 19 nt, Homo sapiens
guaagccagagucaacaaa

SEQ ID NO: 19499 - RNA, 19 nt, Homo sapiens
gagaaauacauggaguuug

SEQ ID NO: 19500 - RNA, 19 nt, Homo sapiens
agagaaauacauggaguuu

SEQ ID NO: 19501 - RNA, 19 nt, Homo sapiens
ccagagucaacaaauuaaa

SEQ ID NO: 19502 - RNA, 19 nt, Homo sapiens
ucaacaagcaauuccuaga

SEQ ID NO: 19503 - RNA, 19 nt, Homo sapiens
ggaugaugcugggcaagag

SEQ ID NO: 19504 - RNA, 19 nt, Homo sapiens
cagauaucaugucccugaa

SEQ ID NO: 19505 - RNA, 19 nt, Homo sapiens
ucuccuacaugcuccauuc

SEQ ID NO: 19506 - RNA, 19 nt, Homo sapiens
aggaagagaggcuggauga

SEQ ID NO: 19507 - RNA, 19 nt, Homo sapiens
uccacaggcucaacauuuc

SEQ ID NO: 19508 - RNA, 19 nt, Homo sapiens
caacaagcaauuccuagac

SEQ ID NO: 19509 - RNA, 19 nt, Homo sapiens
cauggaguuugaccuuaau

SEQ ID NO: 19510 - RNA, 19 nt, Homo sapiens
cuagacgaucccaaauaua

SEQ ID NO: 19511 - RNA, 19 nt, Homo sapiens
uaaugacccagauauggaa

SEQ ID NO: 19512 - RNA, 19 nt, Homo sapiens
caagaacaaggcaggaaca

SEQ ID NO: 19513 - RNA, 19 nt, Homo sapiens
ugaaggcccagcaggaaga

SEQ ID NO: 19514 - RNA, 19 nt, Homo sapiens
agagaucugccauccuaaa

SEQ ID NO: 19515 - RNA, 19 nt, Homo sapiens
caagacucaccuagagcua

SEQ ID NO: 19516 - RNA, 19 nt, Homo sapiens
caggaacagcagagauaaa

SEQ ID NO: 19517 - RNA, 19 nt, Homo sapiens
cgaaugcuggagaaacuug

SEQ ID NO: 19518 - RNA, 19 nt, Homo sapiens
gugcaggccuaagaagaca

SEQ ID NO: 19519 - RNA, 19 nt, Homo sapiens
ugacccagauauggaaaca

SEQ ID NO: 19520 - RNA, 19 nt, Homo sapiens
agaggaguguucccugauc

SEQ ID NO: 19521 - RNA, 19 nt, Homo sapiens
cagagaaauacauggaguu

SEQ ID NO: 19522 - RNA, 19 nt, Homo sapiens
gaaacagaagacaaaauug

SEQ ID NO: 19523 - RNA, 19 nt, Homo sapiens
gagaggaguguucccugau

SEQ ID NO: 19524 - RNA, 19 nt, Homo sapiens
uaagccagagucaacaaau

SEQ ID NO: 19525 - RNA, 19 nt, Homo sapiens
gaugaugcugggcaagaga

SEQ ID NO: 19526 - RNA, 19 nt, Homo sapiens
gcaggccuaagaagacaga

SEQ ID NO: 19527 - RNA, 19 nt, Homo sapiens
ccagauauggaaacagaag

SEQ ID NO: 19528 - RNA, 19 nt, Homo sapiens
ggaucugcccuccaaacug

SEQ ID NO: 19529 - RNA, 19 nt, Homo sapiens
cuagcacccuaugauuuau

SEQ ID NO: 19530 - RNA, 19 nt, Homo sapiens
cucaacauuucuacacguu

SEQ ID NO: 19531 - RNA, 19 nt, Homo sapiens
uaucaugucccugaaacga

SEQ ID NO: 19532 - RNA, 19 nt, Homo sapiens
aaagggaugaugggauuga

SEQ ID NO: 19533 - RNA, 19 nt, Homo sapiens
caagcaauuccuagacgau

SEQ ID NO: 19534 - RNA, 19 nt, Homo sapiens
aacgaaugcuggagaaacu

SEQ ID NO: 19535 - RNA, 19 nt, Homo sapiens
auacauggaguuugaccuu

SEQ ID NO: 19536 - RNA, 19 nt, Homo sapiens
gagugucaauuuccaaccu

SEQ ID NO: 19537 - RNA, 19 nt, Homo sapiens
gaauggggaugcggaagug

SEQ ID NO: 19538 - RNA, 19 nt, Homo sapiens
uggcgauauuggugagaaa

SEQ ID NO: 19539 - RNA, 19 nt, Homo sapiens
caagagaucugccauccua

SEQ ID NO: 19540 - RNA, 19 nt, Homo sapiens
ggaaauggcgauauugaua

SEQ ID NO: 19541 - RNA, 19 nt, Homo sapiens
agaaauacauggaguuuga

SEQ ID NO: 19542 - RNA, 19 nt, Homo sapiens
gaaaagggaugaugggauu

SEQ ID NO: 19543 - RNA, 19 nt, Homo sapiens
uaauggaaauggcgauauu

SEQ ID NO: 19544 - RNA, 19 nt, Homo sapiens
ccaagaaagcuaucucuga

SEQ ID NO: 19545 - RNA, 19 nt, Homo sapiens
agaaagcuaucucugaguu

SEQ ID NO: 19546 - RNA, 19 nt, Homo sapiens
aaaugauccugauguauga

SEQ ID NO: 19547 - RNA, 19 nt, Homo sapiens
ggaaacagaagacaaaauu

SEQ ID NO: 19548 - RNA, 19 nt, Homo sapiens
ugaaacgaaugcuggagaa

SEQ ID NO: 19549 - RNA, 19 nt, Homo sapiens
acauggaguuugaccuuaa

SEQ ID NO: 19550 - RNA, 19 nt, Homo sapiens
ucucugaguugcccugauu

SEQ ID NO: 19551 - RNA, 19 nt, Homo sapiens
agacucaccuagagcuaaa

SEQ ID NO: 19552 - RNA, 19 nt, Homo sapiens
gauaucaugucccugaaac

SEQ ID NO: 19553 - RNA, 19 nt, Homo sapiens
accuagagcuaaagaaauu

SEQ ID NO: 19554 - RNA, 19 nt, Homo sapiens
gaguugcccugauuugaag

SEQ ID NO: 19555 - RNA, 19 nt, Homo sapiens
ucaccuagagcuaaagaaa

SEQ ID NO: 19556 - RNA, 19 nt, Homo sapiens
gaguuugaccuuaauggaa

SEQ ID NO: 19557 - RNA, 19 nt, Homo sapiens
aagccagagucaacaaauu

SEQ ID NO: 19558 - RNA, 19 nt, Homo sapiens
agccagagucaacaaauua

SEQ ID NO: 19559 - RNA, 19 nt, Homo sapiens
uauggaaacagaagacaaa

SEQ ID NO: 19560 - RNA, 19 nt, Homo sapiens
gaaagcuaucucugaguug

SEQ ID NO: 19561 - RNA, 19 nt, Homo sapiens
gaaacgaaugcuggagaaa

SEQ ID NO: 19562 - RNA, 19 nt, Homo sapiens
uacauggaguuugaccuua

SEQ ID NO: 19563 - RNA, 19 nt, Homo sapiens
aguuugaccuuaauggaaa

SEQ ID NO: 19564 - RNA, 19 nt, Homo sapiens
ggaguuugaccuuaaugga

SEQ ID NO: 19565 - RNA, 19 nt, Homo sapiens
acccagauauggaaacaga

SEQ ID NO: 19566 - RNA, 19 nt, Homo sapiens
ugaguugcccugauuugaa

SEQ ID NO: 19567 - RNA, 19 nt, Homo sapiens
gccagagucaacaaauuaa

SEQ ID NO: 19568 - RNA, 19 nt, Homo sapiens
ucaugucccugaaacgaau

SEQ ID NO: 19569 - RNA, 19 nt, Homo sapiens
cuaaugacccagauaugga

SEQ ID NO: 19570 - RNA, 19 nt, Homo sapiens
cagcuacccugacuuucuc

SEQ ID NO: 19571 - RNA, 19 nt, Homo sapiens
agagaaauacauggaguuu

SEQ ID NO: 19572 - RNA, 19 nt, Homo sapiens
guaagccagagucaacaaa

SEQ ID NO: 19573 - RNA, 19 nt, Homo sapiens
gagaaauacauggaguuug

SEQ ID NO: 19574 - RNA, 19 nt, Homo sapiens
ccagagucaacaaauuaaa

SEQ ID NO: 19575 - RNA, 19 nt, Homo sapiens
ggaugaugcugggcaagag

SEQ ID NO: 19576 - RNA, 19 nt, Homo sapiens
cauggaguuugaccuuaau

SEQ ID NO: 19577 - RNA, 19 nt, Homo sapiens
uaaugacccagauauggaa

SEQ ID NO: 19578 - RNA, 19 nt, Homo sapiens
agagaucugccauccuaaa

SEQ ID NO: 19579 - RNA, 19 nt, Homo sapiens
caagacucaccuagagcua

SEQ ID NO: 19580 - RNA, 19 nt, Homo sapiens
cgaaugcuggagaaacuug

SEQ ID NO: 19581 - RNA, 19 nt, Homo sapiens
cagagaaauacauggaguu

SEQ ID NO: 19582 - RNA, 19 nt, Homo sapiens
ugacccagauauggaaaca

SEQ ID NO: 19583 - RNA, 19 nt, Homo sapiens
aaaaugauccugauguaug

SEQ ID NO: 19584 - RNA, 19 nt, Homo sapiens
gaaacagaagacaaaauug

SEQ ID NO: 19585 - RNA, 19 nt, Homo sapiens
uaagccagagucaacaaau

SEQ ID NO: 19586 - RNA, 19 nt, Homo sapiens
gaugaugcugggcaagaga

SEQ ID NO: 19587 - RNA, 19 nt, Homo sapiens
uaucaugucccugaaacga

SEQ ID NO: 19588 - RNA, 19 nt, Homo sapiens
ccagauauggaaacagaag

SEQ ID NO: 19589 - RNA, 19 nt, Homo sapiens
aaagggaugaugggauuga

SEQ ID NO: 19590 - RNA, 19 nt, Homo sapiens
gcugaaaacccuccaguca

SEQ ID NO: 19591 - RNA, 19 nt, Homo sapiens
auacauggaguuugaccuu

SEQ ID NO: 19592 - RNA, 19 nt, Homo sapiens
aacgaaugcuggagaaacu

SEQ ID NO: 19593 - RNA, 19 nt, Homo sapiens
gcaagaagcugucggaaau

SEQ ID NO: 19594 - RNA, 19 nt, Homo sapiens
gaaagaagaacaucaaaga

SEQ ID NO: 19595 - RNA, 19 nt, Homo sapiens
gagaaaggcucaauuuggu

SEQ ID NO: 19596 - RNA, 19 nt, Homo sapiens
gcacuaaaggaauuucuaa

SEQ ID NO: 19597 - RNA, 19 nt, Homo sapiens
cuaaaggaauuucuaagga

SEQ ID NO: 19598 - RNA, 19 nt, Homo sapiens
gcugagcacuaaaggaauu

SEQ ID NO: 19599 - RNA, 19 nt, Homo sapiens
caaaaccccuuauuuacua

SEQ ID NO: 19600 - RNA, 19 nt, Homo sapiens
ccacacugcugcuguaugu

SEQ ID NO: 19601 - RNA, 19 nt, Homo sapiens
ccaaaggcuuccugauuga

SEQ ID NO: 19602 - RNA, 19 nt, Homo sapiens
gugagaagaucgugcagaa

SEQ ID NO: 19603 - RNA, 19 nt, Homo sapiens
gcagcaaggagaagaguuu

SEQ ID NO: 19604 - RNA, 19 nt, Homo sapiens
caagcugcgugcccuuuaa

SEQ ID NO: 19605 - RNA, 19 nt, Homo sapiens
uccaaaggcuuccugauug

SEQ ID NO: 19606 - RNA, 19 nt, Homo sapiens
gaaauaaacaggaguucag

SEQ ID NO: 19607 - RNA, 19 nt, Homo sapiens
gaguggagcuugcaaugag

SEQ ID NO: 19608 - RNA, 19 nt, Homo sapiens
gaagagaagcugaagaaaa

SEQ ID NO: 19609 - RNA, 19 nt, Homo sapiens
gagaagaucgugcagaagu

SEQ ID NO: 19610 - RNA, 19 nt, Homo sapiens
ugagaaacguggcauugug

SEQ ID NO: 19611 - RNA, 19 nt, Homo sapiens
ucaugucacugaaauugaa

SEQ ID NO: 19612 - RNA, 19 nt, Homo sapiens
agaagaucgugcagaagua

SEQ ID NO: 19613 - RNA, 19 nt, Homo sapiens
ggaagggcacccaguguga

SEQ ID NO: 19614 - RNA, 19 nt, Homo sapiens
ggaguugauucaugugcuu

SEQ ID NO: 19615 - RNA, 19 nt, Homo sapiens
gugaaucuauugaaagaag

SEQ ID NO: 19616 - RNA, 19 nt, Homo sapiens
gaaugaaauccgaacaguu

SEQ ID NO: 19617 - RNA, 19 nt, Homo sapiens
guagugaauuggcuuccuu

SEQ ID NO: 19618 - RNA, 19 nt, Homo sapiens
cagcugagcacuaaaggaa

SEQ ID NO: 19619 - RNA, 19 nt, Homo sapiens
aaugaaauccgaacaguug

SEQ ID NO: 19620 - RNA, 19 nt, Homo sapiens
gaauuucuaaggacauuug

SEQ ID NO: 19621 - RNA, 19 nt, Homo sapiens
gaaaagggcaucucaaugg

SEQ ID NO: 19622 - RNA, 19 nt, Homo sapiens
gcaaggucauggucugagu

SEQ ID NO: 19623 - RNA, 19 nt, Homo sapiens
cgaaugaaauccgaacagu

SEQ ID NO: 19624 - RNA, 19 nt, Homo sapiens
ugucggaaaucauggagaa

SEQ ID NO: 19625 - RNA, 19 nt, Homo sapiens
gaagcugucggaaaucaug

SEQ ID NO: 19626 - RNA, 19 nt, Homo sapiens
ggacagcugagcacuaaag

SEQ ID NO: 19627 - RNA, 19 nt, Homo sapiens
gaagaucgugcagaaguau

SEQ ID NO: 19628 - RNA, 19 nt, Homo sapiens
cuaaggacauuugguuuua

SEQ ID NO: 19629 - RNA, 19 nt, Homo sapiens
ggaguggagcuugcaauga

SEQ ID NO: 19630 - RNA, 19 nt, Homo sapiens
gcagaagacaaggcaugua

SEQ ID NO: 19631 - RNA, 19 nt, Homo sapiens
ggaagagaagcugaagaaa

SEQ ID NO: 19632 - RNA, 19 nt, Homo sapiens
gcaggagaauggcgugaac

SEQ ID NO: 19633 - RNA, 19 nt, Homo sapiens
uggcaaaaccccuuauuua

SEQ ID NO: 19634 - RNA, 19 nt, Homo sapiens
uggaagagaagcugaagaa

SEQ ID NO: 19635 - RNA, 19 nt, Homo sapiens
ggcaagaagcugucggaaa

SEQ ID NO: 19636 - RNA, 19 nt, Homo sapiens
ccaagcugcgugcccuuua

SEQ ID NO: 19637 - RNA, 19 nt, Homo sapiens
ugugagccguuuccaauuc

SEQ ID NO: 19638 - RNA, 19 nt, Homo sapiens
aagaagcugucggaaauca

SEQ ID NO: 19639 - RNA, 19 nt, Homo sapiens
aggugaaucuauugaaaga

SEQ ID NO: 19640 - RNA, 19 nt, Homo sapiens
auggacagcugagcacuaa

SEQ ID NO: 19641 - RNA, 19 nt, Homo sapiens
cagaagacaaggcauguag

SEQ ID NO: 19642 - RNA, 19 nt, Homo sapiens
gugccuguauucccagcua

SEQ ID NO: 19643 - RNA, 19 nt, Homo sapiens
aaaagcggcuggagaccua

SEQ ID NO: 19644 - RNA, 19 nt, Homo sapiens
gagagcagccuggccaaca

SEQ ID NO: 19645 - RNA, 19 nt, Homo sapiens
ccuguaaucccagcacuuu

SEQ ID NO: 19646 - RNA, 19 nt, Homo sapiens
gggagucagucaugucacu

SEQ ID NO: 19647 - RNA, 19 nt, Homo sapiens
caguuggaguugauucaug

SEQ ID NO: 19648 - RNA, 19 nt, Homo sapiens
gcaaggagaagaguuugag

SEQ ID NO: 19649 - RNA, 19 nt, Homo sapiens
ggaggugcagcaaggagaa

SEQ ID NO: 19650 - RNA, 19 nt, Homo sapiens
ggaguucagcggaguagca

SEQ ID NO: 19651 - RNA, 19 nt, Homo sapiens
acaaugaggagaccaucaa

SEQ ID NO: 19652 - RNA, 19 nt, Homo sapiens
guucagcggaguagcagaa

SEQ ID NO: 19653 - RNA, 19 nt, Homo sapiens
ggauggaagagaagcugaa

SEQ ID NO: 19654 - RNA, 19 nt, Homo sapiens
gggaguggagcuugcaaug

SEQ ID NO: 19655 - RNA, 19 nt, Homo sapiens
ugaaagaagaacaucaaag

SEQ ID NO: 19656 - RNA, 19 nt, Homo sapiens
gagccguuuccaauucuaa

SEQ ID NO: 19657 - RNA, 19 nt, Homo sapiens
aagagaagcugaagaaaac

SEQ ID NO: 19658 - RNA, 19 nt, Homo sapiens
caaugaggagaccaucaaa

SEQ ID NO: 19659 - RNA, 19 nt, Homo sapiens
gaguuugagcgacggauug

SEQ ID NO: 19660 - RNA, 19 nt, Homo sapiens
cggaguagcagaagacaag

SEQ ID NO: 19661 - RNA, 19 nt, Homo sapiens
gcaaaaccccuuauuuacu

SEQ ID NO: 19662 - RNA, 19 nt, Homo sapiens
gcuggagaccuauuacaag

SEQ ID NO: 19663 - RNA, 19 nt, Homo sapiens
gcacccagugugagaagau

SEQ ID NO: 19664 - RNA, 19 nt, Homo sapiens
uuccaaaggcuuccugauu

SEQ ID NO: 19665 - RNA, 19 nt, Homo sapiens
ggagacaguguuggacaug

SEQ ID NO: 19666 - RNA, 19 nt, Homo sapiens
gaagaaaaccaagaucauc

SEQ ID NO: 19667 - RNA, 19 nt, Homo sapiens
uaugagaaacguggcauug

SEQ ID NO: 19668 - RNA, 19 nt, Homo sapiens
ugacccagcggcucuugaa

SEQ ID NO: 19669 - RNA, 19 nt, Homo sapiens
caugguggccaaagucaau

SEQ ID NO: 19670 - RNA, 19 nt, Homo sapiens
ggcuggagaccuauuacaa

SEQ ID NO: 19671 - RNA, 19 nt, Homo sapiens
ucugugagccguuuccaau

SEQ ID NO: 19672 - RNA, 19 nt, Homo sapiens
gagcagccuggccaacaug

SEQ ID NO: 19673 - RNA, 19 nt, Homo sapiens
ggugcucacguguccuuaa

SEQ ID NO: 19674 - RNA, 19 nt, Homo sapiens
aggaauuucuaaggacauu

SEQ ID NO: 19675 - RNA, 19 nt, Homo sapiens
ccaccuggacgcccuaaag

SEQ ID NO: 19676 - RNA, 19 nt, Homo sapiens
gcacaggcagcaaggucau

SEQ ID NO: 19677 - RNA, 19 nt, Homo sapiens
ccuggacgcccuaaaguag

SEQ ID NO: 19678 - RNA, 19 nt, Homo sapiens
gugcucacguguccuuaac

SEQ ID NO: 19679 - RNA, 19 nt, Homo sapiens
agucaugucacugaaauug

SEQ ID NO: 19680 - RNA, 19 nt, Homo sapiens
gugcagaaguauggcuaca

SEQ ID NO: 19681 - RNA, 19 nt, Homo sapiens
ccuauuacaaggccacaga

SEQ ID NO: 19682 - RNA, 19 nt, Homo sapiens
gacaaugaggagaccauca

SEQ ID NO: 19683 - RNA, 19 nt, Homo sapiens
ucggcaggauggaagagaa

SEQ ID NO: 19684 - RNA, 19 nt, Homo sapiens
aguuggaguugauucaugu

SEQ ID NO: 19685 - RNA, 19 nt, Homo sapiens
uuucuaaggacauuugguu

SEQ ID NO: 19686 - RNA, 19 nt, Homo sapiens
ggaauuucuaaggacauuu

SEQ ID NO: 19687 - RNA, 19 nt, Homo sapiens
cauggacagcugagcacua

SEQ ID NO: 19688 - RNA, 19 nt, Homo sapiens
guaaagacuugguuauguu

SEQ ID NO: 19689 - RNA, 19 nt, Homo sapiens
ggaaagagaagcuugauuc

SEQ ID NO: 19690 - RNA, 19 nt, Homo sapiens
gaagcuugauucugugauu

SEQ ID NO: 19691 - RNA, 19 nt, Homo sapiens
ggugagugaugaaauggua

SEQ ID NO: 19692 - RNA, 19 nt, Homo sapiens
caaaagagcccaugaaaga

SEQ ID NO: 19693 - RNA, 19 nt, Homo sapiens
gcaaugggugggaaugaua

SEQ ID NO: 19694 - RNA, 19 nt, Homo sapiens
ggaaacuggugagugauga

SEQ ID NO: 19695 - RNA, 19 nt, Homo sapiens
gcacccagauuggcugaaa

SEQ ID NO: 19696 - RNA, 19 nt, Homo sapiens
gcacuugcuugauguaucu

SEQ ID NO: 19697 - RNA, 19 nt, Homo sapiens
gaaaaggccuugaaaaucc

SEQ ID NO: 19698 - RNA, 19 nt, Homo sapiens
aggcagaaaugcucgauga

SEQ ID NO: 19699 - RNA, 19 nt, Homo sapiens
gugcuacucucaucugugu

SEQ ID NO: 19700 - RNA, 19 nt, Homo sapiens
uguaaagacuugguuaugu

SEQ ID NO: 19701 - RNA, 19 nt, Homo sapiens
gcagaacccgaguauccua

SEQ ID NO: 19702 - RNA, 19 nt, Homo sapiens
gauaggacaggcaaagaga

SEQ ID NO: 19703 - RNA, 19 nt, Homo sapiens
gaacccgaguauccuaaag

SEQ ID NO: 19704 - RNA, 19 nt, Homo sapiens
cugggaaacuggugaguga

SEQ ID NO: 19705 - RNA, 19 nt, Homo sapiens
guauguguguugugugugu

SEQ ID NO: 19706 - RNA, 19 nt, Homo sapiens
cagauuggcugaaaacuuc

SEQ ID NO: 19707 - RNA, 19 nt, Homo sapiens
ggacccaggcacccagauu

SEQ ID NO: 19708 - RNA, 19 nt, Homo sapiens
ccuagcagccuucuccaaa

SEQ ID NO: 19709 - RNA, 19 nt, Homo sapiens
aaagagcccaugaaagaug

SEQ ID NO: 19710 - RNA, 19 nt, Homo sapiens
gaaacuggugagugaugaa

SEQ ID NO: 19711 - RNA, 19 nt, Homo sapiens
gcugaaaacuucugugucu

SEQ ID NO: 19712 - RNA, 19 nt, Homo sapiens
cauagaguacuacaggaaa

SEQ ID NO: 19713 - RNA, 19 nt, Homo sapiens
aagagcccaugaaagauga

SEQ ID NO: 19714 - RNA, 19 nt, Homo sapiens
gaauucagcaucccagacu

SEQ ID NO: 19715 - RNA, 19 nt, Homo sapiens
gaagaggaaagagaagcuu

SEQ ID NO: 19716 - RNA, 19 nt, Homo sapiens
guguauguguguugugugu

SEQ ID NO: 19717 - RNA, 19 nt, Homo sapiens
ggcaaugggugggaaugau

SEQ ID NO: 19718 - RNA, 19 nt, Homo sapiens
gaaggcaacuauggaugcu

SEQ ID NO: 19719 - RNA, 19 nt, Homo sapiens
ccaaagccacauguaaaga

SEQ ID NO: 19720 - RNA, 19 nt, Homo sapiens
gggaaacuggugagugaug

SEQ ID NO: 19721 - RNA, 19 nt, Homo sapiens
gacccaggcacccagauug

SEQ ID NO: 19722 - RNA, 19 nt, Homo sapiens
cuccaaagccacauguaaa

SEQ ID NO: 19723 - RNA, 19 nt, Homo sapiens
ucuccaaagccacauguaa

SEQ ID NO: 19724 - RNA, 19 nt, Homo sapiens
ucauagaguacuacaggaa

SEQ ID NO: 19725 - RNA, 19 nt, Homo sapiens
ucacaggaaggcugauuca

SEQ ID NO: 19726 - RNA, 19 nt, Homo sapiens
gauccacuccgccaucgau

SEQ ID NO: 19727 - RNA, 19 nt, Homo sapiens
uggagaagaggaaagagaa

SEQ ID NO: 19728 - RNA, 19 nt, Homo sapiens
ucaaaccaccccacucaua

SEQ ID NO: 19729 - RNA, 19 nt, Homo sapiens
gcaagccuaccacacucaa

SEQ ID NO: 19730 - RNA, 19 nt, Homo sapiens
gcuugauucugugauugaa

SEQ ID NO: 19731 - RNA, 19 nt, Homo sapiens
acuggugagugaugaaaug

SEQ ID NO: 19732 - RNA, 19 nt, Homo sapiens
aacuauggaugcugggaaa

SEQ ID NO: 19733 - RNA, 19 nt, Homo sapiens
cauguaaagacuugguuau

SEQ ID NO: 19734 - RNA, 19 nt, Homo sapiens
acauguaaagacuugguua

SEQ ID NO: 19735 - RNA, 19 nt, Homo sapiens
gcugaaggcaacuauggau

SEQ ID NO: 19736 - RNA, 19 nt, Homo sapiens
cuagcagccuucuccaaag

SEQ ID NO: 19737 - RNA, 19 nt, Homo sapiens
ucauugagaagaauuugga

SEQ ID NO: 19738 - RNA, 19 nt, Homo sapiens
cagaacccgaguauccuaa

SEQ ID NO: 19739 - RNA, 19 nt, Homo sapiens
ggagaagaggaaagagaag

SEQ ID NO: 19740 - RNA, 19 nt, Homo sapiens
gcuacucucaucugugugu

SEQ ID NO: 19741 - RNA, 19 nt, Homo sapiens
agccacauguaaagacuug

SEQ ID NO: 19742 - RNA, 19 nt, Homo sapiens
caaagccacauguaaagac

SEQ ID NO: 19743 - RNA, 19 nt, Homo sapiens
aagcuugauucugugauug

SEQ ID NO: 19744 - RNA, 19 nt, Homo sapiens
cuucugugucugccauuua

SEQ ID NO: 19745 - RNA, 19 nt, Homo sapiens
aaacuggugagugaugaaa

SEQ ID NO: 19746 - RNA, 19 nt, Homo sapiens
ucucaucuguguguaugug

SEQ ID NO: 19747 - RNA, 19 nt, Homo sapiens
guucaacccuccaaaagag

SEQ ID NO: 19748 - RNA, 19 nt, Homo sapiens
gaggaaagagaagcuugau

SEQ ID NO: 19749 - RNA, 19 nt, Homo sapiens
agaggaaagagaagcuuga

SEQ ID NO: 19750 - RNA, 19 nt, Homo sapiens
guguguauguguguugugu

SEQ ID NO: 19751 - RNA, 19 nt, Homo sapiens
cggcagaacccgaguaucc

SEQ ID NO: 19752 - RNA, 19 nt, Homo sapiens
agacuugguuauguuuauc

SEQ ID NO: 19753 - RNA, 19 nt, Homo sapiens
aaagccacauguaaagacu

SEQ ID NO: 19754 - RNA, 19 nt, Homo sapiens
gauguaagguguauucaua

SEQ ID NO: 19755 - RNA, 19 nt, Homo sapiens
gcacugugauguauuauuu

SEQ ID NO: 19756 - RNA, 19 nt, Homo sapiens
gaacagggagcuuugauua

SEQ ID NO: 19757 - RNA, 19 nt, Homo sapiens
caacagacauuggauaaau

SEQ ID NO: 19758 - RNA, 19 nt, Homo sapiens
ggaccuggcuggaaggaaa

SEQ ID NO: 19759 - RNA, 19 nt, Homo sapiens
ggaagggaaugaaauggaa

SEQ ID NO: 19760 - RNA, 19 nt, Homo sapiens
gagcaaguguccuaagcua

SEQ ID NO: 19761 - RNA, 19 nt, Homo sapiens
ggaaagagaagcuugauuc

SEQ ID NO: 19762 - RNA, 19 nt, Homo sapiens
gaugguggcucaacaaauc

SEQ ID NO: 19763 - RNA, 19 nt, Homo sapiens
gaagcuugauucugugauu

SEQ ID NO: 19764 - RNA, 19 nt, Homo sapiens
ggaaucggguuuucauuua

SEQ ID NO: 19765 - RNA, 19 nt, Homo sapiens
uuaguuggauccagauaua

SEQ ID NO: 19766 - RNA, 19 nt, Homo sapiens
ggacaaaucccagccaguu

SEQ ID NO: 19767 - RNA, 19 nt, Homo sapiens
ggugagugaugaaauggua

SEQ ID NO: 19768 - RNA, 19 nt, Homo sapiens
ucaaugaggugccuuucuu

SEQ ID NO: 19769 - RNA, 19 nt, Homo sapiens
caaaagagcccaugaaaga

SEQ ID NO: 19770 - RNA, 19 nt, Homo sapiens
guagggagguccaaguaug

SEQ ID NO: 19771 - RNA, 19 nt, Homo sapiens
caagcaaacuggaaucaag

SEQ ID NO: 19772 - RNA, 19 nt, Homo sapiens
gcucuaagaccucagcuuu

SEQ ID NO: 19773 - RNA, 19 nt, Homo sapiens
ggaaacuggugagugauga

SEQ ID NO: 19774 - RNA, 19 nt, Homo sapiens
gcacccagauuggcugaaa

SEQ ID NO: 19775 - RNA, 19 nt, Homo sapiens
uaaaugagcaaguguccua

SEQ ID NO: 19776 - RNA, 19 nt, Homo sapiens
gcacaugccacaauccuau

SEQ ID NO: 19777 - RNA, 19 nt, Homo sapiens
uaaagccagugcucuaaga

SEQ ID NO: 19778 - RNA, 19 nt, Homo sapiens
ggauaaauguuaguuggau

SEQ ID NO: 19779 - RNA, 19 nt, Homo sapiens
uuucuuaacugaccaaaug

SEQ ID NO: 19780 - RNA, 19 nt, Homo sapiens
gcaaguguccuaagcuaug

SEQ ID NO: 19781 - RNA, 19 nt, Homo sapiens
gaagggacucuuuuaaaua

SEQ ID NO: 19782 - RNA, 19 nt, Homo sapiens
caacaaaucaagcaaacug

SEQ ID NO: 19783 - RNA, 19 nt, Homo sapiens
gacaaaucccagccaguua

SEQ ID NO: 19784 - RNA, 19 nt, Homo sapiens
gcuaugucauccaaagauu

SEQ ID NO: 19785 - RNA, 19 nt, Homo sapiens
gaaagagauguaaggugua

SEQ ID NO: 19786 - RNA, 19 nt, Homo sapiens
gguagaaauagacacaaua

SEQ ID NO: 19787 - RNA, 19 nt, Homo sapiens
ccaaagccacauccuagua

SEQ ID NO: 19788 - RNA, 19 nt, Homo sapiens
gaaaaggccuugaaaaucc

SEQ ID NO: 19789 - RNA, 19 nt, Homo sapiens
aggcagaaaugcucgauga

SEQ ID NO: 19790 - RNA, 19 nt, Homo sapiens
ccagauauacacagaaaga

SEQ ID NO: 19791 - RNA, 19 nt, Homo sapiens
ugacugggaucacucaaca

SEQ ID NO: 19792 - RNA, 19 nt, Homo sapiens
gaccaaaugcugccuuguu

SEQ ID NO: 19793 - RNA, 19 nt, Homo sapiens
aaagagauguaagguguau

SEQ ID NO: 19794 - RNA, 19 nt, Homo sapiens
cuggauaacuguugaaugg

SEQ ID NO: 19795 - RNA, 19 nt, Homo sapiens
ggaacagggagcuuugauu

SEQ ID NO: 19796 - RNA, 19 nt, Homo sapiens
gaccaagaguacaggaaau

SEQ ID NO: 19797 - RNA, 19 nt, Homo sapiens
accaaaugcugccuuguuu

SEQ ID NO: 19798 - RNA, 19 nt, Homo sapiens
ggauccagauauacacaga

SEQ ID NO: 19799 - RNA, 19 nt, Homo sapiens
caaugaggugccuuucuua

SEQ ID NO: 19800 - RNA, 19 nt, Homo sapiens
ccacaauccuaugcucuug

SEQ ID NO: 19801 - RNA, 19 nt, Homo sapiens
gcagaacccgaguauccua

SEQ ID NO: 19802 - RNA, 19 nt, Homo sapiens
uaagcuaugucauccaaag

SEQ ID NO: 19803 - RNA, 19 nt, Homo sapiens
guacaggaaaucaaauugu

SEQ ID NO: 19804 - RNA, 19 nt, Homo sapiens
ucuaagaccucagcuuuua

SEQ ID NO: 19805 - RNA, 19 nt, Homo sapiens
ggguagaaauagacacaau

SEQ ID NO: 19806 - RNA, 19 nt, Homo sapiens
gaacccgaguauccuaaag

SEQ ID NO: 19807 - RNA, 19 nt, Homo sapiens
cugggaaacuggugaguga

SEQ ID NO: 19808 - RNA, 19 nt, Homo sapiens
ccuaagcuaugucauccaa

SEQ ID NO: 19809 - RNA, 19 nt, Homo sapiens
gaguacaggaaaucaaauu

SEQ ID NO: 19810 - RNA, 19 nt, Homo sapiens
gaccucagcuuuuaucuca

SEQ ID NO: 19811 - RNA, 19 nt, Homo sapiens
caaagccacauccuaguau

SEQ ID NO: 19812 - RNA, 19 nt, Homo sapiens
gcaacagacauuggauaaa

SEQ ID NO: 19813 - RNA, 19 nt, Homo sapiens
ugaggugccuuucuuaacu

SEQ ID NO: 19814 - RNA, 19 nt, Homo sapiens
gaagggaaugaaauggaaa

SEQ ID NO: 19815 - RNA, 19 nt, Homo sapiens
caaaucaagcaaacuggaa

SEQ ID NO: 19816 - RNA, 19 nt, Homo sapiens
aaucccagccaguuaguua

SEQ ID NO: 19817 - RNA, 19 nt, Homo sapiens
ugaagggacucuuuuaaau

SEQ ID NO: 19818 - RNA, 19 nt, Homo sapiens
ccuaugcucuugccuucuu

SEQ ID NO: 19819 - RNA, 19 nt, Homo sapiens
ggcgugaucccugcucuua

SEQ ID NO: 19820 - RNA, 19 nt, Homo sapiens
guaccuggcaugcaacaga

SEQ ID NO: 19821 - RNA, 19 nt, Homo sapiens
ugacuuaccacuaauuuac

SEQ ID NO: 19822 - RNA, 19 nt, Homo sapiens
gcucaacaaaucaagcaaa

SEQ ID NO: 19823 - RNA, 19 nt, Homo sapiens
cagauuggcugaaaacuuc

SEQ ID NO: 19824 - RNA, 19 nt, Homo sapiens
ucaaauuguuguccugucu

SEQ ID NO: 19825 - RNA, 19 nt, Homo sapiens
gggcucagaggaauacuug

SEQ ID NO: 19826 - RNA, 19 nt, Homo sapiens
ggacccaggcacccagauu

SEQ ID NO: 19827 - RNA, 19 nt, Homo sapiens
gaggugccuuucuuaacug

SEQ ID NO: 19828 - RNA, 19 nt, Homo sapiens
caaguguccuaagcuaugu

SEQ ID NO: 19829 - RNA, 19 nt, Homo sapiens
ccuagcagccuucuccaaa

SEQ ID NO: 19830 - RNA, 19 nt, Homo sapiens
aaagagcccaugaaagaug

SEQ ID NO: 19831 - RNA, 19 nt, Homo sapiens
gggaagggaaugaaaugga

SEQ ID NO: 19832 - RNA, 19 nt, Homo sapiens
guaguguggcaguuucuuu

SEQ ID NO: 19833 - RNA, 19 nt, Homo sapiens
gcucagaggaauacuugga

SEQ ID NO: 19834 - RNA, 19 nt, Homo sapiens
gcugaaaacuucugugucu

SEQ ID NO: 19835 - RNA, 19 nt, Homo sapiens
cagcaguguuauuguagug

SEQ ID NO: 19836 - RNA, 19 nt, Homo sapiens
gaaacuggugagugaugaa

SEQ ID NO: 19837 - RNA, 19 nt, Homo sapiens
aaaaccaucuccacauuug

SEQ ID NO: 19838 - RNA, 19 nt, Homo sapiens
acagggagcuuugauuacu

SEQ ID NO: 19839 - RNA, 19 nt, Homo sapiens
caagaguacaggaaaucaa

SEQ ID NO: 19840 - RNA, 19 nt, Homo sapiens
cauagaguacuacaggaaa

SEQ ID NO: 19841 - RNA, 19 nt, Homo sapiens
aagagcccaugaaagauga

SEQ ID NO: 19842 - RNA, 19 nt, Homo sapiens
gaauucagcaucccagacu

SEQ ID NO: 19843 - RNA, 19 nt, Homo sapiens
gaagaggaaagagaagcuu

SEQ ID NO: 19844 - RNA, 19 nt, Homo sapiens
caucuccacauuugaaaga

SEQ ID NO: 19845 - RNA, 19 nt, Homo sapiens
aagaguacaggaaaucaaa

SEQ ID NO: 19846 - RNA, 19 nt, Homo sapiens
gaaggcaacuauggaugcu

SEQ ID NO: 19847 - RNA, 19 nt, Homo sapiens
aggaauacuuggaacaaca

SEQ ID NO: 19848 - RNA, 19 nt, Homo sapiens
gaggaauacuuggaacaac

SEQ ID NO: 19849 - RNA, 19 nt, Homo sapiens
ccugcaaccucuugaccuu

SEQ ID NO: 19850 - RNA, 19 nt, Homo sapiens
gacccaggcacccagauug

SEQ ID NO: 19851 - RNA, 19 nt, Homo sapiens
aagauuguccuuuccauuc

SEQ ID NO: 19852 - RNA, 19 nt, Homo sapiens
gggaaacuggugagugaug

SEQ ID NO: 19853 - RNA, 19 nt, Homo sapiens
ccacauccuaguaucagaa

SEQ ID NO: 19854 - RNA, 19 nt, Homo sapiens
ggaaagagaagcuugauuc

SEQ ID NO: 19855 - RNA, 19 nt, Homo sapiens
gaagcuugauucugugauu

SEQ ID NO: 19856 - RNA, 19 nt, Homo sapiens
ggugagugaugaaauggua

SEQ ID NO: 19857 - RNA, 19 nt, Homo sapiens
caaaagagcccaugaaaga

SEQ ID NO: 19858 - RNA, 19 nt, Homo sapiens
ggaaacuggugagugauga

SEQ ID NO: 19859 - RNA, 19 nt, Homo sapiens
gcacccagauuggcugaaa

SEQ ID NO: 19860 - RNA, 19 nt, Homo sapiens
gcacuugcuugauguaucu

SEQ ID NO: 19861 - RNA, 19 nt, Homo sapiens
aggcagaaaugcucgauga

SEQ ID NO: 19862 - RNA, 19 nt, Homo sapiens
gugcuacucucaucugugu

SEQ ID NO: 19863 - RNA, 19 nt, Homo sapiens
gcagaacccgaguauccua

SEQ ID NO: 19864 - RNA, 19 nt, Homo sapiens
cugggaaacuggugaguga

SEQ ID NO: 19865 - RNA, 19 nt, Homo sapiens
gaacccgaguauccuaaag

SEQ ID NO: 19866 - RNA, 19 nt, Homo sapiens
guauguguguugugugugu

SEQ ID NO: 19867 - RNA, 19 nt, Homo sapiens
cagauuggcugaaaacuuc

SEQ ID NO: 19868 - RNA, 19 nt, Homo sapiens
ggacccaggcacccagauu

SEQ ID NO: 19869 - RNA, 19 nt, Homo sapiens
gauauaggacaggcaaaga

SEQ ID NO: 19870 - RNA, 19 nt, Homo sapiens
aaagagcccaugaaagaug

SEQ ID NO: 19871 - RNA, 19 nt, Homo sapiens
gaaacuggugagugaugaa

SEQ ID NO: 19872 - RNA, 19 nt, Homo sapiens
gcugaaaacuucugugucu

SEQ ID NO: 19873 - RNA, 19 nt, Homo sapiens
aagagcccaugaaagauga

SEQ ID NO: 19874 - RNA, 19 nt, Homo sapiens
gaauucagcaucccagacu

SEQ ID NO: 19875 - RNA, 19 nt, Homo sapiens
gaagaggaaagagaagcuu

SEQ ID NO: 19876 - RNA, 19 nt, Homo sapiens
guguauguguguugugugu

SEQ ID NO: 19877 - RNA, 19 nt, Homo sapiens
gaaggcaacuauggaugcu

SEQ ID NO: 19878 - RNA, 19 nt, Homo sapiens
gacccaggcacccagauug

SEQ ID NO: 19879 - RNA, 19 nt, Homo sapiens
gggaaacuggugagugaug

SEQ ID NO: 19880 - RNA, 19 nt, Homo sapiens
ucacaggaaggcugauuca

SEQ ID NO: 19881 - RNA, 19 nt, Homo sapiens
uggagaagaggaaagagaa

SEQ ID NO: 19882 - RNA, 19 nt, Homo sapiens
uauaggacaggcaaagaga

SEQ ID NO: 19883 - RNA, 19 nt, Homo sapiens
gcuugauucugugauugaa

SEQ ID NO: 19884 - RNA, 19 nt, Homo sapiens
acuggugagugaugaaaug

SEQ ID NO: 19885 - RNA, 19 nt, Homo sapiens
aacuauggaugcugggaaa

SEQ ID NO: 19886 - RNA, 19 nt, Homo sapiens
ucauugagaagaauuugga

SEQ ID NO: 19887 - RNA, 19 nt, Homo sapiens
gcugaaggcaacuauggau

SEQ ID NO: 19888 - RNA, 19 nt, Homo sapiens
cagaacccgaguauccuaa

SEQ ID NO: 19889 - RNA, 19 nt, Homo sapiens
ggagaagaggaaagagaag

SEQ ID NO: 19890 - RNA, 19 nt, Homo sapiens
gcuacucucaucugugugu

SEQ ID NO: 19891 - RNA, 19 nt, Homo sapiens
aagcuugauucugugauug

SEQ ID NO: 19892 - RNA, 19 nt, Homo sapiens
cuucugugucugccauuua

SEQ ID NO: 19893 - RNA, 19 nt, Homo sapiens
aaacuggugagugaugaaa

SEQ ID NO: 19894 - RNA, 19 nt, Homo sapiens
ucucaucuguguguaugug

SEQ ID NO: 19895 - RNA, 19 nt, Homo sapiens
guucaacccuccaaaagag

SEQ ID NO: 19896 - RNA, 19 nt, Homo sapiens
gaggaaagagaagcuugau

SEQ ID NO: 19897 - RNA, 19 nt, Homo sapiens
agaggaaagagaagcuuga

SEQ ID NO: 19898 - RNA, 19 nt, Homo sapiens
guguguauguguguugugu

SEQ ID NO: 19899 - RNA, 19 nt, Homo sapiens
cggcagaacccgaguaucc

SEQ ID NO: 19900 - RNA, 19 nt, Homo sapiens
gaacugagcuaugaagaga

SEQ ID NO: 19901 - RNA, 19 nt, Homo sapiens
caaacaagaucacaccuau

SEQ ID NO: 19902 - RNA, 19 nt, Homo sapiens
gcaaagcaguauauagaga

SEQ ID NO: 19903 - RNA, 19 nt, Homo sapiens
gcaaguacaguguggauuu

SEQ ID NO: 19904 - RNA, 19 nt, Homo sapiens
caaagccagucauugaauu

SEQ ID NO: 19905 - RNA, 19 nt, Homo sapiens
ggucugacuuuauggauug

SEQ ID NO: 19906 - RNA, 19 nt, Homo sapiens
gaagauguggucauucauu

SEQ ID NO: 19907 - RNA, 19 nt, Homo sapiens
caaaugguguguaacuuca

SEQ ID NO: 19908 - RNA, 19 nt, Homo sapiens
uauauaaccuggacuucaa

SEQ ID NO: 19909 - RNA, 19 nt, Homo sapiens
ggaagaaccaggaagaugu

SEQ ID NO: 19910 - RNA, 19 nt, Homo sapiens
ccaggaagauguggucauu

SEQ ID NO: 19911 - RNA, 19 nt, Homo sapiens
gaacuuuggucuccagcau

SEQ ID NO: 19912 - RNA, 19 nt, Homo sapiens
gaggaucgcccagaacuuu

SEQ ID NO: 19913 - RNA, 19 nt, Homo sapiens
agaaagaguucaugaagag

SEQ ID NO: 19914 - RNA, 19 nt, Homo sapiens
uagaaagaguucaugaaga

SEQ ID NO: 19915 - RNA, 19 nt, Homo sapiens
gugaucaguuugaauauuc

SEQ ID NO: 19916 - RNA, 19 nt, Homo sapiens
cuagugaucaguuugaaua

SEQ ID NO: 19917 - RNA, 19 nt, Homo sapiens
caaaugaguagaaagaguu

SEQ ID NO: 19918 - RNA, 19 nt, Homo sapiens
ggucauucauucaauagug

SEQ ID NO: 19919 - RNA, 19 nt, Homo sapiens
ugacacuguuccuuucuuu

SEQ ID NO: 19920 - RNA, 19 nt, Homo sapiens
ggauugacacuguuccuuu

SEQ ID NO: 19921 - RNA, 19 nt, Homo sapiens
gaacggagacgaacaaaau

SEQ ID NO: 19922 - RNA, 19 nt, Homo sapiens
ucaaaaggcuggucaccua

SEQ ID NO: 19923 - RNA, 19 nt, Homo sapiens
uugaaauggugaacugaua

SEQ ID NO: 19924 - RNA, 19 nt, Homo sapiens
gcaaagccagucauugaau

SEQ ID NO: 19925 - RNA, 19 nt, Homo sapiens
gauugacacuguuccuuuc

SEQ ID NO: 19926 - RNA, 19 nt, Homo sapiens
acugagaacugagcuauga

SEQ ID NO: 19927 - RNA, 19 nt, Homo sapiens
cacaaaggcuguugaacca

SEQ ID NO: 19928 - RNA, 19 nt, Homo sapiens
ucaagcccaucacaagaaa

SEQ ID NO: 19929 - RNA, 19 nt, Homo sapiens
guagaaagaguucaugaag

SEQ ID NO: 19930 - RNA, 19 nt, Homo sapiens
gaacugauaggaaaacaaa

SEQ ID NO: 19931 - RNA, 19 nt, Homo sapiens
gaagcuacuuacucauagu

SEQ ID NO: 19932 - RNA, 19 nt, Homo sapiens
ucaauaguguguguaguau

SEQ ID NO: 19933 - RNA, 19 nt, Homo sapiens
ggacuucaauccaccucau

SEQ ID NO: 19934 - RNA, 19 nt, Homo sapiens
uggcaaagcaguauauaga

SEQ ID NO: 19935 - RNA, 19 nt, Homo sapiens
uaaggugucucugcacaug

SEQ ID NO: 19936 - RNA, 19 nt, Homo sapiens
caaagcaguauauagagaa

SEQ ID NO: 19937 - RNA, 19 nt, Homo sapiens
gcacugagaacugagcuau

SEQ ID NO: 19938 - RNA, 19 nt, Homo sapiens
gaagaaccaggaagaugug

SEQ ID NO: 19939 - RNA, 19 nt, Homo sapiens
caaguacaguguggauuuc

SEQ ID NO: 19940 - RNA, 19 nt, Homo sapiens
gccagaggaucgcccagaa

SEQ ID NO: 19941 - RNA, 19 nt, Homo sapiens
aggaagauguggucauuca

SEQ ID NO: 19942 - RNA, 19 nt, Homo sapiens
guccaaagaagcauauuga

SEQ ID NO: 19943 - RNA, 19 nt, Homo sapiens
ucacaccuauucaguccaa

SEQ ID NO: 19944 - RNA, 19 nt, Homo sapiens
aaaucuggcccuacguuua

SEQ ID NO: 19945 - RNA, 19 nt, Homo sapiens
guacaaagacguggcaaag

SEQ ID NO: 19946 - RNA, 19 nt, Homo sapiens
ugauaaacccgaagcaguu

SEQ ID NO: 19947 - RNA, 19 nt, Homo sapiens
cauccacgcuccauagagu

SEQ ID NO: 19948 - RNA, 19 nt, Homo sapiens
aauugaagcuacuuacuca

SEQ ID NO: 19949 - RNA, 19 nt, Homo sapiens
aaagccagucauugaauua

SEQ ID NO: 19950 - RNA, 19 nt, Homo sapiens
guacaguguggauuucaaa

SEQ ID NO: 19951 - RNA, 19 nt, Homo sapiens
ggucaccuacacauguuua

SEQ ID NO: 19952 - RNA, 19 nt, Homo sapiens
ugaagcuacuuacucauag

SEQ ID NO: 19953 - RNA, 19 nt, Homo sapiens
gaaauugaagcuacuuacu

SEQ ID NO: 19954 - RNA, 19 nt, Homo sapiens
aaacugcuggucugacuuu

SEQ ID NO: 19955 - RNA, 19 nt, Homo sapiens
ggacaucuguuuucacucu

SEQ ID NO: 19956 - RNA, 19 nt, Homo sapiens
gacaugugauggugauagu

SEQ ID NO: 19957 - RNA, 19 nt, Homo sapiens
acaaaugaguagaaagagu

SEQ ID NO: 19958 - RNA, 19 nt, Homo sapiens
uguggucauucauucaaua

SEQ ID NO: 19959 - RNA, 19 nt, Homo sapiens
uguaugcacugagaacuga

SEQ ID NO: 19960 - RNA, 19 nt, Homo sapiens
ucaaacaagaucacaccua

SEQ ID NO: 19961 - RNA, 19 nt, Homo sapiens
caauccaccucauguacau

SEQ ID NO: 19962 - RNA, 19 nt, Homo sapiens
gaaucucuguaugcacuga

SEQ ID NO: 19963 - RNA, 19 nt, Homo sapiens
gaguagaaagaguucauga

SEQ ID NO: 19964 - RNA, 19 nt, Homo sapiens
caaaaucugugaaguggau

SEQ ID NO: 19965 - RNA, 19 nt, Homo sapiens
cugcuggucugacuuuaug

SEQ ID NO: 19966 - RNA, 19 nt, Homo sapiens
gugaucacacgccuaauga

SEQ ID NO: 19967 - RNA, 19 nt, Homo sapiens
ggaaaacaaaugaguagaa

SEQ ID NO: 19968 - RNA, 19 nt, Homo sapiens
gggagggguugucuuaaaa

SEQ ID NO: 19969 - RNA, 19 nt, Homo sapiens
ggugugugcccuccuggua

SEQ ID NO: 19970 - RNA, 19 nt, Homo sapiens
ucaaaugguguguaacuuc

SEQ ID NO: 19971 - RNA, 19 nt, Homo sapiens
aagauguggucauucauuc

SEQ ID NO: 19972 - RNA, 19 nt, Homo sapiens
aacaagaucacaccuauuc

SEQ ID NO: 19973 - RNA, 19 nt, Homo sapiens
gcccuacguuuacacacuu

SEQ ID NO: 19974 - RNA, 19 nt, Homo sapiens
gccagucauugaauuauac

SEQ ID NO: 19975 - RNA, 19 nt, Homo sapiens
agccagucauugaauuaua

SEQ ID NO: 19976 - RNA, 19 nt, Homo sapiens
gagauggcaaagcaguaua

SEQ ID NO: 19977 - RNA, 19 nt, Homo sapiens
gauaaacccgaagcaguug

SEQ ID NO: 19978 - RNA, 19 nt, Homo sapiens
guauauaaccuggacuuca

SEQ ID NO: 19979 - RNA, 19 nt, Homo sapiens
ccucucagauucuaauaac

SEQ ID NO: 19980 - RNA, 19 nt, Homo sapiens
uugaagcuacuuacucaua

SEQ ID NO: 19981 - RNA, 19 nt, Homo sapiens
gauguggucauucauucaa

SEQ ID NO: 19982 - RNA, 19 nt, Homo sapiens
ggggagggguugucuuaaa

SEQ ID NO: 19983 - RNA, 19 nt, Homo sapiens
gauggcaaagcaguauaua

SEQ ID NO: 19984 - RNA, 19 nt, Homo sapiens
auggugaacugauaggaaa

SEQ ID NO: 19985 - RNA, 19 nt, Homo sapiens
ucacacgccuaaugauguc

SEQ ID NO: 19986 - RNA, 19 nt, Homo sapiens
ggcaaagccagucauugaa

SEQ ID NO: 19987 - RNA, 19 nt, Homo sapiens
ggacaaaaucugugaagug

SEQ ID NO: 19988 - RNA, 19 nt, Homo sapiens
gagaacugagcuaugaaga

SEQ ID NO: 19989 - RNA, 19 nt, Homo sapiens
gugaaauugaagcuacuua

SEQ ID NO: 19990 - RNA, 19 nt, Homo sapiens
gaggggagggguugucuua

SEQ ID NO: 19991 - RNA, 19 nt, Homo sapiens
gcuggucaccuacacaugu

SEQ ID NO: 19992 - RNA, 19 nt, Homo sapiens
gcccuccucugccuuucaa

SEQ ID NO: 19993 - RNA, 19 nt, Homo sapiens
ggugcuguguccaaauuag

SEQ ID NO: 19994 - RNA, 19 nt, Homo sapiens
ccuauucaguccaaagaag

SEQ ID NO: 19995 - RNA, 19 nt, Homo sapiens
ucauagugguuguuucucu

SEQ ID NO: 19996 - RNA, 19 nt, Homo sapiens
ugguaacagugaaauugaa

SEQ ID NO: 19997 - RNA, 19 nt, Homo sapiens
gcuaagacaguacaaagac

SEQ ID NO: 19998 - RNA, 19 nt, Homo sapiens
gccuaaugauguccgaguu

SEQ ID NO: 19999 - RNA, 19 nt, Homo sapiens
cuuuauggauugacacugu

SEQ ID NO: 20000 - RNA, 19 nt, Homo sapiens
ggagcaagguuuaaauuug

SEQ ID NO: 20001 - RNA, 19 nt, Homo sapiens
ggacugcgcuggacgauag

SEQ ID NO: 20002 - RNA, 19 nt, Homo sapiens
gagcaagguuuaaauuugu

SEQ ID NO: 20003 - RNA, 19 nt, Homo sapiens
ggacagaggagcaagguuu

SEQ ID NO: 20004 - RNA, 19 nt, Homo sapiens
gccaugaucuguauuuaau

SEQ ID NO: 20005 - RNA, 19 nt, Homo sapiens
ccaugaagauccucaagaa

SEQ ID NO: 20006 - RNA, 19 nt, Homo sapiens
gacaaggacgggcacauua

SEQ ID NO: 20007 - RNA, 19 nt, Homo sapiens
gcaaggugauccuggugaa

SEQ ID NO: 20008 - RNA, 19 nt, Homo sapiens
gaaccuucccuccaaauuc

SEQ ID NO: 20009 - RNA, 19 nt, Homo sapiens
uuucagggcugcucaagaa

SEQ ID NO: 20010 - RNA, 19 nt, Homo sapiens
ggacaaggacgggcacauu

SEQ ID NO: 20011 - RNA, 19 nt, Homo sapiens
gcacuaaggccgugucucu

SEQ ID NO: 20012 - RNA, 19 nt, Homo sapiens
cgacguggcuauugugaag

SEQ ID NO: 20013 - RNA, 19 nt, Homo sapiens
gaggagcaagguuuaaauu

SEQ ID NO: 20014 - RNA, 19 nt, Homo sapiens
gaaauguuaaggacuucua

SEQ ID NO: 20015 - RNA, 19 nt, Homo sapiens
ucacagcccugaaguacuc

SEQ ID NO: 20016 - RNA, 19 nt, Homo sapiens
gacagaggagcaagguuua

SEQ ID NO: 20017 - RNA, 19 nt, Homo sapiens
uuaaggacuucuacagcua

SEQ ID NO: 20018 - RNA, 19 nt, Homo sapiens
gcuacuuccuccucaagaa

SEQ ID NO: 20019 - RNA, 19 nt, Homo sapiens
gaugcaaccucacuauggu

SEQ ID NO: 20020 - RNA, 19 nt, Homo sapiens
ccagcuaucugucaucucu

SEQ ID NO: 20021 - RNA, 19 nt, Homo sapiens
acauuaagaucacagacuu

SEQ ID NO: 20022 - RNA, 19 nt, Homo sapiens
gaccgccucugcuuuguca

SEQ ID NO: 20023 - RNA, 19 nt, Homo sapiens
caaccgccauccagacugu

SEQ ID NO: 20024 - RNA, 19 nt, Homo sapiens
ucacguagggaaauguuaa

SEQ ID NO: 20025 - RNA, 19 nt, Homo sapiens
gugccaugaucuguauuua

SEQ ID NO: 20026 - RNA, 19 nt, Homo sapiens
ccugucagcuggugcauca

SEQ ID NO: 20027 - RNA, 19 nt, Homo sapiens
cuacagcuaugcgcaaugu

SEQ ID NO: 20028 - RNA, 19 nt, Homo sapiens
caugaucuguauuuaaugg

SEQ ID NO: 20029 - RNA, 19 nt, Homo sapiens
agacugacaccagguauuu

SEQ ID NO: 20030 - RNA, 19 nt, Homo sapiens
acaaggacgggcacauuaa

SEQ ID NO: 20031 - RNA, 19 nt, Homo sapiens
gcgcagugccagcugauga

SEQ ID NO: 20032 - RNA, 19 nt, Homo sapiens
ggaguucacggcccagaug

SEQ ID NO: 20033 - RNA, 19 nt, Homo sapiens
ggcagcacguguacgagaa

SEQ ID NO: 20034 - RNA, 19 nt, Homo sapiens
ucacaccaccugaccaaga

SEQ ID NO: 20035 - RNA, 19 nt, Homo sapiens
uuucgacgcuuaaccuuuc

SEQ ID NO: 20036 - RNA, 19 nt, Homo sapiens
ccucagcccucagaacaau

SEQ ID NO: 20037 - RNA, 19 nt, Homo sapiens
ccacgaccgccucugcuuu

SEQ ID NO: 20038 - RNA, 19 nt, Homo sapiens
gcaccuucauuggcuacaa

SEQ ID NO: 20039 - RNA, 19 nt, Homo sapiens
agggaaauguuaaggacuu

SEQ ID NO: 20040 - RNA, 19 nt, Homo sapiens
ccaugaacgaguuugagua

SEQ ID NO: 20041 - RNA, 19 nt, Homo sapiens
ugagcgacguggcuauugu

SEQ ID NO: 20042 - RNA, 19 nt, Homo sapiens
cagaggagcaagguuuaaa

SEQ ID NO: 20043 - RNA, 19 nt, Homo sapiens
gagacugacaccagguauu

SEQ ID NO: 20044 - RNA, 19 nt, Homo sapiens
gcccaacaccuucaucauc

SEQ ID NO: 20045 - RNA, 19 nt, Homo sapiens
cagccugggucaaagaagu

SEQ ID NO: 20046 - RNA, 19 nt, Homo sapiens
ggacgggcacauuaagauc

SEQ ID NO: 20047 - RNA, 19 nt, Homo sapiens
gcgugaccaugaacgaguu

SEQ ID NO: 20048 - RNA, 19 nt, Homo sapiens
caaccucacuaugguaugc

SEQ ID NO: 20049 - RNA, 19 nt, Homo sapiens
ccagaugcaaccucacuau

SEQ ID NO: 20050 - RNA, 19 nt, Homo sapiens
cagggcugcucaagaagga

SEQ ID NO: 20051 - RNA, 19 nt, Homo sapiens
caaccaggaccaugagaag

SEQ ID NO: 20052 - RNA, 19 nt, Homo sapiens
ccgaggugcuggaggacaa

SEQ ID NO: 20053 - RNA, 19 nt, Homo sapiens
cacaccaccugaccaagau

SEQ ID NO: 20054 - RNA, 19 nt, Homo sapiens
cggagaagaacguggugua

SEQ ID NO: 20055 - RNA, 19 nt, Homo sapiens
gcuacuacgccaugaagau

SEQ ID NO: 20056 - RNA, 19 nt, Homo sapiens
gggaaauguuaaggacuuc

SEQ ID NO: 20057 - RNA, 19 nt, Homo sapiens
caucacaccaccugaccaa

SEQ ID NO: 20058 - RNA, 19 nt, Homo sapiens
gcaaggaggggaucaagga

SEQ ID NO: 20059 - RNA, 19 nt, Homo sapiens
uaaucuuugugacaggaaa

SEQ ID NO: 20060 - RNA, 19 nt, Homo sapiens
ggccucagcccucagaaca

SEQ ID NO: 20061 - RNA, 19 nt, Homo sapiens
aggagcaagguuuaaauuu

SEQ ID NO: 20062 - RNA, 19 nt, Homo sapiens
ggcugggcguggucaugua

SEQ ID NO: 20063 - RNA, 19 nt, Homo sapiens
gccaugaagauccucaaga

SEQ ID NO: 20064 - RNA, 19 nt, Homo sapiens
ugaacgaguuugaguaccu

SEQ ID NO: 20065 - RNA, 19 nt, Homo sapiens
aagcaccgcgugaccauga

SEQ ID NO: 20066 - RNA, 19 nt, Homo sapiens
gcucagcccacccuucaag

SEQ ID NO: 20067 - RNA, 19 nt, Homo sapiens
gcacguguacgagaagaag

SEQ ID NO: 20068 - RNA, 19 nt, Homo sapiens
gacgggcacauuaagauca

SEQ ID NO: 20069 - RNA, 19 nt, Homo sapiens
ggagaagaacgugguguac

SEQ ID NO: 20070 - RNA, 19 nt, Homo sapiens
cgaacgcaccuuccaugug

SEQ ID NO: 20071 - RNA, 19 nt, Homo sapiens
aaccuucccuccaaauucu

SEQ ID NO: 20072 - RNA, 19 nt, Homo sapiens
uaaggacuucuacagcuau

SEQ ID NO: 20073 - RNA, 19 nt, Homo sapiens
ccaggaccaugagaagcuu

SEQ ID NO: 20074 - RNA, 19 nt, Homo sapiens
caaggacgggcacauuaag

SEQ ID NO: 20075 - RNA, 19 nt, Homo sapiens
uaccugcacucggagaaga

SEQ ID NO: 20076 - RNA, 19 nt, Homo sapiens
cccacacacucaccgagaa

SEQ ID NO: 20077 - RNA, 19 nt, Homo sapiens
uuauuucucgggugcauuu

SEQ ID NO: 20078 - RNA, 19 nt, Homo sapiens
ugccaugaucuguauuuaa

SEQ ID NO: 20079 - RNA, 19 nt, Homo sapiens
ggagacugacaccagguau

SEQ ID NO: 20080 - RNA, 19 nt, Homo sapiens
cuauggcgcugagauugug

SEQ ID NO: 20081 - RNA, 19 nt, Homo sapiens
acuaaggccgugucucuga

SEQ ID NO: 20082 - RNA, 19 nt, Homo sapiens
ccucgugccaugaucugua

SEQ ID NO: 20083 - RNA, 19 nt, Homo sapiens
ucuacaaccaggaccauga

SEQ ID NO: 20084 - RNA, 19 nt, Homo sapiens
gugccaccaugaagaccuu

SEQ ID NO: 20085 - RNA, 19 nt, Homo sapiens
gcaggaggaggaggagaug

SEQ ID NO: 20086 - RNA, 19 nt, Homo sapiens
gagcgacguggcuauugug

SEQ ID NO: 20087 - RNA, 19 nt, Homo sapiens
gcccagauggaaagacguu

SEQ ID NO: 20088 - RNA, 19 nt, Homo sapiens
caugaacgaguuugaguac

SEQ ID NO: 20089 - RNA, 19 nt, Homo sapiens
cacgguagcacuugaccuu

SEQ ID NO: 20090 - RNA, 19 nt, Homo sapiens
cagaugcaaccucacuaug

SEQ ID NO: 20091 - RNA, 19 nt, Homo sapiens
cgauucacguagggaaaug

SEQ ID NO: 20092 - RNA, 19 nt, Homo sapiens
aagcucagcccacccuuca

SEQ ID NO: 20093 - RNA, 19 nt, Homo sapiens
guacuucgaugaugaauuu

SEQ ID NO: 20094 - RNA, 19 nt, Homo sapiens
gcaaagagggcaucaguga

SEQ ID NO: 20095 - RNA, 19 nt, Homo sapiens
gaaaggaagucaucauugc

SEQ ID NO: 20096 - RNA, 19 nt, Homo sapiens
caagguacuucgaugauga

SEQ ID NO: 20097 - RNA, 19 nt, Homo sapiens
gggcuaaagugaccaugaa

SEQ ID NO: 20098 - RNA, 19 nt, Homo sapiens
ugaggugucugucaucaaa

SEQ ID NO: 20099 - RNA, 19 nt, Homo sapiens
ccaugaagauccugcgaaa

SEQ ID NO: 20100 - RNA, 19 nt, Homo sapiens
ucacugcgcugaaguaugc

SEQ ID NO: 20101 - RNA, 19 nt, Homo sapiens
gcagaaugccagcugauga

SEQ ID NO: 20102 - RNA, 19 nt, Homo sapiens
ugacuucgacuaucucaaa

SEQ ID NO: 20103 - RNA, 19 nt, Homo sapiens
gcgaaaggaagucaucauu

SEQ ID NO: 20104 - RNA, 19 nt, Homo sapiens
cuaaagugaccaugaauga

SEQ ID NO: 20105 - RNA, 19 nt, Homo sapiens
ugaaugacuucgacuaucu

SEQ ID NO: 20106 - RNA, 19 nt, Homo sapiens
uugcugggcugcuuaagaa

SEQ ID NO: 20107 - RNA, 19 nt, Homo sapiens
cgaaaggaagucaucauug

SEQ ID NO: 20108 - RNA, 19 nt, Homo sapiens
gcaaggcacgggcuaaagu

SEQ ID NO: 20109 - RNA, 19 nt, Homo sapiens
gaccgccugugcuuuguga

SEQ ID NO: 20110 - RNA, 19 nt, Homo sapiens
ucucggcucuugaguacuu

SEQ ID NO: 20111 - RNA, 19 nt, Homo sapiens
gggagcgugucuucacaga

SEQ ID NO: 20112 - RNA, 19 nt, Homo sapiens
cagaaugccagcugaugaa

SEQ ID NO: 20113 - RNA, 19 nt, Homo sapiens
gcuaaagugaccaugaaug

SEQ ID NO: 20114 - RNA, 19 nt, Homo sapiens
caagcguggugaauacauc

SEQ ID NO: 20115 - RNA, 19 nt, Homo sapiens
caucaagaucacugacuuu

SEQ ID NO: 20116 - RNA, 19 nt, Homo sapiens
acccaacaccuuugucaua

SEQ ID NO: 20117 - RNA, 19 nt, Homo sapiens
acacaagguacuucgauga

SEQ ID NO: 20118 - RNA, 19 nt, Homo sapiens
cgacugaggagauggaagu

SEQ ID NO: 20119 - RNA, 19 nt, Homo sapiens
acaucaagaucacugacuu

SEQ ID NO: 20120 - RNA, 19 nt, Homo sapiens
ggaugaagucgcucacaca

SEQ ID NO: 20121 - RNA, 19 nt, Homo sapiens
caugaaugacuucgacuau

SEQ ID NO: 20122 - RNA, 19 nt, Homo sapiens
gaaugccagcugaugaaga

SEQ ID NO: 20123 - RNA, 19 nt, Homo sapiens
acaagguacuucgaugaug

SEQ ID NO: 20124 - RNA, 19 nt, Homo sapiens
gcuacuacgccaugaagau

SEQ ID NO: 20125 - RNA, 19 nt, Homo sapiens
ggcuggguguggucaugua

SEQ ID NO: 20126 - RNA, 19 nt, Homo sapiens
cguccgaggucgacacaag

SEQ ID NO: 20127 - RNA, 19 nt, Homo sapiens
gcuggaggacaaugacuau

SEQ ID NO: 20128 - RNA, 19 nt, Homo sapiens
ugucucggcucuugaguac

SEQ ID NO: 20129 - RNA, 19 nt, Homo sapiens
cgacacaagguacuucgau

SEQ ID NO: 20130 - RNA, 19 nt, Homo sapiens
gcuccugccacccuucaaa

SEQ ID NO: 20131 - RNA, 19 nt, Homo sapiens
cacggugccuccugcaugu

SEQ ID NO: 20132 - RNA, 19 nt, Homo sapiens
ccaugaaugacuucgacua

SEQ ID NO: 20133 - RNA, 19 nt, Homo sapiens
cagcaaggcacgggcuaaa

SEQ ID NO: 20134 - RNA, 19 nt, Homo sapiens
aaacaacuucuccguagca

SEQ ID NO: 20135 - RNA, 19 nt, Homo sapiens
agcgacggcuccuucauug

SEQ ID NO: 20136 - RNA, 19 nt, Homo sapiens
cgacccaacaccuuuguca

SEQ ID NO: 20137 - RNA, 19 nt, Homo sapiens
gcccaguccaucacaauca

SEQ ID NO: 20138 - RNA, 19 nt, Homo sapiens
cguggugaauacaucaaga

SEQ ID NO: 20139 - RNA, 19 nt, Homo sapiens
cugaggugcuggaggacaa

SEQ ID NO: 20140 - RNA, 19 nt, Homo sapiens
aaagugaccaugaaugacu

SEQ ID NO: 20141 - RNA, 19 nt, Homo sapiens
caaggcacgggcuaaagug

SEQ ID NO: 20142 - RNA, 19 nt, Homo sapiens
cccaacaccuuugucauac

SEQ ID NO: 20143 - RNA, 19 nt, Homo sapiens
gcuuugugauggaguaugc

SEQ ID NO: 20144 - RNA, 19 nt, Homo sapiens
gguauaccgcgacaucaag

SEQ ID NO: 20145 - RNA, 19 nt, Homo sapiens
ccacgaccgccugugcuuu

SEQ ID NO: 20146 - RNA, 19 nt, Homo sapiens
cacgguacuuccugcugaa

SEQ ID NO: 20147 - RNA, 19 nt, Homo sapiens
gcgaggaccccauggacua

SEQ ID NO: 20148 - RNA, 19 nt, Homo sapiens
gagcuacagugccaaauuu

SEQ ID NO: 20149 - RNA, 19 nt, Homo sapiens
caaauuugcuuccuguuuc

SEQ ID NO: 20150 - RNA, 19 nt, Homo sapiens
ucacggauguuccugauga

SEQ ID NO: 20151 - RNA, 19 nt, Homo sapiens
caagugacaaccaaaguaa

SEQ ID NO: 20152 - RNA, 19 nt, Homo sapiens
ggguaucggugaugagcua

SEQ ID NO: 20153 - RNA, 19 nt, Homo sapiens
ccaaauuugcuuccuguuu

SEQ ID NO: 20154 - RNA, 19 nt, Homo sapiens
caauccaucuguugaggaa

SEQ ID NO: 20155 - RNA, 19 nt, Homo sapiens
gaacuagaacuuucaaacg

SEQ ID NO: 20156 - RNA, 19 nt, Homo sapiens
ggacuuggcaacaggguau

SEQ ID NO: 20157 - RNA, 19 nt, Homo sapiens
ucagacaagugacaaccaa

SEQ ID NO: 20158 - RNA, 19 nt, Homo sapiens
ucucaaggcugccguacug

SEQ ID NO: 20159 - RNA, 19 nt, Homo sapiens
ugaagcggcuggaagagau

SEQ ID NO: 20160 - RNA, 19 nt, Homo sapiens
gcacauggacuuggcaaca

SEQ ID NO: 20161 - RNA, 19 nt, Homo sapiens
ggcaggaugucagguggua

SEQ ID NO: 20162 - RNA, 19 nt, Homo sapiens
ggccuacgcugugucuuga

SEQ ID NO: 20163 - RNA, 19 nt, Homo sapiens
cccaagaacuagaacuuuc

SEQ ID NO: 20164 - RNA, 19 nt, Homo sapiens
caucaucaccuacuacaca

SEQ ID NO: 20165 - RNA, 19 nt, Homo sapiens
ggacaucgugcgggaggua

SEQ ID NO: 20166 - RNA, 19 nt, Homo sapiens
gcaacaggguaucggugau

SEQ ID NO: 20167 - RNA, 19 nt, Homo sapiens
gaugacauacagccuauca

SEQ ID NO: 20168 - RNA, 19 nt, Homo sapiens
acaagugacaaccaaagua

SEQ ID NO: 20169 - RNA, 19 nt, Homo sapiens
gugccaggcccaagaacua

SEQ ID NO: 20170 - RNA, 19 nt, Homo sapiens
gaggcaauccaucuguuga

SEQ ID NO: 20171 - RNA, 19 nt, Homo sapiens
acuagaacuuucaaacguu

SEQ ID NO: 20172 - RNA, 19 nt, Homo sapiens
ggccagguauggugugaag

SEQ ID NO: 20173 - RNA, 19 nt, Homo sapiens
gcccaagaacuagaacuuu

SEQ ID NO: 20174 - RNA, 19 nt, Homo sapiens
ccaagaacuagaacuuuca

SEQ ID NO: 20175 - RNA, 19 nt, Homo sapiens
gaugagcuacagugccaaa

SEQ ID NO: 20176 - RNA, 19 nt, Homo sapiens
ccagcagaguucccaagga

SEQ ID NO: 20177 - RNA, 19 nt, Homo sapiens
gggccuacgcugugucuug

SEQ ID NO: 20178 - RNA, 19 nt, Homo sapiens
ucccaggaguggccaggua

SEQ ID NO: 20179 - RNA, 19 nt, Homo sapiens
gcguggaagccaucaaaga

SEQ ID NO: 20180 - RNA, 19 nt, Homo sapiens
caagaacuagaacuuucaa

SEQ ID NO: 20181 - RNA, 19 nt, Homo sapiens
ugagcuacagugccaaauu

SEQ ID NO: 20182 - RNA, 19 nt, Homo sapiens
caacaggguaucggugaug

SEQ ID NO: 20183 - RNA, 19 nt, Homo sapiens
cugaugacauacagccuau

SEQ ID NO: 20184 - RNA, 19 nt, Homo sapiens
gacaagugacaaccaaagu

SEQ ID NO: 20185 - RNA, 19 nt, Homo sapiens
aacuagaacuuucaaacgu

SEQ ID NO: 20186 - RNA, 19 nt, Homo sapiens
gacagugccaggcccaaga

SEQ ID NO: 20187 - RNA, 19 nt, Homo sapiens
gagguggcauuggcguaug

SEQ ID NO: 20188 - RNA, 19 nt, Homo sapiens
acugcgggcuccugaguga

SEQ ID NO: 20189 - RNA, 19 nt, Homo sapiens
cuacuuccacccacuacuu

SEQ ID NO: 20190 - RNA, 19 nt, Homo sapiens
ggcccaagaacuagaacuu

SEQ ID NO: 20191 - RNA, 19 nt, Homo sapiens
gcugaggcccuugguggaa

SEQ ID NO: 20192 - RNA, 19 nt, Homo sapiens
gugugaagcggcuggaaga

SEQ ID NO: 20193 - RNA, 19 nt, Homo sapiens
gugcugacaucaucaucac

SEQ ID NO: 20194 - RNA, 19 nt, Homo sapiens
gggaugcagcuaagucaag

SEQ ID NO: 20195 - RNA, 19 nt, Homo sapiens
caggagcccuagguuccaa

SEQ ID NO: 20196 - RNA, 19 nt, Homo sapiens
ugucacggauguuccugau

SEQ ID NO: 20197 - RNA, 19 nt, Homo sapiens
cgcugugucuugaucuuug

SEQ ID NO: 20198 - RNA, 19 nt, Homo sapiens
gugaagcggcuggaagaga

SEQ ID NO: 20199 - RNA, 19 nt, Homo sapiens
aaauuugcuuccuguuucu

SEQ ID NO: 20200 - RNA, 19 nt, Homo sapiens
ccugauggcacauggacuu

SEQ ID NO: 20201 - RNA, 19 nt, Homo sapiens
ugaggcaauccaucuguug

SEQ ID NO: 20202 - RNA, 19 nt, Homo sapiens
gcaaaucucuguuguucua

SEQ ID NO: 20203 - RNA, 19 nt, Homo sapiens
gaacuaaugagcagacaua

SEQ ID NO: 20204 - RNA, 19 nt, Homo sapiens
ggaaagagguugcugaaac

SEQ ID NO: 20205 - RNA, 19 nt, Homo sapiens
gaagagcuccuacggauug

SEQ ID NO: 20206 - RNA, 19 nt, Homo sapiens
gcugugagauuuacucuga

SEQ ID NO: 20207 - RNA, 19 nt, Homo sapiens
gaccacaccuaucgaguuu

SEQ ID NO: 20208 - RNA, 19 nt, Homo sapiens
gagcaugaccucaauuauu

SEQ ID NO: 20209 - RNA, 19 nt, Homo sapiens
cuucagaguugucuuuaua

SEQ ID NO: 20210 - RNA, 19 nt, Homo sapiens
aaagagagaaguccuauuu

SEQ ID NO: 20211 - RNA, 19 nt, Homo sapiens
aaacauaguccuggaaaua

SEQ ID NO: 20212 - RNA, 19 nt, Homo sapiens
gcagaaagcaggcaaaucu

SEQ ID NO: 20213 - RNA, 19 nt, Homo sapiens
ggacaucauuucuggaaca

SEQ ID NO: 20214 - RNA, 19 nt, Homo sapiens
gcaguacacuaccaacaga

SEQ ID NO: 20215 - RNA, 19 nt, Homo sapiens
cagauggucuucagaguug

SEQ ID NO: 20216 - RNA, 19 nt, Homo sapiens
agcaugaccucaauuauuu

SEQ ID NO: 20217 - RNA, 19 nt, Homo sapiens
caaaaucuguuuccacuuu

SEQ ID NO: 20218 - RNA, 19 nt, Homo sapiens
gagcagacauaacaucuac

SEQ ID NO: 20219 - RNA, 19 nt, Homo sapiens
gggcaguuauggacacuuu

SEQ ID NO: 20220 - RNA, 19 nt, Homo sapiens
gcaggugguacuagaaaua

SEQ ID NO: 20221 - RNA, 19 nt, Homo sapiens
gagaacugcugcaaagauc

SEQ ID NO: 20222 - RNA, 19 nt, Homo sapiens
ucagagaacugcugcaaag

SEQ ID NO: 20223 - RNA, 19 nt, Homo sapiens
ucaguaugaucguuucuuu

SEQ ID NO: 20224 - RNA, 19 nt, Homo sapiens
agaagucugugaugaacua

SEQ ID NO: 20225 - RNA, 19 nt, Homo sapiens
gcagaugacuauucagacu

SEQ ID NO: 20226 - RNA, 19 nt, Homo sapiens
ugagacagaugcuaaugga

SEQ ID NO: 20227 - RNA, 19 nt, Homo sapiens
ccaagauuguggcauuuga

SEQ ID NO: 20228 - RNA, 19 nt, Homo sapiens
gaacuuccaggacauuaug

SEQ ID NO: 20229 - RNA, 19 nt, Homo sapiens
ccagggcacugcaagcaaa

SEQ ID NO: 20230 - RNA, 19 nt, Homo sapiens
gaacuacuuccuugagaau

SEQ ID NO: 20231 - RNA, 19 nt, Homo sapiens
gcaggcaaaucucuguugu

SEQ ID NO: 20232 - RNA, 19 nt, Homo sapiens
caucauuucuggaacacuu

SEQ ID NO: 20233 - RNA, 19 nt, Homo sapiens
uggaagagcugugugaugu

SEQ ID NO: 20234 - RNA, 19 nt, Homo sapiens
cuaaugagcagacauaaca

SEQ ID NO: 20235 - RNA, 19 nt, Homo sapiens
gggauggagucaugccaaa

SEQ ID NO: 20236 - RNA, 19 nt, Homo sapiens
gcacgaguucucugauuga

SEQ ID NO: 20237 - RNA, 19 nt, Homo sapiens
cagcacgaguucucugauu

SEQ ID NO: 20238 - RNA, 19 nt, Homo sapiens
uaugaucguuucuuugaga

SEQ ID NO: 20239 - RNA, 19 nt, Homo sapiens
agaguugucuuuauaugug

SEQ ID NO: 20240 - RNA, 19 nt, Homo sapiens
cauggcagaugacuauuca

SEQ ID NO: 20241 - RNA, 19 nt, Homo sapiens
ccaacagacuccugaugga

SEQ ID NO: 20242 - RNA, 19 nt, Homo sapiens
acauaguccuggaaauaaa

SEQ ID NO: 20243 - RNA, 19 nt, Homo sapiens
ugaacuacuuccuugagaa

SEQ ID NO: 20244 - RNA, 19 nt, Homo sapiens
gaacuaguaaauuccaugu

SEQ ID NO: 20245 - RNA, 19 nt, Homo sapiens
gaggaaagagguugcugaa

SEQ ID NO: 20246 - RNA, 19 nt, Homo sapiens
cagcauacuuccugaacau

SEQ ID NO: 20247 - RNA, 19 nt, Homo sapiens
gaaagagagaaguccuauu

SEQ ID NO: 20248 - RNA, 19 nt, Homo sapiens
ggaucgggauggagucaug

SEQ ID NO: 20249 - RNA, 19 nt, Homo sapiens
gcaguuaugcccaguucuu

SEQ ID NO: 20250 - RNA, 19 nt, Homo sapiens
ggugguacuagaaauauuu

SEQ ID NO: 20251 - RNA, 19 nt, Homo sapiens
gcaguuauggacacuuuga

SEQ ID NO: 20252 - RNA, 19 nt, Homo sapiens
ucagaguugucuuuauaug

SEQ ID NO: 20253 - RNA, 19 nt, Homo sapiens
ugauguggcccaugaguuu

SEQ ID NO: 20254 - RNA, 19 nt, Homo sapiens
gugcaguaaugacuaccua

SEQ ID NO: 20255 - RNA, 19 nt, Homo sapiens
cagaaagagugucucaucu

SEQ ID NO: 20256 - RNA, 19 nt, Homo sapiens
gcugcuggcuucaucuuca

SEQ ID NO: 20257 - RNA, 19 nt, Homo sapiens
gcgcaguuaugcccaguuc

SEQ ID NO: 20258 - RNA, 19 nt, Homo sapiens
aggcaaaucucuguuguuc

SEQ ID NO: 20259 - RNA, 19 nt, Homo sapiens
ugaaugccgugaggaaaga

SEQ ID NO: 20260 - RNA, 19 nt, Homo sapiens
gcaagcaaaugcccuuucc

SEQ ID NO: 20261 - RNA, 19 nt, Homo sapiens
ggucuucagaguugucuuu

SEQ ID NO: 20262 - RNA, 19 nt, Homo sapiens
gaugaugaacuacuuccuu

SEQ ID NO: 20263 - RNA, 19 nt, Homo sapiens
gaaacagccgagugccaaa

SEQ ID NO: 20264 - RNA, 19 nt, Homo sapiens
aguaaugacuaccuaggaa

SEQ ID NO: 20265 - RNA, 19 nt, Homo sapiens
ccagaaagagugucucauc

SEQ ID NO: 20266 - RNA, 19 nt, Homo sapiens
caacgucaaacucaugaga

SEQ ID NO: 20267 - RNA, 19 nt, Homo sapiens
gcaguccucagcgcaguua

SEQ ID NO: 20268 - RNA, 19 nt, Homo sapiens
gaguugucuuuauauguga

SEQ ID NO: 20269 - RNA, 19 nt, Homo sapiens
guggacugcugaagaacuu

SEQ ID NO: 20270 - RNA, 19 nt, Homo sapiens
ggaggccacugcauuuuga

SEQ ID NO: 20271 - RNA, 19 nt, Homo sapiens
gaggagcguuucguuugga

SEQ ID NO: 20272 - RNA, 19 nt, Homo sapiens
ugugugauguggcccauga

SEQ ID NO: 20273 - RNA, 19 nt, Homo sapiens
gagauuuacucugauucug

SEQ ID NO: 20274 - RNA, 19 nt, Homo sapiens
gggcaggugguacuagaaa

SEQ ID NO: 20275 - RNA, 19 nt, Homo sapiens
cagacucccucaucaccaa

SEQ ID NO: 20276 - RNA, 19 nt, Homo sapiens
ccagauggucuucagaguu

SEQ ID NO: 20277 - RNA, 19 nt, Homo sapiens
gaacugaagccucauuccu

SEQ ID NO: 20278 - RNA, 19 nt, Homo sapiens
ugugagauuuacucugauu

SEQ ID NO: 20279 - RNA, 19 nt, Homo sapiens
uauggacacuuugaaacaa

SEQ ID NO: 20280 - RNA, 19 nt, Homo sapiens
gcccaaaacugccccaaga

SEQ ID NO: 20281 - RNA, 19 nt, Homo sapiens
gaacugcugcaaagaucug

SEQ ID NO: 20282 - RNA, 19 nt, Homo sapiens
guacaucuuccgccacaau

SEQ ID NO: 20283 - RNA, 19 nt, Homo sapiens
gaugccaggcugugagauu

SEQ ID NO: 20284 - RNA, 19 nt, Homo sapiens
caaucaccuucguggauga

SEQ ID NO: 20285 - RNA, 19 nt, Homo sapiens
aguaugaucguuucuuuga

SEQ ID NO: 20286 - RNA, 19 nt, Homo sapiens
aaagucaggaucccuaaga

SEQ ID NO: 20287 - RNA, 19 nt, Homo sapiens
gaccucaauuauuucacuu

SEQ ID NO: 20288 - RNA, 19 nt, Homo sapiens
agaaucugcuagucacaug

SEQ ID NO: 20289 - RNA, 19 nt, Homo sapiens
agucugugaugaacuaaug

SEQ ID NO: 20290 - RNA, 19 nt, Homo sapiens
ucagucuggugcaguaaug

SEQ ID NO: 20291 - RNA, 19 nt, Homo sapiens
ucaggaggaugugcaggaa

SEQ ID NO: 20292 - RNA, 19 nt, Homo sapiens
cacaggagccagcauacuu

SEQ ID NO: 20293 - RNA, 19 nt, Homo sapiens
gcaccagcgcaacgucaaa

SEQ ID NO: 20294 - RNA, 19 nt, Homo sapiens
gugucagucuggugcagua

SEQ ID NO: 20295 - RNA, 19 nt, Homo sapiens
guuuggacuucucgacuug

SEQ ID NO: 20296 - RNA, 19 nt, Homo sapiens
gccauuaucauauccagau

SEQ ID NO: 20297 - RNA, 19 nt, Homo sapiens
gaagugaugagugaaagag

SEQ ID NO: 20298 - RNA, 19 nt, Homo sapiens
cgaggagcguuucguuugg

SEQ ID NO: 20299 - RNA, 19 nt, Homo sapiens
cauacuuccugaacaugga

SEQ ID NO: 20300 - RNA, 19 nt, Homo sapiens
aaagaaugaccacaccuau

SEQ ID NO: 20301 - RNA, 19 nt, Homo sapiens
gaggaugugcaggaaauga

SEQ ID NO: 20302 - RNA, 19 nt, Homo sapiens
ggaccaaacuguucucaaa

SEQ ID NO: 20303 - RNA, 19 nt, Homo sapiens
caacaggacuuuagguuca

SEQ ID NO: 20304 - RNA, 19 nt, Homo sapiens
caauaugccuggaaacuau

SEQ ID NO: 20305 - RNA, 19 nt, Homo sapiens
gcugcaggcuucaucuuua

SEQ ID NO: 20306 - RNA, 19 nt, Homo sapiens
gcaaggugguuaagacuca

SEQ ID NO: 20307 - RNA, 19 nt, Homo sapiens
gaagccagcugccuaggau

SEQ ID NO: 20308 - RNA, 19 nt, Homo sapiens
gggacaagaucauggagaa

SEQ ID NO: 20309 - RNA, 19 nt, Homo sapiens
caaugacccugaccaccua

SEQ ID NO: 20310 - RNA, 19 nt, Homo sapiens
uggcugagcugcaccagaa

SEQ ID NO: 20311 - RNA, 19 nt, Homo sapiens
ccacagcccucagaugaug

SEQ ID NO: 20312 - RNA, 19 nt, Homo sapiens
ggugcgagauuuacucaga

SEQ ID NO: 20313 - RNA, 19 nt, Homo sapiens
ccgcugggcugaugcauau

SEQ ID NO: 20314 - RNA, 19 nt, Homo sapiens
guucucaaauccaccuuaa

SEQ ID NO: 20315 - RNA, 19 nt, Homo sapiens
caucaucucuggaacucuu

SEQ ID NO: 20316 - RNA, 19 nt, Homo sapiens
gguuaagacucaccaguuc

SEQ ID NO: 20317 - RNA, 19 nt, Homo sapiens
gaagucuaacccuaagaua

SEQ ID NO: 20318 - RNA, 19 nt, Homo sapiens
aggaagaugugaaggcuuu

SEQ ID NO: 20319 - RNA, 19 nt, Homo sapiens
gcauaagauugacaucauc

SEQ ID NO: 20320 - RNA, 19 nt, Homo sapiens
gcccucagaugauggaaga

SEQ ID NO: 20321 - RNA, 19 nt, Homo sapiens
caaugacucuacucucuuc

SEQ ID NO: 20322 - RNA, 19 nt, Homo sapiens
gccaaugacucuacucucu

SEQ ID NO: 20323 - RNA, 19 nt, Homo sapiens
agaacaauaugccuggaaa

SEQ ID NO: 20324 - RNA, 19 nt, Homo sapiens
ggagcgugauggaauuaug

SEQ ID NO: 20325 - RNA, 19 nt, Homo sapiens
gcucuucuccuccugcuuu

SEQ ID NO: 20326 - RNA, 19 nt, Homo sapiens
ggacucagcccugcucuuc

SEQ ID NO: 20327 - RNA, 19 nt, Homo sapiens
acuuugagcucaugaguga

SEQ ID NO: 20328 - RNA, 19 nt, Homo sapiens
agagcaagauugugcagaa

SEQ ID NO: 20329 - RNA, 19 nt, Homo sapiens
caccacagcccucagauga

SEQ ID NO: 20330 - RNA, 19 nt, Homo sapiens
acaagaucauggagaagaa

SEQ ID NO: 20331 - RNA, 19 nt, Homo sapiens
ggacauggugcgcuccuau

SEQ ID NO: 20332 - RNA, 19 nt, Homo sapiens
gcugaugcauaucccuuug

SEQ ID NO: 20333 - RNA, 19 nt, Homo sapiens
gacaagaucauggagaaga

SEQ ID NO: 20334 - RNA, 19 nt, Homo sapiens
cuucaguuaugaccaguuu

SEQ ID NO: 20335 - RNA, 19 nt, Homo sapiens
gaugggaagagcaagauug

SEQ ID NO: 20336 - RNA, 19 nt, Homo sapiens
aacaaaggcuggaggagau

SEQ ID NO: 20337 - RNA, 19 nt, Homo sapiens
caguggagcagccaaguuu

SEQ ID NO: 20338 - RNA, 19 nt, Homo sapiens
cccaguaugucaccaccua

SEQ ID NO: 20339 - RNA, 19 nt, Homo sapiens
gcaaggccuuuggcugugu

SEQ ID NO: 20340 - RNA, 19 nt, Homo sapiens
ugagguccaugcuguagga

SEQ ID NO: 20341 - RNA, 19 nt, Homo sapiens
agaaacaggaucacaccua

SEQ ID NO: 20342 - RNA, 19 nt, Homo sapiens
cuagcugaauugagccuaa

SEQ ID NO: 20343 - RNA, 19 nt, Homo sapiens
gugaaccgcugggcugaug

SEQ ID NO: 20344 - RNA, 19 nt, Homo sapiens
cgugauggaauuaugcaua

SEQ ID NO: 20345 - RNA, 19 nt, Homo sapiens
gauccaagguauccguaac

SEQ ID NO: 20346 - RNA, 19 nt, Homo sapiens
gagcaagauugugcagaag

SEQ ID NO: 20347 - RNA, 19 nt, Homo sapiens
ggaugagguccaugcugua

SEQ ID NO: 20348 - RNA, 19 nt, Homo sapiens
ggacuuuagguucaagaug

SEQ ID NO: 20349 - RNA, 19 nt, Homo sapiens
uggaaacuaugucuucagu

SEQ ID NO: 20350 - RNA, 19 nt, Homo sapiens
gaccaaacuguucucaaau

SEQ ID NO: 20351 - RNA, 19 nt, Homo sapiens
gcagggcaacaggacuuua

SEQ ID NO: 20352 - RNA, 19 nt, Homo sapiens
gccaucaacuacccaacug

SEQ ID NO: 20353 - RNA, 19 nt, Homo sapiens
gacaucaucucuggaacuc

SEQ ID NO: 20354 - RNA, 19 nt, Homo sapiens
acaauaugccuggaaacua

SEQ ID NO: 20355 - RNA, 19 nt, Homo sapiens
gggccacugucccuucaug

SEQ ID NO: 20356 - RNA, 19 nt, Homo sapiens
cucagaugauggaagauuu

SEQ ID NO: 20357 - RNA, 19 nt, Homo sapiens
gcaccaguaaguuucaugu

SEQ ID NO: 20358 - RNA, 19 nt, Homo sapiens
uagcugaauugagccuaaa

SEQ ID NO: 20359 - RNA, 19 nt, Homo sapiens
caccaccuaugccugagaa

SEQ ID NO: 20360 - RNA, 19 nt, Homo sapiens
ggcaacaggacuuuagguu

SEQ ID NO: 20361 - RNA, 19 nt, Homo sapiens
ccaagcauggcaucuaugu

SEQ ID NO: 20362 - RNA, 19 nt, Homo sapiens
ggcuucaucuuuaccacuu

SEQ ID NO: 20363 - RNA, 19 nt, Homo sapiens
gaggaguugugugaugugu

SEQ ID NO: 20364 - RNA, 19 nt, Homo sapiens
acucuacucucuucaccuu

SEQ ID NO: 20365 - RNA, 19 nt, Homo sapiens
ugcauaagauugacaucau

SEQ ID NO: 20366 - RNA, 19 nt, Homo sapiens
gcagccaaguuugucuuca

SEQ ID NO: 20367 - RNA, 19 nt, Homo sapiens
gagaagaaacaggaucaca

SEQ ID NO: 20368 - RNA, 19 nt, Homo sapiens
ucgccguccuguacacuuu

SEQ ID NO: 20369 - RNA, 19 nt, Homo sapiens
agagaagucuaacccuaag

SEQ ID NO: 20370 - RNA, 19 nt, Homo sapiens
guguccgucugguguagua

SEQ ID NO: 20371 - RNA, 19 nt, Homo sapiens
cuacuccugucuucugcuu

SEQ ID NO: 20372 - RNA, 19 nt, Homo sapiens
cuccaagcauggcaucuau

SEQ ID NO: 20373 - RNA, 19 nt, Homo sapiens
accaaacuguucucaaauc

SEQ ID NO: 20374 - RNA, 19 nt, Homo sapiens
augcagcacucaacagcaa

SEQ ID NO: 20375 - RNA, 19 nt, Homo sapiens
gacccugaccaccuaaaga

SEQ ID NO: 20376 - RNA, 19 nt, Homo sapiens
gagcagccaaguuugucuu

SEQ ID NO: 20377 - RNA, 19 nt, Homo sapiens
ccaaugacucuacucucuu

SEQ ID NO: 20378 - RNA, 19 nt, Homo sapiens
caagaucauggagaagaaa

SEQ ID NO: 20379 - RNA, 19 nt, Homo sapiens
ccugucuucugcuuuguug

SEQ ID NO: 20380 - RNA, 19 nt, Homo sapiens
acuccugucuucugcuuug

SEQ ID NO: 20381 - RNA, 19 nt, Homo sapiens
ccaaacuguucucaaaucc

SEQ ID NO: 20382 - RNA, 19 nt, Homo sapiens
ugaugugucccaccaguau

SEQ ID NO: 20383 - RNA, 19 nt, Homo sapiens
ccuaagauacccaaaauug

SEQ ID NO: 20384 - RNA, 19 nt, Homo sapiens
gauguguccgucuggugua

SEQ ID NO: 20385 - RNA, 19 nt, Homo sapiens
gaaggcagccccagaaguc

SEQ ID NO: 20386 - RNA, 19 nt, Homo sapiens
cuggagcucuagaaucugu

SEQ ID NO: 20387 - RNA, 19 nt, Homo sapiens
gaacaauaugccuggaaac

SEQ ID NO: 20388 - RNA, 19 nt, Homo sapiens
gcagaaggcagccccagaa

SEQ ID NO: 20389 - RNA, 19 nt, Homo sapiens
ucucaaauccaccuuaagg

SEQ ID NO: 20390 - RNA, 19 nt, Homo sapiens
ucgaggaguugugugaugu

SEQ ID NO: 20391 - RNA, 19 nt, Homo sapiens
uaggcaaggugguuaagac

SEQ ID NO: 20392 - RNA, 19 nt, Homo sapiens
ccucagaugauggaagauu

SEQ ID NO: 20393 - RNA, 19 nt, Homo sapiens
gcacaugcgccagcuacuc

SEQ ID NO: 20394 - RNA, 19 nt, Homo sapiens
cucuggagcucuagaaucu

SEQ ID NO: 20395 - RNA, 19 nt, Homo sapiens
gaugagguccaugcuguag

SEQ ID NO: 20396 - RNA, 19 nt, Homo sapiens
ccgacacccucaggucuug

SEQ ID NO: 20397 - RNA, 19 nt, Homo sapiens
acucaccaguuccuguuug

SEQ ID NO: 20398 - RNA, 19 nt, Homo sapiens
ggaugggaagagcaagauu

SEQ ID NO: 20399 - RNA, 19 nt, Homo sapiens
gugaucuccugcucuccaa

SEQ ID NO: 20400 - RNA, 19 nt, Homo sapiens
gcaaugcagcacucaacag

SEQ ID NO: 20401 - RNA, 19 nt, Homo sapiens
cagaaguccaggaagaugu

SEQ ID NO: 20402 - RNA, 19 nt, Homo sapiens
gcagauauaugcacacuuu

SEQ ID NO: 20403 - RNA, 19 nt, Homo sapiens
ggaagagccucagaauuua

SEQ ID NO: 20404 - RNA, 19 nt, Homo sapiens
caagaaggcauccugauua

SEQ ID NO: 20405 - RNA, 19 nt, Homo sapiens
cagaagacauccuuacuuu

SEQ ID NO: 20406 - RNA, 19 nt, Homo sapiens
aaacauacguucccaaaga

SEQ ID NO: 20407 - RNA, 19 nt, Homo sapiens
gcucaucgguuuaaagauu

SEQ ID NO: 20408 - RNA, 19 nt, Homo sapiens
ugacagaucuuaccaaagu

SEQ ID NO: 20409 - RNA, 19 nt, Homo sapiens
ggaagucgaugaaacauac

SEQ ID NO: 20410 - RNA, 19 nt, Homo sapiens
gaagacauccuuacuuuua

SEQ ID NO: 20411 - RNA, 19 nt, Homo sapiens
uggaagagccucagaauuu

SEQ ID NO: 20412 - RNA, 19 nt, Homo sapiens
ugaaagcuguuauggauga

SEQ ID NO: 20413 - RNA, 19 nt, Homo sapiens
ccacuucgguagaggauuu

SEQ ID NO: 20414 - RNA, 19 nt, Homo sapiens
guaaacauccugaagcaaa

SEQ ID NO: 20415 - RNA, 19 nt, Homo sapiens
gcaagaaggcauccugauu

SEQ ID NO: 20416 - RNA, 19 nt, Homo sapiens
ucugugggcuaauuaaaua

SEQ ID NO: 20417 - RNA, 19 nt, Homo sapiens
caaaguguucgaugaauuu

SEQ ID NO: 20418 - RNA, 19 nt, Homo sapiens
ccaaaguguucgaugaauu

SEQ ID NO: 20419 - RNA, 19 nt, Homo sapiens
ugagaugccugcugacuug

SEQ ID NO: 20420 - RNA, 19 nt, Homo sapiens
ugaaguaacugaauuugca

SEQ ID NO: 20421 - RNA, 19 nt, Homo sapiens
gaacaggcgaccaugcuuu

SEQ ID NO: 20422 - RNA, 19 nt, Homo sapiens
ugcagaaguuuccaaguua

SEQ ID NO: 20423 - RNA, 19 nt, Homo sapiens
gaccagagguugaugugau

SEQ ID NO: 20424 - RNA, 19 nt, Homo sapiens
gaagagccucagaauuuaa

SEQ ID NO: 20425 - RNA, 19 nt, Homo sapiens
gacaaauuaugcacaguug

SEQ ID NO: 20426 - RNA, 19 nt, Homo sapiens
guuccaguguucucucuua

SEQ ID NO: 20427 - RNA, 19 nt, Homo sapiens
ucaaagauguguugcuauc

SEQ ID NO: 20428 - RNA, 19 nt, Homo sapiens
ugaaaccuauggugaaaug

SEQ ID NO: 20429 - RNA, 19 nt, Homo sapiens
gaaauugccagaagacauc

SEQ ID NO: 20430 - RNA, 19 nt, Homo sapiens
ccaguguucucucuuauuc

SEQ ID NO: 20431 - RNA, 19 nt, Homo sapiens
ggagagacaaaucaagaaa

SEQ ID NO: 20432 - RNA, 19 nt, Homo sapiens
gaugugaugugcacugcuu

SEQ ID NO: 20433 - RNA, 19 nt, Homo sapiens
ugaaguggguaaccuuuau

SEQ ID NO: 20434 - RNA, 19 nt, Homo sapiens
caccuuccaugcagauaua

SEQ ID NO: 20435 - RNA, 19 nt, Homo sapiens
gcacagaauccuuggugaa

SEQ ID NO: 20436 - RNA, 19 nt, Homo sapiens
gcagaaguuuccaaguuag

SEQ ID NO: 20437 - RNA, 19 nt, Homo sapiens
gaggauuucuaguuucugu

SEQ ID NO: 20438 - RNA, 19 nt, Homo sapiens
cagccuaccaugagaauaa

SEQ ID NO: 20439 - RNA, 19 nt, Homo sapiens
ugaaugcuaugccaaagug

SEQ ID NO: 20440 - RNA, 19 nt, Homo sapiens
acaagaaccugagagaaau

SEQ ID NO: 20441 - RNA, 19 nt, Homo sapiens
gagaugcacacaagaguga

SEQ ID NO: 20442 - RNA, 19 nt, Homo sapiens
acugaaagcuguuauggau

SEQ ID NO: 20443 - RNA, 19 nt, Homo sapiens
ugaaaccacucuagagaag

SEQ ID NO: 20444 - RNA, 19 nt, Homo sapiens
agagacaaaucaagaaaca

SEQ ID NO: 20445 - RNA, 19 nt, Homo sapiens
gaaaguaccccaaguguca

SEQ ID NO: 20446 - RNA, 19 nt, Homo sapiens
uugcagaaguuuccaaguu

SEQ ID NO: 20447 - RNA, 19 nt, Homo sapiens
gagaaggagagacaaauca

SEQ ID NO: 20448 - RNA, 19 nt, Homo sapiens
gaaggcauccugauuacuc

SEQ ID NO: 20449 - RNA, 19 nt, Homo sapiens
uugccaagcugcugauaaa

SEQ ID NO: 20450 - RNA, 19 nt, Homo sapiens
caaagaguuuaaugcugaa

SEQ ID NO: 20451 - RNA, 19 nt, Homo sapiens
uauaugaaauugccagaag

SEQ ID NO: 20452 - RNA, 19 nt, Homo sapiens
guuuaaagauuugggagaa

SEQ ID NO: 20453 - RNA, 19 nt, Homo sapiens
uuucaaagauguguugcua

SEQ ID NO: 20454 - RNA, 19 nt, Homo sapiens
gcugcaaggcugacgauaa

SEQ ID NO: 20455 - RNA, 19 nt, Homo sapiens
ccagaaugcgcuauuaguu

SEQ ID NO: 20456 - RNA, 19 nt, Homo sapiens
gauucgaucuccaguaaac

SEQ ID NO: 20457 - RNA, 19 nt, Homo sapiens
gaaguuuccaaguuaguga

SEQ ID NO: 20458 - RNA, 19 nt, Homo sapiens
ucgaugaacuucgggauga

SEQ ID NO: 20459 - RNA, 19 nt, Homo sapiens
aacaagaaccugagagaaa

SEQ ID NO: 20460 - RNA, 19 nt, Homo sapiens
ugaaacauacguucccaaa

SEQ ID NO: 20461 - RNA, 19 nt, Homo sapiens
guagaggucucaagaaacc

SEQ ID NO: 20462 - RNA, 19 nt, Homo sapiens
cugaaggaaugcugugaaa

SEQ ID NO: 20463 - RNA, 19 nt, Homo sapiens
gaaugcuucuugcaacaca

SEQ ID NO: 20464 - RNA, 19 nt, Homo sapiens
cgugaaaccuauggugaaa

SEQ ID NO: 20465 - RNA, 19 nt, Homo sapiens
gagcaacugaaagcuguua

SEQ ID NO: 20466 - RNA, 19 nt, Homo sapiens
gaaguggguaaccuuuauu

SEQ ID NO: 20467 - RNA, 19 nt, Homo sapiens
ugacuugccuucauuagcu

SEQ ID NO: 20468 - RNA, 19 nt, Homo sapiens
gaaaugaaugcuucuugca

SEQ ID NO: 20469 - RNA, 19 nt, Homo sapiens
ucucugugcuucaauuaau

SEQ ID NO: 20470 - RNA, 19 nt, Homo sapiens
aagcuguuauggaugauuu

SEQ ID NO: 20471 - RNA, 19 nt, Homo sapiens
uuaaagauuugggagaaga

SEQ ID NO: 20472 - RNA, 19 nt, Homo sapiens
ccauggagaucugcuugaa

SEQ ID NO: 20473 - RNA, 19 nt, Homo sapiens
gaaccugagagaaaugaau

SEQ ID NO: 20474 - RNA, 19 nt, Homo sapiens
uggaugauuucgcagcuuu

SEQ ID NO: 20475 - RNA, 19 nt, Homo sapiens
gaaccaguuauguguguug

SEQ ID NO: 20476 - RNA, 19 nt, Homo sapiens
uuguagaggucucaagaaa

SEQ ID NO: 20477 - RNA, 19 nt, Homo sapiens
aaguaaggauguuugcaaa

SEQ ID NO: 20478 - RNA, 19 nt, Homo sapiens
gauaaggagaccugcuuug

SEQ ID NO: 20479 - RNA, 19 nt, Homo sapiens
gcaaggcugacgauaagga

SEQ ID NO: 20480 - RNA, 19 nt, Homo sapiens
cugcaaggcugacgauaag

SEQ ID NO: 20481 - RNA, 19 nt, Homo sapiens
agugacagaucuuaccaaa

SEQ ID NO: 20482 - RNA, 19 nt, Homo sapiens
ccagaagacauccuuacuu

SEQ ID NO: 20483 - RNA, 19 nt, Homo sapiens
cuucagcaguguccauuug

SEQ ID NO: 20484 - RNA, 19 nt, Homo sapiens
gagaguacaaauuccagaa

SEQ ID NO: 20485 - RNA, 19 nt, Homo sapiens
ugccaaagcucgaugaacu

SEQ ID NO: 20486 - RNA, 19 nt, Homo sapiens
uaaagcugccugccuguug

SEQ ID NO: 20487 - RNA, 19 nt, Homo sapiens
gaacuccuuuucuuugcua

SEQ ID NO: 20488 - RNA, 19 nt, Homo sapiens
acaaagaugacaacccaaa

SEQ ID NO: 20489 - RNA, 19 nt, Homo sapiens
ccucagaauuuaaucaaac

SEQ ID NO: 20490 - RNA, 19 nt, Homo sapiens
uaugaaaccacucuagaga

SEQ ID NO: 20491 - RNA, 19 nt, Homo sapiens
ggaaugcugccauggagau

SEQ ID NO: 20492 - RNA, 19 nt, Homo sapiens
ccacacgccuuuggcacaa

SEQ ID NO: 20493 - RNA, 19 nt, Homo sapiens
cagaaugcgcuauuaguuc

SEQ ID NO: 20494 - RNA, 19 nt, Homo sapiens
aaacuaugcugaggcaaag

SEQ ID NO: 20495 - RNA, 19 nt, Homo sapiens
ccaaguauaucugugaaaa

SEQ ID NO: 20496 - RNA, 19 nt, Homo sapiens
auggagaucugcuugaaug

SEQ ID NO: 20497 - RNA, 19 nt, Homo sapiens
ccagagauuucccaaagcu

SEQ ID NO: 20498 - RNA, 19 nt, Homo sapiens
gaaguaacugaauuugcaa

SEQ ID NO: 20499 - RNA, 19 nt, Homo sapiens
aaagugggcagcaaauguu

SEQ ID NO: 20500 - RNA, 19 nt, Homo sapiens
uugagcagcuuggagagua

SEQ ID NO: 20501 - RNA, 19 nt, Homo sapiens
cugcagauccucaugaaug

SEQ ID NO: 20502 - RNA, 19 nt, Homo sapiens
gaacguggauuguauuuaa

SEQ ID NO: 20503 - RNA, 19 nt, Homo sapiens
gauaauaggucauauguug

SEQ ID NO: 20504 - RNA, 19 nt, Homo sapiens
ggaauaagaagcucaaaua

SEQ ID NO: 20505 - RNA, 19 nt, Homo sapiens
gaacaggcaguauuugaua

SEQ ID NO: 20506 - RNA, 19 nt, Homo sapiens
gaaggcaaaccucaaauaa

SEQ ID NO: 20507 - RNA, 19 nt, Homo sapiens
gcagguacauuucugauuc

SEQ ID NO: 20508 - RNA, 19 nt, Homo sapiens
gccauucaguggacaauua

SEQ ID NO: 20509 - RNA, 19 nt, Homo sapiens
gggauaacaucacucuuaa

SEQ ID NO: 20510 - RNA, 19 nt, Homo sapiens
uaacaucacucuuaaaugc

SEQ ID NO: 20511 - RNA, 19 nt, Homo sapiens
gaaugucucugcuauaagu

SEQ ID NO: 20512 - RNA, 19 nt, Homo sapiens
cuacaaguguucccugaua

SEQ ID NO: 20513 - RNA, 19 nt, Homo sapiens
gaagacaguuauccagaug

SEQ ID NO: 20514 - RNA, 19 nt, Homo sapiens
gcaugaacguggauuguau

SEQ ID NO: 20515 - RNA, 19 nt, Homo sapiens
caucacaguucacuauuug

SEQ ID NO: 20516 - RNA, 19 nt, Homo sapiens
ucaaauacuuacacacuga

SEQ ID NO: 20517 - RNA, 19 nt, Homo sapiens
ggucauauguuguguuugg

SEQ ID NO: 20518 - RNA, 19 nt, Homo sapiens
gcaggagguugaaggacua

SEQ ID NO: 20519 - RNA, 19 nt, Homo sapiens
caacagccaucacaguuca

SEQ ID NO: 20520 - RNA, 19 nt, Homo sapiens
ccaagaaggaggaggaaua

SEQ ID NO: 20521 - RNA, 19 nt, Homo sapiens
uaucauaccuugccgacuu

SEQ ID NO: 20522 - RNA, 19 nt, Homo sapiens
ucacaaaacugaagccuaa

SEQ ID NO: 20523 - RNA, 19 nt, Homo sapiens
acaaggaccucgguaauau

SEQ ID NO: 20524 - RNA, 19 nt, Homo sapiens
acaguaaacuccuugaaug

SEQ ID NO: 20525 - RNA, 19 nt, Homo sapiens
acaaagacauugacagcaa

SEQ ID NO: 20526 - RNA, 19 nt, Homo sapiens
ggaccucgguaauauggaa

SEQ ID NO: 20527 - RNA, 19 nt, Homo sapiens
aaucacagaugcauauaga

SEQ ID NO: 20528 - RNA, 19 nt, Homo sapiens
guacauuucugauucugau

SEQ ID NO: 20529 - RNA, 19 nt, Homo sapiens
guucaaguauuaagcaguu

SEQ ID NO: 20530 - RNA, 19 nt, Homo sapiens
ccugcucggugacauauua

SEQ ID NO: 20531 - RNA, 19 nt, Homo sapiens
gcaaccaucuaaaccugaa

SEQ ID NO: 20532 - RNA, 19 nt, Homo sapiens
gaugguauacuguaaauuc

SEQ ID NO: 20533 - RNA, 19 nt, Homo sapiens
gguggcagcuugugaagau

SEQ ID NO: 20534 - RNA, 19 nt, Homo sapiens
gcaauucaugguucaagua

SEQ ID NO: 20535 - RNA, 19 nt, Homo sapiens
ggagccgacucuuugauau

SEQ ID NO: 20536 - RNA, 19 nt, Homo sapiens
agaagugacuagacagauu

SEQ ID NO: 20537 - RNA, 19 nt, Homo sapiens
ggacagcccgaaggaauaa

SEQ ID NO: 20538 - RNA, 19 nt, Homo sapiens
ccagcgaacucucagaaau

SEQ ID NO: 20539 - RNA, 19 nt, Homo sapiens
ucaggaugcuggaaacuau

SEQ ID NO: 20540 - RNA, 19 nt, Homo sapiens
gaaugcaacugugguaugg

SEQ ID NO: 20541 - RNA, 19 nt, Homo sapiens
ugacucagcucuauaccau

SEQ ID NO: 20542 - RNA, 19 nt, Homo sapiens
aaaguugggugacugcauu

SEQ ID NO: 20543 - RNA, 19 nt, Homo sapiens
cagcgaacucucagaaaua

SEQ ID NO: 20544 - RNA, 19 nt, Homo sapiens
cauaggagccgacucuuug

SEQ ID NO: 20545 - RNA, 19 nt, Homo sapiens
aaucugagcagguacauuu

SEQ ID NO: 20546 - RNA, 19 nt, Homo sapiens
uugaaugucucugcuauaa

SEQ ID NO: 20547 - RNA, 19 nt, Homo sapiens
gaagugacuagacagauug

SEQ ID NO: 20548 - RNA, 19 nt, Homo sapiens
aaccaaggcugacauacaa

SEQ ID NO: 20549 - RNA, 19 nt, Homo sapiens
uaggucauauguuguguuu

SEQ ID NO: 20550 - RNA, 19 nt, Homo sapiens
gaacaguaaacuccuugaa

SEQ ID NO: 20551 - RNA, 19 nt, Homo sapiens
ugguauggaugaaagauaa

SEQ ID NO: 20552 - RNA, 19 nt, Homo sapiens
ccaucacaguucacuauuu

SEQ ID NO: 20553 - RNA, 19 nt, Homo sapiens
caucuaaaccugaaauugu

SEQ ID NO: 20554 - RNA, 19 nt, Homo sapiens
uggauaaucugagcaggua

SEQ ID NO: 20555 - RNA, 19 nt, Homo sapiens
guagaaggcaaaccucaaa

SEQ ID NO: 20556 - RNA, 19 nt, Homo sapiens
ugaaggagcgguggucaua

SEQ ID NO: 20557 - RNA, 19 nt, Homo sapiens
guaaacuccuugaaugucu

SEQ ID NO: 20558 - RNA, 19 nt, Homo sapiens
gaaacuaugucugcgaaac

SEQ ID NO: 20559 - RNA, 19 nt, Homo sapiens
cuacagagcaggugacaau

SEQ ID NO: 20560 - RNA, 19 nt, Homo sapiens
aauggcagguauuauagua

SEQ ID NO: 20561 - RNA, 19 nt, Homo sapiens
cagauccucuacaaagaaa

SEQ ID NO: 20562 - RNA, 19 nt, Homo sapiens
uaaacaaggaccucgguaa

SEQ ID NO: 20563 - RNA, 19 nt, Homo sapiens
cuauuuggauuuguccuua

SEQ ID NO: 20564 - RNA, 19 nt, Homo sapiens
gcauauagacacacauaca

SEQ ID NO: 20565 - RNA, 19 nt, Homo sapiens
uaagagagaaacuguccua

SEQ ID NO: 20566 - RNA, 19 nt, Homo sapiens
uggcagguauuauaguaaa

SEQ ID NO: 20567 - RNA, 19 nt, Homo sapiens
ggaagcgucauaaaccaaa

SEQ ID NO: 20568 - RNA, 19 nt, Homo sapiens
gaauacaaagacagauuga

SEQ ID NO: 20569 - RNA, 19 nt, Homo sapiens
gggaguugcuguuaaucug

SEQ ID NO: 20570 - RNA, 19 nt, Homo sapiens
gaaggaggaggaauaugga

SEQ ID NO: 20571 - RNA, 19 nt, Homo sapiens
gaauaagaagcucaaauac

SEQ ID NO: 20572 - RNA, 19 nt, Homo sapiens
ggaaauggacccagugacu

SEQ ID NO: 20573 - RNA, 19 nt, Homo sapiens
gauugaaccucucagaaaa

SEQ ID NO: 20574 - RNA, 19 nt, Homo sapiens
acucauauugcccuaauua

SEQ ID NO: 20575 - RNA, 19 nt, Homo sapiens
gcuguuaaucugauguaua

SEQ ID NO: 20576 - RNA, 19 nt, Homo sapiens
gauaagugaugaaaacaga

SEQ ID NO: 20577 - RNA, 19 nt, Homo sapiens
aggcaaaccucaaauaaaa

SEQ ID NO: 20578 - RNA, 19 nt, Homo sapiens
gaaggaauaagaagcucaa

SEQ ID NO: 20579 - RNA, 19 nt, Homo sapiens
uacaagugcugccaccaaa

SEQ ID NO: 20580 - RNA, 19 nt, Homo sapiens
cagagcaggugacaauaca

SEQ ID NO: 20581 - RNA, 19 nt, Homo sapiens
gaaauaaaucacagaugca

SEQ ID NO: 20582 - RNA, 19 nt, Homo sapiens
gauaacaucaggcuucgau

SEQ ID NO: 20583 - RNA, 19 nt, Homo sapiens
ggaaugcaacugugguaug

SEQ ID NO: 20584 - RNA, 19 nt, Homo sapiens
acaguucacuauuuggauu

SEQ ID NO: 20585 - RNA, 19 nt, Homo sapiens
caaccaaggcugacauaca

SEQ ID NO: 20586 - RNA, 19 nt, Homo sapiens
acucagcucuauaccauga

SEQ ID NO: 20587 - RNA, 19 nt, Homo sapiens
ggagcgguggucauaauuu

SEQ ID NO: 20588 - RNA, 19 nt, Homo sapiens
gcauuucagaagacaguua

SEQ ID NO: 20589 - RNA, 19 nt, Homo sapiens
agacacacauacauaaugg

SEQ ID NO: 20590 - RNA, 19 nt, Homo sapiens
ucuacuggcuguacaugaa

SEQ ID NO: 20591 - RNA, 19 nt, Homo sapiens
cgaugaggcagacgagaua

SEQ ID NO: 20592 - RNA, 19 nt, Homo sapiens
agaaggcaaaccucaaaua

SEQ ID NO: 20593 - RNA, 19 nt, Homo sapiens
ggagaagugacuagacaga

SEQ ID NO: 20594 - RNA, 19 nt, Homo sapiens
guggagaagugacuagaca

SEQ ID NO: 20595 - RNA, 19 nt, Homo sapiens
caacaggagacuacaagug

SEQ ID NO: 20596 - RNA, 19 nt, Homo sapiens
gaugugaggcgcaaugcaa

SEQ ID NO: 20597 - RNA, 19 nt, Homo sapiens
caagaaggaggaggaauau

SEQ ID NO: 20598 - RNA, 19 nt, Homo sapiens
uaacugaggacaacguguu

SEQ ID NO: 20599 - RNA, 19 nt, Homo sapiens
guaaugcaaggaucaguga

SEQ ID NO: 20600 - RNA, 19 nt, Homo sapiens
ggggauaacaucacucuua

SEQ ID NO: 20601 - RNA, 19 nt, Homo sapiens
gagcgguggucauaauuuu

SEQ ID NO: 20602 - RNA, 19 nt, Homo sapiens
gaacgccugugguauguua

SEQ ID NO: 20603 - RNA, 19 nt, Homo sapiens
ggaaauaccacacacacuu

SEQ ID NO: 20604 - RNA, 19 nt, Homo sapiens
gcagugaguccucuacuuu

SEQ ID NO: 20605 - RNA, 19 nt, Homo sapiens
gaaauaccacacacacuug

SEQ ID NO: 20606 - RNA, 19 nt, Homo sapiens
guucagcgcugucacuuca

SEQ ID NO: 20607 - RNA, 19 nt, Homo sapiens
ggagcuggcuggcuacaca

SEQ ID NO: 20608 - RNA, 19 nt, Homo sapiens
ccagguauuugaagauguu

SEQ ID NO: 20609 - RNA, 19 nt, Homo sapiens
cggaggagaucgccuucua

SEQ ID NO: 20610 - RNA, 19 nt, Homo sapiens
gaccuggccucgcagauca

SEQ ID NO: 20611 - RNA, 19 nt, Homo sapiens
ggcccucccuguggaaaua

SEQ ID NO: 20612 - RNA, 19 nt, Homo sapiens
cagccuaauuuauuggauu

SEQ ID NO: 20613 - RNA, 19 nt, Homo sapiens
ggucagagcaacaauccuu

SEQ ID NO: 20614 - RNA, 19 nt, Homo sapiens
acacacacuugcuacaguu

SEQ ID NO: 20615 - RNA, 19 nt, Homo sapiens
ggacaggagagccaaguuc

SEQ ID NO: 20616 - RNA, 19 nt, Homo sapiens
gcagaggcccuacaugucu

SEQ ID NO: 20617 - RNA, 19 nt, Homo sapiens
gcagaucaaccucauccuu

SEQ ID NO: 20618 - RNA, 19 nt, Homo sapiens
gaggagaucgccuucuaug

SEQ ID NO: 20619 - RNA, 19 nt, Homo sapiens
uuuauuggauucccuauuc

SEQ ID NO: 20620 - RNA, 19 nt, Homo sapiens
ucuacagccuaauuuauug

SEQ ID NO: 20621 - RNA, 19 nt, Homo sapiens
gcucggaucacaugaagga

SEQ ID NO: 20622 - RNA, 19 nt, Homo sapiens
ggaggaagcugggguacaa

SEQ ID NO: 20623 - RNA, 19 nt, Homo sapiens
cacgagauguuccagguau

SEQ ID NO: 20624 - RNA, 19 nt, Homo sapiens
gcacgagauguuccaggua

SEQ ID NO: 20625 - RNA, 19 nt, Homo sapiens
aggagaagguggagaggaa

SEQ ID NO: 20626 - RNA, 19 nt, Homo sapiens
uggaggacaugcaaaggaa

SEQ ID NO: 20627 - RNA, 19 nt, Homo sapiens
gcauugcccugcucuccau

SEQ ID NO: 20628 - RNA, 19 nt, Homo sapiens
caaguacgcccuccuggau

SEQ ID NO: 20629 - RNA, 19 nt, Homo sapiens
gaggccaggugguggaugu

SEQ ID NO: 20630 - RNA, 19 nt, Homo sapiens
ggcagugaguccucuacuu

SEQ ID NO: 20631 - RNA, 19 nt, Homo sapiens
guugggaggcuauguguga

SEQ ID NO: 20632 - RNA, 19 nt, Homo sapiens
gggaucaucugcgagaaca

SEQ ID NO: 20633 - RNA, 19 nt, Homo sapiens
gagcaguuccucaugaagu

SEQ ID NO: 20634 - RNA, 19 nt, Homo sapiens
ucaacagugccauccguua

SEQ ID NO: 20635 - RNA, 19 nt, Homo sapiens
ggagugcggacaccauguu

SEQ ID NO: 20636 - RNA, 19 nt, Homo sapiens
cgagauguuccagguauuu

SEQ ID NO: 20637 - RNA, 19 nt, Homo sapiens
gggaggaggaggaggagaa

SEQ ID NO: 20638 - RNA, 19 nt, Homo sapiens
ggaggagaucgccuucuau

SEQ ID NO: 20639 - RNA, 19 nt, Homo sapiens
ccgcagaggcccuacaugu

SEQ ID NO: 20640 - RNA, 19 nt, Homo sapiens
cccaauggcugcggcaaga

SEQ ID NO: 20641 - RNA, 19 nt, Homo sapiens
agcaguuccucaugaagua

SEQ ID NO: 20642 - RNA, 19 nt, Homo sapiens
gcuggaaguucgagaagcu

SEQ ID NO: 20643 - RNA, 19 nt, Homo sapiens
caacaggcccagggucaga

SEQ ID NO: 20644 - RNA, 19 nt, Homo sapiens
gauguuccagguauuugaa

SEQ ID NO: 20645 - RNA, 19 nt, Homo sapiens
cuggagcaguuccucauga

SEQ ID NO: 20646 - RNA, 19 nt, Homo sapiens
ucgcaacccugaccagucu

SEQ ID NO: 20647 - RNA, 19 nt, Homo sapiens
uggagcaguuccucaugaa

SEQ ID NO: 20648 - RNA, 19 nt, Homo sapiens
caacagugccauccguuac

SEQ ID NO: 20649 - RNA, 19 nt, Homo sapiens
gcaugcaucugcucaucac

SEQ ID NO: 20650 - RNA, 19 nt, Homo sapiens
gagaagguggagaggaaga

SEQ ID NO: 20651 - RNA, 19 nt, Homo sapiens
ggacccacagucacacaga

SEQ ID NO: 20652 - RNA, 19 nt, Homo sapiens
caacaucaggguggaggaa

SEQ ID NO: 20653 - RNA, 19 nt, Homo sapiens
gaucaucugcgagaacauc

SEQ ID NO: 20654 - RNA, 19 nt, Homo sapiens
gaucaugucgucguacaag

SEQ ID NO: 20655 - RNA, 19 nt, Homo sapiens
aguacgcccuccuggauga

SEQ ID NO: 20656 - RNA, 19 nt, Homo sapiens
cuauggagcccacaaaguc

SEQ ID NO: 20657 - RNA, 19 nt, Homo sapiens
caagcucggaucacaugaa

SEQ ID NO: 20658 - RNA, 19 nt, Homo sapiens
cacacacacuugcuacagu

SEQ ID NO: 20659 - RNA, 19 nt, Homo sapiens
guacgguggugugcucuac

SEQ ID NO: 20660 - RNA, 19 nt, Homo sapiens
caagaggcccagggagcua

SEQ ID NO: 20661 - RNA, 19 nt, Homo sapiens
gaagguggagaggaagaga

SEQ ID NO: 20662 - RNA, 19 nt, Homo sapiens
ggugagcgagcgcacagaa

SEQ ID NO: 20663 - RNA, 19 nt, Homo sapiens
caaccucauccuucuggaa

SEQ ID NO: 20664 - RNA, 19 nt, Homo sapiens
gagauguuccagguauuug

SEQ ID NO: 20665 - RNA, 19 nt, Homo sapiens
augcagaggccgugaagaa

SEQ ID NO: 20666 - RNA, 19 nt, Homo sapiens
uggaacgccugugguaugu

SEQ ID NO: 20667 - RNA, 19 nt, Homo sapiens
ccaucuccguggccaaugu

SEQ ID NO: 20668 - RNA, 19 nt, Homo sapiens
ccucgucagucucucaaag

SEQ ID NO: 20669 - RNA, 19 nt, Homo sapiens
cgacguggaaggcaagauc

SEQ ID NO: 20670 - RNA, 19 nt, Homo sapiens
ggacucaguggaggacaug

SEQ ID NO: 20671 - RNA, 19 nt, Homo sapiens
ccauugagcggaucauguc

SEQ ID NO: 20672 - RNA, 19 nt, Homo sapiens
guggaggacaugcaaagga

SEQ ID NO: 20673 - RNA, 19 nt, Homo sapiens
ccagcucagugccaaagag

SEQ ID NO: 20674 - RNA, 19 nt, Homo sapiens
aagcucggaucacaugaag

SEQ ID NO: 20675 - RNA, 19 nt, Homo sapiens
gccuaaagcgacagucuca

SEQ ID NO: 20676 - RNA, 19 nt, Homo sapiens
cagagcgccucaccugcau

SEQ ID NO: 20677 - RNA, 19 nt, Homo sapiens
gagguugggaggcuaugug

SEQ ID NO: 20678 - RNA, 19 nt, Homo sapiens
ccagccaccugccucaacu

SEQ ID NO: 20679 - RNA, 19 nt, Homo sapiens
cagugaguccucuacuuug

SEQ ID NO: 20680 - RNA, 19 nt, Homo sapiens
cggaucaugucgucguaca

SEQ ID NO: 20681 - RNA, 19 nt, Homo sapiens
agaucaaccucauccuucu

SEQ ID NO: 20682 - RNA, 19 nt, Homo sapiens
ccucgcagaucaaccucau

SEQ ID NO: 20683 - RNA, 19 nt, Homo sapiens
uggcccaccucuacuccaa

SEQ ID NO: 20684 - RNA, 19 nt, Homo sapiens
ggaggacgugguggccuuu

SEQ ID NO: 20685 - RNA, 19 nt, Homo sapiens
ucucccagcagaccuacua

SEQ ID NO: 20686 - RNA, 19 nt, Homo sapiens
ggacaaugcuguugaauuu

SEQ ID NO: 20687 - RNA, 19 nt, Homo sapiens
gaagagaacugggagagua

SEQ ID NO: 20688 - RNA, 19 nt, Homo sapiens
ggaaagagcccuugcauug

SEQ ID NO: 20689 - RNA, 19 nt, Homo sapiens
caaagaagcugccgggaaa

SEQ ID NO: 20690 - RNA, 19 nt, Homo sapiens
cagaagaacucauaaagaa

SEQ ID NO: 20691 - RNA, 19 nt, Homo sapiens
gcacugagcuguggaaaca

SEQ ID NO: 20692 - RNA, 19 nt, Homo sapiens
caaguccuauccuaaauaa

SEQ ID NO: 20693 - RNA, 19 nt, Homo sapiens
ccacguggcaucuuuaaua

SEQ ID NO: 20694 - RNA, 19 nt, Homo sapiens
cagcaaaucaugaaguuua

SEQ ID NO: 20695 - RNA, 19 nt, Homo sapiens
caagaugucuggaaaugga

SEQ ID NO: 20696 - RNA, 19 nt, Homo sapiens
gaauugcuauggcguggua

SEQ ID NO: 20697 - RNA, 19 nt, Homo sapiens
ucacauggauauagacaaa

SEQ ID NO: 20698 - RNA, 19 nt, Homo sapiens
acaguguucucuaauguua

SEQ ID NO: 20699 - RNA, 19 nt, Homo sapiens
cacguuaacugcagaguaa

SEQ ID NO: 20700 - RNA, 19 nt, Homo sapiens
ugaauauuguuccugguua

SEQ ID NO: 20701 - RNA, 19 nt, Homo sapiens
ccaaagacauugauaaagc

SEQ ID NO: 20702 - RNA, 19 nt, Homo sapiens
gagcaaacaauacuuucua

SEQ ID NO: 20703 - RNA, 19 nt, Homo sapiens
agaaguauauccuuggaaa

SEQ ID NO: 20704 - RNA, 19 nt, Homo sapiens
gaauauuguuccugguuau

SEQ ID NO: 20705 - RNA, 19 nt, Homo sapiens
cuuagugacucuugaagua

SEQ ID NO: 20706 - RNA, 19 nt, Homo sapiens
gaacagugugggugaauug

SEQ ID NO: 20707 - RNA, 19 nt, Homo sapiens
uauacaaguuggcugauuu

SEQ ID NO: 20708 - RNA, 19 nt, Homo sapiens
gauucaagaugucuggaaa

SEQ ID NO: 20709 - RNA, 19 nt, Homo sapiens
gaaacacagugguugucaa

SEQ ID NO: 20710 - RNA, 19 nt, Homo sapiens
agacauugauaaagccaua

SEQ ID NO: 20711 - RNA, 19 nt, Homo sapiens
ucucuaauguuacagauga

SEQ ID NO: 20712 - RNA, 19 nt, Homo sapiens
ccacaguguucucuaaugu

SEQ ID NO: 20713 - RNA, 19 nt, Homo sapiens
gggcagccauuucuucuca

SEQ ID NO: 20714 - RNA, 19 nt, Homo sapiens
uaugaucucucuagcuuug

SEQ ID NO: 20715 - RNA, 19 nt, Homo sapiens
aaagacaaauucggaugua

SEQ ID NO: 20716 - RNA, 19 nt, Homo sapiens
gacaaggaacaauaugaua

SEQ ID NO: 20717 - RNA, 19 nt, Homo sapiens
gagauaaggaggauguuga

SEQ ID NO: 20718 - RNA, 19 nt, Homo sapiens
acauguagcuucuucugaa

SEQ ID NO: 20719 - RNA, 19 nt, Homo sapiens
gauaaagccauaacaaucu

SEQ ID NO: 20720 - RNA, 19 nt, Homo sapiens
aaagagcccuugcauugug

SEQ ID NO: 20721 - RNA, 19 nt, Homo sapiens
uacaagacaugaaccuauu

SEQ ID NO: 20722 - RNA, 19 nt, Homo sapiens
gauccagggccguacaaua

SEQ ID NO: 20723 - RNA, 19 nt, Homo sapiens
cacguggcaucuuuaauaa

SEQ ID NO: 20724 - RNA, 19 nt, Homo sapiens
ccuguaauauuuagcugua

SEQ ID NO: 20725 - RNA, 19 nt, Homo sapiens
ggaacagugugggugaauu

SEQ ID NO: 20726 - RNA, 19 nt, Homo sapiens
gcaggaguguuuaccaaag

SEQ ID NO: 20727 - RNA, 19 nt, Homo sapiens
gaaagagcccuugcauugu

SEQ ID NO: 20728 - RNA, 19 nt, Homo sapiens
gagaguacgguuuccauga

SEQ ID NO: 20729 - RNA, 19 nt, Homo sapiens
ggcaagaaauuuccugucu

SEQ ID NO: 20730 - RNA, 19 nt, Homo sapiens
uguaugaucucucuagcuu

SEQ ID NO: 20731 - RNA, 19 nt, Homo sapiens
gacaaauucggauguauga

SEQ ID NO: 20732 - RNA, 19 nt, Homo sapiens
caaacaauacuuucuaugg

SEQ ID NO: 20733 - RNA, 19 nt, Homo sapiens
uaaggaggauguugacaag

SEQ ID NO: 20734 - RNA, 19 nt, Homo sapiens
agacuuaccuguccuacuc

SEQ ID NO: 20735 - RNA, 19 nt, Homo sapiens
gcccucagauugacaagga

SEQ ID NO: 20736 - RNA, 19 nt, Homo sapiens
uaagaaguauauccuugga

SEQ ID NO: 20737 - RNA, 19 nt, Homo sapiens
guggaagaaucaauuuaug

SEQ ID NO: 20738 - RNA, 19 nt, Homo sapiens
acaauggagucaaugaaug

SEQ ID NO: 20739 - RNA, 19 nt, Homo sapiens
aaaacaaccuugcaugaaa

SEQ ID NO: 20740 - RNA, 19 nt, Homo sapiens
ccaaguccuauccuaaaua

SEQ ID NO: 20741 - RNA, 19 nt, Homo sapiens
gugaaaaucucucagaaga

SEQ ID NO: 20742 - RNA, 19 nt, Homo sapiens
cagcaggaguguuuaccaa

SEQ ID NO: 20743 - RNA, 19 nt, Homo sapiens
agaguacgguuuccaugaa

SEQ ID NO: 20744 - RNA, 19 nt, Homo sapiens
aaaguagccuucacaggau

SEQ ID NO: 20745 - RNA, 19 nt, Homo sapiens
ucagaagaacucauaaaga

SEQ ID NO: 20746 - RNA, 19 nt, Homo sapiens
aacaaugaauggcaugauu

SEQ ID NO: 20747 - RNA, 19 nt, Homo sapiens
acaugaaccuauuggugua

SEQ ID NO: 20748 - RNA, 19 nt, Homo sapiens
gggcgacuauuauacaagu

SEQ ID NO: 20749 - RNA, 19 nt, Homo sapiens
gaacaguugcauuuagcuu

SEQ ID NO: 20750 - RNA, 19 nt, Homo sapiens
aaacacagugguugucaaa

SEQ ID NO: 20751 - RNA, 19 nt, Homo sapiens
aaaggaacaguugcauuua

SEQ ID NO: 20752 - RNA, 19 nt, Homo sapiens
caaauucggauguaugauc

SEQ ID NO: 20753 - RNA, 19 nt, Homo sapiens
caggaguguuuaccaaaga

SEQ ID NO: 20754 - RNA, 19 nt, Homo sapiens
gcaaacaauacuuucuaug

SEQ ID NO: 20755 - RNA, 19 nt, Homo sapiens
gcucuguucccaguaguua

SEQ ID NO: 20756 - RNA, 19 nt, Homo sapiens
gaaaaucucucagaagaac

SEQ ID NO: 20757 - RNA, 19 nt, Homo sapiens
gacaauggagucaaugaau

SEQ ID NO: 20758 - RNA, 19 nt, Homo sapiens
cauguagcuucuucugaaa

SEQ ID NO: 20759 - RNA, 19 nt, Homo sapiens
ugauaaagccauaacaauc

SEQ ID NO: 20760 - RNA, 19 nt, Homo sapiens
cagugugggugaauugcua

SEQ ID NO: 20761 - RNA, 19 nt, Homo sapiens
ugucaugucugcuugucaa

SEQ ID NO: 20762 - RNA, 19 nt, Homo sapiens
gaguacgguuuccaugaau

SEQ ID NO: 20763 - RNA, 19 nt, Homo sapiens
caccagggccaguguugua

SEQ ID NO: 20764 - RNA, 19 nt, Homo sapiens
ccaaugcauaucugaauga

SEQ ID NO: 20765 - RNA, 19 nt, Homo sapiens
gcucuucaauagcuaagca

SEQ ID NO: 20766 - RNA, 19 nt, Homo sapiens
acucaaggcccucagauug

SEQ ID NO: 20767 - RNA, 19 nt, Homo sapiens
ggaggagcucugccaggua

SEQ ID NO: 20768 - RNA, 19 nt, Homo sapiens
ggagauaaggaggauguug

SEQ ID NO: 20769 - RNA, 19 nt, Homo sapiens
ggaaacacagugguuguca

SEQ ID NO: 20770 - RNA, 19 nt, Homo sapiens
aaacaaccuugcaugaaaa

SEQ ID NO: 20771 - RNA, 19 nt, Homo sapiens
aaaaggaacaguugcauuu

SEQ ID NO: 20772 - RNA, 19 nt, Homo sapiens
ugacaaggaacaauaugau

SEQ ID NO: 20773 - RNA, 19 nt, Homo sapiens
gaaguauauccuuggaaau

SEQ ID NO: 20774 - RNA, 19 nt, Homo sapiens
gcagccauuucuucucaca

SEQ ID NO: 20775 - RNA, 19 nt, Homo sapiens
guauguggccaaaucauuc

SEQ ID NO: 20776 - RNA, 19 nt, Homo sapiens
gguagaagaaggagauaag

SEQ ID NO: 20777 - RNA, 19 nt, Homo sapiens
cgacaauggagucaaugaa

SEQ ID NO: 20778 - RNA, 19 nt, Homo sapiens
auacaaguuggcugauuua

SEQ ID NO: 20779 - RNA, 19 nt, Homo sapiens
aaggaacaguugcauuuag

SEQ ID NO: 20780 - RNA, 19 nt, Homo sapiens
ggauguaugaucucucuag

SEQ ID NO: 20781 - RNA, 19 nt, Homo sapiens
aagcaucuccuuacaguca

SEQ ID NO: 20782 - RNA, 19 nt, Homo sapiens
ucucucagaagaacucaua

SEQ ID NO: 20783 - RNA, 19 nt, Homo sapiens
guacgguuuccaugaauau

SEQ ID NO: 20784 - RNA, 19 nt, Homo sapiens
cuuaucagcaggaguguuu

SEQ ID NO: 20785 - RNA, 19 nt, Homo sapiens
uaugaugaguuuguucgaa

SEQ ID NO: 20786 - RNA, 19 nt, Homo sapiens
ucaaaugucuccgguauua

SEQ ID NO: 20787 - RNA, 19 nt, Homo sapiens
caacaauacugcuagcuuu

SEQ ID NO: 20788 - RNA, 19 nt, Homo sapiens
caacugcuaugauguguuu

SEQ ID NO: 20789 - RNA, 19 nt, Homo sapiens
cagaagaacucauaagaau

SEQ ID NO: 20790 - RNA, 19 nt, Homo sapiens
gaagaacucauaagaauca

SEQ ID NO: 20791 - RNA, 19 nt, Homo sapiens
gaagguagcugagcagaca

SEQ ID NO: 20792 - RNA, 19 nt, Homo sapiens
gaaacgugguugugaugaa

SEQ ID NO: 20793 - RNA, 19 nt, Homo sapiens
gauggaaaguucagcaaga

SEQ ID NO: 20794 - RNA, 19 nt, Homo sapiens
gggcuaagauucauuaaaa

SEQ ID NO: 20795 - RNA, 19 nt, Homo sapiens
gcucgggccuguucacauu

SEQ ID NO: 20796 - RNA, 19 nt, Homo sapiens
gaaaugaucucgcuuuugg

SEQ ID NO: 20797 - RNA, 19 nt, Homo sapiens
gcagcaaccucaagagagu

SEQ ID NO: 20798 - RNA, 19 nt, Homo sapiens
aaaacuagcugcucuuaaa

SEQ ID NO: 20799 - RNA, 19 nt, Homo sapiens
ucaaagugccucagaagaa

SEQ ID NO: 20800 - RNA, 19 nt, Homo sapiens
ggaaaaccauccccauuga

SEQ ID NO: 20801 - RNA, 19 nt, Homo sapiens
gaucaaggaggcuggcuuu

SEQ ID NO: 20802 - RNA, 19 nt, Homo sapiens
ucuccuaccugguggauuu

SEQ ID NO: 20803 - RNA, 19 nt, Homo sapiens
gcaaccagauuuucauaaa

SEQ ID NO: 20804 - RNA, 19 nt, Homo sapiens
ggacaaaguggcauucaca

SEQ ID NO: 20805 - RNA, 19 nt, Homo sapiens
ccucaaaugucuccgguau

SEQ ID NO: 20806 - RNA, 19 nt, Homo sapiens
ggaaaguucagcaagauca

SEQ ID NO: 20807 - RNA, 19 nt, Homo sapiens
gcagcugucuucacaaagg

SEQ ID NO: 20808 - RNA, 19 nt, Homo sapiens
caaggaagauguggacaag

SEQ ID NO: 20809 - RNA, 19 nt, Homo sapiens
gguaagaguauaugaggaa

SEQ ID NO: 20810 - RNA, 19 nt, Homo sapiens
ccgcagcugucuucacaaa

SEQ ID NO: 20811 - RNA, 19 nt, Homo sapiens
gauccuugcgugcugaaua

SEQ ID NO: 20812 - RNA, 19 nt, Homo sapiens
ugaugcagauccugaaguu

SEQ ID NO: 20813 - RNA, 19 nt, Homo sapiens
caacauugugccuggauuu

SEQ ID NO: 20814 - RNA, 19 nt, Homo sapiens
ucugaaacgcuuccuauaa

SEQ ID NO: 20815 - RNA, 19 nt, Homo sapiens
gcaugaccaucgccaagga

SEQ ID NO: 20816 - RNA, 19 nt, Homo sapiens
gagcagcaaccucaagaga

SEQ ID NO: 20817 - RNA, 19 nt, Homo sapiens
gaguauaugaggaaccuuu

SEQ ID NO: 20818 - RNA, 19 nt, Homo sapiens
ucagaagaacucauaagaa

SEQ ID NO: 20819 - RNA, 19 nt, Homo sapiens
ggccgcagcugucuucaca

SEQ ID NO: 20820 - RNA, 19 nt, Homo sapiens
caugucagaugccgauaug

SEQ ID NO: 20821 - RNA, 19 nt, Homo sapiens
ggagacuucuucagcuaca

SEQ ID NO: 20822 - RNA, 19 nt, Homo sapiens
caaagugccucagaagaac

SEQ ID NO: 20823 - RNA, 19 nt, Homo sapiens
gagccaacaauuccacgua

SEQ ID NO: 20824 - RNA, 19 nt, Homo sapiens
gaauuucccgcuccugaug

SEQ ID NO: 20825 - RNA, 19 nt, Homo sapiens
cggcugggcugauaaguac

SEQ ID NO: 20826 - RNA, 19 nt, Homo sapiens
cuggagaggucaucuguca

SEQ ID NO: 20827 - RNA, 19 nt, Homo sapiens
gaagauccucggcuacauc

SEQ ID NO: 20828 - RNA, 19 nt, Homo sapiens
cugaaacgcuuccuauaac

SEQ ID NO: 20829 - RNA, 19 nt, Homo sapiens
aguacgggcugcaggcaua

SEQ ID NO: 20830 - RNA, 19 nt, Homo sapiens
ccaugaggauguggacaaa

SEQ ID NO: 20831 - RNA, 19 nt, Homo sapiens
uggccaaccugaucaagga

SEQ ID NO: 20832 - RNA, 19 nt, Homo sapiens
ucagcaagaucagcaacaa

SEQ ID NO: 20833 - RNA, 19 nt, Homo sapiens
ggucaaaggcacacauugg

SEQ ID NO: 20834 - RNA, 19 nt, Homo sapiens
gaucuucgggccagugaug

SEQ ID NO: 20835 - RNA, 19 nt, Homo sapiens
ccacuucgcccuguucuuc

SEQ ID NO: 20836 - RNA, 19 nt, Homo sapiens
uguguuauccucucucuga

SEQ ID NO: 20837 - RNA, 19 nt, Homo sapiens
caaauguguuauccucucu

SEQ ID NO: 20838 - RNA, 19 nt, Homo sapiens
cugaauaucugaaaagaga

SEQ ID NO: 20839 - RNA, 19 nt, Homo sapiens
gaccauagaggagguuguu

SEQ ID NO: 20840 - RNA, 19 nt, Homo sapiens
ggaaacgugguugugauga

SEQ ID NO: 20841 - RNA, 19 nt, Homo sapiens
ggucaacugcuaugaugug

SEQ ID NO: 20842 - RNA, 19 nt, Homo sapiens
gggaagagccccaacauca

SEQ ID NO: 20843 - RNA, 19 nt, Homo sapiens
ggagcccagucacccuuug

SEQ ID NO: 20844 - RNA, 19 nt, Homo sapiens
ugggucaacugcuaugaug

SEQ ID NO: 20845 - RNA, 19 nt, Homo sapiens
uggagacccuggacaaugg

SEQ ID NO: 20846 - RNA, 19 nt, Homo sapiens
ugaggaaccuuuuaaacga

SEQ ID NO: 20847 - RNA, 19 nt, Homo sapiens
gcaggaggacaucuaugau

SEQ ID NO: 20848 - RNA, 19 nt, Homo sapiens
ugaaacgcuuccuauaacu

SEQ ID NO: 20849 - RNA, 19 nt, Homo sapiens
gacaauggcaagcccuaug

SEQ ID NO: 20850 - RNA, 19 nt, Homo sapiens
gaaacgcuuccuauaacuc

SEQ ID NO: 20851 - RNA, 19 nt, Homo sapiens
gggagcagcaaccucaaga

SEQ ID NO: 20852 - RNA, 19 nt, Homo sapiens
ucaacauugugccuggauu

SEQ ID NO: 20853 - RNA, 19 nt, Homo sapiens
aaacgugguugugaugaag

SEQ ID NO: 20854 - RNA, 19 nt, Homo sapiens
acggagacuucuucagcua

SEQ ID NO: 20855 - RNA, 19 nt, Homo sapiens
aaaugucuccgguauuaug

SEQ ID NO: 20856 - RNA, 19 nt, Homo sapiens
guuauccucucucugaaac

SEQ ID NO: 20857 - RNA, 19 nt, Homo sapiens
cagucaaagugccucagaa

SEQ ID NO: 20858 - RNA, 19 nt, Homo sapiens
ugaccgugguuacuucauc

SEQ ID NO: 20859 - RNA, 19 nt, Homo sapiens
cauccagcccacuguguuu

SEQ ID NO: 20860 - RNA, 19 nt, Homo sapiens
uaugccggcugggcugaua

SEQ ID NO: 20861 - RNA, 19 nt, Homo sapiens
gcugaggguaagaguauau

SEQ ID NO: 20862 - RNA, 19 nt, Homo sapiens
auaagaaucaugcaagcuu

SEQ ID NO: 20863 - RNA, 19 nt, Homo sapiens
gaaguucaagaccauagag

SEQ ID NO: 20864 - RNA, 19 nt, Homo sapiens
ccacuguguuuggagaugu

SEQ ID NO: 20865 - RNA, 19 nt, Homo sapiens
ggacaauggcaagcccuau

SEQ ID NO: 20866 - RNA, 19 nt, Homo sapiens
cugcuagcuuucaggauga

SEQ ID NO: 20867 - RNA, 19 nt, Homo sapiens
uggcugaggguaagaguau

SEQ ID NO: 20868 - RNA, 19 nt, Homo sapiens
cagcaagaucagcaacaaa

SEQ ID NO: 20869 - RNA, 19 nt, Homo sapiens
cagcugucuucacaaagga

SEQ ID NO: 20870 - RNA, 19 nt, Homo sapiens
ggccgcagguggaugaaac

SEQ ID NO: 20871 - RNA, 19 nt, Homo sapiens
ugcaggaggacaucuauga

SEQ ID NO: 20872 - RNA, 19 nt, Homo sapiens
ucagaugccgauauggauu

SEQ ID NO: 20873 - RNA, 19 nt, Homo sapiens
cagcuacacacgccaugaa

SEQ ID NO: 20874 - RNA, 19 nt, Homo sapiens
ucugggcuaagauucauua

SEQ ID NO: 20875 - RNA, 19 nt, Homo sapiens
caacugcuacacccugcuu

SEQ ID NO: 20876 - RNA, 19 nt, Homo sapiens
gagaucuucgggccaguga

SEQ ID NO: 20877 - RNA, 19 nt, Homo sapiens
cagaugccgauauggauug

SEQ ID NO: 20878 - RNA, 19 nt, Homo sapiens
ggucaucugucagguagcu

SEQ ID NO: 20879 - RNA, 19 nt, Homo sapiens
ugucagaugccgauaugga

SEQ ID NO: 20880 - RNA, 19 nt, Homo sapiens
ugauaaguaccacgggaaa

SEQ ID NO: 20881 - RNA, 19 nt, Homo sapiens
acaacaauacugcuagcuu

SEQ ID NO: 20882 - RNA, 19 nt, Homo sapiens
augaggauguggacaaagu

SEQ ID NO: 20883 - RNA, 19 nt, Homo sapiens
ggcaagcccuaugucaucu

SEQ ID NO: 20884 - RNA, 19 nt, Homo sapiens
ucucugaaacgcuuccuau

SEQ ID NO: 20885 - RNA, 19 nt, Homo sapiens
ugccucagaagaacucaua

SEQ ID NO: 20886 - RNA, 19 nt, Homo sapiens
gaagaugauugcagagaca

SEQ ID NO: 20887 - RNA, 19 nt, Homo sapiens
agaagucacugaaagaguu

SEQ ID NO: 20888 - RNA, 19 nt, Homo sapiens
gcaacgacaaggugauuaa

SEQ ID NO: 20889 - RNA, 19 nt, Homo sapiens
ugaggccucugaugaauga

SEQ ID NO: 20890 - RNA, 19 nt, Homo sapiens
gacuauggaagaaucauua

SEQ ID NO: 20891 - RNA, 19 nt, Homo sapiens
gggaagaugcuaagaaauc

SEQ ID NO: 20892 - RNA, 19 nt, Homo sapiens
uggagaagcucaagaaguc

SEQ ID NO: 20893 - RNA, 19 nt, Homo sapiens
gaggagaucgaguacauga

SEQ ID NO: 20894 - RNA, 19 nt, Homo sapiens
uaagaaaucccgggacuau

SEQ ID NO: 20895 - RNA, 19 nt, Homo sapiens
uagaggagaucgaguacau

SEQ ID NO: 20896 - RNA, 19 nt, Homo sapiens
gaaccaaauuguggagaag

SEQ ID NO: 20897 - RNA, 19 nt, Homo sapiens
aaggagagguucgaccaua

SEQ ID NO: 20898 - RNA, 19 nt, Homo sapiens
ccucggagcugagugagaa

SEQ ID NO: 20899 - RNA, 19 nt, Homo sapiens
gaauggaacgccuacuaug

SEQ ID NO: 20900 - RNA, 19 nt, Homo sapiens
caagaugacccagcacuga

SEQ ID NO: 20901 - RNA, 19 nt, Homo sapiens
acgacaaggugauuaagaa

SEQ ID NO: 20902 - RNA, 19 nt, Homo sapiens
acaaggugauuaagaagau

SEQ ID NO: 20903 - RNA, 19 nt, Homo sapiens
ggaggaggccauccaguuc

SEQ ID NO: 20904 - RNA, 19 nt, Homo sapiens
ggaacucagugguccucaa

SEQ ID NO: 20905 - RNA, 19 nt, Homo sapiens
ucgaguacaugauccagaa

SEQ ID NO: 20906 - RNA, 19 nt, Homo sapiens
gcucaagaagucacugaaa

SEQ ID NO: 20907 - RNA, 19 nt, Homo sapiens
ggugaggccucugaugaau

SEQ ID NO: 20908 - RNA, 19 nt, Homo sapiens
gggagaggcugugucaaag

SEQ ID NO: 20909 - RNA, 19 nt, Homo sapiens
ucaagaagucacugaaaga

SEQ ID NO: 20910 - RNA, 19 nt, Homo sapiens
ggacuauggaagaaucauu

SEQ ID NO: 20911 - RNA, 19 nt, Homo sapiens
cggaugagcccguggagaa

SEQ ID NO: 20912 - RNA, 19 nt, Homo sapiens
ccaauaaagagacgaauac

SEQ ID NO: 20913 - RNA, 19 nt, Homo sapiens
agaaccaaauuguggagaa

SEQ ID NO: 20914 - RNA, 19 nt, Homo sapiens
aaggaucuguacccaguaa

SEQ ID NO: 20915 - RNA, 19 nt, Homo sapiens
cgggagaggcugugucaaa

SEQ ID NO: 20916 - RNA, 19 nt, Homo sapiens
ggaagaugcuaagaaaucc

SEQ ID NO: 20917 - RNA, 19 nt, Homo sapiens
gaacucagugguccucaag

SEQ ID NO: 20918 - RNA, 19 nt, Homo sapiens
ggccucugaugaaugauga

SEQ ID NO: 20919 - RNA, 19 nt, Homo sapiens
gacaaggugauuaagaaga

SEQ ID NO: 20920 - RNA, 19 nt, Homo sapiens
gauccuaccauggcaagaa

SEQ ID NO: 20921 - RNA, 19 nt, Homo sapiens
ugaauggaacgccuacuau

SEQ ID NO: 20922 - RNA, 19 nt, Homo sapiens
ggagcugagugagaacaug

SEQ ID NO: 20923 - RNA, 19 nt, Homo sapiens
cugacuacauccucuguga

SEQ ID NO: 20924 - RNA, 19 nt, Homo sapiens
gaucuguacccaguaauca

SEQ ID NO: 20925 - RNA, 19 nt, Homo sapiens
ggaggugguguacguccua

SEQ ID NO: 20926 - RNA, 19 nt, Homo sapiens
ccugcuacguggacaagaa

SEQ ID NO: 20927 - RNA, 19 nt, Homo sapiens
ugccgccacucgcuacaua

SEQ ID NO: 20928 - RNA, 19 nt, Homo sapiens
gaaaucccgggacuaugga

SEQ ID NO: 20929 - RNA, 19 nt, Homo sapiens
aauggaacgccuacuauga

SEQ ID NO: 20930 - RNA, 19 nt, Homo sapiens
gaucagcgaggccgugaag

SEQ ID NO: 20931 - RNA, 19 nt, Homo sapiens
ggagagguucgaccauauc

SEQ ID NO: 20932 - RNA, 19 nt, Homo sapiens
gcaggacgagcucuacauc

SEQ ID NO: 20933 - RNA, 19 nt, Homo sapiens
uauggaagaaucauuagug

SEQ ID NO: 20934 - RNA, 19 nt, Homo sapiens
gggcgugguccucgucauu

SEQ ID NO: 20935 - RNA, 19 nt, Homo sapiens
gugauuaagaagaugauug

SEQ ID NO: 20936 - RNA, 19 nt, Homo sapiens
gaggaggccauccaguuca

SEQ ID NO: 20937 - RNA, 19 nt, Homo sapiens
caaggugauuaagaagaug

SEQ ID NO: 20938 - RNA, 19 nt, Homo sapiens
agaaaucccgggacuaugg

SEQ ID NO: 20939 - RNA, 19 nt, Homo sapiens
ucaaaggcgccaugagcaa

SEQ ID NO: 20940 - RNA, 19 nt, Homo sapiens
gaagucacugaaagaguuc

SEQ ID NO: 20941 - RNA, 19 nt, Homo sapiens
cucaagaagucacugaaag

SEQ ID NO: 20942 - RNA, 19 nt, Homo sapiens
gauccagaaccaaauugug

SEQ ID NO: 20943 - RNA, 19 nt, Homo sapiens
aggagagguucgaccauau

SEQ ID NO: 20944 - RNA, 19 nt, Homo sapiens
ccacaucaccuugcacucu

SEQ ID NO: 20945 - RNA, 19 nt, Homo sapiens
cagcaacgacaaggugauu

SEQ ID NO: 20946 - RNA, 19 nt, Homo sapiens
gaugagcccguggagaaga

SEQ ID NO: 20947 - RNA, 19 nt, Homo sapiens
cggggaagaugcuaagaaa

SEQ ID NO: 20948 - RNA, 19 nt, Homo sapiens
caagaagucacugaaagag

SEQ ID NO: 20949 - RNA, 19 nt, Homo sapiens
ggaagagucccugcuacgu

SEQ ID NO: 20950 - RNA, 19 nt, Homo sapiens
gaccugcacaagaaugaau

SEQ ID NO: 20951 - RNA, 19 nt, Homo sapiens
guggagaagcucaagaagu

SEQ ID NO: 20952 - RNA, 19 nt, Homo sapiens
ggaucuguacccaguaauc

SEQ ID NO: 20953 - RNA, 19 nt, Homo sapiens
caauaaagagacgaauaca

SEQ ID NO: 20954 - RNA, 19 nt, Homo sapiens
accaauaaagagacgaaua

SEQ ID NO: 20955 - RNA, 19 nt, Homo sapiens
guucgaccauauccuguac

SEQ ID NO: 20956 - RNA, 19 nt, Homo sapiens
gguucgaccauauccugua

SEQ ID NO: 20957 - RNA, 19 nt, Homo sapiens
cuggugaggccucugauga

SEQ ID NO: 20958 - RNA, 19 nt, Homo sapiens
gaggccauccaguucauca

SEQ ID NO: 20959 - RNA, 19 nt, Homo sapiens
gaaugaugaaggccugaag

SEQ ID NO: 20960 - RNA, 19 nt, Homo sapiens
cgacaaggugauuaagaag

SEQ ID NO: 20961 - RNA, 19 nt, Homo sapiens
cagaccugcacaagaauga

SEQ ID NO: 20962 - RNA, 19 nt, Homo sapiens
ccgggacuauggaagaauc

SEQ ID NO: 20963 - RNA, 19 nt, Homo sapiens
acuaugaggagguggugua

SEQ ID NO: 20964 - RNA, 19 nt, Homo sapiens
aggacgagcucuacaucca

SEQ ID NO: 20965 - RNA, 19 nt, Homo sapiens
aaucaaggcuguucuauuu

SEQ ID NO: 20966 - RNA, 19 nt, Homo sapiens
caucacaccuggcuaauuu

SEQ ID NO: 20967 - RNA, 19 nt, Homo sapiens
gcacguggauguugacaaa

SEQ ID NO: 20968 - RNA, 19 nt, Homo sapiens
gagaugagguuucaccauu

SEQ ID NO: 20969 - RNA, 19 nt, Homo sapiens
caaagaauaugcuuacaug

SEQ ID NO: 20970 - RNA, 19 nt, Homo sapiens
ggagauggaacauagauua

SEQ ID NO: 20971 - RNA, 19 nt, Homo sapiens
ugaacuagguggauacuaa

SEQ ID NO: 20972 - RNA, 19 nt, Homo sapiens
gaagaaaccccacaaauaa

SEQ ID NO: 20973 - RNA, 19 nt, Homo sapiens
gauagaggaguaauuguua

SEQ ID NO: 20974 - RNA, 19 nt, Homo sapiens
ccagugaucuguaauuugu

SEQ ID NO: 20975 - RNA, 19 nt, Homo sapiens
ucaaggcuguucuauuuaa

SEQ ID NO: 20976 - RNA, 19 nt, Homo sapiens
caucaagccuacugucuuu

SEQ ID NO: 20977 - RNA, 19 nt, Homo sapiens
gaaacaagccagagagaug

SEQ ID NO: 20978 - RNA, 19 nt, Homo sapiens
gaaagcagcuggcgauucc

SEQ ID NO: 20979 - RNA, 19 nt, Homo sapiens
ggaaugaaguacugacaca

SEQ ID NO: 20980 - RNA, 19 nt, Homo sapiens
ggaagaauccaucuacaau

SEQ ID NO: 20981 - RNA, 19 nt, Homo sapiens
ccaaauguccgucaacuga

SEQ ID NO: 20982 - RNA, 19 nt, Homo sapiens
aagaauccaucuacaauga

SEQ ID NO: 20983 - RNA, 19 nt, Homo sapiens
gcaacacugugguuaugaa

SEQ ID NO: 20984 - RNA, 19 nt, Homo sapiens
cugaguagcugggauuaua

SEQ ID NO: 20985 - RNA, 19 nt, Homo sapiens
uaaagacggucaccaucaa

SEQ ID NO: 20986 - RNA, 19 nt, Homo sapiens
ggaaggaguaggcaaagaa

SEQ ID NO: 20987 - RNA, 19 nt, Homo sapiens
gagcgugguuucuucauca

SEQ ID NO: 20988 - RNA, 19 nt, Homo sapiens
gauggaacauagauuagug

SEQ ID NO: 20989 - RNA, 19 nt, Homo sapiens
gaacuagguggauacuaaa

SEQ ID NO: 20990 - RNA, 19 nt, Homo sapiens
caagguguaucgguacuuu

SEQ ID NO: 20991 - RNA, 19 nt, Homo sapiens
ggauagaggaguaauuguu

SEQ ID NO: 20992 - RNA, 19 nt, Homo sapiens
acugaugaguggauuaaua

SEQ ID NO: 20993 - RNA, 19 nt, Homo sapiens
gcucagaguucuaccuauc

SEQ ID NO: 20994 - RNA, 19 nt, Homo sapiens
gaagaauccaucuacaaug

SEQ ID NO: 20995 - RNA, 19 nt, Homo sapiens
aguaaugguugcaugauuu

SEQ ID NO: 20996 - RNA, 19 nt, Homo sapiens
gaacacaagcuuggaaagu

SEQ ID NO: 20997 - RNA, 19 nt, Homo sapiens
uugcuuccaugaaaucuua

SEQ ID NO: 20998 - RNA, 19 nt, Homo sapiens
ggacaaggccauguacuuc

SEQ ID NO: 20999 - RNA, 19 nt, Homo sapiens
caacugaugaguggauuaa

SEQ ID NO: 21000 - RNA, 19 nt, Homo sapiens
ggagugcaguggugugauc

SEQ ID NO: 21001 - RNA, 19 nt, Homo sapiens
aaacauccuucucagugaa

SEQ ID NO: 21002 - RNA, 19 nt, Homo sapiens
gcaaagaauaugcuuacau

SEQ ID NO: 21003 - RNA, 19 nt, Homo sapiens
guaaagacggucaccauca

SEQ ID NO: 21004 - RNA, 19 nt, Homo sapiens
aaacguauacauucuguga

SEQ ID NO: 21005 - RNA, 19 nt, Homo sapiens
ccaaagugcugggauuaca

SEQ ID NO: 21006 - RNA, 19 nt, Homo sapiens
caaggcuguucuauuuaaa

SEQ ID NO: 21007 - RNA, 19 nt, Homo sapiens
gguaaacaccuacaacauc

SEQ ID NO: 21008 - RNA, 19 nt, Homo sapiens
acaaccagcuguucaucaa

SEQ ID NO: 21009 - RNA, 19 nt, Homo sapiens
ccaucaagguuccucagaa

SEQ ID NO: 21010 - RNA, 19 nt, Homo sapiens
cgagagaaccguggagaaa

SEQ ID NO: 21011 - RNA, 19 nt, Homo sapiens
gaauccaucuacaaugagu

SEQ ID NO: 21012 - RNA, 19 nt, Homo sapiens
gacuguaugauuccauuua

SEQ ID NO: 21013 - RNA, 19 nt, Homo sapiens
uaaaguaagcccaaacauc

SEQ ID NO: 21014 - RNA, 19 nt, Homo sapiens
ugggugcgcuugaugguuu

SEQ ID NO: 21015 - RNA, 19 nt, Homo sapiens
caugaaaucuuaggagucu

SEQ ID NO: 21016 - RNA, 19 nt, Homo sapiens
ucagaguucuaccuaucua

SEQ ID NO: 21017 - RNA, 19 nt, Homo sapiens
ggacaaggagcaguuugaa

SEQ ID NO: 21018 - RNA, 19 nt, Homo sapiens
cgacucaacucagaacaca

SEQ ID NO: 21019 - RNA, 19 nt, Homo sapiens
caggaugacaugagaauug

SEQ ID NO: 21020 - RNA, 19 nt, Homo sapiens
agaugagguuucaccauuu

SEQ ID NO: 21021 - RNA, 19 nt, Homo sapiens
agaagaaaccccacaaaua

SEQ ID NO: 21022 - RNA, 19 nt, Homo sapiens
acaaccaccuugacgaaug

SEQ ID NO: 21023 - RNA, 19 nt, Homo sapiens
caucaagguuccucagaag

SEQ ID NO: 21024 - RNA, 19 nt, Homo sapiens
ggccucagguggacaagga

SEQ ID NO: 21025 - RNA, 19 nt, Homo sapiens
ugaccgggcugauguggau

SEQ ID NO: 21026 - RNA, 19 nt, Homo sapiens
gaauauuccuuggauuacu

SEQ ID NO: 21027 - RNA, 19 nt, Homo sapiens
gaaggaguaggcaaagaau

SEQ ID NO: 21028 - RNA, 19 nt, Homo sapiens
ccacaaauaaagcaauuca

SEQ ID NO: 21029 - RNA, 19 nt, Homo sapiens
ccacaaccaccuugacgaa

SEQ ID NO: 21030 - RNA, 19 nt, Homo sapiens
ggagcgggaucgagucuac

SEQ ID NO: 21031 - RNA, 19 nt, Homo sapiens
cagacuguaugauuccauu

SEQ ID NO: 21032 - RNA, 19 nt, Homo sapiens
aaccagugaucuguaauuu

SEQ ID NO: 21033 - RNA, 19 nt, Homo sapiens
ggaccaggcucagaguucu

SEQ ID NO: 21034 - RNA, 19 nt, Homo sapiens
gaaagcaaagcagaggaaa

SEQ ID NO: 21035 - RNA, 19 nt, Homo sapiens
uaguaaugguugcaugauu

SEQ ID NO: 21036 - RNA, 19 nt, Homo sapiens
gaguugaacaauaguaaug

SEQ ID NO: 21037 - RNA, 19 nt, Homo sapiens
gggaaggaguaggcaaaga

SEQ ID NO: 21038 - RNA, 19 nt, Homo sapiens
caacucagaacacaagcuu

SEQ ID NO: 21039 - RNA, 19 nt, Homo sapiens
caaucaaggcuguucuauu

SEQ ID NO: 21040 - RNA, 19 nt, Homo sapiens
gaugagguuucaccauuuu

SEQ ID NO: 21041 - RNA, 19 nt, Homo sapiens
gaaggugaccgggcugaug

SEQ ID NO: 21042 - RNA, 19 nt, Homo sapiens
caugagaauugccaaagag

SEQ ID NO: 21043 - RNA, 19 nt, Homo sapiens
ggagcgugguuucuucauc

SEQ ID NO: 21044 - RNA, 19 nt, Homo sapiens
caucaaggaggcaggcuuu

SEQ ID NO: 21045 - RNA, 19 nt, Homo sapiens
cugaugaguggauuaauaa

SEQ ID NO: 21046 - RNA, 19 nt, Homo sapiens
uucauuggcuuaaccuaaa

SEQ ID NO: 21047 - RNA, 19 nt, Homo sapiens
ucaagguuccucagaagaa

SEQ ID NO: 21048 - RNA, 19 nt, Homo sapiens
gaacgaguccuaggcuaca

SEQ ID NO: 21049 - RNA, 19 nt, Homo sapiens
gaaccguggagaaagcaaa

SEQ ID NO: 21050 - RNA, 19 nt, Homo sapiens
uggccaggcugaucuugaa

SEQ ID NO: 21051 - RNA, 19 nt, Homo sapiens
uaguagagaugagguuuca

SEQ ID NO: 21052 - RNA, 19 nt, Homo sapiens
caagaugcagucagcaaga

SEQ ID NO: 21053 - RNA, 19 nt, Homo sapiens
acaugagaauugccaaaga

SEQ ID NO: 21054 - RNA, 19 nt, Homo sapiens
guagcugggauuauaggua

SEQ ID NO: 21055 - RNA, 19 nt, Homo sapiens
aacaaugaauggcaagaug

SEQ ID NO: 21056 - RNA, 19 nt, Homo sapiens
guaaugguugcaugauuug

SEQ ID NO: 21057 - RNA, 19 nt, Homo sapiens
aaauguccgucaacugaug

SEQ ID NO: 21058 - RNA, 19 nt, Homo sapiens
cuagguggauacuaaaucu

SEQ ID NO: 21059 - RNA, 19 nt, Homo sapiens
gcaguuugaacgaguccua

SEQ ID NO: 21060 - RNA, 19 nt, Homo sapiens
gaucaucccguggaacuuc

SEQ ID NO: 21061 - RNA, 19 nt, Homo sapiens
augaguugcuuccaugaaa

SEQ ID NO: 21062 - RNA, 19 nt, Homo sapiens
gcaauuccacaaccaccuu

SEQ ID NO: 21063 - RNA, 19 nt, Homo sapiens
gaagauugaggaggugguu

SEQ ID NO: 21064 - RNA, 19 nt, Homo sapiens
gcuggccgaugcugacaug

SEQ ID NO: 21065 - RNA, 19 nt, Homo sapiens
gcaaauaugugaaguggaa

SEQ ID NO: 21066 - RNA, 19 nt, Homo sapiens
acacagaggugguauauuu

SEQ ID NO: 21067 - RNA, 19 nt, Homo sapiens
gcagagaacuaggugaaua

SEQ ID NO: 21068 - RNA, 19 nt, Homo sapiens
gggaaaggauucacaguaa

SEQ ID NO: 21069 - RNA, 19 nt, Homo sapiens
gaaaguagugcuuaaguuu

SEQ ID NO: 21070 - RNA, 19 nt, Homo sapiens
ggaaaguagugcuuaaguu

SEQ ID NO: 21071 - RNA, 19 nt, Homo sapiens
uggaaagacugcuguaaua

SEQ ID NO: 21072 - RNA, 19 nt, Homo sapiens
ccaaguggccugaguauuu

SEQ ID NO: 21073 - RNA, 19 nt, Homo sapiens
gaugugcaauuucauguuu

SEQ ID NO: 21074 - RNA, 19 nt, Homo sapiens
gaaucugacuccaguaaga

SEQ ID NO: 21075 - RNA, 19 nt, Homo sapiens
gagcuguaauucacuuuaa

SEQ ID NO: 21076 - RNA, 19 nt, Homo sapiens
gagcagcaauuucuucuca

SEQ ID NO: 21077 - RNA, 19 nt, Homo sapiens
guaaauaacaccuggauuc

SEQ ID NO: 21078 - RNA, 19 nt, Homo sapiens
uaaccaaggcacuuucuua

SEQ ID NO: 21079 - RNA, 19 nt, Homo sapiens
gaaaugcuuugccgaaucu

SEQ ID NO: 21080 - RNA, 19 nt, Homo sapiens
gaaaugugcuggaggaaaa

SEQ ID NO: 21081 - RNA, 19 nt, Homo sapiens
ggaaagacugcuguaauaa

SEQ ID NO: 21082 - RNA, 19 nt, Homo sapiens
cgacaaagcccugaaguug

SEQ ID NO: 21083 - RNA, 19 nt, Homo sapiens
ggugguauauuuaaacuuc

SEQ ID NO: 21084 - RNA, 19 nt, Homo sapiens
aauaacaccuggauucuau

SEQ ID NO: 21085 - RNA, 19 nt, Homo sapiens
guacacaacuggaaagacu

SEQ ID NO: 21086 - RNA, 19 nt, Homo sapiens
uaauucaccuccucauuug

SEQ ID NO: 21087 - RNA, 19 nt, Homo sapiens
ccagagagcuuagucaaag

SEQ ID NO: 21088 - RNA, 19 nt, Homo sapiens
gaauguggcagaugaaaug

SEQ ID NO: 21089 - RNA, 19 nt, Homo sapiens
caaaugaugaugugcaauu

SEQ ID NO: 21090 - RNA, 19 nt, Homo sapiens
gccuauagguugucuguga

SEQ ID NO: 21091 - RNA, 19 nt, Homo sapiens
gugcuuaaguuugcaaauu

SEQ ID NO: 21092 - RNA, 19 nt, Homo sapiens
gagcaagccacgccucuuu

SEQ ID NO: 21093 - RNA, 19 nt, Homo sapiens
ucacuaacagcuuaugaua

SEQ ID NO: 21094 - RNA, 19 nt, Homo sapiens
cagcagccguguucacaaa

SEQ ID NO: 21095 - RNA, 19 nt, Homo sapiens
ggauuuggcuucauacacu

SEQ ID NO: 21096 - RNA, 19 nt, Homo sapiens
uaacagaaccagugugugu

SEQ ID NO: 21097 - RNA, 19 nt, Homo sapiens
cugaaaguguucccauaua

SEQ ID NO: 21098 - RNA, 19 nt, Homo sapiens
ccaguucuguuacccaauu

SEQ ID NO: 21099 - RNA, 19 nt, Homo sapiens
cuacuggaguugaaugauu

SEQ ID NO: 21100 - RNA, 19 nt, Homo sapiens
gcagaucgcaucccacaau

SEQ ID NO: 21101 - RNA, 19 nt, Homo sapiens
aaagacugcuguaauaaca

SEQ ID NO: 21102 - RNA, 19 nt, Homo sapiens
ugacaaaucagagcuguaa

SEQ ID NO: 21103 - RNA, 19 nt, Homo sapiens
caauacugccuuuggaaua

SEQ ID NO: 21104 - RNA, 19 nt, Homo sapiens
ggaaaggauucacaguaag

SEQ ID NO: 21105 - RNA, 19 nt, Homo sapiens
ccacaaugcgagaaugaua

SEQ ID NO: 21106 - RNA, 19 nt, Homo sapiens
gauaucacggucuaccuua

SEQ ID NO: 21107 - RNA, 19 nt, Homo sapiens
ugaaaguguucccauauag

SEQ ID NO: 21108 - RNA, 19 nt, Homo sapiens
gaggucaaguucaccaaga

SEQ ID NO: 21109 - RNA, 19 nt, Homo sapiens
ggaaauggcagagaacuag

SEQ ID NO: 21110 - RNA, 19 nt, Homo sapiens
caaacccacugucuucuca

SEQ ID NO: 21111 - RNA, 19 nt, Homo sapiens
cuggagggcuguauuagaa

SEQ ID NO: 21112 - RNA, 19 nt, Homo sapiens
caaguucaccaagauauuu

SEQ ID NO: 21113 - RNA, 19 nt, Homo sapiens
caaguggccugaguauuuc

SEQ ID NO: 21114 - RNA, 19 nt, Homo sapiens
cgaauacacagaagugaaa

SEQ ID NO: 21115 - RNA, 19 nt, Homo sapiens
gcucagccauggaagacaa

SEQ ID NO: 21116 - RNA, 19 nt, Homo sapiens
ggaacaccaugguccugaa

SEQ ID NO: 21117 - RNA, 19 nt, Homo sapiens
ggguggaccugcuuacaga

SEQ ID NO: 21118 - RNA, 19 nt, Homo sapiens
gaccuggagggcuguauua

SEQ ID NO: 21119 - RNA, 19 nt, Homo sapiens
gaauccaaaugaugaugug

SEQ ID NO: 21120 - RNA, 19 nt, Homo sapiens
cacguucacuaacagcuua

SEQ ID NO: 21121 - RNA, 19 nt, Homo sapiens
gauaauucaccuccucauu

SEQ ID NO: 21122 - RNA, 19 nt, Homo sapiens
ccaaggcacuuucuuaagc

SEQ ID NO: 21123 - RNA, 19 nt, Homo sapiens
ucaaaccaauacugccuuu

SEQ ID NO: 21124 - RNA, 19 nt, Homo sapiens
gcaguugcuugaaaugcuu

SEQ ID NO: 21125 - RNA, 19 nt, Homo sapiens
ggaacggucuggaucaacu

SEQ ID NO: 21126 - RNA, 19 nt, Homo sapiens
agcuaacacuuaucacuua

SEQ ID NO: 21127 - RNA, 19 nt, Homo sapiens
ggagugguauuugaagugu

SEQ ID NO: 21128 - RNA, 19 nt, Homo sapiens
ucuggaggcuuuacaucua

SEQ ID NO: 21129 - RNA, 19 nt, Homo sapiens
cagaggugguauauuuaaa

SEQ ID NO: 21130 - RNA, 19 nt, Homo sapiens
guacacagaggugguauau

SEQ ID NO: 21131 - RNA, 19 nt, Homo sapiens
ucaaguagauauagacacu

SEQ ID NO: 21132 - RNA, 19 nt, Homo sapiens
acuaguacuuuccuaauug

SEQ ID NO: 21133 - RNA, 19 nt, Homo sapiens
acuggcagguugugaauuu

SEQ ID NO: 21134 - RNA, 19 nt, Homo sapiens
gaaagacugcuguaauaac

SEQ ID NO: 21135 - RNA, 19 nt, Homo sapiens
gaacaggggccucagauug

SEQ ID NO: 21136 - RNA, 19 nt, Homo sapiens
gaacauugugccaggauuc

SEQ ID NO: 21137 - RNA, 19 nt, Homo sapiens
uaucucggcucucugauca

SEQ ID NO: 21138 - RNA, 19 nt, Homo sapiens
gcuaacacuuaucacuuau

SEQ ID NO: 21139 - RNA, 19 nt, Homo sapiens
ggcggaauguggcagauga

SEQ ID NO: 21140 - RNA, 19 nt, Homo sapiens
cuucaucagcuaacacuua

SEQ ID NO: 21141 - RNA, 19 nt, Homo sapiens
guauuagaacccucagaua

SEQ ID NO: 21142 - RNA, 19 nt, Homo sapiens
aaucagagcuguaauucac

SEQ ID NO: 21143 - RNA, 19 nt, Homo sapiens
auaauucaccuccucauuu

SEQ ID NO: 21144 - RNA, 19 nt, Homo sapiens
ucucagaagucacagacaa

SEQ ID NO: 21145 - RNA, 19 nt, Homo sapiens
caucaaacccacugucuuc

SEQ ID NO: 21146 - RNA, 19 nt, Homo sapiens
gagcgaauagcaccgacua

SEQ ID NO: 21147 - RNA, 19 nt, Homo sapiens
caaaucagagcuguaauuc

SEQ ID NO: 21148 - RNA, 19 nt, Homo sapiens
acaaaucagagcuguaauu

SEQ ID NO: 21149 - RNA, 19 nt, Homo sapiens
ggaauaugacagaaucaau

SEQ ID NO: 21150 - RNA, 19 nt, Homo sapiens
ugacauugaccgugagauu

SEQ ID NO: 21151 - RNA, 19 nt, Homo sapiens
gaaaggauucacaguaagg

SEQ ID NO: 21152 - RNA, 19 nt, Homo sapiens
ugaaaugcuuugccgaauc

SEQ ID NO: 21153 - RNA, 19 nt, Homo sapiens
cagaaccaguguguguaua

SEQ ID NO: 21154 - RNA, 19 nt, Homo sapiens
ggucaaguucaccaagaua

SEQ ID NO: 21155 - RNA, 19 nt, Homo sapiens
ccaguaagaaugugggaaa

SEQ ID NO: 21156 - RNA, 19 nt, Homo sapiens
gucaggaaauggcagagaa

SEQ ID NO: 21157 - RNA, 19 nt, Homo sapiens
gcaguucgacaaaaucuua

SEQ ID NO: 21158 - RNA, 19 nt, Homo sapiens
caaggcacuuucuuaagca

SEQ ID NO: 21159 - RNA, 19 nt, Homo sapiens
uaacagggagugguauuug

SEQ ID NO: 21160 - RNA, 19 nt, Homo sapiens
ucacucuccuguuuauuca

SEQ ID NO: 21161 - RNA, 19 nt, Homo sapiens
guuagaggguuccuauucu

SEQ ID NO: 21162 - RNA, 19 nt, Homo sapiens
caauagcccagagagcuua

SEQ ID NO: 21163 - RNA, 19 nt, Homo sapiens
caaaagcaguucgacaaaa

SEQ ID NO: 21164 - RNA, 19 nt, Homo sapiens
gaaccaguguguguauaac

SEQ ID NO: 21165 - RNA, 19 nt, Homo sapiens
gcaagaacgucgagaagau

SEQ ID NO: 21166 - RNA, 19 nt, Homo sapiens
ggagagaauuaaccauuga

SEQ ID NO: 21167 - RNA, 19 nt, Homo sapiens
ugaacaagcugaugauucu

SEQ ID NO: 21168 - RNA, 19 nt, Homo sapiens
gaaaucaggaguucaagau

SEQ ID NO: 21169 - RNA, 19 nt, Homo sapiens
caucggagauuagcaagaa

SEQ ID NO: 21170 - RNA, 19 nt, Homo sapiens
ugagaaaccuacauuugga

SEQ ID NO: 21171 - RNA, 19 nt, Homo sapiens
gcugaugucaccugaauaa

SEQ ID NO: 21172 - RNA, 19 nt, Homo sapiens
gccaggagcuuguaacucu

SEQ ID NO: 21173 - RNA, 19 nt, Homo sapiens
gggcugugguuaugcgaua

SEQ ID NO: 21174 - RNA, 19 nt, Homo sapiens
gagcugagauugcgucacu

SEQ ID NO: 21175 - RNA, 19 nt, Homo sapiens
gcaccaaccacccauauuc

SEQ ID NO: 21176 - RNA, 19 nt, Homo sapiens
ggacgaggccaucgaguuc

SEQ ID NO: 21177 - RNA, 19 nt, Homo sapiens
ggaacuguguggugcugaa

SEQ ID NO: 21178 - RNA, 19 nt, Homo sapiens
gaugucaccugaauaaagc

SEQ ID NO: 21179 - RNA, 19 nt, Homo sapiens
aaugaaggauugagggauu

SEQ ID NO: 21180 - RNA, 19 nt, Homo sapiens
aggaugaaaugaaggauug

SEQ ID NO: 21181 - RNA, 19 nt, Homo sapiens
gcaaggaugaaaugaagga

SEQ ID NO: 21182 - RNA, 19 nt, Homo sapiens
ccacccauauucaggagaa

SEQ ID NO: 21183 - RNA, 19 nt, Homo sapiens
ggagauggagccugugaug

SEQ ID NO: 21184 - RNA, 19 nt, Homo sapiens
aaucaggaguucaagauca

SEQ ID NO: 21185 - RNA, 19 nt, Homo sapiens
gagcacagguucgacuaca

SEQ ID NO: 21186 - RNA, 19 nt, Homo sapiens
ccacucagccaaagcagaa

SEQ ID NO: 21187 - RNA, 19 nt, Homo sapiens
cugaagccaucggagauua

SEQ ID NO: 21188 - RNA, 19 nt, Homo sapiens
uggagagaauuaaccauug

SEQ ID NO: 21189 - RNA, 19 nt, Homo sapiens
aaagcagaaugcaggguuu

SEQ ID NO: 21190 - RNA, 19 nt, Homo sapiens
gcaggagaaucgcuugaac

SEQ ID NO: 21191 - RNA, 19 nt, Homo sapiens
gaaaccccgucucuacuaa

SEQ ID NO: 21192 - RNA, 19 nt, Homo sapiens
aaaccuacauuuggacaau

SEQ ID NO: 21193 - RNA, 19 nt, Homo sapiens
gagauugcgucacugaacu

SEQ ID NO: 21194 - RNA, 19 nt, Homo sapiens
gcacagguucgacuacauc

SEQ ID NO: 21195 - RNA, 19 nt, Homo sapiens
aaacuggcccaauuuccua

SEQ ID NO: 21196 - RNA, 19 nt, Homo sapiens
guggagagaauuaaccauu

SEQ ID NO: 21197 - RNA, 19 nt, Homo sapiens
gaaacagugcagugacuca

SEQ ID NO: 21198 - RNA, 19 nt, Homo sapiens
gggaaacagugcagugacu

SEQ ID NO: 21199 - RNA, 19 nt, Homo sapiens
caccaucacccguuucuau

SEQ ID NO: 21200 - RNA, 19 nt, Homo sapiens
cuccagguguccuaucuuu

SEQ ID NO: 21201 - RNA, 19 nt, Homo sapiens
uggcugaugucaccugaau

SEQ ID NO: 21202 - RNA, 19 nt, Homo sapiens
guaacucuuuauccucaug

SEQ ID NO: 21203 - RNA, 19 nt, Homo sapiens
gagaauuaaccauugauac

SEQ ID NO: 21204 - RNA, 19 nt, Homo sapiens
ggccugguccucaucauug

SEQ ID NO: 21205 - RNA, 19 nt, Homo sapiens
gggcaagauuguuaugacu

SEQ ID NO: 21206 - RNA, 19 nt, Homo sapiens
cgugugggcaagauuguua

SEQ ID NO: 21207 - RNA, 19 nt, Homo sapiens
ggaacuauccgcugaaccu

SEQ ID NO: 21208 - RNA, 19 nt, Homo sapiens
cagcuacucaggaggcuaa

SEQ ID NO: 21209 - RNA, 19 nt, Homo sapiens
uagacuauaucaaccuaca

SEQ ID NO: 21210 - RNA, 19 nt, Homo sapiens
uugcaaggaugaaaugaag

SEQ ID NO: 21211 - RNA, 19 nt, Homo sapiens
gcugagauugcgucacuga

SEQ ID NO: 21212 - RNA, 19 nt, Homo sapiens
gagcuuguaacucuuuauc

SEQ ID NO: 21213 - RNA, 19 nt, Homo sapiens
ccuguaaucccagcacuuu

SEQ ID NO: 21214 - RNA, 19 nt, Homo sapiens
gaaaccuacauuuggacaa

SEQ ID NO: 21215 - RNA, 19 nt, Homo sapiens
cuugagaaaccuacauuug

SEQ ID NO: 21216 - RNA, 19 nt, Homo sapiens
acaagcugaugauucugaa

SEQ ID NO: 21217 - RNA, 19 nt, Homo sapiens
gcuuguaacucuuuauccu

SEQ ID NO: 21218 - RNA, 19 nt, Homo sapiens
ggccauuccugcccucucu

SEQ ID NO: 21219 - RNA, 19 nt, Homo sapiens
agagcaccaucacccguuu

SEQ ID NO: 21220 - RNA, 19 nt, Homo sapiens
caacuuuagucgggaagag

SEQ ID NO: 21221 - RNA, 19 nt, Homo sapiens
acacggcaccucugaguca

SEQ ID NO: 21222 - RNA, 19 nt, Homo sapiens
cagguucgacuacaucuuc

SEQ ID NO: 21223 - RNA, 19 nt, Homo sapiens
ucugaaacuggcccaauuu

SEQ ID NO: 21224 - RNA, 19 nt, Homo sapiens
ccagguguccuaucuuucu

SEQ ID NO: 21225 - RNA, 19 nt, Homo sapiens
cagccgcucccaaccauga

SEQ ID NO: 21226 - RNA, 19 nt, Homo sapiens
gcuugagaaaccuacauuu

SEQ ID NO: 21227 - RNA, 19 nt, Homo sapiens
gcugaugauucugaaacug

SEQ ID NO: 21228 - RNA, 19 nt, Homo sapiens
caggagcuuguaacucuuu

SEQ ID NO: 21229 - RNA, 19 nt, Homo sapiens
auugagggauugagggauu

SEQ ID NO: 21230 - RNA, 19 nt, Homo sapiens
cagcuggacuccgccuuca

SEQ ID NO: 21231 - RNA, 19 nt, Homo sapiens
ugaugucaccugaauaaag

SEQ ID NO: 21232 - RNA, 19 nt, Homo sapiens
ggcagagccucaggaugga

SEQ ID NO: 21233 - RNA, 19 nt, Homo sapiens
ccaggagcuuguaacucuu

SEQ ID NO: 21234 - RNA, 19 nt, Homo sapiens
gcugaagccaucggagauu

SEQ ID NO: 21235 - RNA, 19 nt, Homo sapiens
ucauugcgcccuggaacua

SEQ ID NO: 21236 - RNA, 19 nt, Homo sapiens
cuauaucaaccuacaacuu

SEQ ID NO: 21237 - RNA, 19 nt, Homo sapiens
ccgaggugcugccccaaua

SEQ ID NO: 21238 - RNA, 19 nt, Homo sapiens
guucaguggagagaauuaa

SEQ ID NO: 21239 - RNA, 19 nt, Homo sapiens
ccgguaccauggcaaguuc

SEQ ID NO: 21240 - RNA, 19 nt, Homo sapiens
caagaacgucgagaagauc

SEQ ID NO: 21241 - RNA, 19 nt, Homo sapiens
gaauuaaccauugauaccu

SEQ ID NO: 21242 - RNA, 19 nt, Homo sapiens
caccaaccacccauauuca

SEQ ID NO: 21243 - RNA, 19 nt, Homo sapiens
ggaacgacggcuucaugca

SEQ ID NO: 21244 - RNA, 19 nt, Homo sapiens
cgacuacaucuucuucaca

SEQ ID NO: 21245 - RNA, 19 nt, Homo sapiens
uucugaaacuggcccaauu

SEQ ID NO: 21246 - RNA, 19 nt, Homo sapiens
gagagaauuaaccauugau

SEQ ID NO: 21247 - RNA, 19 nt, Homo sapiens
cuuggcuccugcuuucuuu

SEQ ID NO: 21248 - RNA, 19 nt, Homo sapiens
gcuggacuccgccuucauc

SEQ ID NO: 21249 - RNA, 19 nt, Homo sapiens
guugcaaggaugaaaugaa

SEQ ID NO: 21250 - RNA, 19 nt, Homo sapiens
uuccuuggcuccugcuuuc

SEQ ID NO: 21251 - RNA, 19 nt, Homo sapiens
caucaaccagaaacaguuc

SEQ ID NO: 21252 - RNA, 19 nt, Homo sapiens
ucaucaaccagaaacaguu

SEQ ID NO: 21253 - RNA, 19 nt, Homo sapiens
gcgaucagcuugugacuua

SEQ ID NO: 21254 - RNA, 19 nt, Homo sapiens
gaaaguugcuggaaccaaa

SEQ ID NO: 21255 - RNA, 19 nt, Homo sapiens
uaucugagcucauccuuug

SEQ ID NO: 21256 - RNA, 19 nt, Homo sapiens
acagugcccugccuucuua

SEQ ID NO: 21257 - RNA, 19 nt, Homo sapiens
gcaaugagggcuucaccua

SEQ ID NO: 21258 - RNA, 19 nt, Homo sapiens
ggaauugcguggugcugaa

SEQ ID NO: 21259 - RNA, 19 nt, Homo sapiens
uaacaggauuuaucaccaa

SEQ ID NO: 21260 - RNA, 19 nt, Homo sapiens
gcacauagaagcccucaca

SEQ ID NO: 21261 - RNA, 19 nt, Homo sapiens
ggacgaggccaucaaguuc

SEQ ID NO: 21262 - RNA, 19 nt, Homo sapiens
agacauaucugagcucauc

SEQ ID NO: 21263 - RNA, 19 nt, Homo sapiens
gcucccaacucacauuguu

SEQ ID NO: 21264 - RNA, 19 nt, Homo sapiens
gagcugcacccuccuguga

SEQ ID NO: 21265 - RNA, 19 nt, Homo sapiens
ugacuacgcucucaagaac

SEQ ID NO: 21266 - RNA, 19 nt, Homo sapiens
ccucaaagacuguaguauu

SEQ ID NO: 21267 - RNA, 19 nt, Homo sapiens
ccucugcuccucccaaaua

SEQ ID NO: 21268 - RNA, 19 nt, Homo sapiens
gaugagcugcagaugcuua

SEQ ID NO: 21269 - RNA, 19 nt, Homo sapiens
gagccucaguuuccuuaug

SEQ ID NO: 21270 - RNA, 19 nt, Homo sapiens
ggaggcagcauguccaaga

SEQ ID NO: 21271 - RNA, 19 nt, Homo sapiens
caaguuggacuacaucuuc

SEQ ID NO: 21272 - RNA, 19 nt, Homo sapiens
cucaaagacuguaguauuc

SEQ ID NO: 21273 - RNA, 19 nt, Homo sapiens
cagaugagcugcagaugcu

SEQ ID NO: 21274 - RNA, 19 nt, Homo sapiens
gaggcagcauguccaagaa

SEQ ID NO: 21275 - RNA, 19 nt, Homo sapiens
uggagucacuuaugccaaa

SEQ ID NO: 21276 - RNA, 19 nt, Homo sapiens
cagagaaaccugagucuag

SEQ ID NO: 21277 - RNA, 19 nt, Homo sapiens
caacgggucacacagagaa

SEQ ID NO: 21278 - RNA, 19 nt, Homo sapiens
ucacuuaugccaaacucua

SEQ ID NO: 21279 - RNA, 19 nt, Homo sapiens
gagcacaaguuggacuaca

SEQ ID NO: 21280 - RNA, 19 nt, Homo sapiens
gggcuucaccuacauaucu

SEQ ID NO: 21281 - RNA, 19 nt, Homo sapiens
caccaucacccguuucuau

SEQ ID NO: 21282 - RNA, 19 nt, Homo sapiens
gcacucauagcccagauag

SEQ ID NO: 21283 - RNA, 19 nt, Homo sapiens
caaagacuguaguauucca

SEQ ID NO: 21284 - RNA, 19 nt, Homo sapiens
aagacacgccugcauguaa

SEQ ID NO: 21285 - RNA, 19 nt, Homo sapiens
caagacacgccugcaugua

SEQ ID NO: 21286 - RNA, 19 nt, Homo sapiens
ugcuggagcugucacauga

SEQ ID NO: 21287 - RNA, 19 nt, Homo sapiens
aaugagggcuucaccuaca

SEQ ID NO: 21288 - RNA, 19 nt, Homo sapiens
gaccagcagcggcagcuuu

SEQ ID NO: 21289 - RNA, 19 nt, Homo sapiens
ggacuacaucuucuucaca

SEQ ID NO: 21290 - RNA, 19 nt, Homo sapiens
gcgugaggccuucaacuga

SEQ ID NO: 21291 - RNA, 19 nt, Homo sapiens
ggaaaagcacguccucaaa

SEQ ID NO: 21292 - RNA, 19 nt, Homo sapiens
gccaaacucuaauaaaaug

SEQ ID NO: 21293 - RNA, 19 nt, Homo sapiens
ccagggauccucucacauc

SEQ ID NO: 21294 - RNA, 19 nt, Homo sapiens
ugccagggcugcaaagcaa

SEQ ID NO: 21295 - RNA, 19 nt, Homo sapiens
gcacaaguuggacuacauc

SEQ ID NO: 21296 - RNA, 19 nt, Homo sapiens
gagguugacuacgcucuca

SEQ ID NO: 21297 - RNA, 19 nt, Homo sapiens
gcuguggcccucuguguau

SEQ ID NO: 21298 - RNA, 19 nt, Homo sapiens
ggagacggagccugugaug

SEQ ID NO: 21299 - RNA, 19 nt, Homo sapiens
ggagacagggcagcugcua

SEQ ID NO: 21300 - RNA, 19 nt, Homo sapiens
gaaccaaaauggagucacu

SEQ ID NO: 21301 - RNA, 19 nt, Homo sapiens
agacggagccugugaugca

SEQ ID NO: 21302 - RNA, 19 nt, Homo sapiens
gggcaagauugucaugacu

SEQ ID NO: 21303 - RNA, 19 nt, Homo sapiens
agacacgccugcauguaag

SEQ ID NO: 21304 - RNA, 19 nt, Homo sapiens
gcucauccuuugccagaac

SEQ ID NO: 21305 - RNA, 19 nt, Homo sapiens
acucauagcccagauagga

SEQ ID NO: 21306 - RNA, 19 nt, Homo sapiens
acuguaguauuccagauga

SEQ ID NO: 21307 - RNA, 19 nt, Homo sapiens
aaaagcacguccucaaaga

SEQ ID NO: 21308 - RNA, 19 nt, Homo sapiens
gaaaagcacguccucaaag

SEQ ID NO: 21309 - RNA, 19 nt, Homo sapiens
agacacagggcguauggaa

SEQ ID NO: 21310 - RNA, 19 nt, Homo sapiens
ccaagacacgccugcaugu

SEQ ID NO: 21311 - RNA, 19 nt, Homo sapiens
agacagggcagcugcuaga

SEQ ID NO: 21312 - RNA, 19 nt, Homo sapiens
ggcagcauguccaagaaag

SEQ ID NO: 21313 - RNA, 19 nt, Homo sapiens
gacacagggcguauggaaa

SEQ ID NO: 21314 - RNA, 19 nt, Homo sapiens
aggccuggaugaaggauga

SEQ ID NO: 21315 - RNA, 19 nt, Homo sapiens
caaaauggagucacuuaug

SEQ ID NO: 21316 - RNA, 19 nt, Homo sapiens
ggcuuaugcucccaacuca

SEQ ID NO: 21317 - RNA, 19 nt, Homo sapiens
agagcaccaucacccguuu

SEQ ID NO: 21318 - RNA, 19 nt, Homo sapiens
gcccguaacaggauuuauc

SEQ ID NO: 21319 - RNA, 19 nt, Homo sapiens
ggccacuuccuucaagaaa

SEQ ID NO: 21320 - RNA, 19 nt, Homo sapiens
gaucagcuugugacuuaca

SEQ ID NO: 21321 - RNA, 19 nt, Homo sapiens
gcacguccucaaagacugu

SEQ ID NO: 21322 - RNA, 19 nt, Homo sapiens
gcauguaagaccagacaca

SEQ ID NO: 21323 - RNA, 19 nt, Homo sapiens
ggaacuacccauugaaccu

SEQ ID NO: 21324 - RNA, 19 nt, Homo sapiens
gccagaacgagguugacua

SEQ ID NO: 21325 - RNA, 19 nt, Homo sapiens
gcuccucccaaauaaauuc

SEQ ID NO: 21326 - RNA, 19 nt, Homo sapiens
caacuccugcgaucagcuu

SEQ ID NO: 21327 - RNA, 19 nt, Homo sapiens
ccagaacgagguugacuac

SEQ ID NO: 21328 - RNA, 19 nt, Homo sapiens
cccuggaacuacccauuga

SEQ ID NO: 21329 - RNA, 19 nt, Homo sapiens
acacacacaugcccguaac

SEQ ID NO: 21330 - RNA, 19 nt, Homo sapiens
gggcuuaugcucccaacuc

SEQ ID NO: 21331 - RNA, 19 nt, Homo sapiens
uggacgaggccaucaaguu

SEQ ID NO: 21332 - RNA, 19 nt, Homo sapiens
cugcuuacauggacuucug

SEQ ID NO: 21333 - RNA, 19 nt, Homo sapiens
gauccgcuacccacccuau

SEQ ID NO: 21334 - RNA, 19 nt, Homo sapiens
gacgaggccaucaaguuca

SEQ ID NO: 21335 - RNA, 19 nt, Homo sapiens
ugccagguguccucacuca

SEQ ID NO: 21336 - RNA, 19 nt, Homo sapiens
ggcuguggcccucugugua

SEQ ID NO: 21337 - RNA, 19 nt, Homo sapiens
acacagggcguauggaaaa

SEQ ID NO: 21338 - RNA, 19 nt, Homo sapiens
cuuaugccaaacucuaaua

SEQ ID NO: 21339 - RNA, 19 nt, Homo sapiens
agccucaguuuccuuaugu

SEQ ID NO: 21340 - RNA, 19 nt, Homo sapiens
ggcagugucacccuggaaa

SEQ ID NO: 21341 - RNA, 19 nt, Homo sapiens
uggagaaauuaaaggagau

SEQ ID NO: 21342 - RNA, 19 nt, Homo sapiens
cggcagcuuuggaggcaau

SEQ ID NO: 21343 - RNA, 19 nt, Homo sapiens
caggauuuaucaccaagac

SEQ ID NO: 21344 - RNA, 19 nt, Homo sapiens
acagagaaaccugagucua

SEQ ID NO: 21345 - RNA, 19 nt, Homo sapiens
ugagggcuucaccuacaua

SEQ ID NO: 21346 - RNA, 19 nt, Homo sapiens
caucaaccagaaacaguuc

SEQ ID NO: 21347 - RNA, 19 nt, Homo sapiens
ucaucaaccagaaacaguu

SEQ ID NO: 21348 - RNA, 19 nt, Homo sapiens
caugagaccuuguguauua

SEQ ID NO: 21349 - RNA, 19 nt, Homo sapiens
gaagucggcuccagcauua

SEQ ID NO: 21350 - RNA, 19 nt, Homo sapiens
gcaaagugcuacgcaaaua

SEQ ID NO: 21351 - RNA, 19 nt, Homo sapiens
gagcuacccuuuaaaugua

SEQ ID NO: 21352 - RNA, 19 nt, Homo sapiens
gcagggugcuaaaguguua

SEQ ID NO: 21353 - RNA, 19 nt, Homo sapiens
aaacagacccaaaggauua

SEQ ID NO: 21354 - RNA, 19 nt, Homo sapiens
gcagugguauuuacaacua

SEQ ID NO: 21355 - RNA, 19 nt, Homo sapiens
guaaugccauggucuuuaa

SEQ ID NO: 21356 - RNA, 19 nt, Homo sapiens
ggagaugggugauguggaa

SEQ ID NO: 21357 - RNA, 19 nt, Homo sapiens
uuaauucucuggcguauuu

SEQ ID NO: 21358 - RNA, 19 nt, Homo sapiens
gcugggacgugcuucauua

SEQ ID NO: 21359 - RNA, 19 nt, Homo sapiens
ggauggauauuacaugaga

SEQ ID NO: 21360 - RNA, 19 nt, Homo sapiens
aaugugaacuugccuagua

SEQ ID NO: 21361 - RNA, 19 nt, Homo sapiens
ggaaaucuaucucccuauc

SEQ ID NO: 21362 - RNA, 19 nt, Homo sapiens
gggagaauguggugucuug

SEQ ID NO: 21363 - RNA, 19 nt, Homo sapiens
ggaaguaaauuuggcuguu

SEQ ID NO: 21364 - RNA, 19 nt, Homo sapiens
ggacgugcuucauuaacaa

SEQ ID NO: 21365 - RNA, 19 nt, Homo sapiens
gaccuuguguauuaacuaa

SEQ ID NO: 21366 - RNA, 19 nt, Homo sapiens
gaaacagacccaaaggauu

SEQ ID NO: 21367 - RNA, 19 nt, Homo sapiens
gaaguaaauuuggcuguuc

SEQ ID NO: 21368 - RNA, 19 nt, Homo sapiens
gugugacaaucgaauauua

SEQ ID NO: 21369 - RNA, 19 nt, Homo sapiens
ggagcuacccuuuaaaugu

SEQ ID NO: 21370 - RNA, 19 nt, Homo sapiens
caguggagcuacccuuuaa

SEQ ID NO: 21371 - RNA, 19 nt, Homo sapiens
gauauaagaagucaggauu

SEQ ID NO: 21372 - RNA, 19 nt, Homo sapiens
guuaugugguggagauaua

SEQ ID NO: 21373 - RNA, 19 nt, Homo sapiens
ucauggagaugucagcuaa

SEQ ID NO: 21374 - RNA, 19 nt, Homo sapiens
cuagaaagagccaaugaua

SEQ ID NO: 21375 - RNA, 19 nt, Homo sapiens
aaaggaaucaaaccuguua

SEQ ID NO: 21376 - RNA, 19 nt, Homo sapiens
gaugucagcuaaaggaauc

SEQ ID NO: 21377 - RNA, 19 nt, Homo sapiens
ugucgcagccgcucaauua

SEQ ID NO: 21378 - RNA, 19 nt, Homo sapiens
uauaagaagucaggauuug

SEQ ID NO: 21379 - RNA, 19 nt, Homo sapiens
gauaauagauggggucaaa

SEQ ID NO: 21380 - RNA, 19 nt, Homo sapiens
uuuaagagccaguaacaua

SEQ ID NO: 21381 - RNA, 19 nt, Homo sapiens
gagaaugguucauguuacu

SEQ ID NO: 21382 - RNA, 19 nt, Homo sapiens
acuagcagcuggcgucuuu

SEQ ID NO: 21383 - RNA, 19 nt, Homo sapiens
gagacgacaugaccugugu

SEQ ID NO: 21384 - RNA, 19 nt, Homo sapiens
ggagaugucagcuaaagga

SEQ ID NO: 21385 - RNA, 19 nt, Homo sapiens
ggaagucggcuccagcauu

SEQ ID NO: 21386 - RNA, 19 nt, Homo sapiens
ggaacgggaggaugaaauu

SEQ ID NO: 21387 - RNA, 19 nt, Homo sapiens
cagaggaaguggugaaaca

SEQ ID NO: 21388 - RNA, 19 nt, Homo sapiens
ccagguggaucguuugguu

SEQ ID NO: 21389 - RNA, 19 nt, Homo sapiens
gagcguugccgaauccuuu

SEQ ID NO: 21390 - RNA, 19 nt, Homo sapiens
ucacuugccuagucuugaa

SEQ ID NO: 21391 - RNA, 19 nt, Homo sapiens
ccacugauaauguuaauuc

SEQ ID NO: 21392 - RNA, 19 nt, Homo sapiens
gauaugaacaaugcuguaa

SEQ ID NO: 21393 - RNA, 19 nt, Homo sapiens
gcuacuggcugaaaucuac

SEQ ID NO: 21394 - RNA, 19 nt, Homo sapiens
gcucccagguggaucguuu

SEQ ID NO: 21395 - RNA, 19 nt, Homo sapiens
ggaugaaauugcuacuaug

SEQ ID NO: 21396 - RNA, 19 nt, Homo sapiens
gauagcuacuuucacaugu

SEQ ID NO: 21397 - RNA, 19 nt, Homo sapiens
gauuucagcucauugacau

SEQ ID NO: 21398 - RNA, 19 nt, Homo sapiens
gaacggccgugugacaauc

SEQ ID NO: 21399 - RNA, 19 nt, Homo sapiens
cugaagaucccaaauuaaa

SEQ ID NO: 21400 - RNA, 19 nt, Homo sapiens
accugaagaucccaaauua

SEQ ID NO: 21401 - RNA, 19 nt, Homo sapiens
gaguauuugugcagaaaga

SEQ ID NO: 21402 - RNA, 19 nt, Homo sapiens
gaaucaaaccuguuaccuu

SEQ ID NO: 21403 - RNA, 19 nt, Homo sapiens
uggcugaaaucuacaguga

SEQ ID NO: 21404 - RNA, 19 nt, Homo sapiens
guaagcacuuugucucugu

SEQ ID NO: 21405 - RNA, 19 nt, Homo sapiens
cuuuaaaccuucucccuuu

SEQ ID NO: 21406 - RNA, 19 nt, Homo sapiens
caaccaguuuguagauuuc

SEQ ID NO: 21407 - RNA, 19 nt, Homo sapiens
uaauacaucuuccacacau

SEQ ID NO: 21408 - RNA, 19 nt, Homo sapiens
caagaguauuugugcagaa

SEQ ID NO: 21409 - RNA, 19 nt, Homo sapiens
gccauggucuuuaaaccuu

SEQ ID NO: 21410 - RNA, 19 nt, Homo sapiens
gguaaugccauggucuuua

SEQ ID NO: 21411 - RNA, 19 nt, Homo sapiens
gaacuaccccuuucagauu

SEQ ID NO: 21412 - RNA, 19 nt, Homo sapiens
gcagaggaaucgagugacu

SEQ ID NO: 21413 - RNA, 19 nt, Homo sapiens
gguagaaucaguagagaug

SEQ ID NO: 21414 - RNA, 19 nt, Homo sapiens
aagagaaugguucauguua

SEQ ID NO: 21415 - RNA, 19 nt, Homo sapiens
gcagugaaaccuauugaca

SEQ ID NO: 21416 - RNA, 19 nt, Homo sapiens
gggacgugcuucauuaaca

SEQ ID NO: 21417 - RNA, 19 nt, Homo sapiens
gagccaaugauaccacuuu

SEQ ID NO: 21418 - RNA, 19 nt, Homo sapiens
aaggauggauauuacauga

SEQ ID NO: 21419 - RNA, 19 nt, Homo sapiens
caagugcagugguauuuac

SEQ ID NO: 21420 - RNA, 19 nt, Homo sapiens
gaagaucccaaauuaaagg

SEQ ID NO: 21421 - RNA, 19 nt, Homo sapiens
uaagggaacgggaggauga

SEQ ID NO: 21422 - RNA, 19 nt, Homo sapiens
guagauuucuuuguuccuu

SEQ ID NO: 21423 - RNA, 19 nt, Homo sapiens
gaaaagagacuaggauaau

SEQ ID NO: 21424 - RNA, 19 nt, Homo sapiens
gaugugaauuggcccuguu

SEQ ID NO: 21425 - RNA, 19 nt, Homo sapiens
aggcaaaucuccacucauc

SEQ ID NO: 21426 - RNA, 19 nt, Homo sapiens
cagauugccucuuggaagu

SEQ ID NO: 21427 - RNA, 19 nt, Homo sapiens
gcuuggacauugacauuuc

SEQ ID NO: 21428 - RNA, 19 nt, Homo sapiens
aggaugaaauugcuacuau

SEQ ID NO: 21429 - RNA, 19 nt, Homo sapiens
gcaaaucuccacucaucau

SEQ ID NO: 21430 - RNA, 19 nt, Homo sapiens
gaggcugccaggauaauaa

SEQ ID NO: 21431 - RNA, 19 nt, Homo sapiens
aaaucuaucucccuaucuu

SEQ ID NO: 21432 - RNA, 19 nt, Homo sapiens
uuaagugccuuguagauac

SEQ ID NO: 21433 - RNA, 19 nt, Homo sapiens
aagcugagguucuagaaag

SEQ ID NO: 21434 - RNA, 19 nt, Homo sapiens
ggagcgaguccuuggguuu

SEQ ID NO: 21435 - RNA, 19 nt, Homo sapiens
ggccagguuugcuguaaug

SEQ ID NO: 21436 - RNA, 19 nt, Homo sapiens
gcuguggaaugaugugaau

SEQ ID NO: 21437 - RNA, 19 nt, Homo sapiens
gaagcugagguucuagaaa

SEQ ID NO: 21438 - RNA, 19 nt, Homo sapiens
ccaaauuaaaggauggaua

SEQ ID NO: 21439 - RNA, 19 nt, Homo sapiens
uaugaacaaugcuguaaag

SEQ ID NO: 21440 - RNA, 19 nt, Homo sapiens
ccuguuaccuuggaacuug

SEQ ID NO: 21441 - RNA, 19 nt, Homo sapiens
ucaaaccuguuaccuugga

SEQ ID NO: 21442 - RNA, 19 nt, Homo sapiens
ccaguggagcuacccuuua

SEQ ID NO: 21443 - RNA, 19 nt, Homo sapiens
cuacugcgauagaggaaau

SEQ ID NO: 21444 - RNA, 19 nt, Homo sapiens
acauuuggcccacugauaa

SEQ ID NO: 21445 - RNA, 19 nt, Homo sapiens
gccgagugauagcuacuuu

SEQ ID NO: 21446 - RNA, 19 nt, Homo sapiens
cgacaugaccugugugaag

SEQ ID NO: 21447 - RNA, 19 nt, Homo sapiens
agugaaaccuauugacaug

SEQ ID NO: 21448 - RNA, 19 nt, Homo sapiens
ggacaaaucuguaaguuuc

SEQ ID NO: 21449 - RNA, 19 nt, Homo sapiens
gagagaaggugcuaacaaa

SEQ ID NO: 21450 - RNA, 19 nt, Homo sapiens
gcucaacucuuucccauuu

SEQ ID NO: 21451 - RNA, 19 nt, Homo sapiens
gggcaaggcugaaguaaga

SEQ ID NO: 21452 - RNA, 19 nt, Homo sapiens
caaagcaucuuguaaccua

SEQ ID NO: 21453 - RNA, 19 nt, Homo sapiens
agagaucccuuucugauua

SEQ ID NO: 21454 - RNA, 19 nt, Homo sapiens
aaaccuaacuggcauuuaa

SEQ ID NO: 21455 - RNA, 19 nt, Homo sapiens
aaagaggccugggauauua

SEQ ID NO: 21456 - RNA, 19 nt, Homo sapiens
caggaucucuauauuguua

SEQ ID NO: 21457 - RNA, 19 nt, Homo sapiens
gagagaaugugauuuacuu

SEQ ID NO: 21458 - RNA, 19 nt, Homo sapiens
gaaccugucuuaaauugug

SEQ ID NO: 21459 - RNA, 19 nt, Homo sapiens
gaaaggaucaucaaucuuc

SEQ ID NO: 21460 - RNA, 19 nt, Homo sapiens
gaaguuaguugccaaaguc

SEQ ID NO: 21461 - RNA, 19 nt, Homo sapiens
gaagaaugauccuguucaa

SEQ ID NO: 21462 - RNA, 19 nt, Homo sapiens
gacaauccuuugaucauaa

SEQ ID NO: 21463 - RNA, 19 nt, Homo sapiens
cagcgucccuguuuauuaa

SEQ ID NO: 21464 - RNA, 19 nt, Homo sapiens
ggaaaugcugugauuauaa

SEQ ID NO: 21465 - RNA, 19 nt, Homo sapiens
caacaguacuuaccgaugu

SEQ ID NO: 21466 - RNA, 19 nt, Homo sapiens
gaacguauaaucaacuuug

SEQ ID NO: 21467 - RNA, 19 nt, Homo sapiens
ccacggagcuccugaagca

SEQ ID NO: 21468 - RNA, 19 nt, Homo sapiens
ggucagaagugccaucuca

SEQ ID NO: 21469 - RNA, 19 nt, Homo sapiens
gggaaccugucuuaaauug

SEQ ID NO: 21470 - RNA, 19 nt, Homo sapiens
uagaugaggccauaaauuu

SEQ ID NO: 21471 - RNA, 19 nt, Homo sapiens
guauggaaccucagauaua

SEQ ID NO: 21472 - RNA, 19 nt, Homo sapiens
guuaguaggucuucaagga

SEQ ID NO: 21473 - RNA, 19 nt, Homo sapiens
ucauugccauucaucauua

SEQ ID NO: 21474 - RNA, 19 nt, Homo sapiens
caaacacucugugaucaaa

SEQ ID NO: 21475 - RNA, 19 nt, Homo sapiens
aaaccaaggugaugcaaga

SEQ ID NO: 21476 - RNA, 19 nt, Homo sapiens
caaagcuucucccucagua

SEQ ID NO: 21477 - RNA, 19 nt, Homo sapiens
agacucagcucacucaaug

SEQ ID NO: 21478 - RNA, 19 nt, Homo sapiens
agacaauccuuugaucaua

SEQ ID NO: 21479 - RNA, 19 nt, Homo sapiens
ccucagauauacccuauug

SEQ ID NO: 21480 - RNA, 19 nt, Homo sapiens
gaaagacucagcucacuca

SEQ ID NO: 21481 - RNA, 19 nt, Homo sapiens
ccagagaggugagauuaga

SEQ ID NO: 21482 - RNA, 19 nt, Homo sapiens
gcaagcaucaccugucauu

SEQ ID NO: 21483 - RNA, 19 nt, Homo sapiens
ggcagaauauuacugaaga

SEQ ID NO: 21484 - RNA, 19 nt, Homo sapiens
gcagcgauuugaccacauu

SEQ ID NO: 21485 - RNA, 19 nt, Homo sapiens
ccaguggucuucauucuuc

SEQ ID NO: 21486 - RNA, 19 nt, Homo sapiens
uaaaagagucuccugauua

SEQ ID NO: 21487 - RNA, 19 nt, Homo sapiens
cuaaaccaguuaagaagaa

SEQ ID NO: 21488 - RNA, 19 nt, Homo sapiens
guaagaggccuguggaaug

SEQ ID NO: 21489 - RNA, 19 nt, Homo sapiens
ggaaguuaguugccaaagu

SEQ ID NO: 21490 - RNA, 19 nt, Homo sapiens
gucccaacauucccuaaua

SEQ ID NO: 21491 - RNA, 19 nt, Homo sapiens
ucaacuacgucccaacauu

SEQ ID NO: 21492 - RNA, 19 nt, Homo sapiens
uauaaagccuucugaacug

SEQ ID NO: 21493 - RNA, 19 nt, Homo sapiens
caaagaggccugggauauu

SEQ ID NO: 21494 - RNA, 19 nt, Homo sapiens
gcagaauauuacugaagaa

SEQ ID NO: 21495 - RNA, 19 nt, Homo sapiens
gauacuaaguuugcuugaa

SEQ ID NO: 21496 - RNA, 19 nt, Homo sapiens
uaauaacgagccuaguuua

SEQ ID NO: 21497 - RNA, 19 nt, Homo sapiens
ccagugggaugggagcuua

SEQ ID NO: 21498 - RNA, 19 nt, Homo sapiens
aaauguagaugaggccaua

SEQ ID NO: 21499 - RNA, 19 nt, Homo sapiens
cugaauggguuacugcuaa

SEQ ID NO: 21500 - RNA, 19 nt, Homo sapiens
ccaaggugaugcaagaaga

SEQ ID NO: 21501 - RNA, 19 nt, Homo sapiens
gcauugcacccgacuauau

SEQ ID NO: 21502 - RNA, 19 nt, Homo sapiens
auuauuggcuugucuacua

SEQ ID NO: 21503 - RNA, 19 nt, Homo sapiens
gaccaauucuuccaauagu

SEQ ID NO: 21504 - RNA, 19 nt, Homo sapiens
ggaaacagugaaggaauuu

SEQ ID NO: 21505 - RNA, 19 nt, Homo sapiens
agaccaggaucucuauauu

SEQ ID NO: 21506 - RNA, 19 nt, Homo sapiens
uaaugacgcuccugguaug

SEQ ID NO: 21507 - RNA, 19 nt, Homo sapiens
gugcaagagugaauucaau

SEQ ID NO: 21508 - RNA, 19 nt, Homo sapiens
uuaccgauguugauccuaa

SEQ ID NO: 21509 - RNA, 19 nt, Homo sapiens
gaaggaauuuuauggagaa

SEQ ID NO: 21510 - RNA, 19 nt, Homo sapiens
aggaaaugcugugauuaua

SEQ ID NO: 21511 - RNA, 19 nt, Homo sapiens
caaggcagaauauuacuga

SEQ ID NO: 21512 - RNA, 19 nt, Homo sapiens
guagaugaggccauaaauu

SEQ ID NO: 21513 - RNA, 19 nt, Homo sapiens
gaucaucaaucuucgucau

SEQ ID NO: 21514 - RNA, 19 nt, Homo sapiens
gagagaucccuuucugauu

SEQ ID NO: 21515 - RNA, 19 nt, Homo sapiens
gaagcaggaggauugauug

SEQ ID NO: 21516 - RNA, 19 nt, Homo sapiens
caaugggacucaaggacuu

SEQ ID NO: 21517 - RNA, 19 nt, Homo sapiens
uaauggcacugcucacuuc

SEQ ID NO: 21518 - RNA, 19 nt, Homo sapiens
ucaucaaucuucgucauuu

SEQ ID NO: 21519 - RNA, 19 nt, Homo sapiens
gcaggaaaugcugugauua

SEQ ID NO: 21520 - RNA, 19 nt, Homo sapiens
agagugaauucaaugugua

SEQ ID NO: 21521 - RNA, 19 nt, Homo sapiens
uggauggucuggacaagaa

SEQ ID NO: 21522 - RNA, 19 nt, Homo sapiens
uaaagugagggaaccauuu

SEQ ID NO: 21523 - RNA, 19 nt, Homo sapiens
ggaggagaauguauuagac

SEQ ID NO: 21524 - RNA, 19 nt, Homo sapiens
ggaccaauucuuccaauag

SEQ ID NO: 21525 - RNA, 19 nt, Homo sapiens
ccgacuauauucucuguga

SEQ ID NO: 21526 - RNA, 19 nt, Homo sapiens
ccucauucauucuuuauca

SEQ ID NO: 21527 - RNA, 19 nt, Homo sapiens
uagugccucuacugaauua

SEQ ID NO: 21528 - RNA, 19 nt, Homo sapiens
ggaagucauuacuguccuu

SEQ ID NO: 21529 - RNA, 19 nt, Homo sapiens
gaugaggccauaaauuuca

SEQ ID NO: 21530 - RNA, 19 nt, Homo sapiens
gcuucucccucaguauuua

SEQ ID NO: 21531 - RNA, 19 nt, Homo sapiens
gggaggagaauguauuaga

SEQ ID NO: 21532 - RNA, 19 nt, Homo sapiens
gcaaacacucugugaucaa

SEQ ID NO: 21533 - RNA, 19 nt, Homo sapiens
uugagaaucuuccugaaug

SEQ ID NO: 21534 - RNA, 19 nt, Homo sapiens
gaccaggaucucuauauug

SEQ ID NO: 21535 - RNA, 19 nt, Homo sapiens
ucaaugagagaaugugauu

SEQ ID NO: 21536 - RNA, 19 nt, Homo sapiens
acccuaaaguugcagguua

SEQ ID NO: 21537 - RNA, 19 nt, Homo sapiens
ggagacaauccuuugauca

SEQ ID NO: 21538 - RNA, 19 nt, Homo sapiens
gaccucaucucuaucaaaa

SEQ ID NO: 21539 - RNA, 19 nt, Homo sapiens
ugaauggguuacugcuaaa

SEQ ID NO: 21540 - RNA, 19 nt, Homo sapiens
caacuacgucccaacauuc

SEQ ID NO: 21541 - RNA, 19 nt, Homo sapiens
ccuagugccucuacugaau

SEQ ID NO: 21542 - RNA, 19 nt, Homo sapiens
gccucuggcucuuuaugua

SEQ ID NO: 21543 - RNA, 19 nt, Homo sapiens
cuacauagccccaacagua

SEQ ID NO: 21544 - RNA, 19 nt, Homo sapiens
aagagucuccugauuauga

SEQ ID NO: 21545 - RNA, 19 nt, Homo sapiens
aggaaacagugaaggaauu

SEQ ID NO: 21546 - RNA, 19 nt, Homo sapiens
caggaaaugcugugauuau

SEQ ID NO: 21547 - RNA, 19 nt, Homo sapiens
gaaacgguucaacaaagaa

SEQ ID NO: 21548 - RNA, 19 nt, Homo sapiens
gagaaacgcugcagacuau

SEQ ID NO: 21549 - RNA, 19 nt, Homo sapiens
gggcauggcucguauguuu

SEQ ID NO: 21550 - RNA, 19 nt, Homo sapiens
uaagagaacugcugucauu

SEQ ID NO: 21551 - RNA, 19 nt, Homo sapiens
uaaaggaacuuaaggauuc

SEQ ID NO: 21552 - RNA, 19 nt, Homo sapiens
gaagugauguauauucuug

SEQ ID NO: 21553 - RNA, 19 nt, Homo sapiens
gaaugcagauuucuucaaa

SEQ ID NO: 21554 - RNA, 19 nt, Homo sapiens
gaacguauccuacacaaug

SEQ ID NO: 21555 - RNA, 19 nt, Homo sapiens
gaacugcugucauucaaga

SEQ ID NO: 21556 - RNA, 19 nt, Homo sapiens
gagggcauauaacaaauua

SEQ ID NO: 21557 - RNA, 19 nt, Homo sapiens
acaaagaggucacugaauu

SEQ ID NO: 21558 - RNA, 19 nt, Homo sapiens
gaacugcaaugguauaaag

SEQ ID NO: 21559 - RNA, 19 nt, Homo sapiens
gcucaaagacauucuguua

SEQ ID NO: 21560 - RNA, 19 nt, Homo sapiens
gagcagcaguggacuaauu

SEQ ID NO: 21561 - RNA, 19 nt, Homo sapiens
ggacuuucaucaucaaauu

SEQ ID NO: 21562 - RNA, 19 nt, Homo sapiens
gaaccuuucuuucuaucua

SEQ ID NO: 21563 - RNA, 19 nt, Homo sapiens
gcaauauucuggaaaugaa

SEQ ID NO: 21564 - RNA, 19 nt, Homo sapiens
uaacaaacaugggcaauau

SEQ ID NO: 21565 - RNA, 19 nt, Homo sapiens
gauaaaggcucaaagacau

SEQ ID NO: 21566 - RNA, 19 nt, Homo sapiens
uaugugcacucgagaauua

SEQ ID NO: 21567 - RNA, 19 nt, Homo sapiens
gaccuucucuuuggaaaua

SEQ ID NO: 21568 - RNA, 19 nt, Homo sapiens
ucacauaguucaaagagaa

SEQ ID NO: 21569 - RNA, 19 nt, Homo sapiens
gaauggagcuaagguagaa

SEQ ID NO: 21570 - RNA, 19 nt, Homo sapiens
uuacaaagcuuuagcagau

SEQ ID NO: 21571 - RNA, 19 nt, Homo sapiens
cuucagaacucgccuagua

SEQ ID NO: 21572 - RNA, 19 nt, Homo sapiens
gcaauaagguaccuggaau

SEQ ID NO: 21573 - RNA, 19 nt, Homo sapiens
caaagaggucacugaauua

SEQ ID NO: 21574 - RNA, 19 nt, Homo sapiens
ucucugaacuccuguuuaa

SEQ ID NO: 21575 - RNA, 19 nt, Homo sapiens
ccacaaaggccauauaugu

SEQ ID NO: 21576 - RNA, 19 nt, Homo sapiens
uuuaagaacugcaauggua

SEQ ID NO: 21577 - RNA, 19 nt, Homo sapiens
uauguaaggucagucauua

SEQ ID NO: 21578 - RNA, 19 nt, Homo sapiens
gacauaagguagaaaugaa

SEQ ID NO: 21579 - RNA, 19 nt, Homo sapiens
ggaaguauaugaucugacu

SEQ ID NO: 21580 - RNA, 19 nt, Homo sapiens
ggacauaagguagaaauga

SEQ ID NO: 21581 - RNA, 19 nt, Homo sapiens
gaaaucaaaugaaguucuc

SEQ ID NO: 21582 - RNA, 19 nt, Homo sapiens
gcauugaugucgaaggaaa

SEQ ID NO: 21583 - RNA, 19 nt, Homo sapiens
uaagguaccuggaaugcaa

SEQ ID NO: 21584 - RNA, 19 nt, Homo sapiens
gcaccgagaccauuuguga

SEQ ID NO: 21585 - RNA, 19 nt, Homo sapiens
gaaggagguuggcgcuuug

SEQ ID NO: 21586 - RNA, 19 nt, Homo sapiens
uggaugauaugcaugauaa

SEQ ID NO: 21587 - RNA, 19 nt, Homo sapiens
uaccacugcucgaaauuua

SEQ ID NO: 21588 - RNA, 19 nt, Homo sapiens
acacagaaauacugcauug

SEQ ID NO: 21589 - RNA, 19 nt, Homo sapiens
ggauuucugugaagcauga

SEQ ID NO: 21590 - RNA, 19 nt, Homo sapiens
ccauauaugucucuuggaa

SEQ ID NO: 21591 - RNA, 19 nt, Homo sapiens
gaaaaguucucucuucaga

SEQ ID NO: 21592 - RNA, 19 nt, Homo sapiens
gagaacugcugucauucaa

SEQ ID NO: 21593 - RNA, 19 nt, Homo sapiens
ggaaagaucgagaaaucaa

SEQ ID NO: 21594 - RNA, 19 nt, Homo sapiens
acacagaccuucucuuugg

SEQ ID NO: 21595 - RNA, 19 nt, Homo sapiens
uagcaggacuuguggugua

SEQ ID NO: 21596 - RNA, 19 nt, Homo sapiens
caaaguagaagaaggaaug

SEQ ID NO: 21597 - RNA, 19 nt, Homo sapiens
uuaaucaaguggcuuauga

SEQ ID NO: 21598 - RNA, 19 nt, Homo sapiens
gagacucaaugaacuaugu

SEQ ID NO: 21599 - RNA, 19 nt, Homo sapiens
aaaucaaacugggcuauaa

SEQ ID NO: 21600 - RNA, 19 nt, Homo sapiens
gaacuuaaggauucugaga

SEQ ID NO: 21601 - RNA, 19 nt, Homo sapiens
gauaauuuccuuagcagaa

SEQ ID NO: 21602 - RNA, 19 nt, Homo sapiens
caugaaguauguuaagcua

SEQ ID NO: 21603 - RNA, 19 nt, Homo sapiens
ugaaggagguuggcgcuuu

SEQ ID NO: 21604 - RNA, 19 nt, Homo sapiens
aaggaaagaucgagaaauc

SEQ ID NO: 21605 - RNA, 19 nt, Homo sapiens
gcauuaaggaaguauauga

SEQ ID NO: 21606 - RNA, 19 nt, Homo sapiens
acacacagaccuucucuuu

SEQ ID NO: 21607 - RNA, 19 nt, Homo sapiens
guaauucgcuuugcucucu

SEQ ID NO: 21608 - RNA, 19 nt, Homo sapiens
gcccuaaucaugcacuuua

SEQ ID NO: 21609 - RNA, 19 nt, Homo sapiens
gcagagacucaaugaacua

SEQ ID NO: 21610 - RNA, 19 nt, Homo sapiens
guuauggacuggaaagaug

SEQ ID NO: 21611 - RNA, 19 nt, Homo sapiens
uuaccgaagugauguauau

SEQ ID NO: 21612 - RNA, 19 nt, Homo sapiens
gaaagaucgagaaaucaaa

SEQ ID NO: 21613 - RNA, 19 nt, Homo sapiens
gaaugggcauggcucguau

SEQ ID NO: 21614 - RNA, 19 nt, Homo sapiens
gaacggacagaagccuuua

SEQ ID NO: 21615 - RNA, 19 nt, Homo sapiens
ucaaguggcuuaugauugc

SEQ ID NO: 21616 - RNA, 19 nt, Homo sapiens
acacaacaguggaagagaa

SEQ ID NO: 21617 - RNA, 19 nt, Homo sapiens
cgagaaaucaaaugaaguu

SEQ ID NO: 21618 - RNA, 19 nt, Homo sapiens
agaaauacacagcuuguuu

SEQ ID NO: 21619 - RNA, 19 nt, Homo sapiens
gaauuuccuuacugucuau

SEQ ID NO: 21620 - RNA, 19 nt, Homo sapiens
uuacagaggacauaaggua

SEQ ID NO: 21621 - RNA, 19 nt, Homo sapiens
ucaaacagcuacuagaacu

SEQ ID NO: 21622 - RNA, 19 nt, Homo sapiens
gauaccaagugcauaagau

SEQ ID NO: 21623 - RNA, 19 nt, Homo sapiens
gcuauccguuugacauuga

SEQ ID NO: 21624 - RNA, 19 nt, Homo sapiens
ccacacacauuuauuacag

SEQ ID NO: 21625 - RNA, 19 nt, Homo sapiens
cggaggauauuaugauguu

SEQ ID NO: 21626 - RNA, 19 nt, Homo sapiens
ggcaaacccugaccaaucu

SEQ ID NO: 21627 - RNA, 19 nt, Homo sapiens
ugacacauaugcuaaaugc

SEQ ID NO: 21628 - RNA, 19 nt, Homo sapiens
gaaaaugacacauaugcua

SEQ ID NO: 21629 - RNA, 19 nt, Homo sapiens
caacuaaaccuguacaaaa

SEQ ID NO: 21630 - RNA, 19 nt, Homo sapiens
cagcauugaugucgaagga

SEQ ID NO: 21631 - RNA, 19 nt, Homo sapiens
gcuuugcucucuccucauu

SEQ ID NO: 21632 - RNA, 19 nt, Homo sapiens
gaaguucuccugacucucu

SEQ ID NO: 21633 - RNA, 19 nt, Homo sapiens
ugucucaaccugauaauuu

SEQ ID NO: 21634 - RNA, 19 nt, Homo sapiens
gaaaaggaguauccaaaca

SEQ ID NO: 21635 - RNA, 19 nt, Homo sapiens
ugaaguauguuaagcuaag

SEQ ID NO: 21636 - RNA, 19 nt, Homo sapiens
guggaucacggaauuauuu

SEQ ID NO: 21637 - RNA, 19 nt, Homo sapiens
gcagaggaagcacauagaa

SEQ ID NO: 21638 - RNA, 19 nt, Homo sapiens
gcucuaaucucaagaaccu

SEQ ID NO: 21639 - RNA, 19 nt, Homo sapiens
ugucugaaguucuuaacaa

SEQ ID NO: 21640 - RNA, 19 nt, Homo sapiens
acaaaugcauuauguaagg

SEQ ID NO: 21641 - RNA, 19 nt, Homo sapiens
uaaaccaccuccucaacau

SEQ ID NO: 21642 - RNA, 19 nt, Homo sapiens
aaagaggcauuuauaagag

SEQ ID NO: 21643 - RNA, 19 nt, Homo sapiens
gcaguggacuaauuauggu

SEQ ID NO: 21644 - RNA, 19 nt, Homo sapiens
guucagaaauacacagcuu

SEQ ID NO: 21645 - RNA, 19 nt, Homo sapiens
caagucauuuacccugauu

SEQ ID NO: 21646 - RNA, 19 nt, Homo sapiens
ugaaagccauagcaagaau

SEQ ID NO: 21647 - RNA, 19 nt, Homo sapiens
gcucgaguguacaauaugu

SEQ ID NO: 21648 - RNA, 19 nt, Homo sapiens
ggaggucccuggccaaaga

SEQ ID NO: 21649 - RNA, 19 nt, Homo sapiens
ccaauguucuggcccguua

SEQ ID NO: 21650 - RNA, 19 nt, Homo sapiens
gcaccaugcccuaccaaua

SEQ ID NO: 21651 - RNA, 19 nt, Homo sapiens
ucucuaaccacgccuauua

SEQ ID NO: 21652 - RNA, 19 nt, Homo sapiens
ggaagaaggagaaccugaa

SEQ ID NO: 21653 - RNA, 19 nt, Homo sapiens
ggccaaagauuuauuucuc

SEQ ID NO: 21654 - RNA, 19 nt, Homo sapiens
gccaguaugugaccgagaa

SEQ ID NO: 21655 - RNA, 19 nt, Homo sapiens
gcacacugccaaauaaaca

SEQ ID NO: 21656 - RNA, 19 nt, Homo sapiens
ggacaaauggcgagacuac

SEQ ID NO: 21657 - RNA, 19 nt, Homo sapiens
caccaugcccuaccaauau

SEQ ID NO: 21658 - RNA, 19 nt, Homo sapiens
caccggaacuugcuacuac

SEQ ID NO: 21659 - RNA, 19 nt, Homo sapiens
ugucgucugugaaugcuaa

SEQ ID NO: 21660 - RNA, 19 nt, Homo sapiens
agaagaaggagcugucuga

SEQ ID NO: 21661 - RNA, 19 nt, Homo sapiens
gaagaaggagaaccugaag

SEQ ID NO: 21662 - RNA, 19 nt, Homo sapiens
ccaagcggcugcaguccau

SEQ ID NO: 21663 - RNA, 19 nt, Homo sapiens
gcuaaguccaucacccuuu

SEQ ID NO: 21664 - RNA, 19 nt, Homo sapiens
gccaaagauuuauuucucu

SEQ ID NO: 21665 - RNA, 19 nt, Homo sapiens
cuaaguccaucacccuuuc

SEQ ID NO: 21666 - RNA, 19 nt, Homo sapiens
uugaagcgcugccaguaug

SEQ ID NO: 21667 - RNA, 19 nt, Homo sapiens
ggccaugcuugcacucaga

SEQ ID NO: 21668 - RNA, 19 nt, Homo sapiens
ugagugaccaccacaucua

SEQ ID NO: 21669 - RNA, 19 nt, Homo sapiens
ggugcuggcugcugucuac

SEQ ID NO: 21670 - RNA, 19 nt, Homo sapiens
gucccuggccaaagauuua

SEQ ID NO: 21671 - RNA, 19 nt, Homo sapiens
gcaccggaacuugcuacua

SEQ ID NO: 21672 - RNA, 19 nt, Homo sapiens
ccugagauccucccugaug

SEQ ID NO: 21673 - RNA, 19 nt, Homo sapiens
gguguguggugucgucugu

SEQ ID NO: 21674 - RNA, 19 nt, Homo sapiens
gcaggaggaguaugucaag

SEQ ID NO: 21675 - RNA, 19 nt, Homo sapiens
guugugugcugaagauugg

SEQ ID NO: 21676 - RNA, 19 nt, Homo sapiens
gcugugcccaguacaagaa

SEQ ID NO: 21677 - RNA, 19 nt, Homo sapiens
ggaggaggcguccaucaac

SEQ ID NO: 21678 - RNA, 19 nt, Homo sapiens
ccucagcccucgccaucau

SEQ ID NO: 21679 - RNA, 19 nt, Homo sapiens
ucuacaaggcucugaguga

SEQ ID NO: 21680 - RNA, 19 nt, Homo sapiens
augagacacucuaccagaa

SEQ ID NO: 21681 - RNA, 19 nt, Homo sapiens
uguguggugucgucuguga

SEQ ID NO: 21682 - RNA, 19 nt, Homo sapiens
ggcguugugugcugaagau

SEQ ID NO: 21683 - RNA, 19 nt, Homo sapiens
gcuggcugcugucuacaag

SEQ ID NO: 21684 - RNA, 19 nt, Homo sapiens
uuauuucucuugacaacca

SEQ ID NO: 21685 - RNA, 19 nt, Homo sapiens
ugaguccacugggagcauu

SEQ ID NO: 21686 - RNA, 19 nt, Homo sapiens
gaggaggaggcguccauca

SEQ ID NO: 21687 - RNA, 19 nt, Homo sapiens
cccaaguuaucaaauccaa

SEQ ID NO: 21688 - RNA, 19 nt, Homo sapiens
ccgagaacaccgaggagaa

SEQ ID NO: 21689 - RNA, 19 nt, Homo sapiens
cauggaaaaugccaauguu

SEQ ID NO: 21690 - RNA, 19 nt, Homo sapiens
ccuauuaagcggagguguu

SEQ ID NO: 21691 - RNA, 19 nt, Homo sapiens
ucacugggaucaccuuccu

SEQ ID NO: 21692 - RNA, 19 nt, Homo sapiens
ggucccuggccaaagauuu

SEQ ID NO: 21693 - RNA, 19 nt, Homo sapiens
uuucuucccucgugacagu

SEQ ID NO: 21694 - RNA, 19 nt, Homo sapiens
gggcaucaagguagacaag

SEQ ID NO: 21695 - RNA, 19 nt, Homo sapiens
gguuggaugggcugucuga

SEQ ID NO: 21696 - RNA, 19 nt, Homo sapiens
ggagauagcugcaaccaaa

SEQ ID NO: 21697 - RNA, 19 nt, Homo sapiens
ccaaggaccugaucaaauu

SEQ ID NO: 21698 - RNA, 19 nt, Homo sapiens
ccaaagcccuggaaacuaa

SEQ ID NO: 21699 - RNA, 19 nt, Homo sapiens
ggacaugccugcaccaaga

SEQ ID NO: 21700 - RNA, 19 nt, Homo sapiens
gaacaacugcugauugaaa

SEQ ID NO: 21701 - RNA, 19 nt, Homo sapiens
gaaguauacuccagaacaa

SEQ ID NO: 21702 - RNA, 19 nt, Homo sapiens
guagagaagugcaucuuau

SEQ ID NO: 21703 - RNA, 19 nt, Homo sapiens
agaaggagcucucagaaau

SEQ ID NO: 21704 - RNA, 19 nt, Homo sapiens
gauuugaacucgcuggaaa

SEQ ID NO: 21705 - RNA, 19 nt, Homo sapiens
gauccuggcugcagaugaa

SEQ ID NO: 21706 - RNA, 19 nt, Homo sapiens
gaaauugcccagagcauug

SEQ ID NO: 21707 - RNA, 19 nt, Homo sapiens
aagaacaacugcugauuga

SEQ ID NO: 21708 - RNA, 19 nt, Homo sapiens
agggaaagcuguucagaaa

SEQ ID NO: 21709 - RNA, 19 nt, Homo sapiens
caagaaagaugguguugac

SEQ ID NO: 21710 - RNA, 19 nt, Homo sapiens
gaagaaggagcucucagaa

SEQ ID NO: 21711 - RNA, 19 nt, Homo sapiens
caagaaguauacuccagaa

SEQ ID NO: 21712 - RNA, 19 nt, Homo sapiens
agaagugcaucuuaugaaa

SEQ ID NO: 21713 - RNA, 19 nt, Homo sapiens
ggacugguaccuauuguug

SEQ ID NO: 21714 - RNA, 19 nt, Homo sapiens
gaaggagcucucagaaauu

SEQ ID NO: 21715 - RNA, 19 nt, Homo sapiens
gagaagugcaucuuaugaa

SEQ ID NO: 21716 - RNA, 19 nt, Homo sapiens
ucaaugcuaucaaccuuug

SEQ ID NO: 21717 - RNA, 19 nt, Homo sapiens
caaagaaaccaccauucaa

SEQ ID NO: 21718 - RNA, 19 nt, Homo sapiens
cgacacaauuagauuugaa

SEQ ID NO: 21719 - RNA, 19 nt, Homo sapiens
agaauggacugguaccuau

SEQ ID NO: 21720 - RNA, 19 nt, Homo sapiens
cagaauacccacccaagaa

SEQ ID NO: 21721 - RNA, 19 nt, Homo sapiens
ugaacucgcuggaaauaca

SEQ ID NO: 21722 - RNA, 19 nt, Homo sapiens
cagccuagcuccagugcuu

SEQ ID NO: 21723 - RNA, 19 nt, Homo sapiens
caccauggcccaccgauuu

SEQ ID NO: 21724 - RNA, 19 nt, Homo sapiens
aaacaaagaaaccaccauu

SEQ ID NO: 21725 - RNA, 19 nt, Homo sapiens
acucuucucucccaaacua

SEQ ID NO: 21726 - RNA, 19 nt, Homo sapiens
gcaggaacaaacaaagaaa

SEQ ID NO: 21727 - RNA, 19 nt, Homo sapiens
uggcaaggcugcaaacaag

SEQ ID NO: 21728 - RNA, 19 nt, Homo sapiens
acaaagaaaccaccauuca

SEQ ID NO: 21729 - RNA, 19 nt, Homo sapiens
ggaaaacacugaagagaac

SEQ ID NO: 21730 - RNA, 19 nt, Homo sapiens
aaggagcucucagaaauug

SEQ ID NO: 21731 - RNA, 19 nt, Homo sapiens
ugauugaaacaccucauua

SEQ ID NO: 21732 - RNA, 19 nt, Homo sapiens
aaagaacaacugcugauug

SEQ ID NO: 21733 - RNA, 19 nt, Homo sapiens
caaagaacaacugcugauu

SEQ ID NO: 21734 - RNA, 19 nt, Homo sapiens
gguccuggcugcugucuac

SEQ ID NO: 21735 - RNA, 19 nt, Homo sapiens
gcaguuuccuugcaacacu

SEQ ID NO: 21736 - RNA, 19 nt, Homo sapiens
ggaaccgccugcagaggau

SEQ ID NO: 21737 - RNA, 19 nt, Homo sapiens
ccaaaggacaguauguuca

SEQ ID NO: 21738 - RNA, 19 nt, Homo sapiens
ucagcagaauggacuggua

SEQ ID NO: 21739 - RNA, 19 nt, Homo sapiens
cagccucgcuauccaggaa

SEQ ID NO: 21740 - RNA, 19 nt, Homo sapiens
gaggauugccgaccagugu

SEQ ID NO: 21741 - RNA, 19 nt, Homo sapiens
gcaaggcugcaaacaagga

SEQ ID NO: 21742 - RNA, 19 nt, Homo sapiens
ccucaaugcuaucaaccuu

SEQ ID NO: 21743 - RNA, 19 nt, Homo sapiens
caaccucaaugcuaucaac

SEQ ID NO: 21744 - RNA, 19 nt, Homo sapiens
aaagaaaccaccauucaag

SEQ ID NO: 21745 - RNA, 19 nt, Homo sapiens
ggacucuucucucccaaac

SEQ ID NO: 21746 - RNA, 19 nt, Homo sapiens
guacaagaaagaugguguu

SEQ ID NO: 21747 - RNA, 19 nt, Homo sapiens
gauugaaacaccucauuag

SEQ ID NO: 21748 - RNA, 19 nt, Homo sapiens
uaucaaccuuugcccucua

SEQ ID NO: 21749 - RNA, 19 nt, Homo sapiens
caugaugagaagucuauaa

SEQ ID NO: 21750 - RNA, 19 nt, Homo sapiens
gaauggacugguaccuauu

SEQ ID NO: 21751 - RNA, 19 nt, Homo sapiens
agaauacccacccaagaaa

SEQ ID NO: 21752 - RNA, 19 nt, Homo sapiens
acacagcaguuuccuugca

SEQ ID NO: 21753 - RNA, 19 nt, Homo sapiens
gaacucgcuggaaauacaa

SEQ ID NO: 21754 - RNA, 19 nt, Homo sapiens
agaagaaggagcucucaga

SEQ ID NO: 21755 - RNA, 19 nt, Homo sapiens
caaggaccugaucaaauuu

SEQ ID NO: 21756 - RNA, 19 nt, Homo sapiens
ucuacaaggcccugaauga

SEQ ID NO: 21757 - RNA, 19 nt, Homo sapiens
gcugugcucaguacaagaa

SEQ ID NO: 21758 - RNA, 19 nt, Homo sapiens
agagaagugcaucuuauga

SEQ ID NO: 21759 - RNA, 19 nt, Homo sapiens
uguagagaagugcaucuua

SEQ ID NO: 21760 - RNA, 19 nt, Homo sapiens
ccagaauacccacccaaga

SEQ ID NO: 21761 - RNA, 19 nt, Homo sapiens
ccacagcuuuugauaucua

SEQ ID NO: 21762 - RNA, 19 nt, Homo sapiens
acugguaccuauuguugaa

SEQ ID NO: 21763 - RNA, 19 nt, Homo sapiens
cagaauggacugguaccua

SEQ ID NO: 21764 - RNA, 19 nt, Homo sapiens
acgagacccucuaccagaa

SEQ ID NO: 21765 - RNA, 19 nt, Homo sapiens
aagugcaucuuaugaaaca

SEQ ID NO: 21766 - RNA, 19 nt, Homo sapiens
ccaaagaacaacugcugau

SEQ ID NO: 21767 - RNA, 19 nt, Homo sapiens
agagguaauuccugaugga

SEQ ID NO: 21768 - RNA, 19 nt, Homo sapiens
agaaagaugguguugacuu

SEQ ID NO: 21769 - RNA, 19 nt, Homo sapiens
gaagugcaucuuaugaaac

SEQ ID NO: 21770 - RNA, 19 nt, Homo sapiens
uaucggcuccucauccaaa

SEQ ID NO: 21771 - RNA, 19 nt, Homo sapiens
gaccugaucaaauuucaca

SEQ ID NO: 21772 - RNA, 19 nt, Homo sapiens
agaaguauacuccagaaca

SEQ ID NO: 21773 - RNA, 19 nt, Homo sapiens
aagaaggagcucucagaaa

SEQ ID NO: 21774 - RNA, 19 nt, Homo sapiens
aaaauugugugcuaccaaa

SEQ ID NO: 21775 - RNA, 19 nt, Homo sapiens
gccaaaggacaguauguuc

SEQ ID NO: 21776 - RNA, 19 nt, Homo sapiens
gcgcugugcucaguacaag

SEQ ID NO: 21777 - RNA, 19 nt, Homo sapiens
gggaaucaaguuagaccaa

SEQ ID NO: 21778 - RNA, 19 nt, Homo sapiens
cacagcaguuuccuugcaa

SEQ ID NO: 21779 - RNA, 19 nt, Homo sapiens
ccuggaaauucgacacaau

SEQ ID NO: 21780 - RNA, 19 nt, Homo sapiens
gcucuucacagccugcuau

SEQ ID NO: 21781 - RNA, 19 nt, Homo sapiens
guagcuauggccaccguaa

SEQ ID NO: 21782 - RNA, 19 nt, Homo sapiens
cagggaaagcuguucagaa

SEQ ID NO: 21783 - RNA, 19 nt, Homo sapiens
caaauuucacacagcaguu

SEQ ID NO: 21784 - RNA, 19 nt, Homo sapiens
agaaauugcccagagcauu

SEQ ID NO: 21785 - RNA, 19 nt, Homo sapiens
uggcaugagugaagaggau

SEQ ID NO: 21786 - RNA, 19 nt, Homo sapiens
gcucuccaccguacuguuc

SEQ ID NO: 21787 - RNA, 19 nt, Homo sapiens
cauggugacugcuggacau

SEQ ID NO: 21788 - RNA, 19 nt, Homo sapiens
uggagaccaugaccuggaa

SEQ ID NO: 21789 - RNA, 19 nt, Homo sapiens
ccaggaggcuuuuaugaag

SEQ ID NO: 21790 - RNA, 19 nt, Homo sapiens
ccagagguaauuccugaug

SEQ ID NO: 21791 - RNA, 19 nt, Homo sapiens
uagagaagugcaucuuaug

SEQ ID NO: 21792 - RNA, 19 nt, Homo sapiens
ggccaaaggacaguauguu

SEQ ID NO: 21793 - RNA, 19 nt, Homo sapiens
aagaugguguugacuuugg

SEQ ID NO: 21794 - RNA, 19 nt, Homo sapiens
gcagaagaaggagcucuca

SEQ ID NO: 21795 - RNA, 19 nt, Homo sapiens
gaauaccaaggaccugauc

SEQ ID NO: 21796 - RNA, 19 nt, Homo sapiens
gcaaauaaaugguagcaaa

SEQ ID NO: 21797 - RNA, 19 nt, Homo sapiens
gaaggauggugcugacuuu

SEQ ID NO: 21798 - RNA, 19 nt, Homo sapiens
guacauaccauacagcaaa

SEQ ID NO: 21799 - RNA, 19 nt, Homo sapiens
gaaagaugauaaugguguu

SEQ ID NO: 21800 - RNA, 19 nt, Homo sapiens
gcaagccucugcacucaau

SEQ ID NO: 21801 - RNA, 19 nt, Homo sapiens
gcgcuuaccuucuccuaug

SEQ ID NO: 21802 - RNA, 19 nt, Homo sapiens
ccagaaagaugauaauggu

SEQ ID NO: 21803 - RNA, 19 nt, Homo sapiens
uguggaaccugaaauauug

SEQ ID NO: 21804 - RNA, 19 nt, Homo sapiens
ccucaaacguugucaguau

SEQ ID NO: 21805 - RNA, 19 nt, Homo sapiens
cagaagaaauugcuagaag

SEQ ID NO: 21806 - RNA, 19 nt, Homo sapiens
caacuugucuuccuuucuc

SEQ ID NO: 21807 - RNA, 19 nt, Homo sapiens
ggucuuggcugcuguguac

SEQ ID NO: 21808 - RNA, 19 nt, Homo sapiens
guacagaagcccugacuca

SEQ ID NO: 21809 - RNA, 19 nt, Homo sapiens
gcaccaacuugucuuccuu

SEQ ID NO: 21810 - RNA, 19 nt, Homo sapiens
gcacagucacucuacauug

SEQ ID NO: 21811 - RNA, 19 nt, Homo sapiens
gaagaagaggcaucauuca

SEQ ID NO: 21812 - RNA, 19 nt, Homo sapiens
gaagaaauugcuagaaguc

SEQ ID NO: 21813 - RNA, 19 nt, Homo sapiens
ggccaugccugucccauca

SEQ ID NO: 21814 - RNA, 19 nt, Homo sapiens
ccugaaauauugccugaug

SEQ ID NO: 21815 - RNA, 19 nt, Homo sapiens
ggagaaaccaccacucaag

SEQ ID NO: 21816 - RNA, 19 nt, Homo sapiens
ugagugaccaucauguaua

SEQ ID NO: 21817 - RNA, 19 nt, Homo sapiens
gaaauugcuagaagucaga

SEQ ID NO: 21818 - RNA, 19 nt, Homo sapiens
gcgaagaagaggcaucauu

SEQ ID NO: 21819 - RNA, 19 nt, Homo sapiens
gucaguauguuacagagaa

SEQ ID NO: 21820 - RNA, 19 nt, Homo sapiens
gaucagaggguaguacaga

SEQ ID NO: 21821 - RNA, 19 nt, Homo sapiens
cgaagaagaggcaucauuc

SEQ ID NO: 21822 - RNA, 19 nt, Homo sapiens
agaagaaggaguugucuga

SEQ ID NO: 21823 - RNA, 19 nt, Homo sapiens
ugaaggcaguggagaagau

SEQ ID NO: 21824 - RNA, 19 nt, Homo sapiens
gacauugcccugcggauug

SEQ ID NO: 21825 - RNA, 19 nt, Homo sapiens
agaagaaauugcuagaagu

SEQ ID NO: 21826 - RNA, 19 nt, Homo sapiens
aaacguugucaguauguua

SEQ ID NO: 21827 - RNA, 19 nt, Homo sapiens
gcagaagaaauugcuagaa

SEQ ID NO: 21828 - RNA, 19 nt, Homo sapiens
caagcgggcugaggugaau

SEQ ID NO: 21829 - RNA, 19 nt, Homo sapiens
gagugaccaucauguauac

SEQ ID NO: 21830 - RNA, 19 nt, Homo sapiens
ucagaacgcugugcccaau

SEQ ID NO: 21831 - RNA, 19 nt, Homo sapiens
ccacugaggaguucaucaa

SEQ ID NO: 21832 - RNA, 19 nt, Homo sapiens
gaccacgaccucaaacguu

SEQ ID NO: 21833 - RNA, 19 nt, Homo sapiens
caaccucaaugccaucaac

SEQ ID NO: 21834 - RNA, 19 nt, Homo sapiens
cauaccauacagcaaauaa

SEQ ID NO: 21835 - RNA, 19 nt, Homo sapiens
ucaccaugccucacucgua

SEQ ID NO: 21836 - RNA, 19 nt, Homo sapiens
gcagcacagucacucuaca

SEQ ID NO: 21837 - RNA, 19 nt, Homo sapiens
ugacugagggcagaagaaa

SEQ ID NO: 21838 - RNA, 19 nt, Homo sapiens
ugccaaccaugccuacuga

SEQ ID NO: 21839 - RNA, 19 nt, Homo sapiens
gagcgaagaagaggcauca

SEQ ID NO: 21840 - RNA, 19 nt, Homo sapiens
guaugaaggcaguggagaa

SEQ ID NO: 21841 - RNA, 19 nt, Homo sapiens
caaacguugucaguauguu

SEQ ID NO: 21842 - RNA, 19 nt, Homo sapiens
cauugugccuauuguggaa

SEQ ID NO: 21843 - RNA, 19 nt, Homo sapiens
ccucugcacuugccauucu

SEQ ID NO: 21844 - RNA, 19 nt, Homo sapiens
acagaagcccugacucaug

SEQ ID NO: 21845 - RNA, 19 nt, Homo sapiens
acugagggcagaagaaauu

SEQ ID NO: 21846 - RNA, 19 nt, Homo sapiens
cagcagcacagucacucua

SEQ ID NO: 21847 - RNA, 19 nt, Homo sapiens
ugaaauauugccugaugga

SEQ ID NO: 21848 - RNA, 19 nt, Homo sapiens
gaaaaucagugagcguaca

SEQ ID NO: 21849 - RNA, 19 nt, Homo sapiens
cacagucacucuacauugc

SEQ ID NO: 21850 - RNA, 19 nt, Homo sapiens
aagaagaggcaucauucaa

SEQ ID NO: 21851 - RNA, 19 nt, Homo sapiens
ucuuccagcucccacaauu

SEQ ID NO: 21852 - RNA, 19 nt, Homo sapiens
gagacccucuaccagaaag

SEQ ID NO: 21853 - RNA, 19 nt, Homo sapiens
ugacauugcccugcggauu

SEQ ID NO: 21854 - RNA, 19 nt, Homo sapiens
ucccugggcucuccuucuu

SEQ ID NO: 21855 - RNA, 19 nt, Homo sapiens
gaaggcaguggagaagaug

SEQ ID NO: 21856 - RNA, 19 nt, Homo sapiens
gcaccugggaccauaggau

SEQ ID NO: 21857 - RNA, 19 nt, Homo sapiens
augagacccucuaccagaa

SEQ ID NO: 21858 - RNA, 19 nt, Homo sapiens
ccugagugaccaucaugua

SEQ ID NO: 21859 - RNA, 19 nt, Homo sapiens
uguacaaggcccugaguga

SEQ ID NO: 21860 - RNA, 19 nt, Homo sapiens
cguacacccucugcacuug

SEQ ID NO: 21861 - RNA, 19 nt, Homo sapiens
agaacgcugugcccaauac

SEQ ID NO: 21862 - RNA, 19 nt, Homo sapiens
ugucuuccuuucucucuuc

SEQ ID NO: 21863 - RNA, 19 nt, Homo sapiens
gggcugccacugaggaguu

SEQ ID NO: 21864 - RNA, 19 nt, Homo sapiens
gcugugcccaauacaagaa

SEQ ID NO: 21865 - RNA, 19 nt, Homo sapiens
uacauaccauacagcaaau

SEQ ID NO: 21866 - RNA, 19 nt, Homo sapiens
gggagccccucaugacuga

SEQ ID NO: 21867 - RNA, 19 nt, Homo sapiens
gcauucuggcugcggauga

SEQ ID NO: 21868 - RNA, 19 nt, Homo sapiens
gugcauuggaggcgucauu

SEQ ID NO: 21869 - RNA, 19 nt, Homo sapiens
gcuaugcagagcagagaug

SEQ ID NO: 21870 - RNA, 19 nt, Homo sapiens
gaccucaaacguugucagu

SEQ ID NO: 21871 - RNA, 19 nt, Homo sapiens
gcguacacccucugcacuu

SEQ ID NO: 21872 - RNA, 19 nt, Homo sapiens
cagaacgcugugcccaaua

SEQ ID NO: 21873 - RNA, 19 nt, Homo sapiens
gccuugaguacauaccaua

SEQ ID NO: 21874 - RNA, 19 nt, Homo sapiens
cuagaagucagaacaggau

SEQ ID NO: 21875 - RNA, 19 nt, Homo sapiens
ggcagaagaaauugcuaga

SEQ ID NO: 21876 - RNA, 19 nt, Homo sapiens
agaagaggcaucauucaac

SEQ ID NO: 21877 - RNA, 19 nt, Homo sapiens
cucaaacguugucaguaug

SEQ ID NO: 21878 - RNA, 19 nt, Homo sapiens
cuucuugccugcccugucu

SEQ ID NO: 21879 - RNA, 19 nt, Homo sapiens
ccugggcgcuuaccuucuc

SEQ ID NO: 21880 - RNA, 19 nt, Homo sapiens
ucaaacguugucaguaugu

SEQ ID NO: 21881 - RNA, 19 nt, Homo sapiens
gaacugagcagccaggaua

SEQ ID NO: 21882 - RNA, 19 nt, Homo sapiens
aaaccuggcuugaaguaua

SEQ ID NO: 21883 - RNA, 19 nt, Homo sapiens
uggaagagcugguggauga

SEQ ID NO: 21884 - RNA, 19 nt, Homo sapiens
gaaaggagccugccagaag

SEQ ID NO: 21885 - RNA, 19 nt, Homo sapiens
aaacaaaccuggcuugaag

SEQ ID NO: 21886 - RNA, 19 nt, Homo sapiens
gcaaugugguucccaguga

SEQ ID NO: 21887 - RNA, 19 nt, Homo sapiens
caagagcccugucaguaga

SEQ ID NO: 21888 - RNA, 19 nt, Homo sapiens
gaaaguacaaccugaauac

SEQ ID NO: 21889 - RNA, 19 nt, Homo sapiens
ggaaaguacaaccugaaua

SEQ ID NO: 21890 - RNA, 19 nt, Homo sapiens
guaccucccacaaggauua

SEQ ID NO: 21891 - RNA, 19 nt, Homo sapiens
gauaugaccaccuuacuca

SEQ ID NO: 21892 - RNA, 19 nt, Homo sapiens
gagggucugugccuuguug

SEQ ID NO: 21893 - RNA, 19 nt, Homo sapiens
aaaggagccugccagaaga

SEQ ID NO: 21894 - RNA, 19 nt, Homo sapiens
gcuuggaacuggaauccuu

SEQ ID NO: 21895 - RNA, 19 nt, Homo sapiens
uaaggucuuugacuuugaa

SEQ ID NO: 21896 - RNA, 19 nt, Homo sapiens
aguauaagccugcaguuaa

SEQ ID NO: 21897 - RNA, 19 nt, Homo sapiens
gggcgugucuagcuugaug

SEQ ID NO: 21898 - RNA, 19 nt, Homo sapiens
gcaguuaaccagauugagu

SEQ ID NO: 21899 - RNA, 19 nt, Homo sapiens
guauaagccugcaguuaac

SEQ ID NO: 21900 - RNA, 19 nt, Homo sapiens
cagaacgcauugcugagaa

SEQ ID NO: 21901 - RNA, 19 nt, Homo sapiens
gaagggcuggugaaagcua

SEQ ID NO: 21902 - RNA, 19 nt, Homo sapiens
gugaggagcucuucaucgu

SEQ ID NO: 21903 - RNA, 19 nt, Homo sapiens
gcauugcugagaacuuuaa

SEQ ID NO: 21904 - RNA, 19 nt, Homo sapiens
gccaggauaugaccaccuu

SEQ ID NO: 21905 - RNA, 19 nt, Homo sapiens
acgcauugcugagaacuuu

SEQ ID NO: 21906 - RNA, 19 nt, Homo sapiens
aggagaaguuaauccagua

SEQ ID NO: 21907 - RNA, 19 nt, Homo sapiens
uaaacaaaccuggcuugaa

SEQ ID NO: 21908 - RNA, 19 nt, Homo sapiens
gccacuaacgguugaguuu

SEQ ID NO: 21909 - RNA, 19 nt, Homo sapiens
ccgugaagguggccauuga

SEQ ID NO: 21910 - RNA, 19 nt, Homo sapiens
aaccuggcuugaaguauaa

SEQ ID NO: 21911 - RNA, 19 nt, Homo sapiens
gagaagggccuggugaaag

SEQ ID NO: 21912 - RNA, 19 nt, Homo sapiens
uaccuggaccucuaccuua

SEQ ID NO: 21913 - RNA, 19 nt, Homo sapiens
gagggcgugucuagcuuga

SEQ ID NO: 21914 - RNA, 19 nt, Homo sapiens
ugagaacuuuaaggucuuu

SEQ ID NO: 21915 - RNA, 19 nt, Homo sapiens
gcccauguguaccagaaug

SEQ ID NO: 21916 - RNA, 19 nt, Homo sapiens
agaagggccuggugaaagg

SEQ ID NO: 21917 - RNA, 19 nt, Homo sapiens
gcgagggcgugucuagcuu

SEQ ID NO: 21918 - RNA, 19 nt, Homo sapiens
gcuuugcccuucuuucuac

SEQ ID NO: 21919 - RNA, 19 nt, Homo sapiens
uggacuaccuggaccucua

SEQ ID NO: 21920 - RNA, 19 nt, Homo sapiens
ucaagagcccugucaguag

SEQ ID NO: 21921 - RNA, 19 nt, Homo sapiens
gaaguauaagccugcaguu

SEQ ID NO: 21922 - RNA, 19 nt, Homo sapiens
ggaugaagggcuggugaaa

SEQ ID NO: 21923 - RNA, 19 nt, Homo sapiens
uggaauccuuucagcaaga

SEQ ID NO: 21924 - RNA, 19 nt, Homo sapiens
uuuaaggucuuugacuuug

SEQ ID NO: 21925 - RNA, 19 nt, Homo sapiens
acaaaccuggcuugaagua

SEQ ID NO: 21926 - RNA, 19 nt, Homo sapiens
uuaaggucuuugacuuuga

SEQ ID NO: 21927 - RNA, 19 nt, Homo sapiens
caucgacugugcccaugug

SEQ ID NO: 21928 - RNA, 19 nt, Homo sapiens
ugacugaggccgugaaggu

SEQ ID NO: 21929 - RNA, 19 nt, Homo sapiens
ccagaacgcauugcugaga

SEQ ID NO: 21930 - RNA, 19 nt, Homo sapiens
gggaaaguacaaccugaau

SEQ ID NO: 21931 - RNA, 19 nt, Homo sapiens
ccaccuuacucagcuacaa

SEQ ID NO: 21932 - RNA, 19 nt, Homo sapiens
ucgcagccaagcacaauaa

SEQ ID NO: 21933 - RNA, 19 nt, Homo sapiens
gaucgcagccaagcacaau

SEQ ID NO: 21934 - RNA, 19 nt, Homo sapiens
ucacucaggagaaguuaau

SEQ ID NO: 21935 - RNA, 19 nt, Homo sapiens
ucagggagcagguggugaa

SEQ ID NO: 21936 - RNA, 19 nt, Homo sapiens
agacuucucuuugccucaa

SEQ ID NO: 21937 - RNA, 19 nt, Homo sapiens
cucaagagcccugucagua

SEQ ID NO: 21938 - RNA, 19 nt, Homo sapiens
gugcccauguguaccagaa

SEQ ID NO: 21939 - RNA, 19 nt, Homo sapiens
agaaguuaauccaguacug

SEQ ID NO: 21940 - RNA, 19 nt, Homo sapiens
ggguggccauucaggagaa

SEQ ID NO: 21941 - RNA, 19 nt, Homo sapiens
aaguauaagccugcaguua

SEQ ID NO: 21942 - RNA, 19 nt, Homo sapiens
gaucucaagagcccuguca

SEQ ID NO: 21943 - RNA, 19 nt, Homo sapiens
ggauaugaccaccuuacuc

SEQ ID NO: 21944 - RNA, 19 nt, Homo sapiens
cgacugugcccauguguac

SEQ ID NO: 21945 - RNA, 19 nt, Homo sapiens
ugagaagggccuggugaaa

SEQ ID NO: 21946 - RNA, 19 nt, Homo sapiens
caagccgucuccugcucaa

SEQ ID NO: 21947 - RNA, 19 nt, Homo sapiens
acuuuaaggucuuugacuu

SEQ ID NO: 21948 - RNA, 19 nt, Homo sapiens
ggucuuugacuuugaacug

SEQ ID NO: 21949 - RNA, 19 nt, Homo sapiens
gauugagugccacccauau

SEQ ID NO: 21950 - RNA, 19 nt, Homo sapiens
ccagugacaccaacauucu

SEQ ID NO: 21951 - RNA, 19 nt, Homo sapiens
ccaaagagaagcaaaaucu

SEQ ID NO: 21952 - RNA, 19 nt, Homo sapiens
aauguaguauggccugugu

SEQ ID NO: 21953 - RNA, 19 nt, Homo sapiens
gagcuguaccucccacaag

SEQ ID NO: 21954 - RNA, 19 nt, Homo sapiens
gucuuugacuuugaacuga

SEQ ID NO: 21955 - RNA, 19 nt, Homo sapiens
ugaaagcuauuggcaucuc

SEQ ID NO: 21956 - RNA, 19 nt, Homo sapiens
gaagagcugguggaugaag

SEQ ID NO: 21957 - RNA, 19 nt, Homo sapiens
cuggaccucuaccuuauuc

SEQ ID NO: 21958 - RNA, 19 nt, Homo sapiens
ucacuggccgacuggcuuu

SEQ ID NO: 21959 - RNA, 19 nt, Homo sapiens
ugaccaccuuacucagcua

SEQ ID NO: 21960 - RNA, 19 nt, Homo sapiens
gaugaagggcuggugaaag

SEQ ID NO: 21961 - RNA, 19 nt, Homo sapiens
ggaugagucgggcaaugug

SEQ ID NO: 21962 - RNA, 19 nt, Homo sapiens
ugaaaggagccugccagaa

SEQ ID NO: 21963 - RNA, 19 nt, Homo sapiens
caaaaucuaccaggucaaa

SEQ ID NO: 21964 - RNA, 19 nt, Homo sapiens
gaacuuuaaggucuuugac

SEQ ID NO: 21965 - RNA, 19 nt, Homo sapiens
uguaccagaaugagaauga

SEQ ID NO: 21966 - RNA, 19 nt, Homo sapiens
guaccagaaugagaaugag

SEQ ID NO: 21967 - RNA, 19 nt, Homo sapiens
augaagggcuggugaaagc

SEQ ID NO: 21968 - RNA, 19 nt, Homo sapiens
ggaauccuuucagcaagac

SEQ ID NO: 21969 - RNA, 19 nt, Homo sapiens
uguguuucuugccucauuu

SEQ ID NO: 21970 - RNA, 19 nt, Homo sapiens
gaccuauaccuguguuucu

SEQ ID NO: 21971 - RNA, 19 nt, Homo sapiens
gagugccacccauaucuca

SEQ ID NO: 21972 - RNA, 19 nt, Homo sapiens
gccugcaguuaaccagauu

SEQ ID NO: 21973 - RNA, 19 nt, Homo sapiens
ccuugcaaauguaguaugg

SEQ ID NO: 21974 - RNA, 19 nt, Homo sapiens
cuuuaaggucuuugacuuu

SEQ ID NO: 21975 - RNA, 19 nt, Homo sapiens
cugagaacuuuaaggucuu

SEQ ID NO: 21976 - RNA, 19 nt, Homo sapiens
uuaaacaaaccuggcuuga

SEQ ID NO: 21977 - RNA, 19 nt, Homo sapiens
ggagguggcuggaaugaua

SEQ ID NO: 21978 - RNA, 19 nt, Homo sapiens
gaacggaaauaaaggaguu

SEQ ID NO: 21979 - RNA, 19 nt, Homo sapiens
gacaagauccugcagaaua

SEQ ID NO: 21980 - RNA, 19 nt, Homo sapiens
ggucauagcuccuuggaau

SEQ ID NO: 21981 - RNA, 19 nt, Homo sapiens
cagagagacuggagaauaa

SEQ ID NO: 21982 - RNA, 19 nt, Homo sapiens
ggaagagucuggcaguuga

SEQ ID NO: 21983 - RNA, 19 nt, Homo sapiens
caacaccgcuuugccgaua

SEQ ID NO: 21984 - RNA, 19 nt, Homo sapiens
gagcauggguucauccuau

SEQ ID NO: 21985 - RNA, 19 nt, Homo sapiens
gcacguggcucgggacauu

SEQ ID NO: 21986 - RNA, 19 nt, Homo sapiens
gaacugcagugaaggaaca

SEQ ID NO: 21987 - RNA, 19 nt, Homo sapiens
gaagagaaagugccuguga

SEQ ID NO: 21988 - RNA, 19 nt, Homo sapiens
gauagaauaugguccacuu

SEQ ID NO: 21989 - RNA, 19 nt, Homo sapiens
gcccagaugugguugcaua

SEQ ID NO: 21990 - RNA, 19 nt, Homo sapiens
gaauacagcacccaaauca

SEQ ID NO: 21991 - RNA, 19 nt, Homo sapiens
ccaagaccaugcucuauug

SEQ ID NO: 21992 - RNA, 19 nt, Homo sapiens
uggcaaggcugcaaagaaa

SEQ ID NO: 21993 - RNA, 19 nt, Homo sapiens
gaagacaggcccaacuuug

SEQ ID NO: 21994 - RNA, 19 nt, Homo sapiens
caagagagauccuccugau

SEQ ID NO: 21995 - RNA, 19 nt, Homo sapiens
ggcaagaccuccuccauca

SEQ ID NO: 21996 - RNA, 19 nt, Homo sapiens
ccaccucccuucaaccaua

SEQ ID NO: 21997 - RNA, 19 nt, Homo sapiens
aaucucaccuggauaauga

SEQ ID NO: 21998 - RNA, 19 nt, Homo sapiens
ggagccaccuacguauuua

SEQ ID NO: 21999 - RNA, 19 nt, Homo sapiens
ccugugagcuggaguauuc

SEQ ID NO: 22000 - RNA, 19 nt, Homo sapiens
ggcaauggcuccuucacaa

SEQ ID NO: 22001 - RNA, 19 nt, Homo sapiens
gccagaaacugccucuuga

SEQ ID NO: 22002 - RNA, 19 nt, Homo sapiens
gaagaaauccgugugaaca

SEQ ID NO: 22003 - RNA, 19 nt, Homo sapiens
gaagaagaaauccguguga

SEQ ID NO: 22004 - RNA, 19 nt, Homo sapiens
gagaccaaaugucacguuu

SEQ ID NO: 22005 - RNA, 19 nt, Homo sapiens
gaacaggacgaacuggauu

SEQ ID NO: 22006 - RNA, 19 nt, Homo sapiens
gggcagagcguucuaagga

SEQ ID NO: 22007 - RNA, 19 nt, Homo sapiens
ggagagggaacggaaauaa

SEQ ID NO: 22008 - RNA, 19 nt, Homo sapiens
gcaaggacgcugcaaacuu

SEQ ID NO: 22009 - RNA, 19 nt, Homo sapiens
gaauaauccuauagcaaag

SEQ ID NO: 22010 - RNA, 19 nt, Homo sapiens
ugaagacgcugccugaagu

SEQ ID NO: 22011 - RNA, 19 nt, Homo sapiens
cgaacuggauuuccucaug

SEQ ID NO: 22012 - RNA, 19 nt, Homo sapiens
gauggcgucuccugcauug

SEQ ID NO: 22013 - RNA, 19 nt, Homo sapiens
cugcagagcuccuucacuu

SEQ ID NO: 22014 - RNA, 19 nt, Homo sapiens
ggaguuauuuguaaugacu

SEQ ID NO: 22015 - RNA, 19 nt, Homo sapiens
gauguuuccuugccuuguu

SEQ ID NO: 22016 - RNA, 19 nt, Homo sapiens
gaacaaugugauagaagaa

SEQ ID NO: 22017 - RNA, 19 nt, Homo sapiens
aaacaugccuucuccuucu

SEQ ID NO: 22018 - RNA, 19 nt, Homo sapiens
ggaagugaauauuaagcau

SEQ ID NO: 22019 - RNA, 19 nt, Homo sapiens
gaauaacuccucgguucua

SEQ ID NO: 22020 - RNA, 19 nt, Homo sapiens
agaacaaugugauagaaga

SEQ ID NO: 22021 - RNA, 19 nt, Homo sapiens
caacaacgccuaccagaac

SEQ ID NO: 22022 - RNA, 19 nt, Homo sapiens
gcucauucguggagucuug

SEQ ID NO: 22023 - RNA, 19 nt, Homo sapiens
gcagagcccugaguacaag

SEQ ID NO: 22024 - RNA, 19 nt, Homo sapiens
gcaaugcagccucaaacaa

SEQ ID NO: 22025 - RNA, 19 nt, Homo sapiens
ggaggaggcggaggauaua

SEQ ID NO: 22026 - RNA, 19 nt, Homo sapiens
gaagaaggcgucggaagug

SEQ ID NO: 22027 - RNA, 19 nt, Homo sapiens
gagagggaacggaaauaaa

SEQ ID NO: 22028 - RNA, 19 nt, Homo sapiens
caaaccaguuaauccagaa

SEQ ID NO: 22029 - RNA, 19 nt, Homo sapiens
gaagaacugcagugaagga

SEQ ID NO: 22030 - RNA, 19 nt, Homo sapiens
ucaccuggauaaugaaaga

SEQ ID NO: 22031 - RNA, 19 nt, Homo sapiens
gcacaguccucuggagauc

SEQ ID NO: 22032 - RNA, 19 nt, Homo sapiens
gcaauggcuccuucacaaa

SEQ ID NO: 22033 - RNA, 19 nt, Homo sapiens
gcuguacugucccaccuaa

SEQ ID NO: 22034 - RNA, 19 nt, Homo sapiens
gcaacaacgccuaccagaa

SEQ ID NO: 22035 - RNA, 19 nt, Homo sapiens
gcagagcuccuucacuugu

SEQ ID NO: 22036 - RNA, 19 nt, Homo sapiens
gcauguuuguuguauacuu

SEQ ID NO: 22037 - RNA, 19 nt, Homo sapiens
gagagaacaaugugauaga

SEQ ID NO: 22038 - RNA, 19 nt, Homo sapiens
cauaguaguuccucuguac

SEQ ID NO: 22039 - RNA, 19 nt, Homo sapiens
ggacugcuaccucaccauu

SEQ ID NO: 22040 - RNA, 19 nt, Homo sapiens
cauggaaucucaccuggau

SEQ ID NO: 22041 - RNA, 19 nt, Homo sapiens
gcccaacuuugccaucauu

SEQ ID NO: 22042 - RNA, 19 nt, Homo sapiens
ggaagaguggccaagauug

SEQ ID NO: 22043 - RNA, 19 nt, Homo sapiens
ccaccuacguauuuaagau

SEQ ID NO: 22044 - RNA, 19 nt, Homo sapiens
gaagaugagagccagaugu

SEQ ID NO: 22045 - RNA, 19 nt, Homo sapiens
uuccaggucuguuucauuu

SEQ ID NO: 22046 - RNA, 19 nt, Homo sapiens
uaucuaaacugcagucacu

SEQ ID NO: 22047 - RNA, 19 nt, Homo sapiens
gaucaagagcucuccaugu

SEQ ID NO: 22048 - RNA, 19 nt, Homo sapiens
ggucuggagugcagcuuug

SEQ ID NO: 22049 - RNA, 19 nt, Homo sapiens
ggaaucaccaacaaacaug

SEQ ID NO: 22050 - RNA, 19 nt, Homo sapiens
ccaggucuguuucauuuag

SEQ ID NO: 22051 - RNA, 19 nt, Homo sapiens
cuacgucacuucccuugug

SEQ ID NO: 22052 - RNA, 19 nt, Homo sapiens
ggauggacccacccaagaa

SEQ ID NO: 22053 - RNA, 19 nt, Homo sapiens
caaugcagccucaaacaau

SEQ ID NO: 22054 - RNA, 19 nt, Homo sapiens
gaaauccgugugaacagaa

SEQ ID NO: 22055 - RNA, 19 nt, Homo sapiens
cugaagaacugcagugaag

SEQ ID NO: 22056 - RNA, 19 nt, Homo sapiens
agagaacaaugugauagaa

SEQ ID NO: 22057 - RNA, 19 nt, Homo sapiens
guacaaaccaguuaaucca

SEQ ID NO: 22058 - RNA, 19 nt, Homo sapiens
gcuccugguuuacagagaa

SEQ ID NO: 22059 - RNA, 19 nt, Homo sapiens
ccgcuuugccgauagaaua

SEQ ID NO: 22060 - RNA, 19 nt, Homo sapiens
gggccuguauaccggauaa

SEQ ID NO: 22061 - RNA, 19 nt, Homo sapiens
gugccaugcugccaguuaa

SEQ ID NO: 22062 - RNA, 19 nt, Homo sapiens
gaacagaagcgugcaugag

SEQ ID NO: 22063 - RNA, 19 nt, Homo sapiens
gaggaagagucuggcaguu

SEQ ID NO: 22064 - RNA, 19 nt, Homo sapiens
acagacacaugguccuuug

SEQ ID NO: 22065 - RNA, 19 nt, Homo sapiens
gcaaauucaaccaccagaa

SEQ ID NO: 22066 - RNA, 19 nt, Homo sapiens
ugaaaggcauccagaucug

SEQ ID NO: 22067 - RNA, 19 nt, Homo sapiens
gcagaauacagcacccaaa

SEQ ID NO: 22068 - RNA, 19 nt, Homo sapiens
gcaagaauagcaugaacca

SEQ ID NO: 22069 - RNA, 19 nt, Homo sapiens
ggagugcugcuaugggaaa

SEQ ID NO: 22070 - RNA, 19 nt, Homo sapiens
agacauugcugccagaaac

SEQ ID NO: 22071 - RNA, 19 nt, Homo sapiens
gccacaaggucaucugcuu

SEQ ID NO: 22072 - RNA, 19 nt, Homo sapiens
caugcucuauugcucagua

SEQ ID NO: 22073 - RNA, 19 nt, Homo sapiens
ccauaguaguuccucugua

SEQ ID NO: 22074 - RNA, 19 nt, Homo sapiens
caacguacggcuccugguu

SEQ ID NO: 22075 - RNA, 19 nt, Homo sapiens
gccuguggcugucaguauu

SEQ ID NO: 22076 - RNA, 19 nt, Homo sapiens
agaaauccgugugaacaga

SEQ ID NO: 22077 - RNA, 19 nt, Homo sapiens
ggacugacauuucuaucuu

SEQ ID NO: 22078 - RNA, 19 nt, Homo sapiens
agaaagaacuucagaaugg

SEQ ID NO: 22079 - RNA, 19 nt, Homo sapiens
ccaaagggaugacauagug

SEQ ID NO: 22080 - RNA, 19 nt, Homo sapiens
gaaaugagugugacuaugu

SEQ ID NO: 22081 - RNA, 19 nt, Homo sapiens
gaugaucuaccuccaaaua

SEQ ID NO: 22082 - RNA, 19 nt, Homo sapiens
ggacccaacucaucucaga

SEQ ID NO: 22083 - RNA, 19 nt, Homo sapiens
agaagaggcuggacuuuga

SEQ ID NO: 22084 - RNA, 19 nt, Homo sapiens
gggcucaacuggagaaaga

SEQ ID NO: 22085 - RNA, 19 nt, Homo sapiens
caacuugacuggcccuaug

SEQ ID NO: 22086 - RNA, 19 nt, Homo sapiens
ggagaaagaacuucagaau

SEQ ID NO: 22087 - RNA, 19 nt, Homo sapiens
ggaguuugaucaugacguu

SEQ ID NO: 22088 - RNA, 19 nt, Homo sapiens
caucugagcccuagaguga

SEQ ID NO: 22089 - RNA, 19 nt, Homo sapiens
ucagaaugguucccuguuu

SEQ ID NO: 22090 - RNA, 19 nt, Homo sapiens
ggaaaugagugugacuaug

SEQ ID NO: 22091 - RNA, 19 nt, Homo sapiens
gacucuaccugcaagauuu

SEQ ID NO: 22092 - RNA, 19 nt, Homo sapiens
ggagaucauugccagguau

SEQ ID NO: 22093 - RNA, 19 nt, Homo sapiens
cggcaggccugucuucaaa

SEQ ID NO: 22094 - RNA, 19 nt, Homo sapiens
gaacugccuagaagacuuu

SEQ ID NO: 22095 - RNA, 19 nt, Homo sapiens
gugacuauguuccaauaaa

SEQ ID NO: 22096 - RNA, 19 nt, Homo sapiens
gcaggccugucuucaaaug

SEQ ID NO: 22097 - RNA, 19 nt, Homo sapiens
gagaaagaacuucagaaug

SEQ ID NO: 22098 - RNA, 19 nt, Homo sapiens
gaaagaacuucagaauggu

SEQ ID NO: 22099 - RNA, 19 nt, Homo sapiens
ggaacugccuagaagacuu

SEQ ID NO: 22100 - RNA, 19 nt, Homo sapiens
uaaagucucugcugcuaag

SEQ ID NO: 22101 - RNA, 19 nt, Homo sapiens
gaacagugucaccaucuga

SEQ ID NO: 22102 - RNA, 19 nt, Homo sapiens
cagaaugguucccuguuug

SEQ ID NO: 22103 - RNA, 19 nt, Homo sapiens
ugacuggcccuaugaauau

SEQ ID NO: 22104 - RNA, 19 nt, Homo sapiens
gcccaaagcugugcuaaac

SEQ ID NO: 22105 - RNA, 19 nt, Homo sapiens
gaucuaccuccaaauauga

SEQ ID NO: 22106 - RNA, 19 nt, Homo sapiens
gagaagaggcuggacuuug

SEQ ID NO: 22107 - RNA, 19 nt, Homo sapiens
gagagaaggaacugaaaga

SEQ ID NO: 22108 - RNA, 19 nt, Homo sapiens
ccaaagcugugcuaaacca

SEQ ID NO: 22109 - RNA, 19 nt, Homo sapiens
gggagaucauugccaggua

SEQ ID NO: 22110 - RNA, 19 nt, Homo sapiens
cuagaagacuuugaucaga

SEQ ID NO: 22111 - RNA, 19 nt, Homo sapiens
ggagauggcccucaaacgu

SEQ ID NO: 22112 - RNA, 19 nt, Homo sapiens
agacaaugcuuuggacaug

SEQ ID NO: 22113 - RNA, 19 nt, Homo sapiens
gugugacuauguuccaaua

SEQ ID NO: 22114 - RNA, 19 nt, Homo sapiens
ccuaaagucucugcugcua

SEQ ID NO: 22115 - RNA, 19 nt, Homo sapiens
gaggaggaguuugaucaug

SEQ ID NO: 22116 - RNA, 19 nt, Homo sapiens
uagaagacuuugaucagau

SEQ ID NO: 22117 - RNA, 19 nt, Homo sapiens
ugaucuaccuccaaauaug

SEQ ID NO: 22118 - RNA, 19 nt, Homo sapiens
aggaggaguuugaucauga

SEQ ID NO: 22119 - RNA, 19 nt, Homo sapiens
gcaggaugaugaguuguuc

SEQ ID NO: 22120 - RNA, 19 nt, Homo sapiens
gcgaggaggaggaguuuga

SEQ ID NO: 22121 - RNA, 19 nt, Homo sapiens
ccacagacaacauggaaau

SEQ ID NO: 22122 - RNA, 19 nt, Homo sapiens
gaacagauuuggaaaagcu

SEQ ID NO: 22123 - RNA, 19 nt, Homo sapiens
gagaaggaacugaaagaca

SEQ ID NO: 22124 - RNA, 19 nt, Homo sapiens
gacuuugaauggacacuga

SEQ ID NO: 22125 - RNA, 19 nt, Homo sapiens
ccagaagcaucgagagaag

SEQ ID NO: 22126 - RNA, 19 nt, Homo sapiens
uggaaaagcuggaaaagga

SEQ ID NO: 22127 - RNA, 19 nt, Homo sapiens
aagcugugcuaaaccaauu

SEQ ID NO: 22128 - RNA, 19 nt, Homo sapiens
gaagaggcuggacuuugaa

SEQ ID NO: 22129 - RNA, 19 nt, Homo sapiens
gaauuucaugcuuuccuaa

SEQ ID NO: 22130 - RNA, 19 nt, Homo sapiens
guccaccucuucuaccaaa

SEQ ID NO: 22131 - RNA, 19 nt, Homo sapiens
caguaucacuugcugaaca

SEQ ID NO: 22132 - RNA, 19 nt, Homo sapiens
aaaugagugugacuauguu

SEQ ID NO: 22133 - RNA, 19 nt, Homo sapiens
cauagucacugucucaacu

SEQ ID NO: 22134 - RNA, 19 nt, Homo sapiens
ccugcaagauuucacauca

SEQ ID NO: 22135 - RNA, 19 nt, Homo sapiens
aagcccagcugcauagaga

SEQ ID NO: 22136 - RNA, 19 nt, Homo sapiens
gagauuacagcccggaaug

SEQ ID NO: 22137 - RNA, 19 nt, Homo sapiens
agagugcccuggcugagaa

SEQ ID NO: 22138 - RNA, 19 nt, Homo sapiens
caaauaugagauuccauga

SEQ ID NO: 22139 - RNA, 19 nt, Homo sapiens
ggagaagaggcuggacuuu

SEQ ID NO: 22140 - RNA, 19 nt, Homo sapiens
aggaugaucuaccuccaaa

SEQ ID NO: 22141 - RNA, 19 nt, Homo sapiens
gaaggcagccacagacaac

SEQ ID NO: 22142 - RNA, 19 nt, Homo sapiens
gaaggaacugaaagacaga

SEQ ID NO: 22143 - RNA, 19 nt, Homo sapiens
acaaugcuuuggacauguu

SEQ ID NO: 22144 - RNA, 19 nt, Homo sapiens
gcuacaccauggaaaucaa

SEQ ID NO: 22145 - RNA, 19 nt, Homo sapiens
gcaugaaggcagccacaga

SEQ ID NO: 22146 - RNA, 19 nt, Homo sapiens
cuaccaaagggaugacaua

SEQ ID NO: 22147 - RNA, 19 nt, Homo sapiens
caguaaacuuucucugcaa

SEQ ID NO: 22148 - RNA, 19 nt, Homo sapiens
gacugacauuucuaucuug

SEQ ID NO: 22149 - RNA, 19 nt, Homo sapiens
cuaugcccaugaugcuuua

SEQ ID NO: 22150 - RNA, 19 nt, Homo sapiens
gcuaccaguuccucaaugg

SEQ ID NO: 22151 - RNA, 19 nt, Homo sapiens
gagauuccaugaggagaag

SEQ ID NO: 22152 - RNA, 19 nt, Homo sapiens
gacaaugcuuuggacaugu

SEQ ID NO: 22153 - RNA, 19 nt, Homo sapiens
gacgauggccacagugaug

SEQ ID NO: 22154 - RNA, 19 nt, Homo sapiens
cgagauccaguaucacuug

SEQ ID NO: 22155 - RNA, 19 nt, Homo sapiens
ugcacgagauccaguauca

SEQ ID NO: 22156 - RNA, 19 nt, Homo sapiens
aguaaacuuucucugcaaa

SEQ ID NO: 22157 - RNA, 19 nt, Homo sapiens
cugcagaccguaaggauga

SEQ ID NO: 22158 - RNA, 19 nt, Homo sapiens
agauuucacaucagcuuua

SEQ ID NO: 22159 - RNA, 19 nt, Homo sapiens
caagauuucacaucagcuu

SEQ ID NO: 22160 - RNA, 19 nt, Homo sapiens
augaugaguuguucagcua

SEQ ID NO: 22161 - RNA, 19 nt, Homo sapiens
gaccgagguuucccugucu

SEQ ID NO: 22162 - RNA, 19 nt, Homo sapiens
cagacaacauggaaaugag

SEQ ID NO: 22163 - RNA, 19 nt, Homo sapiens
acagacaacauggaaauga

SEQ ID NO: 22164 - RNA, 19 nt, Homo sapiens
gccauuuccucaccaugug

SEQ ID NO: 22165 - RNA, 19 nt, Homo sapiens
gauuucacaucagcuuuag

SEQ ID NO: 22166 - RNA, 19 nt, Homo sapiens
uugacuggcccuaugaaua

SEQ ID NO: 22167 - RNA, 19 nt, Homo sapiens
uaaaccaauuccgaacaga

SEQ ID NO: 22168 - RNA, 19 nt, Homo sapiens
uuacggcucugggagauca

SEQ ID NO: 22169 - RNA, 19 nt, Homo sapiens
gagaacagugucaccaucu

SEQ ID NO: 22170 - RNA, 19 nt, Homo sapiens
gaaagacagacagcagauc

SEQ ID NO: 22171 - RNA, 19 nt, Homo sapiens
gccaggagacaaugcuuug

SEQ ID NO: 22172 - RNA, 19 nt, Homo sapiens
gaaugguucccuguuugaa

SEQ ID NO: 22173 - RNA, 19 nt, Homo sapiens
ggaggaguuugaucaugac

SEQ ID NO: 22174 - RNA, 19 nt, Homo sapiens
ggagauuacagcccggaau

SEQ ID NO: 22175 - RNA, 19 nt, Homo sapiens
cuaaaccaauuccgaacag

SEQ ID NO: 22176 - RNA, 19 nt, Homo sapiens
caaagggaugacauaguga

SEQ ID NO: 22177 - RNA, 19 nt, Homo sapiens
gcacagagcugcccgagaa

SEQ ID NO: 22178 - RNA, 19 nt, Homo sapiens
agaagcagcugccauauua

SEQ ID NO: 22179 - RNA, 19 nt, Homo sapiens
gccaguaccuuuccauuua

SEQ ID NO: 22180 - RNA, 19 nt, Homo sapiens
gggagcagcugucggagua

SEQ ID NO: 22181 - RNA, 19 nt, Homo sapiens
ucagggaacugcauagauu

SEQ ID NO: 22182 - RNA, 19 nt, Homo sapiens
cugcauagauuguaucaaa

SEQ ID NO: 22183 - RNA, 19 nt, Homo sapiens
ggaguggacuuuguucuga

SEQ ID NO: 22184 - RNA, 19 nt, Homo sapiens
gaaccuggccaacaagauu

SEQ ID NO: 22185 - RNA, 19 nt, Homo sapiens
cauaguagguacccaauuc

SEQ ID NO: 22186 - RNA, 19 nt, Homo sapiens
ggaaugacuucgccgacuu

SEQ ID NO: 22187 - RNA, 19 nt, Homo sapiens
ggcccgagaugaccaaauu

SEQ ID NO: 22188 - RNA, 19 nt, Homo sapiens
agacaugggaugauuauuu

SEQ ID NO: 22189 - RNA, 19 nt, Homo sapiens
ggaacugcauagauuguau

SEQ ID NO: 22190 - RNA, 19 nt, Homo sapiens
gcaaguacuggcugaauga

SEQ ID NO: 22191 - RNA, 19 nt, Homo sapiens
ugaaggaccugaccuaugc

SEQ ID NO: 22192 - RNA, 19 nt, Homo sapiens
gcacugacgacuacaucua

SEQ ID NO: 22193 - RNA, 19 nt, Homo sapiens
agaagaagcagcugccaua

SEQ ID NO: 22194 - RNA, 19 nt, Homo sapiens
ugaacgaugucuacgugua

SEQ ID NO: 22195 - RNA, 19 nt, Homo sapiens
auaagaaccuggccaacaa

SEQ ID NO: 22196 - RNA, 19 nt, Homo sapiens
ugaaguacaucacgcugaa

SEQ ID NO: 22197 - RNA, 19 nt, Homo sapiens
ggagaugagaacccuauuu

SEQ ID NO: 22198 - RNA, 19 nt, Homo sapiens
aagaauugguugccauaaa

SEQ ID NO: 22199 - RNA, 19 nt, Homo sapiens
gaacaguguggccaucuga

SEQ ID NO: 22200 - RNA, 19 nt, Homo sapiens
gaacuggaaacacggcaaa

SEQ ID NO: 22201 - RNA, 19 nt, Homo sapiens
gacaugggaugauuauuuu

SEQ ID NO: 22202 - RNA, 19 nt, Homo sapiens
ggacaagcccuucuacaac

SEQ ID NO: 22203 - RNA, 19 nt, Homo sapiens
cgagaagccugugaaggaa

SEQ ID NO: 22204 - RNA, 19 nt, Homo sapiens
ggagacaugggaugauuau

SEQ ID NO: 22205 - RNA, 19 nt, Homo sapiens
uggacuuuguucugaauua

SEQ ID NO: 22206 - RNA, 19 nt, Homo sapiens
ccaguaccuuuccauuuau

SEQ ID NO: 22207 - RNA, 19 nt, Homo sapiens
gcauggagagcaaagaaga

SEQ ID NO: 22208 - RNA, 19 nt, Homo sapiens
gaaugacuucgccgacuuu

SEQ ID NO: 22209 - RNA, 19 nt, Homo sapiens
gcugccauauuacuacuug

SEQ ID NO: 22210 - RNA, 19 nt, Homo sapiens
ggauggacgcgcaaaguug

SEQ ID NO: 22211 - RNA, 19 nt, Homo sapiens
gaaucgagaagcgcaagua

SEQ ID NO: 22212 - RNA, 19 nt, Homo sapiens
ggccaguaccuuuccauuu

SEQ ID NO: 22213 - RNA, 19 nt, Homo sapiens
ccauccagcucaaccaaau

SEQ ID NO: 22214 - RNA, 19 nt, Homo sapiens
aggaagaccugauguuugg

SEQ ID NO: 22215 - RNA, 19 nt, Homo sapiens
ccaaagcgauggagaaccu

SEQ ID NO: 22216 - RNA, 19 nt, Homo sapiens
aagaucagcaacacuauuu

SEQ ID NO: 22217 - RNA, 19 nt, Homo sapiens
ccaucugcuugcuguauaa

SEQ ID NO: 22218 - RNA, 19 nt, Homo sapiens
gaagaagcagcugccauau

SEQ ID NO: 22219 - RNA, 19 nt, Homo sapiens
gggaagccaucaggacguu

SEQ ID NO: 22220 - RNA, 19 nt, Homo sapiens
gaguggacuuuguucugaa

SEQ ID NO: 22221 - RNA, 19 nt, Homo sapiens
gcauagauuguaucaaagu

SEQ ID NO: 22222 - RNA, 19 nt, Homo sapiens
ucgagaagccugugaagga

SEQ ID NO: 22223 - RNA, 19 nt, Homo sapiens
gagaugagaacccuauuuu

SEQ ID NO: 22224 - RNA, 19 nt, Homo sapiens
caagaucagcaacacuauu

SEQ ID NO: 22225 - RNA, 19 nt, Homo sapiens
gucaagaucagcaacacua

SEQ ID NO: 22226 - RNA, 19 nt, Homo sapiens
ggacuuuguucugaauuac

SEQ ID NO: 22227 - RNA, 19 nt, Homo sapiens
gcaacaccgacguaaagaa

SEQ ID NO: 22228 - RNA, 19 nt, Homo sapiens
ccaauuccuugcacauagu

SEQ ID NO: 22229 - RNA, 19 nt, Homo sapiens
caucuggugucugagguuu

SEQ ID NO: 22230 - RNA, 19 nt, Homo sapiens
gaacgaugucuacguguac

SEQ ID NO: 22231 - RNA, 19 nt, Homo sapiens
gggcauggagagcaaagaa

SEQ ID NO: 22232 - RNA, 19 nt, Homo sapiens
gcuaccaguuccugaaugg

SEQ ID NO: 22233 - RNA, 19 nt, Homo sapiens
cccgugauauccaguuuga

SEQ ID NO: 22234 - RNA, 19 nt, Homo sapiens
caagcaacaccgacguaaa

SEQ ID NO: 22235 - RNA, 19 nt, Homo sapiens
gggauggacgcgcaaaguu

SEQ ID NO: 22236 - RNA, 19 nt, Homo sapiens
ucuguucuauuugugcuua

SEQ ID NO: 22237 - RNA, 19 nt, Homo sapiens
ggagagcaaagaagacauc

SEQ ID NO: 22238 - RNA, 19 nt, Homo sapiens
cccaucugcuugcuguaua

SEQ ID NO: 22239 - RNA, 19 nt, Homo sapiens
gaccaaauucacauucuca

SEQ ID NO: 22240 - RNA, 19 nt, Homo sapiens
caccggcgaugucgagguu

SEQ ID NO: 22241 - RNA, 19 nt, Homo sapiens
agaauugguugccauaaaa

SEQ ID NO: 22242 - RNA, 19 nt, Homo sapiens
acacccagcucagcauuuc

SEQ ID NO: 22243 - RNA, 19 nt, Homo sapiens
ccauugcaaucaacaccaa

SEQ ID NO: 22244 - RNA, 19 nt, Homo sapiens
caacaccgacguaaagaac

SEQ ID NO: 22245 - RNA, 19 nt, Homo sapiens
cacgaccacugauagaugu

SEQ ID NO: 22246 - RNA, 19 nt, Homo sapiens
ccaagcagcaacagcaaau

SEQ ID NO: 22247 - RNA, 19 nt, Homo sapiens
gaacugcauagauuguauc

SEQ ID NO: 22248 - RNA, 19 nt, Homo sapiens
aagaagacauccccuacua

SEQ ID NO: 22249 - RNA, 19 nt, Homo sapiens
cugcgaguguggccucuuu

SEQ ID NO: 22250 - RNA, 19 nt, Homo sapiens
ucugcuugcuguauaagaa

SEQ ID NO: 22251 - RNA, 19 nt, Homo sapiens
gcaaaguuggcccgagaug

SEQ ID NO: 22252 - RNA, 19 nt, Homo sapiens
aaauucacauucucaagca

SEQ ID NO: 22253 - RNA, 19 nt, Homo sapiens
cauagauuguaucaaagug

SEQ ID NO: 22254 - RNA, 19 nt, Homo sapiens
gcugagcgcaacaagaaga

SEQ ID NO: 22255 - RNA, 19 nt, Homo sapiens
gaagccaucaggacguuca

SEQ ID NO: 22256 - RNA, 19 nt, Homo sapiens
gaguguggccucuuugaca

SEQ ID NO: 22257 - RNA, 19 nt, Homo sapiens
caaaguuggcccgagauga

SEQ ID NO: 22258 - RNA, 19 nt, Homo sapiens
gaucagcaacacuauuucu

SEQ ID NO: 22259 - RNA, 19 nt, Homo sapiens
cgagaugaccaaauucaca

SEQ ID NO: 22260 - RNA, 19 nt, Homo sapiens
gagaugaccaaauucacau

SEQ ID NO: 22261 - RNA, 19 nt, Homo sapiens
cgacguaaagaacuggaaa

SEQ ID NO: 22262 - RNA, 19 nt, Homo sapiens
uuaagaauugguugccaua

SEQ ID NO: 22263 - RNA, 19 nt, Homo sapiens
uggacaagcccuucuacaa

SEQ ID NO: 22264 - RNA, 19 nt, Homo sapiens
cgcaaguacuggcugaaug

SEQ ID NO: 22265 - RNA, 19 nt, Homo sapiens
caguaccuuuccauuuauu

SEQ ID NO: 22266 - RNA, 19 nt, Homo sapiens
gaaccucgaggccauuguc

SEQ ID NO: 22267 - RNA, 19 nt, Homo sapiens
gaccaucacccaccuucug

SEQ ID NO: 22268 - RNA, 19 nt, Homo sapiens
gauguuuggcuaccaguuc

SEQ ID NO: 22269 - RNA, 19 nt, Homo sapiens
guucaucaaccgcuucaug

SEQ ID NO: 22270 - RNA, 19 nt, Homo sapiens
agauccagcuggucagaau

SEQ ID NO: 22271 - RNA, 19 nt, Homo sapiens
ucacgaccacugauagaug

SEQ ID NO: 22272 - RNA, 19 nt, Homo sapiens
gggaacugcauagauugua

SEQ ID NO: 22273 - RNA, 19 nt, Homo sapiens
aagaagcagcugccauauu

SEQ ID NO: 22274 - RNA, 19 nt, Homo sapiens
ccaugaaggaccugaccua

SEQ ID NO: 22275 - RNA, 19 nt, Homo sapiens
uauaagaaccuggccaaca

SEQ ID NO: 22276 - RNA, 19 nt, Homo sapiens
ugacuucgccgacuuugag

SEQ ID NO: 22277 - RNA, 19 nt, Homo sapiens
ggacugauguacuuguuug

SEQ ID NO: 22278 - RNA, 19 nt, Homo sapiens
ucaagaaacuguaggcaau

SEQ ID NO: 22279 - RNA, 19 nt, Homo sapiens
aaacauggaucaagaaacu

SEQ ID NO: 22280 - RNA, 19 nt, Homo sapiens
cuaacucucugcugaauau

SEQ ID NO: 22281 - RNA, 19 nt, Homo sapiens
ccaaguuccugcugcguuu

SEQ ID NO: 22282 - RNA, 19 nt, Homo sapiens
ggaaacgcaucauacucuu

SEQ ID NO: 22283 - RNA, 19 nt, Homo sapiens
aagcaaacauggaucaaga

SEQ ID NO: 22284 - RNA, 19 nt, Homo sapiens
gaaagcaggacccagaaug

SEQ ID NO: 22285 - RNA, 19 nt, Homo sapiens
caucugggcuucacagcuu

SEQ ID NO: 22286 - RNA, 19 nt, Homo sapiens
gcaaacauggaucaagaaa

SEQ ID NO: 22287 - RNA, 19 nt, Homo sapiens
caucauaauucagcucuug

SEQ ID NO: 22288 - RNA, 19 nt, Homo sapiens
ccggaacacuugccuuuga

SEQ ID NO: 22289 - RNA, 19 nt, Homo sapiens
gaaacuguaggcaauguug

SEQ ID NO: 22290 - RNA, 19 nt, Homo sapiens
cuacaagucaucauaauuc

SEQ ID NO: 22291 - RNA, 19 nt, Homo sapiens
gagcaccccuggcuacaua

SEQ ID NO: 22292 - RNA, 19 nt, Homo sapiens
gcauucugcucuucuuuag

SEQ ID NO: 22293 - RNA, 19 nt, Homo sapiens
gcuggcauauucaacuauu

SEQ ID NO: 22294 - RNA, 19 nt, Homo sapiens
guaaaucuauuggccaucu

SEQ ID NO: 22295 - RNA, 19 nt, Homo sapiens
guucucaucuaaucaauac

SEQ ID NO: 22296 - RNA, 19 nt, Homo sapiens
gaccggaacacuugccuuu

SEQ ID NO: 22297 - RNA, 19 nt, Homo sapiens
acuauuaccucaucuucuu

SEQ ID NO: 22298 - RNA, 19 nt, Homo sapiens
ccuguucucugaagauguu

SEQ ID NO: 22299 - RNA, 19 nt, Homo sapiens
guccguugcuggcauauuc

SEQ ID NO: 22300 - RNA, 19 nt, Homo sapiens
gggaaacgcaucauacucu

SEQ ID NO: 22301 - RNA, 19 nt, Homo sapiens
aaccagaacuguguagaug

SEQ ID NO: 22302 - RNA, 19 nt, Homo sapiens
cagaggaccggaacacuug

SEQ ID NO: 22303 - RNA, 19 nt, Homo sapiens
cuucacagcuugaguuaac

SEQ ID NO: 22304 - RNA, 19 nt, Homo sapiens
gguugguguucucaucuaa

SEQ ID NO: 22305 - RNA, 19 nt, Homo sapiens
cugauguacuuguuuguga

SEQ ID NO: 22306 - RNA, 19 nt, Homo sapiens
caacuauuaccucaucuuc

SEQ ID NO: 22307 - RNA, 19 nt, Homo sapiens
caucauacucuuccuguuc

SEQ ID NO: 22308 - RNA, 19 nt, Homo sapiens
ggguugguguucucaucua

SEQ ID NO: 22309 - RNA, 19 nt, Homo sapiens
gcaucauacucuuccuguu

SEQ ID NO: 22310 - RNA, 19 nt, Homo sapiens
ccagguuuguguuuucuua

SEQ ID NO: 22311 - RNA, 19 nt, Homo sapiens
cauguccguugcuggcaua

SEQ ID NO: 22312 - RNA, 19 nt, Homo sapiens
guacuuugucgguuaccua

SEQ ID NO: 22313 - RNA, 19 nt, Homo sapiens
ccagaggaccggaacacuu

SEQ ID NO: 22314 - RNA, 19 nt, Homo sapiens
gaaacgcaucauacucuuc

SEQ ID NO: 22315 - RNA, 19 nt, Homo sapiens
caaccagaacuguguagau

SEQ ID NO: 22316 - RNA, 19 nt, Homo sapiens
uggauucuuugcccauaaa

SEQ ID NO: 22317 - RNA, 19 nt, Homo sapiens
uuucuucacuuauccuguu

SEQ ID NO: 22318 - RNA, 19 nt, Homo sapiens
gggcuucacagcuugaguu

SEQ ID NO: 22319 - RNA, 19 nt, Homo sapiens
gaagcaaacauggaucaag

SEQ ID NO: 22320 - RNA, 19 nt, Homo sapiens
uugcuggacugauguacuu

SEQ ID NO: 22321 - RNA, 19 nt, Homo sapiens
auucugcucuucuuuagau

SEQ ID NO: 22322 - RNA, 19 nt, Homo sapiens
ccuacaagucaucauaauu

SEQ ID NO: 22323 - RNA, 19 nt, Homo sapiens
auaccuacaagucaucaua

SEQ ID NO: 22324 - RNA, 19 nt, Homo sapiens
aaucaauaccuacaaguca

SEQ ID NO: 22325 - RNA, 19 nt, Homo sapiens
cacuuauccuguucucuga

SEQ ID NO: 22326 - RNA, 19 nt, Homo sapiens
ucuaaucaauaccuacaag

SEQ ID NO: 22327 - RNA, 19 nt, Homo sapiens
aggcaauguuguccuguug

SEQ ID NO: 22328 - RNA, 19 nt, Homo sapiens
gguguucucaucuaaucaa

SEQ ID NO: 22329 - RNA, 19 nt, Homo sapiens
uaggcaauguuguccuguu

SEQ ID NO: 22330 - RNA, 19 nt, Homo sapiens
cuggcauauucaacuauua

SEQ ID NO: 22331 - RNA, 19 nt, Homo sapiens
caagaaacuguaggcaaug

SEQ ID NO: 22332 - RNA, 19 nt, Homo sapiens
aagaaacuguaggcaaugu

SEQ ID NO: 22333 - RNA, 19 nt, Homo sapiens
uugcuggcauauucaacua

SEQ ID NO: 22334 - RNA, 19 nt, Homo sapiens
uaccuacaagucaucauaa

SEQ ID NO: 22335 - RNA, 19 nt, Homo sapiens
guuuguuucuucacuuauc

SEQ ID NO: 22336 - RNA, 19 nt, Homo sapiens
auucaacuauuaccucauc

SEQ ID NO: 22337 - RNA, 19 nt, Homo sapiens
caucuaaucaauaccuaca

SEQ ID NO: 22338 - RNA, 19 nt, Homo sapiens
gaccguggccccaaauuug

SEQ ID NO: 22339 - RNA, 19 nt, Homo sapiens
ggcuucacagcuugaguua

SEQ ID NO: 22340 - RNA, 19 nt, Homo sapiens
cauaauucagcucuugaga

SEQ ID NO: 22341 - RNA, 19 nt, Homo sapiens
uaaaguggagcacgaaagc

SEQ ID NO: 22342 - RNA, 19 nt, Homo sapiens
uaaucaauaccuacaaguc

SEQ ID NO: 22343 - RNA, 19 nt, Homo sapiens
ccaugcauuuuguuuguuu

SEQ ID NO: 22344 - RNA, 19 nt, Homo sapiens
cauaaaguggagcacgaaa

SEQ ID NO: 22345 - RNA, 19 nt, Homo sapiens
gcauuuuguuuguuucuuc

SEQ ID NO: 22346 - RNA, 19 nt, Homo sapiens
cgaaagcaggacccagaau

SEQ ID NO: 22347 - RNA, 19 nt, Homo sapiens
caucagcgugguccagaau

SEQ ID NO: 22348 - RNA, 19 nt, Homo sapiens
ggaaugcacuggagaagua

SEQ ID NO: 22349 - RNA, 19 nt, Homo sapiens
gaacagcauuucuauuuag

SEQ ID NO: 22350 - RNA, 19 nt, Homo sapiens
gauccgauaugucacuaua

SEQ ID NO: 22351 - RNA, 19 nt, Homo sapiens
ugacggagaucaucaccua

SEQ ID NO: 22352 - RNA, 19 nt, Homo sapiens
ugucggagcucaccuauga

SEQ ID NO: 22353 - RNA, 19 nt, Homo sapiens
ggaagaggcugaaggacau

SEQ ID NO: 22354 - RNA, 19 nt, Homo sapiens
ccaauucucaucaacuuua

SEQ ID NO: 22355 - RNA, 19 nt, Homo sapiens
gagcagccauggccaccua

SEQ ID NO: 22356 - RNA, 19 nt, Homo sapiens
gagcugauccgauauguca

SEQ ID NO: 22357 - RNA, 19 nt, Homo sapiens
gaaagacaacagcagauga

SEQ ID NO: 22358 - RNA, 19 nt, Homo sapiens
ugccugagcugauccgaua

SEQ ID NO: 22359 - RNA, 19 nt, Homo sapiens
gaucaucaccuauuauuac

SEQ ID NO: 22360 - RNA, 19 nt, Homo sapiens
cggagaucaucaccuauua

SEQ ID NO: 22361 - RNA, 19 nt, Homo sapiens
gagaucaucaccuauuauu

SEQ ID NO: 22362 - RNA, 19 nt, Homo sapiens
ggaccugccuggauauuac

SEQ ID NO: 22363 - RNA, 19 nt, Homo sapiens
gcaacuaugugcagaucug

SEQ ID NO: 22364 - RNA, 19 nt, Homo sapiens
gcacgcugcugucaacaca

SEQ ID NO: 22365 - RNA, 19 nt, Homo sapiens
gcacgcggaucccagacaa

SEQ ID NO: 22366 - RNA, 19 nt, Homo sapiens
ggagggugauccggaauug

SEQ ID NO: 22367 - RNA, 19 nt, Homo sapiens
gagccaagcaggacuucua

SEQ ID NO: 22368 - RNA, 19 nt, Homo sapiens
ugaguggaauggcuauauu

SEQ ID NO: 22369 - RNA, 19 nt, Homo sapiens
gcagaggacaccuucuuug

SEQ ID NO: 22370 - RNA, 19 nt, Homo sapiens
gggccguucuccucaauga

SEQ ID NO: 22371 - RNA, 19 nt, Homo sapiens
acauuuaccuggccgacua

SEQ ID NO: 22372 - RNA, 19 nt, Homo sapiens
ugaggaaccugcccaugug

SEQ ID NO: 22373 - RNA, 19 nt, Homo sapiens
ggaaagacaacagcagaug

SEQ ID NO: 22374 - RNA, 19 nt, Homo sapiens
agaaguaugugacggagau

SEQ ID NO: 22375 - RNA, 19 nt, Homo sapiens
gauacaccguccagaucaa

SEQ ID NO: 22376 - RNA, 19 nt, Homo sapiens
ggagaucaucaccuauuau

SEQ ID NO: 22377 - RNA, 19 nt, Homo sapiens
gcacuggagaaguauguga

SEQ ID NO: 22378 - RNA, 19 nt, Homo sapiens
ugaccacucuggagaccuu

SEQ ID NO: 22379 - RNA, 19 nt, Homo sapiens
ggaccugggugagcucauc

SEQ ID NO: 22380 - RNA, 19 nt, Homo sapiens
gggagagacuuugcaacug

SEQ ID NO: 22381 - RNA, 19 nt, Homo sapiens
gugaagaccacgugcauca

SEQ ID NO: 22382 - RNA, 19 nt, Homo sapiens
ccauggcacuggcuuucaa

SEQ ID NO: 22383 - RNA, 19 nt, Homo sapiens
gggcagaggacaccuucuu

SEQ ID NO: 22384 - RNA, 19 nt, Homo sapiens
gauccggaauugcagucuu

SEQ ID NO: 22385 - RNA, 19 nt, Homo sapiens
gcugaaggacauuaggaaa

SEQ ID NO: 22386 - RNA, 19 nt, Homo sapiens
cccauucugugcccuacua

SEQ ID NO: 22387 - RNA, 19 nt, Homo sapiens
gaaccgugccugagcugau

SEQ ID NO: 22388 - RNA, 19 nt, Homo sapiens
gcaggaaauauuuaaagag

SEQ ID NO: 22389 - RNA, 19 nt, Homo sapiens
caaccggccugaguggaau

SEQ ID NO: 22390 - RNA, 19 nt, Homo sapiens
ugggugagcucaucaucau

SEQ ID NO: 22391 - RNA, 19 nt, Homo sapiens
ccaucucacugaccauugu

SEQ ID NO: 22392 - RNA, 19 nt, Homo sapiens
cgauaugucacuauaguca

SEQ ID NO: 22393 - RNA, 19 nt, Homo sapiens
acacaaggagagagccaua

SEQ ID NO: 22394 - RNA, 19 nt, Homo sapiens
ggcagaggacaccuucuuu

SEQ ID NO: 22395 - RNA, 19 nt, Homo sapiens
ucccaauucucaucaacuu

SEQ ID NO: 22396 - RNA, 19 nt, Homo sapiens
aaucugucgucuccgagua

SEQ ID NO: 22397 - RNA, 19 nt, Homo sapiens
acacaggccagauggaguu

SEQ ID NO: 22398 - RNA, 19 nt, Homo sapiens
gauauuacuaccgcgauga

SEQ ID NO: 22399 - RNA, 19 nt, Homo sapiens
gaacacgggacuccaucuc

SEQ ID NO: 22400 - RNA, 19 nt, Homo sapiens
gcuggagacacaccucauu

SEQ ID NO: 22401 - RNA, 19 nt, Homo sapiens
ggcagcagcuuuuccagaa

SEQ ID NO: 22402 - RNA, 19 nt, Homo sapiens
agucuugggugcaggaaau

SEQ ID NO: 22403 - RNA, 19 nt, Homo sapiens
guccagaucaacagcauug

SEQ ID NO: 22404 - RNA, 19 nt, Homo sapiens
cgagggaacgugcuugcaa

SEQ ID NO: 22405 - RNA, 19 nt, Homo sapiens
gcggaucccagacaaguuc

SEQ ID NO: 22406 - RNA, 19 nt, Homo sapiens
ccagaucucacacgacauc

SEQ ID NO: 22407 - RNA, 19 nt, Homo sapiens
ggacacuucccggacauuc

SEQ ID NO: 22408 - RNA, 19 nt, Homo sapiens
ccaucuuccugcccaguga

SEQ ID NO: 22409 - RNA, 19 nt, Homo sapiens
gaaggacauuaggaaaauu

SEQ ID NO: 22410 - RNA, 19 nt, Homo sapiens
ccaaccggccugaguggaa

SEQ ID NO: 22411 - RNA, 19 nt, Homo sapiens
ccacuuugggagagacuuu

SEQ ID NO: 22412 - RNA, 19 nt, Homo sapiens
auucugugcccuacuauuu

SEQ ID NO: 22413 - RNA, 19 nt, Homo sapiens
auccaccgauucagacuaa

SEQ ID NO: 22414 - RNA, 19 nt, Homo sapiens
ccgccuggaugcccaacuu

SEQ ID NO: 22415 - RNA, 19 nt, Homo sapiens
gugcaggaaauauuuaaag

SEQ ID NO: 22416 - RNA, 19 nt, Homo sapiens
gcaaacauucguggaagag

SEQ ID NO: 22417 - RNA, 19 nt, Homo sapiens
uccgauaugucacuauagu

SEQ ID NO: 22418 - RNA, 19 nt, Homo sapiens
cgauacaccguccagauca

SEQ ID NO: 22419 - RNA, 19 nt, Homo sapiens
ugaaggacauuaggaaaau

SEQ ID NO: 22420 - RNA, 19 nt, Homo sapiens
cacaggcaccgaccucuug

SEQ ID NO: 22421 - RNA, 19 nt, Homo sapiens
ucauccgccugcacaaaga

SEQ ID NO: 22422 - RNA, 19 nt, Homo sapiens
caccaagggcagcagcuuu

SEQ ID NO: 22423 - RNA, 19 nt, Homo sapiens
gccagcgccugaaccagau

SEQ ID NO: 22424 - RNA, 19 nt, Homo sapiens
gggugcaggaaauauuuaa

SEQ ID NO: 22425 - RNA, 19 nt, Homo sapiens
gaagaggcugaaggacauu

SEQ ID NO: 22426 - RNA, 19 nt, Homo sapiens
caucauccgccugcacaaa

SEQ ID NO: 22427 - RNA, 19 nt, Homo sapiens
cagcagcuuuuccagaauu

SEQ ID NO: 22428 - RNA, 19 nt, Homo sapiens
cagaggacaccuucuuugg

SEQ ID NO: 22429 - RNA, 19 nt, Homo sapiens
ugcaaacauucguggaaga

SEQ ID NO: 22430 - RNA, 19 nt, Homo sapiens
acacguugccggaugugaa

SEQ ID NO: 22431 - RNA, 19 nt, Homo sapiens
ggagacacaccucauugcu

SEQ ID NO: 22432 - RNA, 19 nt, Homo sapiens
gguacgcuaugcggaguuc

SEQ ID NO: 22433 - RNA, 19 nt, Homo sapiens
ggacccgagggcaagauga

SEQ ID NO: 22434 - RNA, 19 nt, Homo sapiens
ccuguccacuccacucugu

SEQ ID NO: 22435 - RNA, 19 nt, Homo sapiens
ccacaggcaccgaccucuu

SEQ ID NO: 22436 - RNA, 19 nt, Homo sapiens
ccuauuauuacccgaguga

SEQ ID NO: 22437 - RNA, 19 nt, Homo sapiens
gauucccaauucucaucaa

SEQ ID NO: 22438 - RNA, 19 nt, Homo sapiens
ggacugagugccccucuug

SEQ ID NO: 22439 - RNA, 19 nt, Homo sapiens
ggaggccacaggaaagaca

SEQ ID NO: 22440 - RNA, 19 nt, Homo sapiens
acccggugcugauugagaa

SEQ ID NO: 22441 - RNA, 19 nt, Homo sapiens
uggacccggugcugauuga

SEQ ID NO: 22442 - RNA, 19 nt, Homo sapiens
agaccuucauggacacguu

SEQ ID NO: 22443 - RNA, 19 nt, Homo sapiens
ggugcaggaaauauuuaaa

SEQ ID NO: 22444 - RNA, 19 nt, Homo sapiens
caagacguggguacgcuau

SEQ ID NO: 22445 - RNA, 19 nt, Homo sapiens
acggagaucaucaccuauu

SEQ ID NO: 22446 - RNA, 19 nt, Homo sapiens
cugaggaaccugcccaugu

SEQ ID NO: 22447 - RNA, 19 nt, Homo sapiens
ggagcgagauugacuuaaa

SEQ ID NO: 22448 - RNA, 19 nt, Homo sapiens
ggacugaugagaugaaauu

SEQ ID NO: 22449 - RNA, 19 nt, Homo sapiens
caaggagggugucaucauu

SEQ ID NO: 22450 - RNA, 19 nt, Homo sapiens
ggacuccucuucccaacuu

SEQ ID NO: 22451 - RNA, 19 nt, Homo sapiens
gcugagaaaugaacacgaa

SEQ ID NO: 22452 - RNA, 19 nt, Homo sapiens
gagaugccauuaacauuca

SEQ ID NO: 22453 - RNA, 19 nt, Homo sapiens
gaaacagggucuccacaag

SEQ ID NO: 22454 - RNA, 19 nt, Homo sapiens
ggacgcagguuggguguga

SEQ ID NO: 22455 - RNA, 19 nt, Homo sapiens
gaugggacccugauaagaa

SEQ ID NO: 22456 - RNA, 19 nt, Homo sapiens
gaaaugaacacgaauccau

SEQ ID NO: 22457 - RNA, 19 nt, Homo sapiens
gagaguguuugaagaguau

SEQ ID NO: 22458 - RNA, 19 nt, Homo sapiens
gagcgagauugacuuaaau

SEQ ID NO: 22459 - RNA, 19 nt, Homo sapiens
gccauuaacauucaucuaa

SEQ ID NO: 22460 - RNA, 19 nt, Homo sapiens
ggucuucuauuucccuauu

SEQ ID NO: 22461 - RNA, 19 nt, Homo sapiens
gccuuucggucuucuauuu

SEQ ID NO: 22462 - RNA, 19 nt, Homo sapiens
gagauggccugguggaaag

SEQ ID NO: 22463 - RNA, 19 nt, Homo sapiens
ucaaaugucacuucaagaa

SEQ ID NO: 22464 - RNA, 19 nt, Homo sapiens
uaucaaaugucacuucaag

SEQ ID NO: 22465 - RNA, 19 nt, Homo sapiens
caaccgagaugccauuaac

SEQ ID NO: 22466 - RNA, 19 nt, Homo sapiens
ugagaguguuugaagagua

SEQ ID NO: 22467 - RNA, 19 nt, Homo sapiens
uaacaagcgucuuacaaaa

SEQ ID NO: 22468 - RNA, 19 nt, Homo sapiens
gagcacaaugccaaccuua

SEQ ID NO: 22469 - RNA, 19 nt, Homo sapiens
uuaacaagcgucuuacaaa

SEQ ID NO: 22470 - RNA, 19 nt, Homo sapiens
gcacaaugccaaccuuagu

SEQ ID NO: 22471 - RNA, 19 nt, Homo sapiens
caaccugugucucuucauc

SEQ ID NO: 22472 - RNA, 19 nt, Homo sapiens
acaaaacacuucucuauca

SEQ ID NO: 22473 - RNA, 19 nt, Homo sapiens
gcaagacccucagcagcau

SEQ ID NO: 22474 - RNA, 19 nt, Homo sapiens
gaacaagagcaaagaccau

SEQ ID NO: 22475 - RNA, 19 nt, Homo sapiens
ugagcucaguggcaaguuu

SEQ ID NO: 22476 - RNA, 19 nt, Homo sapiens
cgagaugccauuaacauuc

SEQ ID NO: 22477 - RNA, 19 nt, Homo sapiens
ucacugagaccuugaaguc

SEQ ID NO: 22478 - RNA, 19 nt, Homo sapiens
aaacagggucuccacaaga

SEQ ID NO: 22479 - RNA, 19 nt, Homo sapiens
ggacauccaagcagacaca

SEQ ID NO: 22480 - RNA, 19 nt, Homo sapiens
guggaaagccuggauugaa

SEQ ID NO: 22481 - RNA, 19 nt, Homo sapiens
caagagcaaagaccaugaa

SEQ ID NO: 22482 - RNA, 19 nt, Homo sapiens
gggaugaugugagcagcuu

SEQ ID NO: 22483 - RNA, 19 nt, Homo sapiens
ugggagcccuuuuguuuua

SEQ ID NO: 22484 - RNA, 19 nt, Homo sapiens
ccauucccaucuacugaaa

SEQ ID NO: 22485 - RNA, 19 nt, Homo sapiens
cagcuacuuugcagagaga

SEQ ID NO: 22486 - RNA, 19 nt, Homo sapiens
gagggugucaucauugaga

SEQ ID NO: 22487 - RNA, 19 nt, Homo sapiens
gaugugcucaccaagagaa

SEQ ID NO: 22488 - RNA, 19 nt, Homo sapiens
gcugggagcccuuuuguuu

SEQ ID NO: 22489 - RNA, 19 nt, Homo sapiens
ggccagggaauauggguuu

SEQ ID NO: 22490 - RNA, 19 nt, Homo sapiens
gaagauucgugggacugau

SEQ ID NO: 22491 - RNA, 19 nt, Homo sapiens
ggcagcagaucgccaaguc

SEQ ID NO: 22492 - RNA, 19 nt, Homo sapiens
ggaaagccuggauugaaca

SEQ ID NO: 22493 - RNA, 19 nt, Homo sapiens
cgagcaggcuaucaucgau

SEQ ID NO: 22494 - RNA, 19 nt, Homo sapiens
cauuguggcccuuauguau

SEQ ID NO: 22495 - RNA, 19 nt, Homo sapiens
ggaccaacgagcaggcuau

SEQ ID NO: 22496 - RNA, 19 nt, Homo sapiens
gagauucugaagugccuuu

SEQ ID NO: 22497 - RNA, 19 nt, Homo sapiens
gcccucagcaccacucuug

SEQ ID NO: 22498 - RNA, 19 nt, Homo sapiens
ugaaacagggucuccacaa

SEQ ID NO: 22499 - RNA, 19 nt, Homo sapiens
uggaaagccuggauugaac

SEQ ID NO: 22500 - RNA, 19 nt, Homo sapiens
ccaggucauuucccagugu

SEQ ID NO: 22501 - RNA, 19 nt, Homo sapiens
gaugaugugagcagcuuug

SEQ ID NO: 22502 - RNA, 19 nt, Homo sapiens
aaggagcgagauugacuua

SEQ ID NO: 22503 - RNA, 19 nt, Homo sapiens
guuugaagaguaugagaaa

SEQ ID NO: 22504 - RNA, 19 nt, Homo sapiens
aggagggugucaucauuga

SEQ ID NO: 22505 - RNA, 19 nt, Homo sapiens
aagaagauguacggcaaga

SEQ ID NO: 22506 - RNA, 19 nt, Homo sapiens
gagcucaguggcaaguuug

SEQ ID NO: 22507 - RNA, 19 nt, Homo sapiens
ucucucgccaucuuaauaa

SEQ ID NO: 22508 - RNA, 19 nt, Homo sapiens
aaaauucucucgccaucuu

SEQ ID NO: 22509 - RNA, 19 nt, Homo sapiens
gccaaccugugucucuuca

SEQ ID NO: 22510 - RNA, 19 nt, Homo sapiens
cagaagaacaagagcaaag

SEQ ID NO: 22511 - RNA, 19 nt, Homo sapiens
cgugaugggacccugauaa

SEQ ID NO: 22512 - RNA, 19 nt, Homo sapiens
aaugaaggcguaugaggaa

SEQ ID NO: 22513 - RNA, 19 nt, Homo sapiens
gaaccagcugcgggagaua

SEQ ID NO: 22514 - RNA, 19 nt, Homo sapiens
guggcuaccuggagaggau

SEQ ID NO: 22515 - RNA, 19 nt, Homo sapiens
ggaggaggacauccaagca

SEQ ID NO: 22516 - RNA, 19 nt, Homo sapiens
cagcugcgggagauaauga

SEQ ID NO: 22517 - RNA, 19 nt, Homo sapiens
uucccaagcuggucacaga

SEQ ID NO: 22518 - RNA, 19 nt, Homo sapiens
caacuuccuccaggucauu

SEQ ID NO: 22519 - RNA, 19 nt, Homo sapiens
agagauggccugguggaaa

SEQ ID NO: 22520 - RNA, 19 nt, Homo sapiens
gaagaacaagagcaaagac

SEQ ID NO: 22521 - RNA, 19 nt, Homo sapiens
cuuaucaaaugucacuuca

SEQ ID NO: 22522 - RNA, 19 nt, Homo sapiens
aaaccuccacagcuacuuu

SEQ ID NO: 22523 - RNA, 19 nt, Homo sapiens
cccaaaaccuccacagcua

SEQ ID NO: 22524 - RNA, 19 nt, Homo sapiens
cauccaagcagacacaagu

SEQ ID NO: 22525 - RNA, 19 nt, Homo sapiens
caacgagcaggcuaucauc

SEQ ID NO: 22526 - RNA, 19 nt, Homo sapiens
augggacccugauaagaaa

SEQ ID NO: 22527 - RNA, 19 nt, Homo sapiens
gaaggcguaugaggaagac

SEQ ID NO: 22528 - RNA, 19 nt, Homo sapiens
ccaacgagcaggcuaucau

SEQ ID NO: 22529 - RNA, 19 nt, Homo sapiens
ccaaggagggugucaucau

SEQ ID NO: 22530 - RNA, 19 nt, Homo sapiens
ccgagaugccauuaacauu

SEQ ID NO: 22531 - RNA, 19 nt, Homo sapiens
aaugccaaccuuaguguuu

SEQ ID NO: 22532 - RNA, 19 nt, Homo sapiens
ucgaugugcucaccaagag

SEQ ID NO: 22533 - RNA, 19 nt, Homo sapiens
gguggaaagccuggauuga

SEQ ID NO: 22534 - RNA, 19 nt, Homo sapiens
gcugagaguguuugaagag

SEQ ID NO: 22535 - RNA, 19 nt, Homo sapiens
ucaucgaugugcucaccaa

SEQ ID NO: 22536 - RNA, 19 nt, Homo sapiens
gacagcaucaagagugaga

SEQ ID NO: 22537 - RNA, 19 nt, Homo sapiens
cuggguaccuggagauucu

SEQ ID NO: 22538 - RNA, 19 nt, Homo sapiens
caaaacacuucucuaucau

SEQ ID NO: 22539 - RNA, 19 nt, Homo sapiens
ugagcacaaugccaaccuu

SEQ ID NO: 22540 - RNA, 19 nt, Homo sapiens
gccaugaagggcuuaggaa

SEQ ID NO: 22541 - RNA, 19 nt, Homo sapiens
agaagaacaagagcaaaga

SEQ ID NO: 22542 - RNA, 19 nt, Homo sapiens
cacagaagaacaagagcaa

SEQ ID NO: 22543 - RNA, 19 nt, Homo sapiens
caacccagacccugaugca

SEQ ID NO: 22544 - RNA, 19 nt, Homo sapiens
aggacagcaucaagaguga

SEQ ID NO: 22545 - RNA, 19 nt, Homo sapiens
agaaccagcugcgggagau

SEQ ID NO: 22546 - RNA, 19 nt, Homo sapiens
gagaaaugaacacgaaucc

SEQ ID NO: 22547 - RNA, 19 nt, Homo sapiens
gcaaauagccacaauuaua

SEQ ID NO: 22548 - RNA, 19 nt, Homo sapiens
gaacccaaauugaguuuaa

SEQ ID NO: 22549 - RNA, 19 nt, Homo sapiens
ggacugggcuggucucuga

SEQ ID NO: 22550 - RNA, 19 nt, Homo sapiens
caaagacucucuaaauguu

SEQ ID NO: 22551 - RNA, 19 nt, Homo sapiens
gauacacccuggaaauuaa

SEQ ID NO: 22552 - RNA, 19 nt, Homo sapiens
cauccuaucuucaagcuua

SEQ ID NO: 22553 - RNA, 19 nt, Homo sapiens
gaaaucaucuaucgguaug

SEQ ID NO: 22554 - RNA, 19 nt, Homo sapiens
ggaaggaucuagaugacuu

SEQ ID NO: 22555 - RNA, 19 nt, Homo sapiens
gaacuaggacugaacuauu

SEQ ID NO: 22556 - RNA, 19 nt, Homo sapiens
ggaccagguuugccacuuu

SEQ ID NO: 22557 - RNA, 19 nt, Homo sapiens
gaucaaggccaacgucauu

SEQ ID NO: 22558 - RNA, 19 nt, Homo sapiens
gcaaacggcaccuccuuaa

SEQ ID NO: 22559 - RNA, 19 nt, Homo sapiens
gaagagagaaggaaguugu

SEQ ID NO: 22560 - RNA, 19 nt, Homo sapiens
caagagaguugacuuugag

SEQ ID NO: 22561 - RNA, 19 nt, Homo sapiens
gagcugcagucucaucuuc

SEQ ID NO: 22562 - RNA, 19 nt, Homo sapiens
gaggucagguucccuuguu

SEQ ID NO: 22563 - RNA, 19 nt, Homo sapiens
cgauacacccuggaaauua

SEQ ID NO: 22564 - RNA, 19 nt, Homo sapiens
acaagagaguugacuuuga

SEQ ID NO: 22565 - RNA, 19 nt, Homo sapiens
ggacaugcccuacgaguac

SEQ ID NO: 22566 - RNA, 19 nt, Homo sapiens
gaaaagaacuaggacugaa

SEQ ID NO: 22567 - RNA, 19 nt, Homo sapiens
gaaauugagauccggaaug

SEQ ID NO: 22568 - RNA, 19 nt, Homo sapiens
ggaaaucaucuaucgguau

SEQ ID NO: 22569 - RNA, 19 nt, Homo sapiens
aacuaggacugaacuauuu

SEQ ID NO: 22570 - RNA, 19 nt, Homo sapiens
ggcaucaccugggaccuua

SEQ ID NO: 22571 - RNA, 19 nt, Homo sapiens
cuaaggcugugcugaagaa

SEQ ID NO: 22572 - RNA, 19 nt, Homo sapiens
gaacacauuuuacucuaga

SEQ ID NO: 22573 - RNA, 19 nt, Homo sapiens
ucaaagacucucuaaaugu

SEQ ID NO: 22574 - RNA, 19 nt, Homo sapiens
gucgagagaucacugaaau

SEQ ID NO: 22575 - RNA, 19 nt, Homo sapiens
caucaugcccagcuaauau

SEQ ID NO: 22576 - RNA, 19 nt, Homo sapiens
ggaucuagaugacuucaac

SEQ ID NO: 22577 - RNA, 19 nt, Homo sapiens
gcaaggagacagaacucaa

SEQ ID NO: 22578 - RNA, 19 nt, Homo sapiens
gaccagguuugccacuuug

SEQ ID NO: 22579 - RNA, 19 nt, Homo sapiens
ucgugagucuccacuauaa

SEQ ID NO: 22580 - RNA, 19 nt, Homo sapiens
gaagaagagcuggaagaga

SEQ ID NO: 22581 - RNA, 19 nt, Homo sapiens
gaggguuuccugucucuuu

SEQ ID NO: 22582 - RNA, 19 nt, Homo sapiens
agaguugacuuugagguuu

SEQ ID NO: 22583 - RNA, 19 nt, Homo sapiens
ggagggaggcacacuguuc

SEQ ID NO: 22584 - RNA, 19 nt, Homo sapiens
gcuggaaggaucuagauga

SEQ ID NO: 22585 - RNA, 19 nt, Homo sapiens
gcgauacacccuggaaauu

SEQ ID NO: 22586 - RNA, 19 nt, Homo sapiens
gguaccaguuucuuaaugg

SEQ ID NO: 22587 - RNA, 19 nt, Homo sapiens
aaggacggguuaauucuga

SEQ ID NO: 22588 - RNA, 19 nt, Homo sapiens
guccugggcucaaaugauc

SEQ ID NO: 22589 - RNA, 19 nt, Homo sapiens
gaccgaggguuuccugucu

SEQ ID NO: 22590 - RNA, 19 nt, Homo sapiens
ggguaccaguuucuuaaug

SEQ ID NO: 22591 - RNA, 19 nt, Homo sapiens
gagaguugacuuugagguu

SEQ ID NO: 22592 - RNA, 19 nt, Homo sapiens
agacaagagaguugacuuu

SEQ ID NO: 22593 - RNA, 19 nt, Homo sapiens
aaacuggaaggacggguua

SEQ ID NO: 22594 - RNA, 19 nt, Homo sapiens
cauauuacuccacaccuuu

SEQ ID NO: 22595 - RNA, 19 nt, Homo sapiens
ggaaggacggguuaauucu

SEQ ID NO: 22596 - RNA, 19 nt, Homo sapiens
gggaagaagagcuggaaga

SEQ ID NO: 22597 - RNA, 19 nt, Homo sapiens
cagcuggacugguacucuu

SEQ ID NO: 22598 - RNA, 19 nt, Homo sapiens
uggcugaggucauuguugu

SEQ ID NO: 22599 - RNA, 19 nt, Homo sapiens
gaguugacuuugagguuuc

SEQ ID NO: 22600 - RNA, 19 nt, Homo sapiens
gacaagagaguugacuuug

SEQ ID NO: 22601 - RNA, 19 nt, Homo sapiens
aggcugugcugaagaaguu

SEQ ID NO: 22602 - RNA, 19 nt, Homo sapiens
aaucgugagucuccacuau

SEQ ID NO: 22603 - RNA, 19 nt, Homo sapiens
cuugauggcugaggucauu

SEQ ID NO: 22604 - RNA, 19 nt, Homo sapiens
gaaggacggguuaauucug

SEQ ID NO: 22605 - RNA, 19 nt, Homo sapiens
gacagagucucacuuugac

SEQ ID NO: 22606 - RNA, 19 nt, Homo sapiens
gaccuggugucgagagauc

SEQ ID NO: 22607 - RNA, 19 nt, Homo sapiens
gaggcgcucugcucaccuu

SEQ ID NO: 22608 - RNA, 19 nt, Homo sapiens
aucaaagacucucuaaaug

SEQ ID NO: 22609 - RNA, 19 nt, Homo sapiens
gcacccagugaacacauuu

SEQ ID NO: 22610 - RNA, 19 nt, Homo sapiens
aaacaguguggccaucuaa

SEQ ID NO: 22611 - RNA, 19 nt, Homo sapiens
uggcugcccuggauaagga

SEQ ID NO: 22612 - RNA, 19 nt, Homo sapiens
ccagaaacaccgggaagaa

SEQ ID NO: 22613 - RNA, 19 nt, Homo sapiens
ggaagaagagcuggaagag

SEQ ID NO: 22614 - RNA, 19 nt, Homo sapiens
agaaacaccgggaagaaga

SEQ ID NO: 22615 - RNA, 19 nt, Homo sapiens
aggguuuccugucucuuua

SEQ ID NO: 22616 - RNA, 19 nt, Homo sapiens
gcuaucaaagacucucuaa

SEQ ID NO: 22617 - RNA, 19 nt, Homo sapiens
cgaccucgcuaucaaagac

SEQ ID NO: 22618 - RNA, 19 nt, Homo sapiens
uggcgacacugcccaacuu

SEQ ID NO: 22619 - RNA, 19 nt, Homo sapiens
ggaaguaccggaguaucug

SEQ ID NO: 22620 - RNA, 19 nt, Homo sapiens
gugagucuccacuauaaga

SEQ ID NO: 22621 - RNA, 19 nt, Homo sapiens
caagcuggagccuuccuaa

SEQ ID NO: 22622 - RNA, 19 nt, Homo sapiens
ugaggugccugccgucgau

SEQ ID NO: 22623 - RNA, 19 nt, Homo sapiens
cgucgccacccuuugguua

SEQ ID NO: 22624 - RNA, 19 nt, Homo sapiens
ggaaauugagauccggaau

SEQ ID NO: 22625 - RNA, 19 nt, Homo sapiens
acauauuacuccacaccuu

SEQ ID NO: 22626 - RNA, 19 nt, Homo sapiens
ggaccuuacuccucuuucc

SEQ ID NO: 22627 - RNA, 19 nt, Homo sapiens
aaauugagauccggaaugc

SEQ ID NO: 22628 - RNA, 19 nt, Homo sapiens
ggauaaggaaauugagauc

SEQ ID NO: 22629 - RNA, 19 nt, Homo sapiens
gcagacgccagcccguuau

SEQ ID NO: 22630 - RNA, 19 nt, Homo sapiens
ccaggcuucucuccagaug

SEQ ID NO: 22631 - RNA, 19 nt, Homo sapiens
ccaacgucauucucuguag

SEQ ID NO: 22632 - RNA, 19 nt, Homo sapiens
ucagaucuauauggcaaau

SEQ ID NO: 22633 - RNA, 19 nt, Homo sapiens
aaacggcaccuccuuaagg

SEQ ID NO: 22634 - RNA, 19 nt, Homo sapiens
gcucugggaaaucaucuau

SEQ ID NO: 22635 - RNA, 19 nt, Homo sapiens
cucuaaauguucugacuug

SEQ ID NO: 22636 - RNA, 19 nt, Homo sapiens
ggccgcugcuguuugugaa

SEQ ID NO: 22637 - RNA, 19 nt, Homo sapiens
uggaaggacggguuaauuc

SEQ ID NO: 22638 - RNA, 19 nt, Homo sapiens
augcaacgcuggagacagu

SEQ ID NO: 22639 - RNA, 19 nt, Homo sapiens
agacguggcugugaaagac

SEQ ID NO: 22640 - RNA, 19 nt, Homo sapiens
gaaacaccgggaagaagag

SEQ ID NO: 22641 - RNA, 19 nt, Homo sapiens
gcugcagucucaucuucug

SEQ ID NO: 22642 - RNA, 19 nt, Homo sapiens
caaggagacagaacucaag

SEQ ID NO: 22643 - RNA, 19 nt, Homo sapiens
gaagagcuggaagagagaa

SEQ ID NO: 22644 - RNA, 19 nt, Homo sapiens
uggccgaccucgcuaucaa

SEQ ID NO: 22645 - RNA, 19 nt, Homo sapiens
gaacucaagguggaaguac

SEQ ID NO: 22646 - RNA, 19 nt, Homo sapiens
gcgcaaacggcaccuccuu

SEQ ID NO: 22647 - RNA, 19 nt, Homo sapiens
ccacaucgcucuaggauaa

SEQ ID NO: 22648 - RNA, 19 nt, Homo sapiens
gaacagcgucuccaucuaa

SEQ ID NO: 22649 - RNA, 19 nt, Homo sapiens
gaacuauucucuccugugu

SEQ ID NO: 22650 - RNA, 19 nt, Homo sapiens
ugaagcagcugaacuauuc

SEQ ID NO: 22651 - RNA, 19 nt, Homo sapiens
gggaagcccuggugcagua

SEQ ID NO: 22652 - RNA, 19 nt, Homo sapiens
guagagagcuggacuuagg

SEQ ID NO: 22653 - RNA, 19 nt, Homo sapiens
ccaaaggccuggcaacaug

SEQ ID NO: 22654 - RNA, 19 nt, Homo sapiens
gcaggaggaugccuucuuc

SEQ ID NO: 22655 - RNA, 19 nt, Homo sapiens
ggaggagucugaaugagau

SEQ ID NO: 22656 - RNA, 19 nt, Homo sapiens
gagcccaccuugaggguuu

SEQ ID NO: 22657 - RNA, 19 nt, Homo sapiens
ccacuagcauccacugauu

SEQ ID NO: 22658 - RNA, 19 nt, Homo sapiens
gaugaugggaugcagauuu

SEQ ID NO: 22659 - RNA, 19 nt, Homo sapiens
ggacagaaccacugagucu

SEQ ID NO: 22660 - RNA, 19 nt, Homo sapiens
caaggagccuggagaccaa

SEQ ID NO: 22661 - RNA, 19 nt, Homo sapiens
gauacacccugcacaucaa

SEQ ID NO: 22662 - RNA, 19 nt, Homo sapiens
ggacagccaccaagaagug

SEQ ID NO: 22663 - RNA, 19 nt, Homo sapiens
cagcugagcacgcauuuga

SEQ ID NO: 22664 - RNA, 19 nt, Homo sapiens
ccacaggcaucggcauuga

SEQ ID NO: 22665 - RNA, 19 nt, Homo sapiens
gucacuaccucccaaagaa

SEQ ID NO: 22666 - RNA, 19 nt, Homo sapiens
gaacacaggcccagaugac

SEQ ID NO: 22667 - RNA, 19 nt, Homo sapiens
ggaacgcuuugucucugaa

SEQ ID NO: 22668 - RNA, 19 nt, Homo sapiens
ccaagaaugccaacuuuua

SEQ ID NO: 22669 - RNA, 19 nt, Homo sapiens
ggagcucaauaucaaauac

SEQ ID NO: 22670 - RNA, 19 nt, Homo sapiens
uagcgagacuccaccucua

SEQ ID NO: 22671 - RNA, 19 nt, Homo sapiens
ucucugaaaucaucgguau

SEQ ID NO: 22672 - RNA, 19 nt, Homo sapiens
gaaaucaucgguaucuacu

SEQ ID NO: 22673 - RNA, 19 nt, Homo sapiens
caugguggccucauuguug

SEQ ID NO: 22674 - RNA, 19 nt, Homo sapiens
aggcuucucugaguugaua

SEQ ID NO: 22675 - RNA, 19 nt, Homo sapiens
caaugacccugcuauacca

SEQ ID NO: 22676 - RNA, 19 nt, Homo sapiens
caaggacagccaccaagaa

SEQ ID NO: 22677 - RNA, 19 nt, Homo sapiens
ugaugagucuguccaagau

SEQ ID NO: 22678 - RNA, 19 nt, Homo sapiens
acagaaccacugagucuuu

SEQ ID NO: 22679 - RNA, 19 nt, Homo sapiens
acaugaagcagcugaacua

SEQ ID NO: 22680 - RNA, 19 nt, Homo sapiens
ucucaacccuguccugauc

SEQ ID NO: 22681 - RNA, 19 nt, Homo sapiens
gaagacuuggagcucaaua

SEQ ID NO: 22682 - RNA, 19 nt, Homo sapiens
agccaagaaugccaacuuu

SEQ ID NO: 22683 - RNA, 19 nt, Homo sapiens
cggaugagcacuucacaga

SEQ ID NO: 22684 - RNA, 19 nt, Homo sapiens
ccgaggaguugaagacauc

SEQ ID NO: 22685 - RNA, 19 nt, Homo sapiens
caggagagcucagguaucc

SEQ ID NO: 22686 - RNA, 19 nt, Homo sapiens
ugaaugagaugaaaaggau

SEQ ID NO: 22687 - RNA, 19 nt, Homo sapiens
cauuugaggucagaaguuc

SEQ ID NO: 22688 - RNA, 19 nt, Homo sapiens
gcagaaaaucuaccaagaa

SEQ ID NO: 22689 - RNA, 19 nt, Homo sapiens
ggaacacaggcccagauga

SEQ ID NO: 22690 - RNA, 19 nt, Homo sapiens
agaacagcgucuccaucua

SEQ ID NO: 22691 - RNA, 19 nt, Homo sapiens
aaucaucgguaucuacuac

SEQ ID NO: 22692 - RNA, 19 nt, Homo sapiens
acuuggagcucaauaucaa

SEQ ID NO: 22693 - RNA, 19 nt, Homo sapiens
caccauacacacacacaaa

SEQ ID NO: 22694 - RNA, 19 nt, Homo sapiens
gaaaaggaucuucaacuuc

SEQ ID NO: 22695 - RNA, 19 nt, Homo sapiens
gugaugagucuguccaaga

SEQ ID NO: 22696 - RNA, 19 nt, Homo sapiens
cgauacacccugcacauca

SEQ ID NO: 22697 - RNA, 19 nt, Homo sapiens
aaagacaguggaagacuug

SEQ ID NO: 22698 - RNA, 19 nt, Homo sapiens
gcaaugccgaguucuccuu

SEQ ID NO: 22699 - RNA, 19 nt, Homo sapiens
gcuaguugguuuuguuuug

SEQ ID NO: 22700 - RNA, 19 nt, Homo sapiens
caguuugacuccugugcuu

SEQ ID NO: 22701 - RNA, 19 nt, Homo sapiens
augaugggaugcagauuug

SEQ ID NO: 22702 - RNA, 19 nt, Homo sapiens
gagucugaaugagaugaaa

SEQ ID NO: 22703 - RNA, 19 nt, Homo sapiens
gaacgcuuugucucugaaa

SEQ ID NO: 22704 - RNA, 19 nt, Homo sapiens
ucaaggacagccaccaaga

SEQ ID NO: 22705 - RNA, 19 nt, Homo sapiens
gaccacaucgcucuaggau

SEQ ID NO: 22706 - RNA, 19 nt, Homo sapiens
cccauaaucccagcacuuu

SEQ ID NO: 22707 - RNA, 19 nt, Homo sapiens
ccacugauuggaccuuaug

SEQ ID NO: 22708 - RNA, 19 nt, Homo sapiens
ccaagggcuuccuaaacca

SEQ ID NO: 22709 - RNA, 19 nt, Homo sapiens
gcaguggaacgcuuugucu

SEQ ID NO: 22710 - RNA, 19 nt, Homo sapiens
gaacaugaagcagcugaac

SEQ ID NO: 22711 - RNA, 19 nt, Homo sapiens
ccaucuuccugcccacuga

SEQ ID NO: 22712 - RNA, 19 nt, Homo sapiens
uggaacgcuuugucucuga

SEQ ID NO: 22713 - RNA, 19 nt, Homo sapiens
gaagacaucccaggcuacu

SEQ ID NO: 22714 - RNA, 19 nt, Homo sapiens
ccacugccacccucucuuc

SEQ ID NO: 22715 - RNA, 19 nt, Homo sapiens
cauaaucccagcacuuugg

SEQ ID NO: 22716 - RNA, 19 nt, Homo sapiens
gaaaaucuaccaagaacag

SEQ ID NO: 22717 - RNA, 19 nt, Homo sapiens
agagaaagcagaaaaucua

SEQ ID NO: 22718 - RNA, 19 nt, Homo sapiens
cagcgucuccaucuaaauc

SEQ ID NO: 22719 - RNA, 19 nt, Homo sapiens
aacagcgucuccaucuaaa

SEQ ID NO: 22720 - RNA, 19 nt, Homo sapiens
ccguagagagcuggacuua

SEQ ID NO: 22721 - RNA, 19 nt, Homo sapiens
uggaagacuuggagcucaa

SEQ ID NO: 22722 - RNA, 19 nt, Homo sapiens
acuauucucuccugugucu

SEQ ID NO: 22723 - RNA, 19 nt, Homo sapiens
ugauacagaggaacaugaa

SEQ ID NO: 22724 - RNA, 19 nt, Homo sapiens
agacuccaccucuaccaaa

SEQ ID NO: 22725 - RNA, 19 nt, Homo sapiens
aaacagagaaagcagaaaa

SEQ ID NO: 22726 - RNA, 19 nt, Homo sapiens
uggacaaucucggcaagga

SEQ ID NO: 22727 - RNA, 19 nt, Homo sapiens
ggugcgcaaugccgaguuc

SEQ ID NO: 22728 - RNA, 19 nt, Homo sapiens
cagccaagaaugccaacuu

SEQ ID NO: 22729 - RNA, 19 nt, Homo sapiens
ccaccaccauacacacaca

SEQ ID NO: 22730 - RNA, 19 nt, Homo sapiens
gggaacacaggcccagaug

SEQ ID NO: 22731 - RNA, 19 nt, Homo sapiens
augagucuguccaagauga

SEQ ID NO: 22732 - RNA, 19 nt, Homo sapiens
ugaaaucaucgguaucuac

SEQ ID NO: 22733 - RNA, 19 nt, Homo sapiens
ggagucugaaugagaugaa

SEQ ID NO: 22734 - RNA, 19 nt, Homo sapiens
cagaaaaucuaccaagaac

SEQ ID NO: 22735 - RNA, 19 nt, Homo sapiens
caagaaugccaacuuuuau

SEQ ID NO: 22736 - RNA, 19 nt, Homo sapiens
ggaacaugaagcagcugaa

SEQ ID NO: 22737 - RNA, 19 nt, Homo sapiens
gagacuccaccucuaccaa

SEQ ID NO: 22738 - RNA, 19 nt, Homo sapiens
gcccauaaucccagcacuu

SEQ ID NO: 22739 - RNA, 19 nt, Homo sapiens
gucaaugccacaugugaug

SEQ ID NO: 22740 - RNA, 19 nt, Homo sapiens
cuacccaagugaugagucu

SEQ ID NO: 22741 - RNA, 19 nt, Homo sapiens
uggaggagucugaaugaga

SEQ ID NO: 22742 - RNA, 19 nt, Homo sapiens
caguggcucaugcccauaa

SEQ ID NO: 22743 - RNA, 19 nt, Homo sapiens
aacaugcgagggcuucaua

SEQ ID NO: 22744 - RNA, 19 nt, Homo sapiens
gacuuggagcucaauauca

SEQ ID NO: 22745 - RNA, 19 nt, Homo sapiens
ccaaugacccugcuauacc

SEQ ID NO: 22746 - RNA, 19 nt, Homo sapiens
cuucuucgccucccaguuc

SEQ ID NO: 22747 - RNA, 19 nt, Homo sapiens
gggcauagauuucucaaca

SEQ ID NO: 22748 - RNA, 19 nt, Homo sapiens
ggagacaaagcaauaauaa

SEQ ID NO: 22749 - RNA, 19 nt, Homo sapiens
ccacucagcucaucuccaa

SEQ ID NO: 22750 - RNA, 19 nt, Homo sapiens
gcagaagaauggcaaacug

SEQ ID NO: 22751 - RNA, 19 nt, Homo sapiens
gaaccgcacugagcucaug

SEQ ID NO: 22752 - RNA, 19 nt, Homo sapiens
gcauagauuucucaacaag

SEQ ID NO: 22753 - RNA, 19 nt, Homo sapiens
gcgaagacguggcgguguu

SEQ ID NO: 22754 - RNA, 19 nt, Homo sapiens
gagcugagccugggacuuc

SEQ ID NO: 22755 - RNA, 19 nt, Homo sapiens
ccuaggagacaaagcaaua

SEQ ID NO: 22756 - RNA, 19 nt, Homo sapiens
caagcaagcaggaaaguca

SEQ ID NO: 22757 - RNA, 19 nt, Homo sapiens
ucacugaggcggucauguu

SEQ ID NO: 22758 - RNA, 19 nt, Homo sapiens
uccagaaggucgccaagaa

SEQ ID NO: 22759 - RNA, 19 nt, Homo sapiens
ccggagacacgaaauauga

SEQ ID NO: 22760 - RNA, 19 nt, Homo sapiens
gccaggacaucgccacuca

SEQ ID NO: 22761 - RNA, 19 nt, Homo sapiens
caaggucuccauucuccua

SEQ ID NO: 22762 - RNA, 19 nt, Homo sapiens
cacccugccucuauccuaa

SEQ ID NO: 22763 - RNA, 19 nt, Homo sapiens
cccagagacugcagauuug

SEQ ID NO: 22764 - RNA, 19 nt, Homo sapiens
gcaaggcucaggacagcaa

SEQ ID NO: 22765 - RNA, 19 nt, Homo sapiens
aggaauggcuggcaaagca

SEQ ID NO: 22766 - RNA, 19 nt, Homo sapiens
auagauuucucaacaagga

SEQ ID NO: 22767 - RNA, 19 nt, Homo sapiens
gaccuucaccuccuagaga

SEQ ID NO: 22768 - RNA, 19 nt, Homo sapiens
cauacaauguggacagaca

SEQ ID NO: 22769 - RNA, 19 nt, Homo sapiens
ggcauagauuucucaacaa

SEQ ID NO: 22770 - RNA, 19 nt, Homo sapiens
ucccaugucuucuccuuug

SEQ ID NO: 22771 - RNA, 19 nt, Homo sapiens
gcaagcaggaaagucagua

SEQ ID NO: 22772 - RNA, 19 nt, Homo sapiens
ggagacacgaaauaugaga

SEQ ID NO: 22773 - RNA, 19 nt, Homo sapiens
gcugaccacucccaugucu

SEQ ID NO: 22774 - RNA, 19 nt, Homo sapiens
ggacauugacgugauccuu

SEQ ID NO: 22775 - RNA, 19 nt, Homo sapiens
ggucuccauucuccuagga

SEQ ID NO: 22776 - RNA, 19 nt, Homo sapiens
ggacaccugaagaagagaa

SEQ ID NO: 22777 - RNA, 19 nt, Homo sapiens
gaugccagccagaauggaa

SEQ ID NO: 22778 - RNA, 19 nt, Homo sapiens
gaaccgcaacugguacuca

SEQ ID NO: 22779 - RNA, 19 nt, Homo sapiens
gcaggagcagagcuucgua

SEQ ID NO: 22780 - RNA, 19 nt, Homo sapiens
uaaaagguguuagacaaug

SEQ ID NO: 22781 - RNA, 19 nt, Homo sapiens
gggccaagcaagcaggaaa

SEQ ID NO: 22782 - RNA, 19 nt, Homo sapiens
aggagacaaagcaauaaua

SEQ ID NO: 22783 - RNA, 19 nt, Homo sapiens
caacacgacacgcggcaau

SEQ ID NO: 22784 - RNA, 19 nt, Homo sapiens
cgaccagacgugaaugaga

SEQ ID NO: 22785 - RNA, 19 nt, Homo sapiens
ugaccacucccaugucuuc

SEQ ID NO: 22786 - RNA, 19 nt, Homo sapiens
caagucacagccacucaga

SEQ ID NO: 22787 - RNA, 19 nt, Homo sapiens
guuggaccuucaccuccua

SEQ ID NO: 22788 - RNA, 19 nt, Homo sapiens
ggaggccgcaaguacaugu

SEQ ID NO: 22789 - RNA, 19 nt, Homo sapiens
gcaccuacgcacacacagu

SEQ ID NO: 22790 - RNA, 19 nt, Homo sapiens
gacaauaaagggaccaaaa

SEQ ID NO: 22791 - RNA, 19 nt, Homo sapiens
gcgagggagcuccaucuuc

SEQ ID NO: 22792 - RNA, 19 nt, Homo sapiens
cauguucgacgacgccauu

SEQ ID NO: 22793 - RNA, 19 nt, Homo sapiens
gcccggagacacgaaauau

SEQ ID NO: 22794 - RNA, 19 nt, Homo sapiens
ccacccugccucuauccua

SEQ ID NO: 22795 - RNA, 19 nt, Homo sapiens
ggccgcaaguacauguuuc

SEQ ID NO: 22796 - RNA, 19 nt, Homo sapiens
cuaggagacaaagcaauaa

SEQ ID NO: 22797 - RNA, 19 nt, Homo sapiens
gaagacguggcgguguuug

SEQ ID NO: 22798 - RNA, 19 nt, Homo sapiens
cgaagacguggcgguguuu

SEQ ID NO: 22799 - RNA, 19 nt, Homo sapiens
ccuggaugcugccaagaag

SEQ ID NO: 22800 - RNA, 19 nt, Homo sapiens
gggcuacguguucaacuca

SEQ ID NO: 22801 - RNA, 19 nt, Homo sapiens
gcaaagccuacacguccau

SEQ ID NO: 22802 - RNA, 19 nt, Homo sapiens
cauggacauugacgugauc

SEQ ID NO: 22803 - RNA, 19 nt, Homo sapiens
agucacagccacucagaug

SEQ ID NO: 22804 - RNA, 19 nt, Homo sapiens
acauggacauugacgugau

SEQ ID NO: 22805 - RNA, 19 nt, Homo sapiens
acacgacacgcggcaauga

SEQ ID NO: 22806 - RNA, 19 nt, Homo sapiens
cuucaccuccuagagauaa

SEQ ID NO: 22807 - RNA, 19 nt, Homo sapiens
caucgccacucagcucauc

SEQ ID NO: 22808 - RNA, 19 nt, Homo sapiens
aaacugauguggaguauga

SEQ ID NO: 22809 - RNA, 19 nt, Homo sapiens
gaacaucaguuaacaucug

SEQ ID NO: 22810 - RNA, 19 nt, Homo sapiens
ugaagcgacucuccuguuu

SEQ ID NO: 22811 - RNA, 19 nt, Homo sapiens
cuaagaaugucaucauguu

SEQ ID NO: 22812 - RNA, 19 nt, Homo sapiens
ggacuaugcucacaacaac

SEQ ID NO: 22813 - RNA, 19 nt, Homo sapiens
ccuaccagcucaugcauaa

SEQ ID NO: 22814 - RNA, 19 nt, Homo sapiens
ggaaaucugugggcauugu

SEQ ID NO: 22815 - RNA, 19 nt, Homo sapiens
gcaccaugauuucaccauu

SEQ ID NO: 22816 - RNA, 19 nt, Homo sapiens
caagagacacugaaauaug

SEQ ID NO: 22817 - RNA, 19 nt, Homo sapiens
gcaagagacacugaaauau

SEQ ID NO: 22818 - RNA, 19 nt, Homo sapiens
gcaccugccuuacuaacuc

SEQ ID NO: 22819 - RNA, 19 nt, Homo sapiens
caaggacgcugggaaaucu

SEQ ID NO: 22820 - RNA, 19 nt, Homo sapiens
gcaaugggccuggcuacaa

SEQ ID NO: 22821 - RNA, 19 nt, Homo sapiens
guaugagagugacgagaaa

SEQ ID NO: 22822 - RNA, 19 nt, Homo sapiens
guaaggacaucgccuacca

SEQ ID NO: 22823 - RNA, 19 nt, Homo sapiens
cgcaagagacacugaaaua

SEQ ID NO: 22824 - RNA, 19 nt, Homo sapiens
gauuucaccauucuuagua

SEQ ID NO: 22825 - RNA, 19 nt, Homo sapiens
acaccaacguggcuaagaa

SEQ ID NO: 22826 - RNA, 19 nt, Homo sapiens
caugauuucaccauucuua

SEQ ID NO: 22827 - RNA, 19 nt, Homo sapiens
ccacgucgauugcaucucu

SEQ ID NO: 22828 - RNA, 19 nt, Homo sapiens
gcgcaggauuggaacauca

SEQ ID NO: 22829 - RNA, 19 nt, Homo sapiens
ggcuggagauggacaaguu

SEQ ID NO: 22830 - RNA, 19 nt, Homo sapiens
gaaauaugcccuggagcuu

SEQ ID NO: 22831 - RNA, 19 nt, Homo sapiens
aguacgagcugaacaggaa

SEQ ID NO: 22832 - RNA, 19 nt, Homo sapiens
gauacaagcacucccacuu

SEQ ID NO: 22833 - RNA, 19 nt, Homo sapiens
caacguggcuaagaauguc

SEQ ID NO: 22834 - RNA, 19 nt, Homo sapiens
gaucugacccucccagucu

SEQ ID NO: 22835 - RNA, 19 nt, Homo sapiens
cgugacagaugccaacuuc

SEQ ID NO: 22836 - RNA, 19 nt, Homo sapiens
ggacauugacgugaucaug

SEQ ID NO: 22837 - RNA, 19 nt, Homo sapiens
ucucaaagccucuuauuuu

SEQ ID NO: 22838 - RNA, 19 nt, Homo sapiens
caaugggccuggcuacaag

SEQ ID NO: 22839 - RNA, 19 nt, Homo sapiens
cguggcaacucuaucuuug

SEQ ID NO: 22840 - RNA, 19 nt, Homo sapiens
gaagcgacucuccuguuug

SEQ ID NO: 22841 - RNA, 19 nt, Homo sapiens
uacaagcacucccacuuca

SEQ ID NO: 22842 - RNA, 19 nt, Homo sapiens
gcucugcgcaggauuggaa

SEQ ID NO: 22843 - RNA, 19 nt, Homo sapiens
guacucagacaacgagaug

SEQ ID NO: 22844 - RNA, 19 nt, Homo sapiens
aagagacacugaaauaugc

SEQ ID NO: 22845 - RNA, 19 nt, Homo sapiens
gguggaaggaggcagaauu

SEQ ID NO: 22846 - RNA, 19 nt, Homo sapiens
ugggaaaucugugggcauu

SEQ ID NO: 22847 - RNA, 19 nt, Homo sapiens
gcuaagaaugucaucaugu

SEQ ID NO: 22848 - RNA, 19 nt, Homo sapiens
caccaugauuucaccauuc

SEQ ID NO: 22849 - RNA, 19 nt, Homo sapiens
cacgccagcuccucucuga

SEQ ID NO: 22850 - RNA, 19 nt, Homo sapiens
ggauuggaacaucaguuaa

SEQ ID NO: 22851 - RNA, 19 nt, Homo sapiens
ggaugggugucuccacagu

SEQ ID NO: 22852 - RNA, 19 nt, Homo sapiens
uucagaagcucaacaccaa

SEQ ID NO: 22853 - RNA, 19 nt, Homo sapiens
ucccacgucuucacauuug

SEQ ID NO: 22854 - RNA, 19 nt, Homo sapiens
aggauuggaacaucaguua

SEQ ID NO: 22855 - RNA, 19 nt, Homo sapiens
ggcuaagaaugucaucaug

SEQ ID NO: 22856 - RNA, 19 nt, Homo sapiens
aauaugcccuggagcuuca

SEQ ID NO: 22857 - RNA, 19 nt, Homo sapiens
aguacagacugcagacauu

SEQ ID NO: 22858 - RNA, 19 nt, Homo sapiens
ggaccauucccacgucuuc

SEQ ID NO: 22859 - RNA, 19 nt, Homo sapiens
ucacacuccugggcucuga

SEQ ID NO: 22860 - RNA, 19 nt, Homo sapiens
ggaaggaggcagaauugac

SEQ ID NO: 22861 - RNA, 19 nt, Homo sapiens
guggaaggaggcagaauug

SEQ ID NO: 22862 - RNA, 19 nt, Homo sapiens
ucagggacauugacgugau

SEQ ID NO: 22863 - RNA, 19 nt, Homo sapiens
gcgacucuccuguuuggaa

SEQ ID NO: 22864 - RNA, 19 nt, Homo sapiens
cauaacaucagggacauug

SEQ ID NO: 22865 - RNA, 19 nt, Homo sapiens
ggccaaggacgcugggaaa

SEQ ID NO: 22866 - RNA, 19 nt, Homo sapiens
ugagugacacagacaagaa

SEQ ID NO: 22867 - RNA, 19 nt, Homo sapiens
ggacugguacucagacaac

SEQ ID NO: 22868 - RNA, 19 nt, Homo sapiens
aagcgacucuccuguuugg

SEQ ID NO: 22869 - RNA, 19 nt, Homo sapiens
cggaacuccugacccuuga

SEQ ID NO: 22870 - RNA, 19 nt, Homo sapiens
gcggugaacgagagaaugu

SEQ ID NO: 22871 - RNA, 19 nt, Homo sapiens
ccacgggcaccaugaagga

SEQ ID NO: 22872 - RNA, 19 nt, Homo sapiens
ccaaaggcuucuucuugcu

SEQ ID NO: 22873 - RNA, 19 nt, Homo sapiens
gcgcaagagacacugaaau

SEQ ID NO: 22874 - RNA, 19 nt, Homo sapiens
cguggaacauuguggaucu

SEQ ID NO: 22875 - RNA, 19 nt, Homo sapiens
cugcagacauucucaaagc

SEQ ID NO: 22876 - RNA, 19 nt, Homo sapiens
guacagacugcagacauuc

SEQ ID NO: 22877 - RNA, 19 nt, Homo sapiens
caagcacucccacuucauc

SEQ ID NO: 22878 - RNA, 19 nt, Homo sapiens
ccugggcucugaacacaca

SEQ ID NO: 22879 - RNA, 19 nt, Homo sapiens
aagccuccguggaacauug

SEQ ID NO: 22880 - RNA, 19 nt, Homo sapiens
cugccuuacuaacuccuua

SEQ ID NO: 22881 - RNA, 19 nt, Homo sapiens
ccaacguggcuaagaaugu

SEQ ID NO: 22882 - RNA, 19 nt, Homo sapiens
gcccuacaaugcucauguc

SEQ ID NO: 22883 - RNA, 19 nt, Homo sapiens
ccacaagcccgugacagau

SEQ ID NO: 22884 - RNA, 19 nt, Homo sapiens
uggcaacucuaucuuuggu

SEQ ID NO: 22885 - RNA, 19 nt, Homo sapiens
ccagugcucugcgcaggau

SEQ ID NO: 22886 - RNA, 19 nt, Homo sapiens
ccaaggacgcugggaaauc

SEQ ID NO: 22887 - RNA, 19 nt, Homo sapiens
ggacccaggaaaccaaagu

SEQ ID NO: 22888 - RNA, 19 nt, Homo sapiens
gguggacuaugcucacaac

SEQ ID NO: 22889 - RNA, 19 nt, Homo sapiens
agaccaagcgcaagagaca

SEQ ID NO: 22890 - RNA, 19 nt, Homo sapiens
agggucagcuccaccacaa

SEQ ID NO: 22891 - RNA, 19 nt, Homo sapiens
uaagaaugucaucauguuc

SEQ ID NO: 22892 - RNA, 19 nt, Homo sapiens
gaguacagacugcagacau

SEQ ID NO: 22893 - RNA, 19 nt, Homo sapiens
acuaugcucacaacaacua

SEQ ID NO: 22894 - RNA, 19 nt, Homo sapiens
gagcguucccggugcaaca

SEQ ID NO: 22895 - RNA, 19 nt, Homo sapiens
gauuggaacaucaguuaac

SEQ ID NO: 22896 - RNA, 19 nt, Homo sapiens
uaaaagggaacacaaaaca

SEQ ID NO: 22897 - RNA, 19 nt, Homo sapiens
gacugcagacauucucaaa

SEQ ID NO: 22898 - RNA, 19 nt, Homo sapiens
gcaugaggcgguggagaug

SEQ ID NO: 22899 - RNA, 19 nt, Homo sapiens
acauguaccccaagaauaa

SEQ ID NO: 22900 - RNA, 19 nt, Homo sapiens
gaaaucugugggcauugug

SEQ ID NO: 22901 - RNA, 19 nt, Homo sapiens
ccacccacgucgauugcau

SEQ ID NO: 22902 - RNA, 19 nt, Homo sapiens
cacaagcccgugacagaug

SEQ ID NO: 22903 - RNA, 19 nt, Homo sapiens
ccaagacguacaacaccaa

SEQ ID NO: 22904 - RNA, 19 nt, Homo sapiens
augggugucuccacaguga

SEQ ID NO: 22905 - RNA, 19 nt, Homo sapiens
aaagggaacacaaaacauu

SEQ ID NO: 22906 - RNA, 19 nt, Homo sapiens
ccaccaggguagauuucuc

SEQ ID NO: 22907 - RNA, 19 nt, Homo sapiens
cccacaagcccgugacaga

SEQ ID NO: 22908 - RNA, 19 nt, Homo sapiens
gggcauagauuucucaaga

SEQ ID NO: 22909 - RNA, 19 nt, Homo sapiens
ggagacaaagcaauaauaa

SEQ ID NO: 22910 - RNA, 19 nt, Homo sapiens
gaucuuugcuucaguccuu

SEQ ID NO: 22911 - RNA, 19 nt, Homo sapiens
gaaccgcacugagcucaug

SEQ ID NO: 22912 - RNA, 19 nt, Homo sapiens
cuacgcagcucaucuccaa

SEQ ID NO: 22913 - RNA, 19 nt, Homo sapiens
gggagacaaagcaauaaua

SEQ ID NO: 22914 - RNA, 19 nt, Homo sapiens
ggacacugggcauagauuu

SEQ ID NO: 22915 - RNA, 19 nt, Homo sapiens
gaagucagugggaguggua

SEQ ID NO: 22916 - RNA, 19 nt, Homo sapiens
gcagugagccgaggucaug

SEQ ID NO: 22917 - RNA, 19 nt, Homo sapiens
ugacugagacgaucauguu

SEQ ID NO: 22918 - RNA, 19 nt, Homo sapiens
caagaaagcagggaaguca

SEQ ID NO: 22919 - RNA, 19 nt, Homo sapiens
ggacauugacgugauccua

SEQ ID NO: 22920 - RNA, 19 nt, Homo sapiens
cggaaacgguccaggcuau

SEQ ID NO: 22921 - RNA, 19 nt, Homo sapiens
ccuacacgguccuccuaua

SEQ ID NO: 22922 - RNA, 19 nt, Homo sapiens
gccaagaaccucaucaucu

SEQ ID NO: 22923 - RNA, 19 nt, Homo sapiens
cagagguccugccauggaa

SEQ ID NO: 22924 - RNA, 19 nt, Homo sapiens
gcaggagcagaccuucaua

SEQ ID NO: 22925 - RNA, 19 nt, Homo sapiens
gcacagacagccgccaaga

SEQ ID NO: 22926 - RNA, 19 nt, Homo sapiens
ugaaucaccugugggacuu

SEQ ID NO: 22927 - RNA, 19 nt, Homo sapiens
gggccgaaaguacauguuu

SEQ ID NO: 22928 - RNA, 19 nt, Homo sapiens
ccugggagacaaagcaaua

SEQ ID NO: 22929 - RNA, 19 nt, Homo sapiens
gaaacgguccaggcuaugu

SEQ ID NO: 22930 - RNA, 19 nt, Homo sapiens
gcagaagaaggacaaacug

SEQ ID NO: 22931 - RNA, 19 nt, Homo sapiens
uggagaccauccuggcuaa

SEQ ID NO: 22932 - RNA, 19 nt, Homo sapiens
caggcuaugugcucaagga

SEQ ID NO: 22933 - RNA, 19 nt, Homo sapiens
cuucauagcgcacgucaug

SEQ ID NO: 22934 - RNA, 19 nt, Homo sapiens
gcaggauaaucgcuugaac

SEQ ID NO: 22935 - RNA, 19 nt, Homo sapiens
aaaggaaguguuuguaauc

SEQ ID NO: 22936 - RNA, 19 nt, Homo sapiens
cuggagacaugaaauacga

SEQ ID NO: 22937 - RNA, 19 nt, Homo sapiens
ggaggcugaagcaggauaa

SEQ ID NO: 22938 - RNA, 19 nt, Homo sapiens
ugaugaaucgggccaagaa

SEQ ID NO: 22939 - RNA, 19 nt, Homo sapiens
ggugaaaccccuuaucuau

SEQ ID NO: 22940 - RNA, 19 nt, Homo sapiens
gcacugacugagacgauca

SEQ ID NO: 22941 - RNA, 19 nt, Homo sapiens
uaaaagggcagaagaagga

SEQ ID NO: 22942 - RNA, 19 nt, Homo sapiens
agaaucuggugcaggaaug

SEQ ID NO: 22943 - RNA, 19 nt, Homo sapiens
gcgagauucugccucaaaa

SEQ ID NO: 22944 - RNA, 19 nt, Homo sapiens
cugcugcccuccagacaug

SEQ ID NO: 22945 - RNA, 19 nt, Homo sapiens
cgaccacucccacgucuuc

SEQ ID NO: 22946 - RNA, 19 nt, Homo sapiens
gaugaaucgggccaagaaa

SEQ ID NO: 22947 - RNA, 19 nt, Homo sapiens
caacuucucagacguucca

SEQ ID NO: 22948 - RNA, 19 nt, Homo sapiens
gcgagggagcuccaucuuc

SEQ ID NO: 22949 - RNA, 19 nt, Homo sapiens
cauguucgacgacgccauu

SEQ ID NO: 22950 - RNA, 19 nt, Homo sapiens
gacccugaguacccagaug

SEQ ID NO: 22951 - RNA, 19 nt, Homo sapiens
gagaccauccuggcuaaca

SEQ ID NO: 22952 - RNA, 19 nt, Homo sapiens
ccagaccauuggcuugagu

SEQ ID NO: 22953 - RNA, 19 nt, Homo sapiens
caucuggacacugggcaua

SEQ ID NO: 22954 - RNA, 19 nt, Homo sapiens
acagagguccugccaugga

SEQ ID NO: 22955 - RNA, 19 nt, Homo sapiens
ggaaacgguccaggcuaug

SEQ ID NO: 22956 - RNA, 19 nt, Homo sapiens
cugagacgaucauguucga

SEQ ID NO: 22957 - RNA, 19 nt, Homo sapiens
cugaguacccagaugacua

SEQ ID NO: 22958 - RNA, 19 nt, Homo sapiens
gagcgagauucugccucaa

SEQ ID NO: 22959 - RNA, 19 nt, Homo sapiens
ggccuacacgguccuccua

SEQ ID NO: 22960 - RNA, 19 nt, Homo sapiens
agacaugaaauacgagauc

SEQ ID NO: 22961 - RNA, 19 nt, Homo sapiens
cauggacauugacgugauc

SEQ ID NO: 22962 - RNA, 19 nt, Homo sapiens
gcagcucaucuccaacaug

SEQ ID NO: 22963 - RNA, 19 nt, Homo sapiens
ggcagaagaaggacaaacu

SEQ ID NO: 22964 - RNA, 19 nt, Homo sapiens
ugaaaccccuuaucuaugc

SEQ ID NO: 22965 - RNA, 19 nt, Homo sapiens
ggaggagaacccggacuuc

SEQ ID NO: 22966 - RNA, 19 nt, Homo sapiens
caaaucucaacuucucaga

SEQ ID NO: 22967 - RNA, 19 nt, Homo sapiens
acagacagccgccaagaac

SEQ ID NO: 22968 - RNA, 19 nt, Homo sapiens
acauggacauugacgugau

SEQ ID NO: 22969 - RNA, 19 nt, Homo sapiens
gacacugggcauagauuuc

SEQ ID NO: 22970 - RNA, 19 nt, Homo sapiens
cccagggacugcagguugu

SEQ ID NO: 22971 - RNA, 19 nt, Homo sapiens
ggaccgcuucccauaugug

SEQ ID NO: 22972 - RNA, 19 nt, Homo sapiens
caaacuggggccugagaua

SEQ ID NO: 22973 - RNA, 19 nt, Homo sapiens
caagaaagcaggaaaguca

SEQ ID NO: 22974 - RNA, 19 nt, Homo sapiens
ccacgcagcucaucuccaa

SEQ ID NO: 22975 - RNA, 19 nt, Homo sapiens
cagcaaggaagacucauua

SEQ ID NO: 22976 - RNA, 19 nt, Homo sapiens
ccacugggcuaauucuaca

SEQ ID NO: 22977 - RNA, 19 nt, Homo sapiens
ugacugagacgaucauguu

SEQ ID NO: 22978 - RNA, 19 nt, Homo sapiens
gggaaacacaaagcaauaa

SEQ ID NO: 22979 - RNA, 19 nt, Homo sapiens
cggaaacgguccaggcuau

SEQ ID NO: 22980 - RNA, 19 nt, Homo sapiens
ggaaacacaaagcaauaau

SEQ ID NO: 22981 - RNA, 19 nt, Homo sapiens
ccuacacgguccuccuaua

SEQ ID NO: 22982 - RNA, 19 nt, Homo sapiens
gccaagaaccucaucaucu

SEQ ID NO: 22983 - RNA, 19 nt, Homo sapiens
ugcuuuaucuugcucuuaa

SEQ ID NO: 22984 - RNA, 19 nt, Homo sapiens
caccacgcccuuugcuuua

SEQ ID NO: 22985 - RNA, 19 nt, Homo sapiens
agacuguccugccauggaa

SEQ ID NO: 22986 - RNA, 19 nt, Homo sapiens
gcaggagcagaccuucaua

SEQ ID NO: 22987 - RNA, 19 nt, Homo sapiens
gcacagacagccgccaaga

SEQ ID NO: 22988 - RNA, 19 nt, Homo sapiens
aggaauggcuggcgaagca

SEQ ID NO: 22989 - RNA, 19 nt, Homo sapiens
acaccacgcccuuugcuuu

SEQ ID NO: 22990 - RNA, 19 nt, Homo sapiens
ucacagccacucagauguu

SEQ ID NO: 22991 - RNA, 19 nt, Homo sapiens
gaaacgguccaggcuaugu

SEQ ID NO: 22992 - RNA, 19 nt, Homo sapiens
gcagaagaaggacaaacug

SEQ ID NO: 22993 - RNA, 19 nt, Homo sapiens
ggacaugaggcacccauac

SEQ ID NO: 22994 - RNA, 19 nt, Homo sapiens
caggcuaugugcucaagga

SEQ ID NO: 22995 - RNA, 19 nt, Homo sapiens
ugggaaacacaaagcaaua

SEQ ID NO: 22996 - RNA, 19 nt, Homo sapiens
caggauagcaguccagagu

SEQ ID NO: 22997 - RNA, 19 nt, Homo sapiens
cuucauagcgcacgucaug

SEQ ID NO: 22998 - RNA, 19 nt, Homo sapiens
cuggagacaugaaauacga

SEQ ID NO: 22999 - RNA, 19 nt, Homo sapiens
caaggaagacucauuaccu

SEQ ID NO: 23000 - RNA, 19 nt, Homo sapiens
ggucaucuccguggugaau

SEQ ID NO: 23001 - RNA, 19 nt, Homo sapiens
gcacugacugagacgauca

SEQ ID NO: 23002 - RNA, 19 nt, Homo sapiens
uaaaagggcagaagaagga

SEQ ID NO: 23003 - RNA, 19 nt, Homo sapiens
agaaucuggugcaggaaug

SEQ ID NO: 23004 - RNA, 19 nt, Homo sapiens
cgaccacucccacgucuuc

SEQ ID NO: 23005 - RNA, 19 nt, Homo sapiens
ccuccauucuucugggaaa

SEQ ID NO: 23006 - RNA, 19 nt, Homo sapiens
ggcauggauuucucagcaa

SEQ ID NO: 23007 - RNA, 19 nt, Homo sapiens
caugaggcacccauaccua

SEQ ID NO: 23008 - RNA, 19 nt, Homo sapiens
caagucacagccacucaga

SEQ ID NO: 23009 - RNA, 19 nt, Homo sapiens
aaagucagugggaguggua

SEQ ID NO: 23010 - RNA, 19 nt, Homo sapiens
ccacgcccuuugcuuuauc

SEQ ID NO: 23011 - RNA, 19 nt, Homo sapiens
gcgagggagcuccaucuuc

SEQ ID NO: 23012 - RNA, 19 nt, Homo sapiens
cauguucgacgacgccauu

SEQ ID NO: 23013 - RNA, 19 nt, Homo sapiens
gacccugaguacccagaug

SEQ ID NO: 23014 - RNA, 19 nt, Homo sapiens
gguggaggccgaaaguaca

SEQ ID NO: 23015 - RNA, 19 nt, Homo sapiens
ccagaccauuggcuugagu

SEQ ID NO: 23016 - RNA, 19 nt, Homo sapiens
ggaaacgguccaggcuaug

SEQ ID NO: 23017 - RNA, 19 nt, Homo sapiens
cugagacgaucauguucga

SEQ ID NO: 23018 - RNA, 19 nt, Homo sapiens
cugaguacccagaugacua

SEQ ID NO: 23019 - RNA, 19 nt, Homo sapiens
ggccuacacgguccuccua

SEQ ID NO: 23020 - RNA, 19 nt, Homo sapiens
agacaugaaauacgagauc

SEQ ID NO: 23021 - RNA, 19 nt, Homo sapiens
gcagcucaucuccaacaug

SEQ ID NO: 23022 - RNA, 19 nt, Homo sapiens
gggccaagaaagcaggaaa

SEQ ID NO: 23023 - RNA, 19 nt, Homo sapiens
ucagcaaggaagacucauu

SEQ ID NO: 23024 - RNA, 19 nt, Homo sapiens
agucacagccacucagaug

SEQ ID NO: 23025 - RNA, 19 nt, Homo sapiens
gaggcacccauaccuagga

SEQ ID NO: 23026 - RNA, 19 nt, Homo sapiens
acagacagccgccaagaac

SEQ ID NO: 23027 - RNA, 19 nt, Homo sapiens
ggaggagaacccggacuuc

SEQ ID NO: 23028 - RNA, 19 nt, Homo sapiens
ggcagaagaaggacaaacu

SEQ ID NO: 23029 - RNA, 19 nt, Homo sapiens
gcaaggaagacucauuacc

SEQ ID NO: 23030 - RNA, 19 nt, Homo sapiens
agaccuuccuggccaugga

SEQ ID NO: 23031 - RNA, 19 nt, Homo sapiens
cacagccacucagauguuc

SEQ ID NO: 23032 - RNA, 19 nt, Homo sapiens
gaaaugauauuggauguug

SEQ ID NO: 23033 - RNA, 19 nt, Homo sapiens
gcauggaccugcagaauga

SEQ ID NO: 23034 - RNA, 19 nt, Homo sapiens
caccagaaaucaccacaua

SEQ ID NO: 23035 - RNA, 19 nt, Homo sapiens
ccacauauuuggaaucuuc

SEQ ID NO: 23036 - RNA, 19 nt, Homo sapiens
gcagaaauuccaccagaaa

SEQ ID NO: 23037 - RNA, 19 nt, Homo sapiens
ccacuauccugauguguau

SEQ ID NO: 23038 - RNA, 19 nt, Homo sapiens
ccagaaaucaccacauauu

SEQ ID NO: 23039 - RNA, 19 nt, Homo sapiens
gauauuggauguugguaag

SEQ ID NO: 23040 - RNA, 19 nt, Homo sapiens
gaaauuccaccagaaauca

SEQ ID NO: 23041 - RNA, 19 nt, Homo sapiens
gaguguggcuggcuucaug

SEQ ID NO: 23042 - RNA, 19 nt, Homo sapiens
ccagagcuaugccauggaa

SEQ ID NO: 23043 - RNA, 19 nt, Homo sapiens
uuacuuggcucaucguuca

SEQ ID NO: 23044 - RNA, 19 nt, Homo sapiens
ccucagauggugacuauaa

SEQ ID NO: 23045 - RNA, 19 nt, Homo sapiens
ccauggaguuggccaagaa

SEQ ID NO: 23046 - RNA, 19 nt, Homo sapiens
gcacgaccuucagcacauu

SEQ ID NO: 23047 - RNA, 19 nt, Homo sapiens
aaacagauuucuacagacu

SEQ ID NO: 23048 - RNA, 19 nt, Homo sapiens
ccauggaaaugauauugga

SEQ ID NO: 23049 - RNA, 19 nt, Homo sapiens
gggagacacugcccugcuu

SEQ ID NO: 23050 - RNA, 19 nt, Homo sapiens
ggacucuuccuaccacaaa

SEQ ID NO: 23051 - RNA, 19 nt, Homo sapiens
ccaugcaugucuccauauu

SEQ ID NO: 23052 - RNA, 19 nt, Homo sapiens
gcuaugccauggaaaugau

SEQ ID NO: 23053 - RNA, 19 nt, Homo sapiens
ggcagaaauuccaccagaa

SEQ ID NO: 23054 - RNA, 19 nt, Homo sapiens
uggaggagcuggagaaggu

SEQ ID NO: 23055 - RNA, 19 nt, Homo sapiens
ggauguugguaagaauaaa

SEQ ID NO: 23056 - RNA, 19 nt, Homo sapiens
uacagggucuuuucucuua

SEQ ID NO: 23057 - RNA, 19 nt, Homo sapiens
ggaaaugauauuggauguu

SEQ ID NO: 23058 - RNA, 19 nt, Homo sapiens
gccaagaacaagagcaaga

SEQ ID NO: 23059 - RNA, 19 nt, Homo sapiens
ccaaguccauugucaucuc

SEQ ID NO: 23060 - RNA, 19 nt, Homo sapiens
ccaagaacaagagcaagaa

SEQ ID NO: 23061 - RNA, 19 nt, Homo sapiens
uauuggauguugguaagaa

SEQ ID NO: 23062 - RNA, 19 nt, Homo sapiens
augaugagauggaaaccaa

SEQ ID NO: 23063 - RNA, 19 nt, Homo sapiens
ugucaucucuccagcuaag

SEQ ID NO: 23064 - RNA, 19 nt, Homo sapiens
uggaaaugauauuggaugu

SEQ ID NO: 23065 - RNA, 19 nt, Homo sapiens
gagcuaugccauggaaaug

SEQ ID NO: 23066 - RNA, 19 nt, Homo sapiens
caccacauauuuggaaucu

SEQ ID NO: 23067 - RNA, 19 nt, Homo sapiens
ccugcuuccuccagacuuu

SEQ ID NO: 23068 - RNA, 19 nt, Homo sapiens
caaguccauugucaucucu

SEQ ID NO: 23069 - RNA, 19 nt, Homo sapiens
ggaccagcccagagcuaug

SEQ ID NO: 23070 - RNA, 19 nt, Homo sapiens
agaaauuccaccagaaauc

SEQ ID NO: 23071 - RNA, 19 nt, Homo sapiens
ggaguuggccaagaacaag

SEQ ID NO: 23072 - RNA, 19 nt, Homo sapiens
cagaaauuccaccagaaau

SEQ ID NO: 23073 - RNA, 19 nt, Homo sapiens
gccugcaucuuccucuuuc

SEQ ID NO: 23074 - RNA, 19 nt, Homo sapiens
ugauauuggauguugguaa

SEQ ID NO: 23075 - RNA, 19 nt, Homo sapiens
uuccucagauggugacuau

SEQ ID NO: 23076 - RNA, 19 nt, Homo sapiens
aaucaccacauauuuggaa

SEQ ID NO: 23077 - RNA, 19 nt, Homo sapiens
auugucaucucuccagcua

SEQ ID NO: 23078 - RNA, 19 nt, Homo sapiens
cccacuauccugaugugua

SEQ ID NO: 23079 - RNA, 19 nt, Homo sapiens
cagcagggaacacguuaca

SEQ ID NO: 23080 - RNA, 19 nt, Homo sapiens
ggacaccacggaggaagca

SEQ ID NO: 23081 - RNA, 19 nt, Homo sapiens
uggauguugguaagaauaa

SEQ ID NO: 23082 - RNA, 19 nt, Homo sapiens
ccgcggaagcugaggagaa

SEQ ID NO: 23083 - RNA, 19 nt, Homo sapiens
gaagcaccucugccuccaa

SEQ ID NO: 23084 - RNA, 19 nt, Homo sapiens
caagaacaagagcaagaag

SEQ ID NO: 23085 - RNA, 19 nt, Homo sapiens
ccacaagguucaacaauuu

SEQ ID NO: 23086 - RNA, 19 nt, Homo sapiens
gauauuagcuacuuucugu

SEQ ID NO: 23087 - RNA, 19 nt, Homo sapiens
ugacagcucuaagauauua

SEQ ID NO: 23088 - RNA, 19 nt, Homo sapiens
uaaacacacuuucucagua

SEQ ID NO: 23089 - RNA, 19 nt, Homo sapiens
gcaaguggcuagaaauagu

SEQ ID NO: 23090 - RNA, 19 nt, Homo sapiens
ugacuucacucuggaauuu

SEQ ID NO: 23091 - RNA, 19 nt, Homo sapiens
caucaugaguucagaagaa

SEQ ID NO: 23092 - RNA, 19 nt, Homo sapiens
gaagaagcaaccauggaua

SEQ ID NO: 23093 - RNA, 19 nt, Homo sapiens
ccugacagcucuaagauau

SEQ ID NO: 23094 - RNA, 19 nt, Homo sapiens
aaacauccaugccaggaaa

SEQ ID NO: 23095 - RNA, 19 nt, Homo sapiens
caagagaacaugaaacuca

SEQ ID NO: 23096 - RNA, 19 nt, Homo sapiens
aaacacacuuucucaguau

SEQ ID NO: 23097 - RNA, 19 nt, Homo sapiens
caaacucucugcaaacauc

SEQ ID NO: 23098 - RNA, 19 nt, Homo sapiens
gcgcuaagcauauauuaau

SEQ ID NO: 23099 - RNA, 19 nt, Homo sapiens
caaaggcccugagaacgaa

SEQ ID NO: 23100 - RNA, 19 nt, Homo sapiens
acaugaaacucaacaguau

SEQ ID NO: 23101 - RNA, 19 nt, Homo sapiens
ggaagucugcagagauuaa

SEQ ID NO: 23102 - RNA, 19 nt, Homo sapiens
gaccuacgaugcugacaug

SEQ ID NO: 23103 - RNA, 19 nt, Homo sapiens
uaaaagcgcuaagcauaua

SEQ ID NO: 23104 - RNA, 19 nt, Homo sapiens
ugaaggaccugauacugau

SEQ ID NO: 23105 - RNA, 19 nt, Homo sapiens
aaacccagcuuuccuuaca

SEQ ID NO: 23106 - RNA, 19 nt, Homo sapiens
gcacuucagccuccaauuc

SEQ ID NO: 23107 - RNA, 19 nt, Homo sapiens
gaacaugaaacucaacagu

SEQ ID NO: 23108 - RNA, 19 nt, Homo sapiens
ggaagaagcaaccauggau

SEQ ID NO: 23109 - RNA, 19 nt, Homo sapiens
gcacaaggcuccccuaugc

SEQ ID NO: 23110 - RNA, 19 nt, Homo sapiens
gagcaaaucaauugaaugc

SEQ ID NO: 23111 - RNA, 19 nt, Homo sapiens
ggaccaaugccacaaaaua

SEQ ID NO: 23112 - RNA, 19 nt, Homo sapiens
guccaucacucccaggauu

SEQ ID NO: 23113 - RNA, 19 nt, Homo sapiens
ugggaagucugcagagauu

SEQ ID NO: 23114 - RNA, 19 nt, Homo sapiens
aaaugcaaguggcuagaaa

SEQ ID NO: 23115 - RNA, 19 nt, Homo sapiens
ccacauuccucucuuccau

SEQ ID NO: 23116 - RNA, 19 nt, Homo sapiens
caccggguauggcuaguuu

SEQ ID NO: 23117 - RNA, 19 nt, Homo sapiens
caucacagccauccuugaa

SEQ ID NO: 23118 - RNA, 19 nt, Homo sapiens
gaaacucaacaguaugaau

SEQ ID NO: 23119 - RNA, 19 nt, Homo sapiens
caacccagacaaucuagaa

SEQ ID NO: 23120 - RNA, 19 nt, Homo sapiens
ccaaaggcccugagaacga

SEQ ID NO: 23121 - RNA, 19 nt, Homo sapiens
uccacaagguucaacaauu

SEQ ID NO: 23122 - RNA, 19 nt, Homo sapiens
gaccugauacugauccuau

SEQ ID NO: 23123 - RNA, 19 nt, Homo sapiens
ucuuagaacuaucuugguu

SEQ ID NO: 23124 - RNA, 19 nt, Homo sapiens
agccaggacugaaaccuuu

SEQ ID NO: 23125 - RNA, 19 nt, Homo sapiens
ggagccauguuuccaggau

SEQ ID NO: 23126 - RNA, 19 nt, Homo sapiens
gauccuaugccuccuggaa

SEQ ID NO: 23127 - RNA, 19 nt, Homo sapiens
caucagauaagccaccaaa

SEQ ID NO: 23128 - RNA, 19 nt, Homo sapiens
gauuaaacacacuuucuca

SEQ ID NO: 23129 - RNA, 19 nt, Homo sapiens
gagccauguuuccaggauu

SEQ ID NO: 23130 - RNA, 19 nt, Homo sapiens
aagagaacaugaaacucaa

SEQ ID NO: 23131 - RNA, 19 nt, Homo sapiens
gaagucugcagagauuaaa

SEQ ID NO: 23132 - RNA, 19 nt, Homo sapiens
cgaagaaggaggugcacaa

SEQ ID NO: 23133 - RNA, 19 nt, Homo sapiens
caaaaugaaggaccugaua

SEQ ID NO: 23134 - RNA, 19 nt, Homo sapiens
agacuuggcaucaugaguu

SEQ ID NO: 23135 - RNA, 19 nt, Homo sapiens
guccaucacucccaggaau

SEQ ID NO: 23136 - RNA, 19 nt, Homo sapiens
gagauuaaacacacuuucu

SEQ ID NO: 23137 - RNA, 19 nt, Homo sapiens
uggagcaaaucaauugaau

SEQ ID NO: 23138 - RNA, 19 nt, Homo sapiens
ggucuccucccaccacauu

SEQ ID NO: 23139 - RNA, 19 nt, Homo sapiens
uaucuugguuggcaucauc

SEQ ID NO: 23140 - RNA, 19 nt, Homo sapiens
ggccaacccagacaaucua

SEQ ID NO: 23141 - RNA, 19 nt, Homo sapiens
gaagaaggaggugcacaag

SEQ ID NO: 23142 - RNA, 19 nt, Homo sapiens
gaccaaugccacaaaauaa

SEQ ID NO: 23143 - RNA, 19 nt, Homo sapiens
aacaugaaacucaacagua

SEQ ID NO: 23144 - RNA, 19 nt, Homo sapiens
ccaccacauuccucucuuc

SEQ ID NO: 23145 - RNA, 19 nt, Homo sapiens
guuugagccuugagacaau

SEQ ID NO: 23146 - RNA, 19 nt, Homo sapiens
gacuuggcaucaugaguuc

SEQ ID NO: 23147 - RNA, 19 nt, Homo sapiens
ggccacagcacugaaagaa

SEQ ID NO: 23148 - RNA, 19 nt, Homo sapiens
gcagagauuaaacacacuu

SEQ ID NO: 23149 - RNA, 19 nt, Homo sapiens
ucaauugucucugugaaaa

SEQ ID NO: 23150 - RNA, 19 nt, Homo sapiens
gccaagagaacaugaaacu

SEQ ID NO: 23151 - RNA, 19 nt, Homo sapiens
cuagauacggcuuuggaaa

SEQ ID NO: 23152 - RNA, 19 nt, Homo sapiens
cccaaacucucugcaaaca

SEQ ID NO: 23153 - RNA, 19 nt, Homo sapiens
ggagcaaaucaauugaaug

SEQ ID NO: 23154 - RNA, 19 nt, Homo sapiens
gaauguuguacgugccuuu

SEQ ID NO: 23155 - RNA, 19 nt, Homo sapiens
caauucaccugggacaucu

SEQ ID NO: 23156 - RNA, 19 nt, Homo sapiens
cugaauuagcugauguuua

SEQ ID NO: 23157 - RNA, 19 nt, Homo sapiens
agccauguuuccaggauuu

SEQ ID NO: 23158 - RNA, 19 nt, Homo sapiens
uaaaugcaaguggcuagaa

SEQ ID NO: 23159 - RNA, 19 nt, Homo sapiens
agcccgagaugaugcauga

SEQ ID NO: 23160 - RNA, 19 nt, Homo sapiens
gcugcugacccacugauga

SEQ ID NO: 23161 - RNA, 19 nt, Homo sapiens
ucaacagccaggacugaaa

SEQ ID NO: 23162 - RNA, 19 nt, Homo sapiens
gagaacaugaaacucaaca

SEQ ID NO: 23163 - RNA, 19 nt, Homo sapiens
guugggaagucugcagaga

SEQ ID NO: 23164 - RNA, 19 nt, Homo sapiens
gcuccuugcucucccuaag

SEQ ID NO: 23165 - RNA, 19 nt, Homo sapiens
ugucaauugucucugugaa

SEQ ID NO: 23166 - RNA, 19 nt, Homo sapiens
aaacacuuauuacccuucu

SEQ ID NO: 23167 - RNA, 19 nt, Homo sapiens
gauccacaagguucaacaa

SEQ ID NO: 23168 - RNA, 19 nt, Homo sapiens
ggcuagaaauaguguaggu

SEQ ID NO: 23169 - RNA, 19 nt, Homo sapiens
acgcauggcauuuccaaga

SEQ ID NO: 23170 - RNA, 19 nt, Homo sapiens
caaacauccaugccaggaa

SEQ ID NO: 23171 - RNA, 19 nt, Homo sapiens
uuaaacacacuuucucagu

SEQ ID NO: 23172 - RNA, 19 nt, Homo sapiens
augaaggaccugauacuga

SEQ ID NO: 23173 - RNA, 19 nt, Homo sapiens
gaagcaaccauggauacca

SEQ ID NO: 23174 - RNA, 19 nt, Homo sapiens
caacagccaggacugaaac

SEQ ID NO: 23175 - RNA, 19 nt, Homo sapiens
augcaaguggcuagaaaua

SEQ ID NO: 23176 - RNA, 19 nt, Homo sapiens
ggaggccaacccagacaau

SEQ ID NO: 23177 - RNA, 19 nt, Homo sapiens
guucuuuccucagcaaucu

SEQ ID NO: 23178 - RNA, 19 nt, Homo sapiens
ccaccaaaggcccugagaa

SEQ ID NO: 23179 - RNA, 19 nt, Homo sapiens
ccaauucaccugggacauc

SEQ ID NO: 23180 - RNA, 19 nt, Homo sapiens
aagcgcuaagcauauauua

SEQ ID NO: 23181 - RNA, 19 nt, Homo sapiens
ggaccuacgaugcugacau

SEQ ID NO: 23182 - RNA, 19 nt, Homo sapiens
cgggagagaagacccaaug

SEQ ID NO: 23183 - RNA, 19 nt, Homo sapiens
ucagauaagccaccaaagc

SEQ ID NO: 23184 - RNA, 19 nt, Homo sapiens
gggaagucugcagagauua

SEQ ID NO: 23185 - RNA, 19 nt, Homo sapiens
uaacugaagucaccaagaa

SEQ ID NO: 23186 - RNA, 19 nt, Homo sapiens
guacauccauggccuguga

SEQ ID NO: 23187 - RNA, 19 nt, Homo sapiens
caaccuggguccaaauaaa

SEQ ID NO: 23188 - RNA, 19 nt, Homo sapiens
ggaaguuucucuaucacaa

SEQ ID NO: 23189 - RNA, 19 nt, Homo sapiens
gcagguauuucuauaaugg

SEQ ID NO: 23190 - RNA, 19 nt, Homo sapiens
ggagacgucuggagcuuau

SEQ ID NO: 23191 - RNA, 19 nt, Homo sapiens
ggaaccagagcccaucuua

SEQ ID NO: 23192 - RNA, 19 nt, Homo sapiens
ggaaugaccagcagguauu

SEQ ID NO: 23193 - RNA, 19 nt, Homo sapiens
caauaucucucggaucuau

SEQ ID NO: 23194 - RNA, 19 nt, Homo sapiens
cagcagguauuucuauaau

SEQ ID NO: 23195 - RNA, 19 nt, Homo sapiens
gggcaacgguaacaacuuc

SEQ ID NO: 23196 - RNA, 19 nt, Homo sapiens
gaaccagagcccaucuuaa

SEQ ID NO: 23197 - RNA, 19 nt, Homo sapiens
gagaaggagugcagagagu

SEQ ID NO: 23198 - RNA, 19 nt, Homo sapiens
guaacaacuucgucacaga

SEQ ID NO: 23199 - RNA, 19 nt, Homo sapiens
gucuggagcuuaugagaaa

SEQ ID NO: 23200 - RNA, 19 nt, Homo sapiens
caccaacuaugaugaguau

SEQ ID NO: 23201 - RNA, 19 nt, Homo sapiens
gaugggaaguuucucuauc

SEQ ID NO: 23202 - RNA, 19 nt, Homo sapiens
caagcaaccuggguccaaa

SEQ ID NO: 23203 - RNA, 19 nt, Homo sapiens
gugggcaacugguaacuga

SEQ ID NO: 23204 - RNA, 19 nt, Homo sapiens
agaccgagccugugggaua

SEQ ID NO: 23205 - RNA, 19 nt, Homo sapiens
ccaagaagaggaaggauca

SEQ ID NO: 23206 - RNA, 19 nt, Homo sapiens
gaaguuucucuaucacaaa

SEQ ID NO: 23207 - RNA, 19 nt, Homo sapiens
gaccgagccugugggauau

SEQ ID NO: 23208 - RNA, 19 nt, Homo sapiens
uaacaacuucgucacagaa

SEQ ID NO: 23209 - RNA, 19 nt, Homo sapiens
gaggagacgucuggagcuu

SEQ ID NO: 23210 - RNA, 19 nt, Homo sapiens
gaggauggccagugucugu

SEQ ID NO: 23211 - RNA, 19 nt, Homo sapiens
gaaugaccagcagguauuu

SEQ ID NO: 23212 - RNA, 19 nt, Homo sapiens
gaaauucagccgccaucau

SEQ ID NO: 23213 - RNA, 19 nt, Homo sapiens
gcaaccuggguccaaauaa

SEQ ID NO: 23214 - RNA, 19 nt, Homo sapiens
ccugugagacuuuccagua

SEQ ID NO: 23215 - RNA, 19 nt, Homo sapiens
caggaaaacuucaauaucu

SEQ ID NO: 23216 - RNA, 19 nt, Homo sapiens
aaccagagcccaucuuaau

SEQ ID NO: 23217 - RNA, 19 nt, Homo sapiens
acauaaccauggaguccua

SEQ ID NO: 23218 - RNA, 19 nt, Homo sapiens
gaccagcagguauuucuau

SEQ ID NO: 23219 - RNA, 19 nt, Homo sapiens
ccugaggacuccaucuuca

SEQ ID NO: 23220 - RNA, 19 nt, Homo sapiens
gggaaugaccagcagguau

SEQ ID NO: 23221 - RNA, 19 nt, Homo sapiens
gaagucaccaagaaagaag

SEQ ID NO: 23222 - RNA, 19 nt, Homo sapiens
uaugaugaguaugccauuu

SEQ ID NO: 23223 - RNA, 19 nt, Homo sapiens
ggaucuaugggaaguggua

SEQ ID NO: 23224 - RNA, 19 nt, Homo sapiens
ccagcagguauuucuauaa

SEQ ID NO: 23225 - RNA, 19 nt, Homo sapiens
aaauucagccgccaucaug

SEQ ID NO: 23226 - RNA, 19 nt, Homo sapiens
uucaauaucucucggaucu

SEQ ID NO: 23227 - RNA, 19 nt, Homo sapiens
gucagaggauggccagugu

SEQ ID NO: 23228 - RNA, 19 nt, Homo sapiens
gaggagcccauagccauga

SEQ ID NO: 23229 - RNA, 19 nt, Homo sapiens
caacauccaagugcaggaa

SEQ ID NO: 23230 - RNA, 19 nt, Homo sapiens
accagcagguauuucuaua

SEQ ID NO: 23231 - RNA, 19 nt, Homo sapiens
ugaagucaccaagaaagaa

SEQ ID NO: 23232 - RNA, 19 nt, Homo sapiens
gaaggagugcagagaguac

SEQ ID NO: 23233 - RNA, 19 nt, Homo sapiens
caaggcagaggagcccaua

SEQ ID NO: 23234 - RNA, 19 nt, Homo sapiens
aacaaguucuacucagaga

SEQ ID NO: 23235 - RNA, 19 nt, Homo sapiens
guaacugaagucaccaaga

SEQ ID NO: 23236 - RNA, 19 nt, Homo sapiens
augggaaguuucucuauca

SEQ ID NO: 23237 - RNA, 19 nt, Homo sapiens
gcgcuucuccaacugacaa

SEQ ID NO: 23238 - RNA, 19 nt, Homo sapiens
ucaccaagaaagaagauuc

SEQ ID NO: 23239 - RNA, 19 nt, Homo sapiens
agauacugaugggaaguuu

SEQ ID NO: 23240 - RNA, 19 nt, Homo sapiens
agaagaucauggacaggau

SEQ ID NO: 23241 - RNA, 19 nt, Homo sapiens
caacugguaacugaaguca

SEQ ID NO: 23242 - RNA, 19 nt, Homo sapiens
agaaggagugcagagagua

SEQ ID NO: 23243 - RNA, 19 nt, Homo sapiens
acaccaacuaugaugagua

SEQ ID NO: 23244 - RNA, 19 nt, Homo sapiens
cuacagaggcggagaucag

SEQ ID NO: 23245 - RNA, 19 nt, Homo sapiens
ccaagcaaccuggguccaa

SEQ ID NO: 23246 - RNA, 19 nt, Homo sapiens
acaacuggccggucugcaa

SEQ ID NO: 23247 - RNA, 19 nt, Homo sapiens
cugcugcgcuucuccaacu

SEQ ID NO: 23248 - RNA, 19 nt, Homo sapiens
gcaggacuucagagugguu

SEQ ID NO: 23249 - RNA, 19 nt, Homo sapiens
gcaggaaaacuucaauauc

SEQ ID NO: 23250 - RNA, 19 nt, Homo sapiens
uaaccauggaguccuaugu

SEQ ID NO: 23251 - RNA, 19 nt, Homo sapiens
cagagaaggagugcagaga

SEQ ID NO: 23252 - RNA, 19 nt, Homo sapiens
gggcaacugguaacugaag

SEQ ID NO: 23253 - RNA, 19 nt, Homo sapiens
ccaacuaugaugaguaugc

SEQ ID NO: 23254 - RNA, 19 nt, Homo sapiens
gagcuuaugagaaaacaga

SEQ ID NO: 23255 - RNA, 19 nt, Homo sapiens
cgucuggagcuuaugagaa

SEQ ID NO: 23256 - RNA, 19 nt, Homo sapiens
ggcggaaaggugucuguga

SEQ ID NO: 23257 - RNA, 19 nt, Homo sapiens
agacgucuggagcuuauga

SEQ ID NO: 23258 - RNA, 19 nt, Homo sapiens
gaaacaaacuuaagucaga

SEQ ID NO: 23259 - RNA, 19 nt, Homo sapiens
ccagagagauuuagcauaa

SEQ ID NO: 23260 - RNA, 19 nt, Homo sapiens
gagaagagguuuaauuuag

SEQ ID NO: 23261 - RNA, 19 nt, Homo sapiens
gcagaaagcccuagaugua

SEQ ID NO: 23262 - RNA, 19 nt, Homo sapiens
gaucaaaccuuggaaauuc

SEQ ID NO: 23263 - RNA, 19 nt, Homo sapiens
ggacuuaaaucaguugaaa

SEQ ID NO: 23264 - RNA, 19 nt, Homo sapiens
gaaauugagcuucuaauga

SEQ ID NO: 23265 - RNA, 19 nt, Homo sapiens
ggacuguucuauuaaauug

SEQ ID NO: 23266 - RNA, 19 nt, Homo sapiens
uaacacagcuggaacaauc

SEQ ID NO: 23267 - RNA, 19 nt, Homo sapiens
gaaaucggauggaacuuau

SEQ ID NO: 23268 - RNA, 19 nt, Homo sapiens
gaccagaguuguagauuga

SEQ ID NO: 23269 - RNA, 19 nt, Homo sapiens
gaaagcaacucaauuuggu

SEQ ID NO: 23270 - RNA, 19 nt, Homo sapiens
gcaggaagcuuauguacuc

SEQ ID NO: 23271 - RNA, 19 nt, Homo sapiens
gcuaaacaauaucccaaua

SEQ ID NO: 23272 - RNA, 19 nt, Homo sapiens
gauaauuucuggauugaug

SEQ ID NO: 23273 - RNA, 19 nt, Homo sapiens
cagcagaguugauuaagaa

SEQ ID NO: 23274 - RNA, 19 nt, Homo sapiens
ggaaacagcaauuaaaguu

SEQ ID NO: 23275 - RNA, 19 nt, Homo sapiens
ggagaagagguuuaauuua

SEQ ID NO: 23276 - RNA, 19 nt, Homo sapiens
gaauuuagccucucuuuua

SEQ ID NO: 23277 - RNA, 19 nt, Homo sapiens
caauagauuuguugacuug

SEQ ID NO: 23278 - RNA, 19 nt, Homo sapiens
guugguaccuuuacguaua

SEQ ID NO: 23279 - RNA, 19 nt, Homo sapiens
ggaaugaaaucggauggaa

SEQ ID NO: 23280 - RNA, 19 nt, Homo sapiens
gugaccaccuuguuuguua

SEQ ID NO: 23281 - RNA, 19 nt, Homo sapiens
gggagaagagguuuaauuu

SEQ ID NO: 23282 - RNA, 19 nt, Homo sapiens
gagcacagcaccuaauauu

SEQ ID NO: 23283 - RNA, 19 nt, Homo sapiens
gauaccagguucugucauu

SEQ ID NO: 23284 - RNA, 19 nt, Homo sapiens
gagaauuuguccagauuau

SEQ ID NO: 23285 - RNA, 19 nt, Homo sapiens
gauggaagcugcacauuuu

SEQ ID NO: 23286 - RNA, 19 nt, Homo sapiens
gcaauacccuguuaacacu

SEQ ID NO: 23287 - RNA, 19 nt, Homo sapiens
gaugugcaauguucaauca

SEQ ID NO: 23288 - RNA, 19 nt, Homo sapiens
auaaagcaauacccuguua

SEQ ID NO: 23289 - RNA, 19 nt, Homo sapiens
gugcuauguucaaugauua

SEQ ID NO: 23290 - RNA, 19 nt, Homo sapiens
acaagagacugaacuguau

SEQ ID NO: 23291 - RNA, 19 nt, Homo sapiens
gaagcauguuguugauuga

SEQ ID NO: 23292 - RNA, 19 nt, Homo sapiens
ugaagcauguuguugauug

SEQ ID NO: 23293 - RNA, 19 nt, Homo sapiens
gaaagcagcggaauacaag

SEQ ID NO: 23294 - RNA, 19 nt, Homo sapiens
gagaacacauguagaaggu

SEQ ID NO: 23295 - RNA, 19 nt, Homo sapiens
ugaaggaugugcaauguuc

SEQ ID NO: 23296 - RNA, 19 nt, Homo sapiens
gaaugacugucccagaaug

SEQ ID NO: 23297 - RNA, 19 nt, Homo sapiens
ggaguuagauaucuugcau

SEQ ID NO: 23298 - RNA, 19 nt, Homo sapiens
gugcaauguucaaucauaa

SEQ ID NO: 23299 - RNA, 19 nt, Homo sapiens
ggaaagcagcggaauacaa

SEQ ID NO: 23300 - RNA, 19 nt, Homo sapiens
gaucauucaccuuaacuuu

SEQ ID NO: 23301 - RNA, 19 nt, Homo sapiens
ugaaugcucucuucugugu

SEQ ID NO: 23302 - RNA, 19 nt, Homo sapiens
aaagagaacacauguagaa

SEQ ID NO: 23303 - RNA, 19 nt, Homo sapiens
gaacuuauuggacuauuca

SEQ ID NO: 23304 - RNA, 19 nt, Homo sapiens
gagcuugacccagcaguua

SEQ ID NO: 23305 - RNA, 19 nt, Homo sapiens
gcacagcaccuaauauuuu

SEQ ID NO: 23306 - RNA, 19 nt, Homo sapiens
guacuuauauacucuggau

SEQ ID NO: 23307 - RNA, 19 nt, Homo sapiens
aaugggaaaugacuaguaa

SEQ ID NO: 23308 - RNA, 19 nt, Homo sapiens
gcaacucaauuugguuuau

SEQ ID NO: 23309 - RNA, 19 nt, Homo sapiens
cccagaagauugaagguuu

SEQ ID NO: 23310 - RNA, 19 nt, Homo sapiens
ggacaaagccuagaaaaga

SEQ ID NO: 23311 - RNA, 19 nt, Homo sapiens
ccaguuaccuccacuuucu

SEQ ID NO: 23312 - RNA, 19 nt, Homo sapiens
uaagucagaccuccuauga

SEQ ID NO: 23313 - RNA, 19 nt, Homo sapiens
caagagacguuucauuuug

SEQ ID NO: 23314 - RNA, 19 nt, Homo sapiens
aaauugagcuucuaaugag

SEQ ID NO: 23315 - RNA, 19 nt, Homo sapiens
agagugcuauguucaauga

SEQ ID NO: 23316 - RNA, 19 nt, Homo sapiens
cucuaggacuguucuauua

SEQ ID NO: 23317 - RNA, 19 nt, Homo sapiens
caugaaugcucucuucugu

SEQ ID NO: 23318 - RNA, 19 nt, Homo sapiens
gaucaggaaaguuguagaa

SEQ ID NO: 23319 - RNA, 19 nt, Homo sapiens
agucagaccuccuaugaug

SEQ ID NO: 23320 - RNA, 19 nt, Homo sapiens
gauggaacuuauuggacua

SEQ ID NO: 23321 - RNA, 19 nt, Homo sapiens
ugaaaucggauggaacuua

SEQ ID NO: 23322 - RNA, 19 nt, Homo sapiens
gagaguagcauguuugucu

SEQ ID NO: 23323 - RNA, 19 nt, Homo sapiens
ucaguuugauucuguaaug

SEQ ID NO: 23324 - RNA, 19 nt, Homo sapiens
caccuuaacuuuuccuuua

SEQ ID NO: 23325 - RNA, 19 nt, Homo sapiens
gguggaugcuuucuagaug

SEQ ID NO: 23326 - RNA, 19 nt, Homo sapiens
ucacaucacuccagaacca

SEQ ID NO: 23327 - RNA, 19 nt, Homo sapiens
guaaugagcacagcaccua

SEQ ID NO: 23328 - RNA, 19 nt, Homo sapiens
aauauaggcuuucaagagu

SEQ ID NO: 23329 - RNA, 19 nt, Homo sapiens
uagcagcccuuuccacuag

SEQ ID NO: 23330 - RNA, 19 nt, Homo sapiens
cuaggacuguucuauuaaa

SEQ ID NO: 23331 - RNA, 19 nt, Homo sapiens
caggaaaguuguagaaguc

SEQ ID NO: 23332 - RNA, 19 nt, Homo sapiens
ggaacuuauuggacuauuc

SEQ ID NO: 23333 - RNA, 19 nt, Homo sapiens
uggaaauucugaugaguga

SEQ ID NO: 23334 - RNA, 19 nt, Homo sapiens
guaccacccucuugcugaa

SEQ ID NO: 23335 - RNA, 19 nt, Homo sapiens
ccucuuaacuacgguguuu

SEQ ID NO: 23336 - RNA, 19 nt, Homo sapiens
gagauggucccugggcuua

SEQ ID NO: 23337 - RNA, 19 nt, Homo sapiens
ugugaaagcaacucaauuu

SEQ ID NO: 23338 - RNA, 19 nt, Homo sapiens
aaccugaacuuuaguaaca

SEQ ID NO: 23339 - RNA, 19 nt, Homo sapiens
caugaaagaugguguuacu

SEQ ID NO: 23340 - RNA, 19 nt, Homo sapiens
gguauucucugccacucuu

SEQ ID NO: 23341 - RNA, 19 nt, Homo sapiens
ucaaggaguuagauaucuu

SEQ ID NO: 23342 - RNA, 19 nt, Homo sapiens
gauauuguaugggacguau

SEQ ID NO: 23343 - RNA, 19 nt, Homo sapiens
ccaauagauuuguugacuu

SEQ ID NO: 23344 - RNA, 19 nt, Homo sapiens
gcuuggaucauucaccuua

SEQ ID NO: 23345 - RNA, 19 nt, Homo sapiens
uaagugaaauugagcuucu

SEQ ID NO: 23346 - RNA, 19 nt, Homo sapiens
uuaaagggcaugggaauuu

SEQ ID NO: 23347 - RNA, 19 nt, Homo sapiens
caacucaauuugguuuaug

SEQ ID NO: 23348 - RNA, 19 nt, Homo sapiens
cagaaagcccuagauguaa

SEQ ID NO: 23349 - RNA, 19 nt, Homo sapiens
ggaaaguuguagaagucuu

SEQ ID NO: 23350 - RNA, 19 nt, Homo sapiens
guucaauccuuguggguau

SEQ ID NO: 23351 - RNA, 19 nt, Homo sapiens
ggagcaggauauuguaugg

SEQ ID NO: 23352 - RNA, 19 nt, Homo sapiens
ugugcaauguucaaucaua

SEQ ID NO: 23353 - RNA, 19 nt, Homo sapiens
gccauaauuucuccuuuca

SEQ ID NO: 23354 - RNA, 19 nt, Homo sapiens
cuucaucuguuccucuuaa

SEQ ID NO: 23355 - RNA, 19 nt, Homo sapiens
gguguuggccucagccuaa

SEQ ID NO: 23356 - RNA, 19 nt, Homo sapiens
ucucuucuguguuuaggua

SEQ ID NO: 23357 - RNA, 19 nt, Homo sapiens
gggcagugcuuuccauaac

SEQ ID NO: 23358 - RNA, 19 nt, Homo sapiens
gaucaagcaucccugaguu

SEQ ID NO: 23359 - RNA, 19 nt, Homo sapiens
aaagaaccaucaagaaaug

SEQ ID NO: 23360 - RNA, 19 nt, Homo sapiens
ucaaagaaccaucaagaaa

SEQ ID NO: 23361 - RNA, 19 nt, Homo sapiens
caaagaaccaucaagaaau

SEQ ID NO: 23362 - RNA, 19 nt, Homo sapiens
cacaagaacacaaugauuu

SEQ ID NO: 23363 - RNA, 19 nt, Homo sapiens
uauaucaacuucagcuaug

SEQ ID NO: 23364 - RNA, 19 nt, Homo sapiens
aaacagaaacuugcacuga

SEQ ID NO: 23365 - RNA, 19 nt, Homo sapiens
ggaaguggauuaaaagauc

SEQ ID NO: 23366 - RNA, 19 nt, Homo sapiens
gggaggaaguggauuaaaa

SEQ ID NO: 23367 - RNA, 19 nt, Homo sapiens
gaagugguaccagagcaua

SEQ ID NO: 23368 - RNA, 19 nt, Homo sapiens
acagaaacuugcacugaau

SEQ ID NO: 23369 - RNA, 19 nt, Homo sapiens
aacagaaacuugcacugaa

SEQ ID NO: 23370 - RNA, 19 nt, Homo sapiens
gaugagaggggaaugaaua

SEQ ID NO: 23371 - RNA, 19 nt, Homo sapiens
cagaaacuugcacugaaua

SEQ ID NO: 23372 - RNA, 19 nt, Homo sapiens
ugacacaagaacacaauga

SEQ ID NO: 23373 - RNA, 19 nt, Homo sapiens
acacaagaacacaaugauu

SEQ ID NO: 23374 - RNA, 19 nt, Homo sapiens
ucuggaagcuuggccauca

SEQ ID NO: 23375 - RNA, 19 nt, Homo sapiens
aagcaucccugaguuucaa

SEQ ID NO: 23376 - RNA, 19 nt, Homo sapiens
accauuagcagacaauaaa

SEQ ID NO: 23377 - RNA, 19 nt, Homo sapiens
uuucaggagugacacaaga

SEQ ID NO: 23378 - RNA, 19 nt, Homo sapiens
gaaacuugcacugaauaca

SEQ ID NO: 23379 - RNA, 19 nt, Homo sapiens
cagaugcuuucaggaguga

SEQ ID NO: 23380 - RNA, 19 nt, Homo sapiens
aacuugcacugaauacauu

SEQ ID NO: 23381 - RNA, 19 nt, Homo sapiens
gcacccugguuauaucaac

SEQ ID NO: 23382 - RNA, 19 nt, Homo sapiens
aaacuugcacugaauacau

SEQ ID NO: 23383 - RNA, 19 nt, Homo sapiens
gaaguggauuaaaagauca

SEQ ID NO: 23384 - RNA, 19 nt, Homo sapiens
cuccaugacuccaauccaa

SEQ ID NO: 23385 - RNA, 19 nt, Homo sapiens
gaauacuucagaugcuuuc

SEQ ID NO: 23386 - RNA, 19 nt, Homo sapiens
caccguacccuuccuaugg

SEQ ID NO: 23387 - RNA, 19 nt, Homo sapiens
aaaguaccauuagcagaca

SEQ ID NO: 23388 - RNA, 19 nt, Homo sapiens
gacacaagaacacaaugau

SEQ ID NO: 23389 - RNA, 19 nt, Homo sapiens
caacacuccaugacuccaa

SEQ ID NO: 23390 - RNA, 19 nt, Homo sapiens
ggaccuggauuuuauuugc

SEQ ID NO: 23391 - RNA, 19 nt, Homo sapiens
uaccauuagcagacaauaa

SEQ ID NO: 23392 - RNA, 19 nt, Homo sapiens
aagcuuggccaucaacaga

SEQ ID NO: 23393 - RNA, 19 nt, Homo sapiens
cacuuuacuuagcaaauuc

SEQ ID NO: 23394 - RNA, 19 nt, Homo sapiens
caagcaucccugaguuuca

SEQ ID NO: 23395 - RNA, 19 nt, Homo sapiens
gcuuggccaucaacagaca

SEQ ID NO: 23396 - RNA, 19 nt, Homo sapiens
cuuagcaaauucuguaacu

SEQ ID NO: 23397 - RNA, 19 nt, Homo sapiens
auucaaagaaccaucaaga

SEQ ID NO: 23398 - RNA, 19 nt, Homo sapiens
caucaacagacaagaccaa

SEQ ID NO: 23399 - RNA, 19 nt, Homo sapiens
ggagugacacaagaacaca

SEQ ID NO: 23400 - RNA, 19 nt, Homo sapiens
gcgggaggaaguggauuaa

SEQ ID NO: 23401 - RNA, 19 nt, Homo sapiens
gaucugacucuggaagcuu

SEQ ID NO: 23402 - RNA, 19 nt, Homo sapiens
gaagaugagaggggaauga

SEQ ID NO: 23403 - RNA, 19 nt, Homo sapiens
guaccauuagcagacaaua

SEQ ID NO: 23404 - RNA, 19 nt, Homo sapiens
ucaagcaucccugaguuuc

SEQ ID NO: 23405 - RNA, 19 nt, Homo sapiens
uaaaagaucagaagaugag

SEQ ID NO: 23406 - RNA, 19 nt, Homo sapiens
agaccaagcgggaggaagu

SEQ ID NO: 23407 - RNA, 19 nt, Homo sapiens
gaccaagccucccugugua

SEQ ID NO: 23408 - RNA, 19 nt, Homo sapiens
aaagaaccaucaagaaaug

SEQ ID NO: 23409 - RNA, 19 nt, Homo sapiens
gacaggaacugaaguaaac

SEQ ID NO: 23410 - RNA, 19 nt, Homo sapiens
ggaccaagccucccugugu

SEQ ID NO: 23411 - RNA, 19 nt, Homo sapiens
gauaagaccaccauacucu

SEQ ID NO: 23412 - RNA, 19 nt, Homo sapiens
uauaucaacuucagcuaug

SEQ ID NO: 23413 - RNA, 19 nt, Homo sapiens
cacaagcacacaaugauuu

SEQ ID NO: 23414 - RNA, 19 nt, Homo sapiens
caacagacaagaccaagca

SEQ ID NO: 23415 - RNA, 19 nt, Homo sapiens
guaccaauaguagacaaua

SEQ ID NO: 23416 - RNA, 19 nt, Homo sapiens
ugacacaagcacacaauga

SEQ ID NO: 23417 - RNA, 19 nt, Homo sapiens
gcaggaggaaguggauuaa

SEQ ID NO: 23418 - RNA, 19 nt, Homo sapiens
ugagacaggaacugaagua

SEQ ID NO: 23419 - RNA, 19 nt, Homo sapiens
agacaggaacugaaguaaa

SEQ ID NO: 23420 - RNA, 19 nt, Homo sapiens
gacacaagcacacaaugau

SEQ ID NO: 23421 - RNA, 19 nt, Homo sapiens
gagacaggaacugaaguaa

SEQ ID NO: 23422 - RNA, 19 nt, Homo sapiens
acacaagcacacaaugauu

SEQ ID NO: 23423 - RNA, 19 nt, Homo sapiens
uacaaucacuuaacuuagc

SEQ ID NO: 23424 - RNA, 19 nt, Homo sapiens
gaugacacaagcacacaau

SEQ ID NO: 23425 - RNA, 19 nt, Homo sapiens
gcagucucaucaccacauc

SEQ ID NO: 23426 - RNA, 19 nt, Homo sapiens
gcacccugguuauaucaac

SEQ ID NO: 23427 - RNA, 19 nt, Homo sapiens
acaaucacuuaacuuagca

SEQ ID NO: 23428 - RNA, 19 nt, Homo sapiens
uaccagagcaugauaagac

SEQ ID NO: 23429 - RNA, 19 nt, Homo sapiens
cacuuaacuuagcaaauuc

SEQ ID NO: 23430 - RNA, 19 nt, Homo sapiens
aggaggaaguggauuaaaa

SEQ ID NO: 23431 - RNA, 19 nt, Homo sapiens
ccaccucugccuccaaugu

SEQ ID NO: 23432 - RNA, 19 nt, Homo sapiens
cuuagcaaauucuguaacu

SEQ ID NO: 23433 - RNA, 19 nt, Homo sapiens
ggaccuggauuuuguuugc

SEQ ID NO: 23434 - RNA, 19 nt, Homo sapiens
aauaugagacaggaacuga

SEQ ID NO: 23435 - RNA, 19 nt, Homo sapiens
gaauaugagacaggaacug

SEQ ID NO: 23436 - RNA, 19 nt, Homo sapiens
ggauuaaaagaccagaaua

SEQ ID NO: 23437 - RNA, 19 nt, Homo sapiens
agaccaagcaggaggaagu

SEQ ID NO: 23438 - RNA, 19 nt, Homo sapiens
aagcuuggccagcaacaga

SEQ ID NO: 23439 - RNA, 19 nt, Homo sapiens
cauacuuccugaucugcau

SEQ ID NO: 23440 - RNA, 19 nt, Homo sapiens
caugauaagaccaccauac

SEQ ID NO: 23441 - RNA, 19 nt, Homo sapiens
ggaugacacaagcacacaa

SEQ ID NO: 23442 - RNA, 19 nt, Homo sapiens
uaaaagaccagaauaugag

SEQ ID NO: 23443 - RNA, 19 nt, Homo sapiens
agcaggaggaaguggauua

SEQ ID NO: 23444 - RNA, 19 nt, Homo sapiens
cagcaacagacaagaccaa

SEQ ID NO: 23445 - RNA, 19 nt, Homo sapiens
gaacuuggaugagaauuug

SEQ ID NO: 23446 - RNA, 19 nt, Homo sapiens
uaaagcauguggucuuaua

SEQ ID NO: 23447 - RNA, 19 nt, Homo sapiens
ggagagaacuuggaugaga

SEQ ID NO: 23448 - RNA, 19 nt, Homo sapiens
gcaaggaucgauuugaaua

SEQ ID NO: 23449 - RNA, 19 nt, Homo sapiens
gaagggagaccucgcuuaa

SEQ ID NO: 23450 - RNA, 19 nt, Homo sapiens
gagcauagcuauuuguuuu

SEQ ID NO: 23451 - RNA, 19 nt, Homo sapiens
gcagcaagcuuugguuuau

SEQ ID NO: 23452 - RNA, 19 nt, Homo sapiens
ggacagcugauaaauuuaa

SEQ ID NO: 23453 - RNA, 19 nt, Homo sapiens
gaggaggccugucccaauu

SEQ ID NO: 23454 - RNA, 19 nt, Homo sapiens
ccaaaucucuucaaauucu

SEQ ID NO: 23455 - RNA, 19 nt, Homo sapiens
ucccaaaucucuucaaauu

SEQ ID NO: 23456 - RNA, 19 nt, Homo sapiens
uuggacagcugauaaauuu

SEQ ID NO: 23457 - RNA, 19 nt, Homo sapiens
ugggaagaauccaguauua

SEQ ID NO: 23458 - RNA, 19 nt, Homo sapiens
uauaaagcauguggucuua

SEQ ID NO: 23459 - RNA, 19 nt, Homo sapiens
gcaaacguuucuugaacaa

SEQ ID NO: 23460 - RNA, 19 nt, Homo sapiens
gagagaacuuggaugagaa

SEQ ID NO: 23461 - RNA, 19 nt, Homo sapiens
ggagcuggcugucaacaau

SEQ ID NO: 23462 - RNA, 19 nt, Homo sapiens
gaggacugcucaugugauu

SEQ ID NO: 23463 - RNA, 19 nt, Homo sapiens
gaaugucucuuaauauugc

SEQ ID NO: 23464 - RNA, 19 nt, Homo sapiens
gcugagagcauagcuauuu

SEQ ID NO: 23465 - RNA, 19 nt, Homo sapiens
ugcagaaugucucuuaaua

SEQ ID NO: 23466 - RNA, 19 nt, Homo sapiens
gcagcugcguuaccuguuu

SEQ ID NO: 23467 - RNA, 19 nt, Homo sapiens
cgagcuggcugccgaguuu

SEQ ID NO: 23468 - RNA, 19 nt, Homo sapiens
gaagggacgugggaaggaa

SEQ ID NO: 23469 - RNA, 19 nt, Homo sapiens
ggaagaauccaguauuauc

SEQ ID NO: 23470 - RNA, 19 nt, Homo sapiens
cacaaucacuucuuccauu

SEQ ID NO: 23471 - RNA, 19 nt, Homo sapiens
ggacguaugucuauuacac

SEQ ID NO: 23472 - RNA, 19 nt, Homo sapiens
gacagcaucucaaagacaa

SEQ ID NO: 23473 - RNA, 19 nt, Homo sapiens
caucagaccugcauugaac

SEQ ID NO: 23474 - RNA, 19 nt, Homo sapiens
ugcaauggcucaucagauu

SEQ ID NO: 23475 - RNA, 19 nt, Homo sapiens
gcagaaugucucuuaauau

SEQ ID NO: 23476 - RNA, 19 nt, Homo sapiens
ucaaacugcugucguuguu

SEQ ID NO: 23477 - RNA, 19 nt, Homo sapiens
ccagugagguggaagacuu

SEQ ID NO: 23478 - RNA, 19 nt, Homo sapiens
cagaggagcuggcugucaa

SEQ ID NO: 23479 - RNA, 19 nt, Homo sapiens
uuaaggauuugaaccauga

SEQ ID NO: 23480 - RNA, 19 nt, Homo sapiens
acaaucacuucuuccauuu

SEQ ID NO: 23481 - RNA, 19 nt, Homo sapiens
gaauuugguuccuguagca

SEQ ID NO: 23482 - RNA, 19 nt, Homo sapiens
gcuaaagccuguggguuug

SEQ ID NO: 23483 - RNA, 19 nt, Homo sapiens
caagucugcugaugagaga

SEQ ID NO: 23484 - RNA, 19 nt, Homo sapiens
gaagaauccaguauuaucu

SEQ ID NO: 23485 - RNA, 19 nt, Homo sapiens
ggucccaaaucucuucaaa

SEQ ID NO: 23486 - RNA, 19 nt, Homo sapiens
ucaaugcaauggcucauca

SEQ ID NO: 23487 - RNA, 19 nt, Homo sapiens
gacacgcucaguugaaaua

SEQ ID NO: 23488 - RNA, 19 nt, Homo sapiens
gcaccauauucacauguug

SEQ ID NO: 23489 - RNA, 19 nt, Homo sapiens
cagagaagguaagguguga

SEQ ID NO: 23490 - RNA, 19 nt, Homo sapiens
uaugaucucuucugguguu

SEQ ID NO: 23491 - RNA, 19 nt, Homo sapiens
ccaacacaaucacuucuuc

SEQ ID NO: 23492 - RNA, 19 nt, Homo sapiens
acacagacuuugucaugga

SEQ ID NO: 23493 - RNA, 19 nt, Homo sapiens
gaaugcacaccuuggcuuu

SEQ ID NO: 23494 - RNA, 19 nt, Homo sapiens
gcuaagcucauccagugua

SEQ ID NO: 23495 - RNA, 19 nt, Homo sapiens
cauguggucuuauaguguu

SEQ ID NO: 23496 - RNA, 19 nt, Homo sapiens
uggaagagguggucaugug

SEQ ID NO: 23497 - RNA, 19 nt, Homo sapiens
aaauaccgcuugcuguguu

SEQ ID NO: 23498 - RNA, 19 nt, Homo sapiens
cugcaaggaucgauuugaa

SEQ ID NO: 23499 - RNA, 19 nt, Homo sapiens
aagcuuugguuuaugguuu

SEQ ID NO: 23500 - RNA, 19 nt, Homo sapiens
gguguugacuggacugcuu

SEQ ID NO: 23501 - RNA, 19 nt, Homo sapiens
gccaagcagugaccaggaa

SEQ ID NO: 23502 - RNA, 19 nt, Homo sapiens
gcacaagaacuaucuacgu

SEQ ID NO: 23503 - RNA, 19 nt, Homo sapiens
ggaggaggccugucccaau

SEQ ID NO: 23504 - RNA, 19 nt, Homo sapiens
ccagcaagcucgcaaacgu

SEQ ID NO: 23505 - RNA, 19 nt, Homo sapiens
cauccaguguauuguguuu

SEQ ID NO: 23506 - RNA, 19 nt, Homo sapiens
ugcguuaccuguuucauga

SEQ ID NO: 23507 - RNA, 19 nt, Homo sapiens
ggaucgauuugaauaucuu

SEQ ID NO: 23508 - RNA, 19 nt, Homo sapiens
cagcagggcaucuuggaaa

SEQ ID NO: 23509 - RNA, 19 nt, Homo sapiens
aaacugcugucguuguugu

SEQ ID NO: 23510 - RNA, 19 nt, Homo sapiens
cccaguaccugcucucaga

SEQ ID NO: 23511 - RNA, 19 nt, Homo sapiens
guauaaagcauguggucuu

SEQ ID NO: 23512 - RNA, 19 nt, Homo sapiens
cugcauugccgcuguauaa

SEQ ID NO: 23513 - RNA, 19 nt, Homo sapiens
gcuguguuauuccugguuu

SEQ ID NO: 23514 - RNA, 19 nt, Homo sapiens
gcacaccaccaacauucuu

SEQ ID NO: 23515 - RNA, 19 nt, Homo sapiens
ugacgacugugccaucugu

SEQ ID NO: 23516 - RNA, 19 nt, Homo sapiens
gcaucucaaagacaaauuu

SEQ ID NO: 23517 - RNA, 19 nt, Homo sapiens
gcggucagauagcaucaga

SEQ ID NO: 23518 - RNA, 19 nt, Homo sapiens
gaaggacggauucaaguac

SEQ ID NO: 23519 - RNA, 19 nt, Homo sapiens
gaauucgucggcacaagaa

SEQ ID NO: 23520 - RNA, 19 nt, Homo sapiens
uuacacagacuuugucaug

SEQ ID NO: 23521 - RNA, 19 nt, Homo sapiens
cuugaaaugcuguuaguaa

SEQ ID NO: 23522 - RNA, 19 nt, Homo sapiens
ggcagcaagcuuugguuua

SEQ ID NO: 23523 - RNA, 19 nt, Homo sapiens
ugacugcauugccgcugua

SEQ ID NO: 23524 - RNA, 19 nt, Homo sapiens
ggacgaacuccuccagcaa

SEQ ID NO: 23525 - RNA, 19 nt, Homo sapiens
caugcagaaugucucuuaa

SEQ ID NO: 23526 - RNA, 19 nt, Homo sapiens
gaaacugcccuguggacau

SEQ ID NO: 23527 - RNA, 19 nt, Homo sapiens
cuacacagcggucagauag

SEQ ID NO: 23528 - RNA, 19 nt, Homo sapiens
cgaagggagaccucgcuua

SEQ ID NO: 23529 - RNA, 19 nt, Homo sapiens
ggcaacaucugguuaucca

SEQ ID NO: 23530 - RNA, 19 nt, Homo sapiens
gagagcauagcuauuuguu

SEQ ID NO: 23531 - RNA, 19 nt, Homo sapiens
guggaagcauguagacugu

SEQ ID NO: 23532 - RNA, 19 nt, Homo sapiens
caaaaguucugaagaugau

SEQ ID NO: 23533 - RNA, 19 nt, Homo sapiens
ggacuucggcgagguggaa

SEQ ID NO: 23534 - RNA, 19 nt, Homo sapiens
gaggccagguuugcaguug

SEQ ID NO: 23535 - RNA, 19 nt, Homo sapiens
ggacugcucaugugauuuu

SEQ ID NO: 23536 - RNA, 19 nt, Homo sapiens
gcucugcaaggaucgauuu

SEQ ID NO: 23537 - RNA, 19 nt, Homo sapiens
uuuccuagcuguguuauuc

SEQ ID NO: 23538 - RNA, 19 nt, Homo sapiens
gcuauagggugugaugaag

SEQ ID NO: 23539 - RNA, 19 nt, Homo sapiens
aaacugcccuguggacauc

SEQ ID NO: 23540 - RNA, 19 nt, Homo sapiens
gggaagaauccaguauuau

SEQ ID NO: 23541 - RNA, 19 nt, Homo sapiens
gggcccaggucccaaaucu

SEQ ID NO: 23542 - RNA, 19 nt, Homo sapiens
uuaucaaacugcugucguu

SEQ ID NO: 23543 - RNA, 19 nt, Homo sapiens
gcucaucagauucaagaga

SEQ ID NO: 23544 - RNA, 19 nt, Homo sapiens
gcuuaaaccaacacaauca

SEQ ID NO: 23545 - RNA, 19 nt, Homo sapiens
uaaagcauguggucuuaua

SEQ ID NO: 23546 - RNA, 19 nt, Homo sapiens
gcaaggaucgauuugaaua

SEQ ID NO: 23547 - RNA, 19 nt, Homo sapiens
gagcauagcuauuuguuuu

SEQ ID NO: 23548 - RNA, 19 nt, Homo sapiens
gcagcaagcuuugguuuau

SEQ ID NO: 23549 - RNA, 19 nt, Homo sapiens
ggacagcugauaaauuuaa

SEQ ID NO: 23550 - RNA, 19 nt, Homo sapiens
gaggaggccugucccaauu

SEQ ID NO: 23551 - RNA, 19 nt, Homo sapiens
ccaaaucucuucaaauucu

SEQ ID NO: 23552 - RNA, 19 nt, Homo sapiens
ucccaaaucucuucaaauu

SEQ ID NO: 23553 - RNA, 19 nt, Homo sapiens
uuggacagcugauaaauuu

SEQ ID NO: 23554 - RNA, 19 nt, Homo sapiens
ugggaagaauccaguauua

SEQ ID NO: 23555 - RNA, 19 nt, Homo sapiens
uauaaagcauguggucuua

SEQ ID NO: 23556 - RNA, 19 nt, Homo sapiens
gcaaacguuucuugaacaa

SEQ ID NO: 23557 - RNA, 19 nt, Homo sapiens
ggagcuggcugucaacaau

SEQ ID NO: 23558 - RNA, 19 nt, Homo sapiens
gaggacugcucaugugauu

SEQ ID NO: 23559 - RNA, 19 nt, Homo sapiens
gcugagagcauagcuauuu

SEQ ID NO: 23560 - RNA, 19 nt, Homo sapiens
gcagcugcguuaccuguuu

SEQ ID NO: 23561 - RNA, 19 nt, Homo sapiens
cgagcuggcugccgaguuu

SEQ ID NO: 23562 - RNA, 19 nt, Homo sapiens
gaagggacgugggaaggaa

SEQ ID NO: 23563 - RNA, 19 nt, Homo sapiens
ggaagaauccaguauuauc

SEQ ID NO: 23564 - RNA, 19 nt, Homo sapiens
ggacguaugucuauuacac

SEQ ID NO: 23565 - RNA, 19 nt, Homo sapiens
gacagcaucucaaagacaa

SEQ ID NO: 23566 - RNA, 19 nt, Homo sapiens
caucagaccugcauugaac

SEQ ID NO: 23567 - RNA, 19 nt, Homo sapiens
ugcaauggcucaucagauu

SEQ ID NO: 23568 - RNA, 19 nt, Homo sapiens
ucaaacugcugucguuguu

SEQ ID NO: 23569 - RNA, 19 nt, Homo sapiens
ccagugagguggaagacuu

SEQ ID NO: 23570 - RNA, 19 nt, Homo sapiens
cagaggagcuggcugucaa

SEQ ID NO: 23571 - RNA, 19 nt, Homo sapiens
uuaaggauuugaaccauga

SEQ ID NO: 23572 - RNA, 19 nt, Homo sapiens
gcuaaagccuguggguuug

SEQ ID NO: 23573 - RNA, 19 nt, Homo sapiens
caagucugcugaugagaga

SEQ ID NO: 23574 - RNA, 19 nt, Homo sapiens
gaagaauccaguauuaucu

SEQ ID NO: 23575 - RNA, 19 nt, Homo sapiens
ggucccaaaucucuucaaa

SEQ ID NO: 23576 - RNA, 19 nt, Homo sapiens
ucaaugcaauggcucauca

SEQ ID NO: 23577 - RNA, 19 nt, Homo sapiens
gacacgcucaguugaaaua

SEQ ID NO: 23578 - RNA, 19 nt, Homo sapiens
gcaccauauucacauguug

SEQ ID NO: 23579 - RNA, 19 nt, Homo sapiens
cagagaagguaagguguga

SEQ ID NO: 23580 - RNA, 19 nt, Homo sapiens
uaugaucucuucugguguu

SEQ ID NO: 23581 - RNA, 19 nt, Homo sapiens
acacagacuuugucaugga

SEQ ID NO: 23582 - RNA, 19 nt, Homo sapiens
gaaugcacaccuuggcuuu

SEQ ID NO: 23583 - RNA, 19 nt, Homo sapiens
cauguggucuuauaguguu

SEQ ID NO: 23584 - RNA, 19 nt, Homo sapiens
uggaagagguggucaugug

SEQ ID NO: 23585 - RNA, 19 nt, Homo sapiens
gcuaagcucauccagugua

SEQ ID NO: 23586 - RNA, 19 nt, Homo sapiens
aaauaccgcuugcuguguu

SEQ ID NO: 23587 - RNA, 19 nt, Homo sapiens
cugcaaggaucgauuugaa

SEQ ID NO: 23588 - RNA, 19 nt, Homo sapiens
aagcuuugguuuaugguuu

SEQ ID NO: 23589 - RNA, 19 nt, Homo sapiens
gguguugacuggacugcuu

SEQ ID NO: 23590 - RNA, 19 nt, Homo sapiens
gccaagcagugaccaggaa

SEQ ID NO: 23591 - RNA, 19 nt, Homo sapiens
gcacaagaacuaucuacgu

SEQ ID NO: 23592 - RNA, 19 nt, Homo sapiens
ggaggaggccugucccaau

SEQ ID NO: 23593 - RNA, 19 nt, Homo sapiens
ccagcaagcucgcaaacgu

SEQ ID NO: 23594 - RNA, 19 nt, Homo sapiens
ugcguuaccuguuucauga

SEQ ID NO: 23595 - RNA, 19 nt, Homo sapiens
ggaucgauuugaauaucuu

SEQ ID NO: 23596 - RNA, 19 nt, Homo sapiens
cauccaguguauuguguuu

SEQ ID NO: 23597 - RNA, 19 nt, Homo sapiens
cccaguaccugcucucaga

SEQ ID NO: 23598 - RNA, 19 nt, Homo sapiens
cagcagggcaucuuggaaa

SEQ ID NO: 23599 - RNA, 19 nt, Homo sapiens
aaacugcugucguuguugu

SEQ ID NO: 23600 - RNA, 19 nt, Homo sapiens
guauaaagcauguggucuu

SEQ ID NO: 23601 - RNA, 19 nt, Homo sapiens
cugcauugccgcuguauaa

SEQ ID NO: 23602 - RNA, 19 nt, Homo sapiens
gcuguguuauuccugguuu

SEQ ID NO: 23603 - RNA, 19 nt, Homo sapiens
gcacaccaccaacauucuu

SEQ ID NO: 23604 - RNA, 19 nt, Homo sapiens
ugacgacugugccaucugu

SEQ ID NO: 23605 - RNA, 19 nt, Homo sapiens
gcaucucaaagacaaauuu

SEQ ID NO: 23606 - RNA, 19 nt, Homo sapiens
gcggucagauagcaucaga

SEQ ID NO: 23607 - RNA, 19 nt, Homo sapiens
gaaggacggauucaaguac

SEQ ID NO: 23608 - RNA, 19 nt, Homo sapiens
gaauucgucggcacaagaa

SEQ ID NO: 23609 - RNA, 19 nt, Homo sapiens
uuacacagacuuugucaug

SEQ ID NO: 23610 - RNA, 19 nt, Homo sapiens
cuugaaaugcuguuaguaa

SEQ ID NO: 23611 - RNA, 19 nt, Homo sapiens
ggcagcaagcuuugguuua

SEQ ID NO: 23612 - RNA, 19 nt, Homo sapiens
ugacugcauugccgcugua

SEQ ID NO: 23613 - RNA, 19 nt, Homo sapiens
ggacgaacuccuccagcaa

SEQ ID NO: 23614 - RNA, 19 nt, Homo sapiens
gaaacugcccuguggacau

SEQ ID NO: 23615 - RNA, 19 nt, Homo sapiens
cuacacagcggucagauag

SEQ ID NO: 23616 - RNA, 19 nt, Homo sapiens
ggcaacaucugguuaucca

SEQ ID NO: 23617 - RNA, 19 nt, Homo sapiens
gagagcauagcuauuuguu

SEQ ID NO: 23618 - RNA, 19 nt, Homo sapiens
guggaagcauguagacugu

SEQ ID NO: 23619 - RNA, 19 nt, Homo sapiens
caaaaguucugaagaugau

SEQ ID NO: 23620 - RNA, 19 nt, Homo sapiens
ggacuucggcgagguggaa

SEQ ID NO: 23621 - RNA, 19 nt, Homo sapiens
gaggccagguuugcaguug

SEQ ID NO: 23622 - RNA, 19 nt, Homo sapiens
ggacugcucaugugauuuu

SEQ ID NO: 23623 - RNA, 19 nt, Homo sapiens
gcucugcaaggaucgauuu

SEQ ID NO: 23624 - RNA, 19 nt, Homo sapiens
uuuccuagcuguguuauuc

SEQ ID NO: 23625 - RNA, 19 nt, Homo sapiens
gcuauagggugugaugaag

SEQ ID NO: 23626 - RNA, 19 nt, Homo sapiens
aaacugcccuguggacauc

SEQ ID NO: 23627 - RNA, 19 nt, Homo sapiens
gggaagaauccaguauuau

SEQ ID NO: 23628 - RNA, 19 nt, Homo sapiens
gggcccaggucccaaaucu

SEQ ID NO: 23629 - RNA, 19 nt, Homo sapiens
uuaucaaacugcugucguu

SEQ ID NO: 23630 - RNA, 19 nt, Homo sapiens
gcucaucagauucaagaga

SEQ ID NO: 23631 - RNA, 19 nt, Homo sapiens
gaggugcaacgucgaauuc

SEQ ID NO: 23632 - RNA, 19 nt, Homo sapiens
uugaauaucuuuccuucuc

SEQ ID NO: 23633 - RNA, 19 nt, Homo sapiens
caaaagccuuaccuugaaa

SEQ ID NO: 23634 - RNA, 19 nt, Homo sapiens
ggaaaguccagggcuauag

SEQ ID NO: 23635 - RNA, 19 nt, Homo sapiens
gggaaaguccagggcuaua

SEQ ID NO: 23636 - RNA, 19 nt, Homo sapiens
agaagcagcagaccuccua

SEQ ID NO: 23637 - RNA, 19 nt, Homo sapiens
agaaggacggauucaagua

SEQ ID NO: 23638 - RNA, 19 nt, Homo sapiens
gaaaggggacguaugucua

SEQ ID NO: 23639 - RNA, 19 nt, Homo sapiens
uuucauggcugcagagucu

SEQ ID NO: 23640 - RNA, 19 nt, Homo sapiens
uauagggugugaugaaguc

SEQ ID NO: 23641 - RNA, 19 nt, Homo sapiens
ucgcaaacguuucuugaac

SEQ ID NO: 23642 - RNA, 19 nt, Homo sapiens
gcucgcaaacguuucuuga

SEQ ID NO: 23643 - RNA, 19 nt, Homo sapiens
gcaucagaccugcauugaa

SEQ ID NO: 23644 - RNA, 19 nt, Homo sapiens
acacagcggucagauagca

SEQ ID NO: 23645 - RNA, 19 nt, Homo sapiens
ccacucggcucacuuaagg

SEQ ID NO: 23646 - RNA, 19 nt, Homo sapiens
ggucuguccugcacaaaca

SEQ ID NO: 23647 - RNA, 19 nt, Homo sapiens
caauaaagaccagcaagca

SEQ ID NO: 23648 - RNA, 19 nt, Homo sapiens
ggucgcggcagaggagaua

SEQ ID NO: 23649 - RNA, 19 nt, Homo sapiens
ccuaccaggccaacaauug

SEQ ID NO: 23650 - RNA, 19 nt, Homo sapiens
ccaagcaucgccccaauaa

SEQ ID NO: 23651 - RNA, 19 nt, Homo sapiens
uggcgcugcuggugcugua

SEQ ID NO: 23652 - RNA, 19 nt, Homo sapiens
aauaaagaccagcaagcaa

SEQ ID NO: 23653 - RNA, 19 nt, Homo sapiens
agaccuaccaggccaacaa

SEQ ID NO: 23654 - RNA, 19 nt, Homo sapiens
cuuccacucggcucacuua

SEQ ID NO: 23655 - RNA, 19 nt, Homo sapiens
cuccaggcaucccacaaga

SEQ ID NO: 23656 - RNA, 19 nt, Homo sapiens
gcaccaguggccucaucuu

SEQ ID NO: 23657 - RNA, 19 nt, Homo sapiens
gagcugauauuuacucuuu

SEQ ID NO: 23658 - RNA, 19 nt, Homo sapiens
ggacaagacucuggaccua

SEQ ID NO: 23659 - RNA, 19 nt, Homo sapiens
guacaugccaacauaaaua

SEQ ID NO: 23660 - RNA, 19 nt, Homo sapiens
gaggagcgcuggcagaaug

SEQ ID NO: 23661 - RNA, 19 nt, Homo sapiens
ugagggagcuccuagaaga

SEQ ID NO: 23662 - RNA, 19 nt, Homo sapiens
caccagagcucuuggacaa

SEQ ID NO: 23663 - RNA, 19 nt, Homo sapiens
gcagaauggccaauauaaa

SEQ ID NO: 23664 - RNA, 19 nt, Homo sapiens
gugagucccuccacuguga

SEQ ID NO: 23665 - RNA, 19 nt, Homo sapiens
cgaccacauuguccgauuu

SEQ ID NO: 23666 - RNA, 19 nt, Homo sapiens
ggcagaauggccaauauaa

SEQ ID NO: 23667 - RNA, 19 nt, Homo sapiens
gaccacauuguccgauuua

SEQ ID NO: 23668 - RNA, 19 nt, Homo sapiens
gggcacagguggaaaugca

SEQ ID NO: 23669 - RNA, 19 nt, Homo sapiens
cagccugccuguacccuuu

SEQ ID NO: 23670 - RNA, 19 nt, Homo sapiens
ugggagagcugcuagauac

SEQ ID NO: 23671 - RNA, 19 nt, Homo sapiens
ccgacgagcugauauuuac

SEQ ID NO: 23672 - RNA, 19 nt, Homo sapiens
gcaaggaugccgagacagu

SEQ ID NO: 23673 - RNA, 19 nt, Homo sapiens
gaggaggcgucccuacauc

SEQ ID NO: 23674 - RNA, 19 nt, Homo sapiens
gcacugacuucugcaaugc

SEQ ID NO: 23675 - RNA, 19 nt, Homo sapiens
guuuaugugucaucaaugu

SEQ ID NO: 23676 - RNA, 19 nt, Homo sapiens
caguuuaugugucaucaau

SEQ ID NO: 23677 - RNA, 19 nt, Homo sapiens
cgaggucuguggcucaguu

SEQ ID NO: 23678 - RNA, 19 nt, Homo sapiens
ccgggcagcugcaaggaaa

SEQ ID NO: 23679 - RNA, 19 nt, Homo sapiens
ucuggaaccugacccaaga

SEQ ID NO: 23680 - RNA, 19 nt, Homo sapiens
gcuauccgcugccucuaca

SEQ ID NO: 23681 - RNA, 19 nt, Homo sapiens
ugagagagcauuguacgaa

SEQ ID NO: 23682 - RNA, 19 nt, Homo sapiens
ggcacugacuucugcaaug

SEQ ID NO: 23683 - RNA, 19 nt, Homo sapiens
gcugauauuuacucuuugg

SEQ ID NO: 23684 - RNA, 19 nt, Homo sapiens
cagaauggccaauauaaac

SEQ ID NO: 23685 - RNA, 19 nt, Homo sapiens
gaaaacugguugccaucaa

SEQ ID NO: 23686 - RNA, 19 nt, Homo sapiens
acaagacucuggaccuaca

SEQ ID NO: 23687 - RNA, 19 nt, Homo sapiens
cacauuguccgauuuauca

SEQ ID NO: 23688 - RNA, 19 nt, Homo sapiens
gcaauaccccuaccucuga

SEQ ID NO: 23689 - RNA, 19 nt, Homo sapiens
gagaggaggcgucccuaca

SEQ ID NO: 23690 - RNA, 19 nt, Homo sapiens
gcugagggagcuccuagaa

SEQ ID NO: 23691 - RNA, 19 nt, Homo sapiens
uacccuuucuccuguguaa

SEQ ID NO: 23692 - RNA, 19 nt, Homo sapiens
cugagccgcugcccagauu

SEQ ID NO: 23693 - RNA, 19 nt, Homo sapiens
aggcagaacugggcaauac

SEQ ID NO: 23694 - RNA, 19 nt, Homo sapiens
ccuuccaacuggccuauga

SEQ ID NO: 23695 - RNA, 19 nt, Homo sapiens
cuacagcacgaccacauug

SEQ ID NO: 23696 - RNA, 19 nt, Homo sapiens
ggaugcagacccagaagca

SEQ ID NO: 23697 - RNA, 19 nt, Homo sapiens
gagccgcugcccagauuug

SEQ ID NO: 23698 - RNA, 19 nt, Homo sapiens
ccacuucagcguucagcaa

SEQ ID NO: 23699 - RNA, 19 nt, Homo sapiens
ccacauuguccgauuuauc

SEQ ID NO: 23700 - RNA, 19 nt, Homo sapiens
aagcugagagagcauugua

SEQ ID NO: 23701 - RNA, 19 nt, Homo sapiens
gagagcauuguacgaacuu

SEQ ID NO: 23702 - RNA, 19 nt, Homo sapiens
ggcuuaugcucuucuccuu

SEQ ID NO: 23703 - RNA, 19 nt, Homo sapiens
aggcccagcugccaucaug

SEQ ID NO: 23704 - RNA, 19 nt, Homo sapiens
gccaauauaaaccagguau

SEQ ID NO: 23705 - RNA, 19 nt, Homo sapiens
ccuuucuccuguguaaaua

SEQ ID NO: 23706 - RNA, 19 nt, Homo sapiens
gaggcagaacugggcaaua

SEQ ID NO: 23707 - RNA, 19 nt, Homo sapiens
gaauggccaauauaaacca

SEQ ID NO: 23708 - RNA, 19 nt, Homo sapiens
auaugcaguuuauguguca

SEQ ID NO: 23709 - RNA, 19 nt, Homo sapiens
caagagagccaccccuuuc

SEQ ID NO: 23710 - RNA, 19 nt, Homo sapiens
gguauugcccaccgagauc

SEQ ID NO: 23711 - RNA, 19 nt, Homo sapiens
cuuaugcucuucuccuucu

SEQ ID NO: 23712 - RNA, 19 nt, Homo sapiens
gccuggcauuucuccauga

SEQ ID NO: 23713 - RNA, 19 nt, Homo sapiens
gaggucaugcagugguuug

SEQ ID NO: 23714 - RNA, 19 nt, Homo sapiens
gggcuuugggcauuacuuc

SEQ ID NO: 23715 - RNA, 19 nt, Homo sapiens
augcaaggaugccgagaca

SEQ ID NO: 23716 - RNA, 19 nt, Homo sapiens
cccuaccucugaugagcua

SEQ ID NO: 23717 - RNA, 19 nt, Homo sapiens
gaugagaucuguccgauuu

SEQ ID NO: 23718 - RNA, 19 nt, Homo sapiens
ccaaugcaauuccacuuua

SEQ ID NO: 23719 - RNA, 19 nt, Homo sapiens
ggacaaauguagcccaaau

SEQ ID NO: 23720 - RNA, 19 nt, Homo sapiens
gagcuucuauccagucuuu

SEQ ID NO: 23721 - RNA, 19 nt, Homo sapiens
gcagauuacuggugacuau

SEQ ID NO: 23722 - RNA, 19 nt, Homo sapiens
ccacauugaugaauacauu

SEQ ID NO: 23723 - RNA, 19 nt, Homo sapiens
ugaaacaucuuccaccaaa

SEQ ID NO: 23724 - RNA, 19 nt, Homo sapiens
gaagacagacaauuacauu

SEQ ID NO: 23725 - RNA, 19 nt, Homo sapiens
ggaaggcccugcuggaaau

SEQ ID NO: 23726 - RNA, 19 nt, Homo sapiens
agaagaaucugacccuaaa

SEQ ID NO: 23727 - RNA, 19 nt, Homo sapiens
cuaaugaucucacugucua

SEQ ID NO: 23728 - RNA, 19 nt, Homo sapiens
gaaggacgguguaguuuac

SEQ ID NO: 23729 - RNA, 19 nt, Homo sapiens
gaagagaaacaaauugaug

SEQ ID NO: 23730 - RNA, 19 nt, Homo sapiens
ggucuuaaaucaacagaau

SEQ ID NO: 23731 - RNA, 19 nt, Homo sapiens
gacggaagacuguuaauuu

SEQ ID NO: 23732 - RNA, 19 nt, Homo sapiens
uaugaaaccugguguuaug

SEQ ID NO: 23733 - RNA, 19 nt, Homo sapiens
ccaaauugaugcugacaga

SEQ ID NO: 23734 - RNA, 19 nt, Homo sapiens
agaauuuccuuccacauuu

SEQ ID NO: 23735 - RNA, 19 nt, Homo sapiens
gaaacaaauugaugaugca

SEQ ID NO: 23736 - RNA, 19 nt, Homo sapiens
ggaagacuguuaauuuguc

SEQ ID NO: 23737 - RNA, 19 nt, Homo sapiens
ucucauggccuaaauuuaa

SEQ ID NO: 23738 - RNA, 19 nt, Homo sapiens
gagaagaaucugacccuaa

SEQ ID NO: 23739 - RNA, 19 nt, Homo sapiens
agaaauacaugcagaaguc

SEQ ID NO: 23740 - RNA, 19 nt, Homo sapiens
ccucugaagucaaagauga

SEQ ID NO: 23741 - RNA, 19 nt, Homo sapiens
gcuaugaaaccugguguua

SEQ ID NO: 23742 - RNA, 19 nt, Homo sapiens
gaugaugaguccaaacaca

SEQ ID NO: 23743 - RNA, 19 nt, Homo sapiens
gaacgaggcaugaauacgu

SEQ ID NO: 23744 - RNA, 19 nt, Homo sapiens
ggguuacaguugaagauuu

SEQ ID NO: 23745 - RNA, 19 nt, Homo sapiens
ggacggaagacuguuaauu

SEQ ID NO: 23746 - RNA, 19 nt, Homo sapiens
gaugcaagcacacauauuc

SEQ ID NO: 23747 - RNA, 19 nt, Homo sapiens
cuacugugcuauccuagaa

SEQ ID NO: 23748 - RNA, 19 nt, Homo sapiens
aagcugagcaccugugaua

SEQ ID NO: 23749 - RNA, 19 nt, Homo sapiens
cuuaugaccugacuguuga

SEQ ID NO: 23750 - RNA, 19 nt, Homo sapiens
ugaaggacgguguaguuua

SEQ ID NO: 23751 - RNA, 19 nt, Homo sapiens
gcacuaugcauacgugaga

SEQ ID NO: 23752 - RNA, 19 nt, Homo sapiens
gaauccaucuuacacuuac

SEQ ID NO: 23753 - RNA, 19 nt, Homo sapiens
caaacacaguggccacaug

SEQ ID NO: 23754 - RNA, 19 nt, Homo sapiens
caaggacggaagacuguua

SEQ ID NO: 23755 - RNA, 19 nt, Homo sapiens
uuaacgagauggacgaguu

SEQ ID NO: 23756 - RNA, 19 nt, Homo sapiens
uuucagagagugcagauua

SEQ ID NO: 23757 - RNA, 19 nt, Homo sapiens
gaaaggaacgaggcaugaa

SEQ ID NO: 23758 - RNA, 19 nt, Homo sapiens
caggaucuaugauguguuc

SEQ ID NO: 23759 - RNA, 19 nt, Homo sapiens
gcauaucacuggcuuugac

SEQ ID NO: 23760 - RNA, 19 nt, Homo sapiens
uaguuuacgucuauccuaa

SEQ ID NO: 23761 - RNA, 19 nt, Homo sapiens
acggaagacuguuaauuug

SEQ ID NO: 23762 - RNA, 19 nt, Homo sapiens
cagaugacccaaugcaauu

SEQ ID NO: 23763 - RNA, 19 nt, Homo sapiens
gaaucugacccuaaaggaa

SEQ ID NO: 23764 - RNA, 19 nt, Homo sapiens
uuacgucuauccuaaugaa

SEQ ID NO: 23765 - RNA, 19 nt, Homo sapiens
ccaccaaacugucccacau

SEQ ID NO: 23766 - RNA, 19 nt, Homo sapiens
agaagucguuucagagguu

SEQ ID NO: 23767 - RNA, 19 nt, Homo sapiens
gguguuaugaacucaauuu

SEQ ID NO: 23768 - RNA, 19 nt, Homo sapiens
ccuacuacauguaugcaaa

SEQ ID NO: 23769 - RNA, 19 nt, Homo sapiens
acagacaaccuuccugaaa

SEQ ID NO: 23770 - RNA, 19 nt, Homo sapiens
gaauacauuuccucaucuc

SEQ ID NO: 23771 - RNA, 19 nt, Homo sapiens
ccacagaagccaggagaaa

SEQ ID NO: 23772 - RNA, 19 nt, Homo sapiens
gcucaaggaccuguuaaga

SEQ ID NO: 23773 - RNA, 19 nt, Homo sapiens
cuaaaaccccuuccaaaua

SEQ ID NO: 23774 - RNA, 19 nt, Homo sapiens
ugaaauuguuugcaaaggu

SEQ ID NO: 23775 - RNA, 19 nt, Homo sapiens
ugucccacauugaugaaua

SEQ ID NO: 23776 - RNA, 19 nt, Homo sapiens
agaaagggcuaaugaucuc

SEQ ID NO: 23777 - RNA, 19 nt, Homo sapiens
gcaugaauacguuucuguu

SEQ ID NO: 23778 - RNA, 19 nt, Homo sapiens
gaauuuccuuccacauuuu

SEQ ID NO: 23779 - RNA, 19 nt, Homo sapiens
ccaaauacuugcggaacau

SEQ ID NO: 23780 - RNA, 19 nt, Homo sapiens
gaaaccugguguuaugaac

SEQ ID NO: 23781 - RNA, 19 nt, Homo sapiens
ucaaggauuucagcaacaa

SEQ ID NO: 23782 - RNA, 19 nt, Homo sapiens
uagccuauuucuagaguau

SEQ ID NO: 23783 - RNA, 19 nt, Homo sapiens
uacgggaccucuacuugaa

SEQ ID NO: 23784 - RNA, 19 nt, Homo sapiens
agucuccucucucuucuuu

SEQ ID NO: 23785 - RNA, 19 nt, Homo sapiens
ugaaguuccucuccuccaa

SEQ ID NO: 23786 - RNA, 19 nt, Homo sapiens
cagcaaagaugagccuaag

SEQ ID NO: 23787 - RNA, 19 nt, Homo sapiens
ugaagcagcagucagcaaa

SEQ ID NO: 23788 - RNA, 19 nt, Homo sapiens
acucccagcugaagagaaa

SEQ ID NO: 23789 - RNA, 19 nt, Homo sapiens
gcugagcaccugugauaug

SEQ ID NO: 23790 - RNA, 19 nt, Homo sapiens
gggaauauuuugccacuau

SEQ ID NO: 23791 - RNA, 19 nt, Homo sapiens
ggacacccauauccaugca

SEQ ID NO: 23792 - RNA, 19 nt, Homo sapiens
ugagaugcaagcacacaua

SEQ ID NO: 23793 - RNA, 19 nt, Homo sapiens
gaggaaggcccugcuggaa

SEQ ID NO: 23794 - RNA, 19 nt, Homo sapiens
ugaccugacuguugauucu

SEQ ID NO: 23795 - RNA, 19 nt, Homo sapiens
gcaccaaagagaagaaucu

SEQ ID NO: 23796 - RNA, 19 nt, Homo sapiens
gcuaucaccucaaaaugaa

SEQ ID NO: 23797 - RNA, 19 nt, Homo sapiens
caaaugagagcuucuaucc

SEQ ID NO: 23798 - RNA, 19 nt, Homo sapiens
gcaaaugagagcuucuauc

SEQ ID NO: 23799 - RNA, 19 nt, Homo sapiens
gagaugcaagcacacauau

SEQ ID NO: 23800 - RNA, 19 nt, Homo sapiens
uaaaguuucugggcgacaa

SEQ ID NO: 23801 - RNA, 19 nt, Homo sapiens
gaacagugucuugcagugu

SEQ ID NO: 23802 - RNA, 19 nt, Homo sapiens
ccgcauggccuaucgcuau

SEQ ID NO: 23803 - RNA, 19 nt, Homo sapiens
gauauccggaggacaaaug

SEQ ID NO: 23804 - RNA, 19 nt, Homo sapiens
agaauccaucuuacacuua

SEQ ID NO: 23805 - RNA, 19 nt, Homo sapiens
aggcuuggguagcaaauga

SEQ ID NO: 23806 - RNA, 19 nt, Homo sapiens
uaaaaccccuuccaaauac

SEQ ID NO: 23807 - RNA, 19 nt, Homo sapiens
caaacugucccacauugau

SEQ ID NO: 23808 - RNA, 19 nt, Homo sapiens
cgacaauuaccuugaggaa

SEQ ID NO: 23809 - RNA, 19 nt, Homo sapiens
ucagaaagggcuaaugauc

SEQ ID NO: 23810 - RNA, 19 nt, Homo sapiens
ucaccacuaaguaacaaua

SEQ ID NO: 23811 - RNA, 19 nt, Homo sapiens
ccaugucaccacuaaguaa

SEQ ID NO: 23812 - RNA, 19 nt, Homo sapiens
ucaacagccugagaaagga

SEQ ID NO: 23813 - RNA, 19 nt, Homo sapiens
gcaugaaccagaaacaucu

SEQ ID NO: 23814 - RNA, 19 nt, Homo sapiens
acccaaaucuggacaccuu

SEQ ID NO: 23815 - RNA, 19 nt, Homo sapiens
cagacaaccuuccugaaaa

SEQ ID NO: 23816 - RNA, 19 nt, Homo sapiens
ugaauacauuuccucaucu

SEQ ID NO: 23817 - RNA, 19 nt, Homo sapiens
gaaagugggugcuggguuu

SEQ ID NO: 23818 - RNA, 19 nt, Homo sapiens
ggaacugcaucucuucuua

SEQ ID NO: 23819 - RNA, 19 nt, Homo sapiens
ccaaauaucccuuuaagaa

SEQ ID NO: 23820 - RNA, 19 nt, Homo sapiens
gcugugaacugcaguguuu

SEQ ID NO: 23821 - RNA, 19 nt, Homo sapiens
gaacugcaguguuucauac

SEQ ID NO: 23822 - RNA, 19 nt, Homo sapiens
ggucagauguggaaggaaa

SEQ ID NO: 23823 - RNA, 19 nt, Homo sapiens
ucaaggaggugaugucaga

SEQ ID NO: 23824 - RNA, 19 nt, Homo sapiens
guacuuugcucacaucauc

SEQ ID NO: 23825 - RNA, 19 nt, Homo sapiens
gcugaauuccuguuuguua

SEQ ID NO: 23826 - RNA, 19 nt, Homo sapiens
ggaaucugcucauuguugu

SEQ ID NO: 23827 - RNA, 19 nt, Homo sapiens
caaugagccugguccauga

SEQ ID NO: 23828 - RNA, 19 nt, Homo sapiens
gcagcugccuuguguuaug

SEQ ID NO: 23829 - RNA, 19 nt, Homo sapiens
gaaguacuuugcucacauc

SEQ ID NO: 23830 - RNA, 19 nt, Homo sapiens
ggaaguacuuugcucacau

SEQ ID NO: 23831 - RNA, 19 nt, Homo sapiens
caagcaagauuuccugaag

SEQ ID NO: 23832 - RNA, 19 nt, Homo sapiens
cgaaccaucuuuccuagug

SEQ ID NO: 23833 - RNA, 19 nt, Homo sapiens
ggagguggcuguggaugga

SEQ ID NO: 23834 - RNA, 19 nt, Homo sapiens
ggagugguguucccagugu

SEQ ID NO: 23835 - RNA, 19 nt, Homo sapiens
gagagcaaauaccagaaug

SEQ ID NO: 23836 - RNA, 19 nt, Homo sapiens
ccagagcuuugaccagauu

SEQ ID NO: 23837 - RNA, 19 nt, Homo sapiens
ggccaaauaucccuuuaag

SEQ ID NO: 23838 - RNA, 19 nt, Homo sapiens
gcaagcccaaggccaaaua

SEQ ID NO: 23839 - RNA, 19 nt, Homo sapiens
ccaaggagccgcugaugga

SEQ ID NO: 23840 - RNA, 19 nt, Homo sapiens
ccuagugcaugagaaauaa

SEQ ID NO: 23841 - RNA, 19 nt, Homo sapiens
ccacaucuccgccaaguca

SEQ ID NO: 23842 - RNA, 19 nt, Homo sapiens
gggaaucugcucauuguug

SEQ ID NO: 23843 - RNA, 19 nt, Homo sapiens
ccacaucgcagcacuuuua

SEQ ID NO: 23844 - RNA, 19 nt, Homo sapiens
caaguuuaaugccaaauac

SEQ ID NO: 23845 - RNA, 19 nt, Homo sapiens
gaaagugccacaccgagau

SEQ ID NO: 23846 - RNA, 19 nt, Homo sapiens
ugacaaguuuaaugccaaa

SEQ ID NO: 23847 - RNA, 19 nt, Homo sapiens
gagcagggccgugaacaga

SEQ ID NO: 23848 - RNA, 19 nt, Homo sapiens
gaacacuuuccaucgcuuu

SEQ ID NO: 23849 - RNA, 19 nt, Homo sapiens
caucuuuccuagugcauga

SEQ ID NO: 23850 - RNA, 19 nt, Homo sapiens
cugcaugucuccauucuuc

SEQ ID NO: 23851 - RNA, 19 nt, Homo sapiens
gcucagcuccugcgauaug

SEQ ID NO: 23852 - RNA, 19 nt, Homo sapiens
uagagcacguggaugguuu

SEQ ID NO: 23853 - RNA, 19 nt, Homo sapiens
gugcugauggcccugauua

SEQ ID NO: 23854 - RNA, 19 nt, Homo sapiens
ggguagagcugggccuaga

SEQ ID NO: 23855 - RNA, 19 nt, Homo sapiens
gaacugcaucucuucuuag

SEQ ID NO: 23856 - RNA, 19 nt, Homo sapiens
guucuggacugaggccuuu

SEQ ID NO: 23857 - RNA, 19 nt, Homo sapiens
caaauaucccuuuaagaag

SEQ ID NO: 23858 - RNA, 19 nt, Homo sapiens
gaaagcaaagccugggaau

SEQ ID NO: 23859 - RNA, 19 nt, Homo sapiens
ggagagcaaauaccagaau

SEQ ID NO: 23860 - RNA, 19 nt, Homo sapiens
cagcuagccuggacuuugg

SEQ ID NO: 23861 - RNA, 19 nt, Homo sapiens
ggacagugacucggaccua

SEQ ID NO: 23862 - RNA, 19 nt, Homo sapiens
gaccacaucuccgccaagu

SEQ ID NO: 23863 - RNA, 19 nt, Homo sapiens
caugcuggcugagaacauu

SEQ ID NO: 23864 - RNA, 19 nt, Homo sapiens
gaggacaacccacccuaug

SEQ ID NO: 23865 - RNA, 19 nt, Homo sapiens
cugaauuccuguuuguuau

SEQ ID NO: 23866 - RNA, 19 nt, Homo sapiens
aagcaagauuuccugaaga

SEQ ID NO: 23867 - RNA, 19 nt, Homo sapiens
gcaacagcgugcucaugag

SEQ ID NO: 23868 - RNA, 19 nt, Homo sapiens
gggaaguacuuugcucaca

SEQ ID NO: 23869 - RNA, 19 nt, Homo sapiens
acaccgagauuucuacaac

SEQ ID NO: 23870 - RNA, 19 nt, Homo sapiens
ccauaaagucauucugcua

SEQ ID NO: 23871 - RNA, 19 nt, Homo sapiens
cugggaaucugcucauugu

SEQ ID NO: 23872 - RNA, 19 nt, Homo sapiens
uccgagagaucuucaucaa

SEQ ID NO: 23873 - RNA, 19 nt, Homo sapiens
ugcaugugcuacucaauga

SEQ ID NO: 23874 - RNA, 19 nt, Homo sapiens
auacgaaccaucuuuccua

SEQ ID NO: 23875 - RNA, 19 nt, Homo sapiens
ggaggacaacccacccuau

SEQ ID NO: 23876 - RNA, 19 nt, Homo sapiens
ccaucgcuuugacaaguuu

SEQ ID NO: 23877 - RNA, 19 nt, Homo sapiens
gcugcugaauuccuguuug

SEQ ID NO: 23878 - RNA, 19 nt, Homo sapiens
gcuccaaguuccagaugca

SEQ ID NO: 23879 - RNA, 19 nt, Homo sapiens
ugacgucaaugugcugaug

SEQ ID NO: 23880 - RNA, 19 nt, Homo sapiens
gagggcucuugguggguua

SEQ ID NO: 23881 - RNA, 19 nt, Homo sapiens
cuacaccuuugccaacaug

SEQ ID NO: 23882 - RNA, 19 nt, Homo sapiens
ccuggacuuuggcuucuuu

SEQ ID NO: 23883 - RNA, 19 nt, Homo sapiens
gagcaaauaccagaaugca

SEQ ID NO: 23884 - RNA, 19 nt, Homo sapiens
gcaugaaccagaagcaucu

SEQ ID NO: 23885 - RNA, 19 nt, Homo sapiens
ccucagcuaucaccggaau

SEQ ID NO: 23886 - RNA, 19 nt, Homo sapiens
cuagacaacaugagaaauc

SEQ ID NO: 23887 - RNA, 19 nt, Homo sapiens
uguuugggcucagguauug

SEQ ID NO: 23888 - RNA, 19 nt, Homo sapiens
aagcaaagccugggaaucu

SEQ ID NO: 23889 - RNA, 19 nt, Homo sapiens
caggguaucugggaaguac

SEQ ID NO: 23890 - RNA, 19 nt, Homo sapiens
cagaggugcuggaccacau

SEQ ID NO: 23891 - RNA, 19 nt, Homo sapiens
cgcaacagcgugcucauga

SEQ ID NO: 23892 - RNA, 19 nt, Homo sapiens
uggagcagcacccguauga

SEQ ID NO: 23893 - RNA, 19 nt, Homo sapiens
ggagcgugaugugcuggaa

SEQ ID NO: 23894 - RNA, 19 nt, Homo sapiens
ggaccuacagcucuacaag

SEQ ID NO: 23895 - RNA, 19 nt, Homo sapiens
gaccugcgcacgucuaugg

SEQ ID NO: 23896 - RNA, 19 nt, Homo sapiens
gcugcaaaguccuggaucu

SEQ ID NO: 23897 - RNA, 19 nt, Homo sapiens
gugagaugcuggagaccau

SEQ ID NO: 23898 - RNA, 19 nt, Homo sapiens
acucggaccuacagcucua

SEQ ID NO: 23899 - RNA, 19 nt, Homo sapiens
gaucccagcuggccccuau

SEQ ID NO: 23900 - RNA, 19 nt, Homo sapiens
cugaugaucccuugcaguu

SEQ ID NO: 23901 - RNA, 19 nt, Homo sapiens
gaugaguccaagccugaaa

SEQ ID NO: 23902 - RNA, 19 nt, Homo sapiens
gcugauggcccugauuauc

SEQ ID NO: 23903 - RNA, 19 nt, Homo sapiens
gaucagccaggaugucaag

SEQ ID NO: 23904 - RNA, 19 nt, Homo sapiens
aagccugacuguccuaugg

SEQ ID NO: 23905 - RNA, 19 nt, Homo sapiens
guaccugagcuccaaguuc

SEQ ID NO: 23906 - RNA, 19 nt, Homo sapiens
gcacccguaugagcacugu

SEQ ID NO: 23907 - RNA, 19 nt, Homo sapiens
cugcaguguuucauacgaa

SEQ ID NO: 23908 - RNA, 19 nt, Homo sapiens
acugaggccuuugcuguga

SEQ ID NO: 23909 - RNA, 19 nt, Homo sapiens
cgcaggcaguccagaguga

SEQ ID NO: 23910 - RNA, 19 nt, Homo sapiens
cggcuucucgcacaaggua

SEQ ID NO: 23911 - RNA, 19 nt, Homo sapiens
agcugcggcucuccauuua

SEQ ID NO: 23912 - RNA, 19 nt, Homo sapiens
cugcugaauuccuguuugu

SEQ ID NO: 23913 - RNA, 19 nt, Homo sapiens
ucccagccauggcauccua

SEQ ID NO: 23914 - RNA, 19 nt, Homo sapiens
cagcugccuuguguuaugu

SEQ ID NO: 23915 - RNA, 19 nt, Homo sapiens
gagccugguccaugaagug

SEQ ID NO: 23916 - RNA, 19 nt, Homo sapiens
cguccugcaugaaccagaa

SEQ ID NO: 23917 - RNA, 19 nt, Homo sapiens
gcacacagcuaauaaguaa

SEQ ID NO: 23918 - RNA, 19 nt, Homo sapiens
caaagaagcugcugccaaa

SEQ ID NO: 23919 - RNA, 19 nt, Homo sapiens
gaacaucucugaaguggau

SEQ ID NO: 23920 - RNA, 19 nt, Homo sapiens
gcacagcgaccacauguuu

SEQ ID NO: 23921 - RNA, 19 nt, Homo sapiens
ccaacuagguccagcauuu

SEQ ID NO: 23922 - RNA, 19 nt, Homo sapiens
gcacuugucuauacuuguu

SEQ ID NO: 23923 - RNA, 19 nt, Homo sapiens
gaaggaagcacuuauggaa

SEQ ID NO: 23924 - RNA, 19 nt, Homo sapiens
uguaguaggugcucaauaa

SEQ ID NO: 23925 - RNA, 19 nt, Homo sapiens
guaacaagauggugacuuc

SEQ ID NO: 23926 - RNA, 19 nt, Homo sapiens
gagcuucaccucuuccuua

SEQ ID NO: 23927 - RNA, 19 nt, Homo sapiens
cgacugaacuuucuggaau

SEQ ID NO: 23928 - RNA, 19 nt, Homo sapiens
ggaugccucugaagaaauu

SEQ ID NO: 23929 - RNA, 19 nt, Homo sapiens
ggaagaauaugccauugca

SEQ ID NO: 23930 - RNA, 19 nt, Homo sapiens
ggaagaugcuggagaacau

SEQ ID NO: 23931 - RNA, 19 nt, Homo sapiens
gaaaugauauucgaaagac

SEQ ID NO: 23932 - RNA, 19 nt, Homo sapiens
gagcugagcacuugucuau

SEQ ID NO: 23933 - RNA, 19 nt, Homo sapiens
uaugagaccuuaugcaaug

SEQ ID NO: 23934 - RNA, 19 nt, Homo sapiens
caugagauguuaaacgaaa

SEQ ID NO: 23935 - RNA, 19 nt, Homo sapiens
gugaaucuccucaugaaua

SEQ ID NO: 23936 - RNA, 19 nt, Homo sapiens
ggacuucuauaacgugaga

SEQ ID NO: 23937 - RNA, 19 nt, Homo sapiens
gaagguguuugcuaaagug

SEQ ID NO: 23938 - RNA, 19 nt, Homo sapiens
cggagaagguguuugcuaa

SEQ ID NO: 23939 - RNA, 19 nt, Homo sapiens
gaagccaaauguacucaug

SEQ ID NO: 23940 - RNA, 19 nt, Homo sapiens
gaguuaacaugcucacuug

SEQ ID NO: 23941 - RNA, 19 nt, Homo sapiens
agaaggaccugaaggaaau

SEQ ID NO: 23942 - RNA, 19 nt, Homo sapiens
caagaagaguccgguauug

SEQ ID NO: 23943 - RNA, 19 nt, Homo sapiens
uaaacgaaauguccgaguu

SEQ ID NO: 23944 - RNA, 19 nt, Homo sapiens
ucaaagcuccauuucauaa

SEQ ID NO: 23945 - RNA, 19 nt, Homo sapiens
gaagaggacagcaaagaug

SEQ ID NO: 23946 - RNA, 19 nt, Homo sapiens
guaggccaauuaucacuuu

SEQ ID NO: 23947 - RNA, 19 nt, Homo sapiens
gaguuaagauggaagacuu

SEQ ID NO: 23948 - RNA, 19 nt, Homo sapiens
gauaugagaccuuaugcaa

SEQ ID NO: 23949 - RNA, 19 nt, Homo sapiens
ggucuacucucccaacaug

SEQ ID NO: 23950 - RNA, 19 nt, Homo sapiens
gcugagcacuugucuauac

SEQ ID NO: 23951 - RNA, 19 nt, Homo sapiens
ugagaaagguggacacaca

SEQ ID NO: 23952 - RNA, 19 nt, Homo sapiens
agagggagcugcagaagga

SEQ ID NO: 23953 - RNA, 19 nt, Homo sapiens
ccagguaggcuaauuggua

SEQ ID NO: 23954 - RNA, 19 nt, Homo sapiens
ggaaaugauauucgaaaga

SEQ ID NO: 23955 - RNA, 19 nt, Homo sapiens
aaacuggauuuccuuauuc

SEQ ID NO: 23956 - RNA, 19 nt, Homo sapiens
gagcacuugucuauacuug

SEQ ID NO: 23957 - RNA, 19 nt, Homo sapiens
ggacuuuccucugugaaga

SEQ ID NO: 23958 - RNA, 19 nt, Homo sapiens
gcuaauaguggucaagauu

SEQ ID NO: 23959 - RNA, 19 nt, Homo sapiens
gaagagaucaccgccuuga

SEQ ID NO: 23960 - RNA, 19 nt, Homo sapiens
gcuaugaaaucagaagaga

SEQ ID NO: 23961 - RNA, 19 nt, Homo sapiens
ugaaggaaaugauauucga

SEQ ID NO: 23962 - RNA, 19 nt, Homo sapiens
gaugaucucuguuccuuuu

SEQ ID NO: 23963 - RNA, 19 nt, Homo sapiens
caaagugacugcguucauc

SEQ ID NO: 23964 - RNA, 19 nt, Homo sapiens
gagaagguguuugcuaaag

SEQ ID NO: 23965 - RNA, 19 nt, Homo sapiens
agacaaauguggcucagau

SEQ ID NO: 23966 - RNA, 19 nt, Homo sapiens
ggaccugaaggaaaugaua

SEQ ID NO: 23967 - RNA, 19 nt, Homo sapiens
gagaagaggacagcaaaga

SEQ ID NO: 23968 - RNA, 19 nt, Homo sapiens
ccaauuaucacuuuaccaa

SEQ ID NO: 23969 - RNA, 19 nt, Homo sapiens
uaaagaaggaccugaagga

SEQ ID NO: 23970 - RNA, 19 nt, Homo sapiens
cgaaauguccgaguucaaa

SEQ ID NO: 23971 - RNA, 19 nt, Homo sapiens
ggacugcauguuucucuuu

SEQ ID NO: 23972 - RNA, 19 nt, Homo sapiens
gcaaaugccgccacagcaa

SEQ ID NO: 23973 - RNA, 19 nt, Homo sapiens
gcucuaauaugcuacaacu

SEQ ID NO: 23974 - RNA, 19 nt, Homo sapiens
gaaaacagccacuccuauu

SEQ ID NO: 23975 - RNA, 19 nt, Homo sapiens
ggucagaugccaaguaaca

SEQ ID NO: 23976 - RNA, 19 nt, Homo sapiens
ccucacugcugacaacauu

SEQ ID NO: 23977 - RNA, 19 nt, Homo sapiens
gagcagaacccacccuaca

SEQ ID NO: 23978 - RNA, 19 nt, Homo sapiens
gggcugcuacauaauauuu

SEQ ID NO: 23979 - RNA, 19 nt, Homo sapiens
uuucaaagcuccauuucau

SEQ ID NO: 23980 - RNA, 19 nt, Homo sapiens
cuaaagugcuccgagaaga

SEQ ID NO: 23981 - RNA, 19 nt, Homo sapiens
caugcucacuuguuaguau

SEQ ID NO: 23982 - RNA, 19 nt, Homo sapiens
cugcucacuuuaagaguua

SEQ ID NO: 23983 - RNA, 19 nt, Homo sapiens
ggaagcacuuauggaagaa

SEQ ID NO: 23984 - RNA, 19 nt, Homo sapiens
aggaagcacuuauggaaga

SEQ ID NO: 23985 - RNA, 19 nt, Homo sapiens
agacuuccuucuugacaaa

SEQ ID NO: 23986 - RNA, 19 nt, Homo sapiens
ggagaagguguuugcuaaa

SEQ ID NO: 23987 - RNA, 19 nt, Homo sapiens
ugucuauacuuguuccuaa

SEQ ID NO: 23988 - RNA, 19 nt, Homo sapiens
gauauucgaaagacaaaug

SEQ ID NO: 23989 - RNA, 19 nt, Homo sapiens
acaagggacugcauguuuc

SEQ ID NO: 23990 - RNA, 19 nt, Homo sapiens
cacaagggacugcauguuu

SEQ ID NO: 23991 - RNA, 19 nt, Homo sapiens
gcagacauuccaccgcuuu

SEQ ID NO: 23992 - RNA, 19 nt, Homo sapiens
cuacugugaugacuucaga

SEQ ID NO: 23993 - RNA, 19 nt, Homo sapiens
gcuaauugguaguuguuca

SEQ ID NO: 23994 - RNA, 19 nt, Homo sapiens
acaguuuguuccucgaaua

SEQ ID NO: 23995 - RNA, 19 nt, Homo sapiens
aguaggugcucaauaaaug

SEQ ID NO: 23996 - RNA, 19 nt, Homo sapiens
uaucuacugugaugacuuc

SEQ ID NO: 23997 - RNA, 19 nt, Homo sapiens
gaaggaaaugauauucgaa

SEQ ID NO: 23998 - RNA, 19 nt, Homo sapiens
aagcacuuauggaagaaua

SEQ ID NO: 23999 - RNA, 19 nt, Homo sapiens
caaaauuucucccuuaucu

SEQ ID NO: 24000 - RNA, 19 nt, Homo sapiens
uaauaggccuaaacuggau

SEQ ID NO: 24001 - RNA, 19 nt, Homo sapiens
uaagggcacacagcuaaua

SEQ ID NO: 24002 - RNA, 19 nt, Homo sapiens
ggccagauaagugaaauuu

SEQ ID NO: 24003 - RNA, 19 nt, Homo sapiens
gggcuacuuugaaggaguu

SEQ ID NO: 24004 - RNA, 19 nt, Homo sapiens
gcacugcucacuuuaagag

SEQ ID NO: 24005 - RNA, 19 nt, Homo sapiens
ggauggcauuccgauauga

SEQ ID NO: 24006 - RNA, 19 nt, Homo sapiens
cuucaccucuuccuuaaau

SEQ ID NO: 24007 - RNA, 19 nt, Homo sapiens
ucaagaagaguccgguauu

SEQ ID NO: 24008 - RNA, 19 nt, Homo sapiens
ggugcucaauaaaugcaua

SEQ ID NO: 24009 - RNA, 19 nt, Homo sapiens
aaagugaggguuuggacua

SEQ ID NO: 24010 - RNA, 19 nt, Homo sapiens
ugaaggaguuaagauggaa

SEQ ID NO: 24011 - RNA, 19 nt, Homo sapiens
cuggucagaugccaaguaa

SEQ ID NO: 24012 - RNA, 19 nt, Homo sapiens
guucagccuucaugagaug

SEQ ID NO: 24013 - RNA, 19 nt, Homo sapiens
ugaaucuccucaugaauac

SEQ ID NO: 24014 - RNA, 19 nt, Homo sapiens
caaagcuccauuucauaaa

SEQ ID NO: 24015 - RNA, 19 nt, Homo sapiens
caauuucaaagcuccauuu

SEQ ID NO: 24016 - RNA, 19 nt, Homo sapiens
ucugggagcugagcacuug

SEQ ID NO: 24017 - RNA, 19 nt, Homo sapiens
cagaagaugugaugaauua

SEQ ID NO: 24018 - RNA, 19 nt, Homo sapiens
gaaaguguuugaagaguuu

SEQ ID NO: 24019 - RNA, 19 nt, Homo sapiens
gcaagaaggagcucaguua

SEQ ID NO: 24020 - RNA, 19 nt, Homo sapiens
gaacuucacccgacgcuua

SEQ ID NO: 24021 - RNA, 19 nt, Homo sapiens
ggaauugccuccuggcuuu

SEQ ID NO: 24022 - RNA, 19 nt, Homo sapiens
gacaagcacugauuuggua

SEQ ID NO: 24023 - RNA, 19 nt, Homo sapiens
caacuuggcugaaucugaa

SEQ ID NO: 24024 - RNA, 19 nt, Homo sapiens
aaacagcuccucuauauuu

SEQ ID NO: 24025 - RNA, 19 nt, Homo sapiens
gcagaaggcuacauauaca

SEQ ID NO: 24026 - RNA, 19 nt, Homo sapiens
gaugaauuauccuguagua

SEQ ID NO: 24027 - RNA, 19 nt, Homo sapiens
gcaauuuccugacauaaag

SEQ ID NO: 24028 - RNA, 19 nt, Homo sapiens
gaacaucaucaguuucuuu

SEQ ID NO: 24029 - RNA, 19 nt, Homo sapiens
gaaaaugguuggugagaaa

SEQ ID NO: 24030 - RNA, 19 nt, Homo sapiens
uggaaacacugcaugauuu

SEQ ID NO: 24031 - RNA, 19 nt, Homo sapiens
gacaacaccuucccagaau

SEQ ID NO: 24032 - RNA, 19 nt, Homo sapiens
acagagaccuugccaccua

SEQ ID NO: 24033 - RNA, 19 nt, Homo sapiens
ugacuuacaagaagaguua

SEQ ID NO: 24034 - RNA, 19 nt, Homo sapiens
gagauuggguagaaagaug

SEQ ID NO: 24035 - RNA, 19 nt, Homo sapiens
ccacaaaucaucuguaaca

SEQ ID NO: 24036 - RNA, 19 nt, Homo sapiens
gcuaagcagucuucucuuc

SEQ ID NO: 24037 - RNA, 19 nt, Homo sapiens
gaaagcacagaaaguguuu

SEQ ID NO: 24038 - RNA, 19 nt, Homo sapiens
ggaaagcugaugagacaaa

SEQ ID NO: 24039 - RNA, 19 nt, Homo sapiens
caucagguguaucguauug

SEQ ID NO: 24040 - RNA, 19 nt, Homo sapiens
caaacuguaugaagugaug

SEQ ID NO: 24041 - RNA, 19 nt, Homo sapiens
cgaguuggauuuuauguua

SEQ ID NO: 24042 - RNA, 19 nt, Homo sapiens
gcugugucauuccaaauaa

SEQ ID NO: 24043 - RNA, 19 nt, Homo sapiens
caacagugccucaggagaa

SEQ ID NO: 24044 - RNA, 19 nt, Homo sapiens
ccaggauacuucauuauuc

SEQ ID NO: 24045 - RNA, 19 nt, Homo sapiens
gaagaguuaccaucauuau

SEQ ID NO: 24046 - RNA, 19 nt, Homo sapiens
aagaauauguccagaacuu

SEQ ID NO: 24047 - RNA, 19 nt, Homo sapiens
gcaaaagagucaacaguau

SEQ ID NO: 24048 - RNA, 19 nt, Homo sapiens
aaacuaaacugcugcaaaa

SEQ ID NO: 24049 - RNA, 19 nt, Homo sapiens
gaucagacuuuaauuucuc

SEQ ID NO: 24050 - RNA, 19 nt, Homo sapiens
gggaagauguaucaaugga

SEQ ID NO: 24051 - RNA, 19 nt, Homo sapiens
uaaggcagaagaagaauuu

SEQ ID NO: 24052 - RNA, 19 nt, Homo sapiens
agacaaaccuugggaagau

SEQ ID NO: 24053 - RNA, 19 nt, Homo sapiens
ggaggccucucaggaauug

SEQ ID NO: 24054 - RNA, 19 nt, Homo sapiens
ggacgacaagcacugauuu

SEQ ID NO: 24055 - RNA, 19 nt, Homo sapiens
caacuuuguuccagaaauc

SEQ ID NO: 24056 - RNA, 19 nt, Homo sapiens
uguaugaagugaugacaaa

SEQ ID NO: 24057 - RNA, 19 nt, Homo sapiens
ccagaucagacuuuaauuu

SEQ ID NO: 24058 - RNA, 19 nt, Homo sapiens
aagaagaguuaccaucauu

SEQ ID NO: 24059 - RNA, 19 nt, Homo sapiens
guggauggguccuugcuaa

SEQ ID NO: 24060 - RNA, 19 nt, Homo sapiens
gcucuuugccucucaauug

SEQ ID NO: 24061 - RNA, 19 nt, Homo sapiens
ggaggaggcagugaucaua

SEQ ID NO: 24062 - RNA, 19 nt, Homo sapiens
gcacagaaaguguuugaag

SEQ ID NO: 24063 - RNA, 19 nt, Homo sapiens
uagauuagggcaacaagua

SEQ ID NO: 24064 - RNA, 19 nt, Homo sapiens
caggauacuucauuauuca

SEQ ID NO: 24065 - RNA, 19 nt, Homo sapiens
aggagaacaucaucaguuu

SEQ ID NO: 24066 - RNA, 19 nt, Homo sapiens
gaagccaaguuucauaagg

SEQ ID NO: 24067 - RNA, 19 nt, Homo sapiens
uaaaauagaugguguaugc

SEQ ID NO: 24068 - RNA, 19 nt, Homo sapiens
cuucacagauuguucuaaa

SEQ ID NO: 24069 - RNA, 19 nt, Homo sapiens
cauaguugcuucuuuccuu

SEQ ID NO: 24070 - RNA, 19 nt, Homo sapiens
gaagaguucacuuuuguua

SEQ ID NO: 24071 - RNA, 19 nt, Homo sapiens
cacagaaaguguuugaaga

SEQ ID NO: 24072 - RNA, 19 nt, Homo sapiens
ucuaugagccugacuggua

SEQ ID NO: 24073 - RNA, 19 nt, Homo sapiens
cagagucgcugcaugaagu

SEQ ID NO: 24074 - RNA, 19 nt, Homo sapiens
ucacagagucgcugcauga

SEQ ID NO: 24075 - RNA, 19 nt, Homo sapiens
auacauaguugcuucuuuc

SEQ ID NO: 24076 - RNA, 19 nt, Homo sapiens
gaagaugugaugaauuauc

SEQ ID NO: 24077 - RNA, 19 nt, Homo sapiens
caagaagaguuaccaucau

SEQ ID NO: 24078 - RNA, 19 nt, Homo sapiens
cgaagaauauguccagaac

SEQ ID NO: 24079 - RNA, 19 nt, Homo sapiens
uuccaccucuuucuauuua

SEQ ID NO: 24080 - RNA, 19 nt, Homo sapiens
ggaaggagaaaacgaaaua

SEQ ID NO: 24081 - RNA, 19 nt, Homo sapiens
uaacguugacuuacaagaa

SEQ ID NO: 24082 - RNA, 19 nt, Homo sapiens
cuucaacgauuacccuaaa

SEQ ID NO: 24083 - RNA, 19 nt, Homo sapiens
cacagauuguucuaaagua

SEQ ID NO: 24084 - RNA, 19 nt, Homo sapiens
ugacaacaccuucccagaa

SEQ ID NO: 24085 - RNA, 19 nt, Homo sapiens
gaacuccgaggauauuuag

SEQ ID NO: 24086 - RNA, 19 nt, Homo sapiens
gaauauguccagaacuuca

SEQ ID NO: 24087 - RNA, 19 nt, Homo sapiens
gaggauauuuagcagcaau

SEQ ID NO: 24088 - RNA, 19 nt, Homo sapiens
caacaccuucccagaauga

SEQ ID NO: 24089 - RNA, 19 nt, Homo sapiens
uugaagaguuuaacguuga

SEQ ID NO: 24090 - RNA, 19 nt, Homo sapiens
agaaaguguuugaagaguu

SEQ ID NO: 24091 - RNA, 19 nt, Homo sapiens
gauacaugcauugcucuua

SEQ ID NO: 24092 - RNA, 19 nt, Homo sapiens
gcagaagaugugaugaauu

SEQ ID NO: 24093 - RNA, 19 nt, Homo sapiens
gaacuucaaacggcaagaa

SEQ ID NO: 24094 - RNA, 19 nt, Homo sapiens
gcaacuuggcugaaucuga

SEQ ID NO: 24095 - RNA, 19 nt, Homo sapiens
ucccugaggugaagaaaga

SEQ ID NO: 24096 - RNA, 19 nt, Homo sapiens
gccacaaacuguaugaagu

SEQ ID NO: 24097 - RNA, 19 nt, Homo sapiens
agucuucucuucugccuuu

SEQ ID NO: 24098 - RNA, 19 nt, Homo sapiens
uggagacucuuguacuuga

SEQ ID NO: 24099 - RNA, 19 nt, Homo sapiens
caacaaguacugcaagaag

SEQ ID NO: 24100 - RNA, 19 nt, Homo sapiens
ggcagcaaauucugaugaa

SEQ ID NO: 24101 - RNA, 19 nt, Homo sapiens
auacaugcauugcucuuau

SEQ ID NO: 24102 - RNA, 19 nt, Homo sapiens
cugaugaacuuaccuuaca

SEQ ID NO: 24103 - RNA, 19 nt, Homo sapiens
aggaugagaugacagauag

SEQ ID NO: 24104 - RNA, 19 nt, Homo sapiens
ugugaugaauuauccugua

SEQ ID NO: 24105 - RNA, 19 nt, Homo sapiens
cagaucagacuuuaauuuc

SEQ ID NO: 24106 - RNA, 19 nt, Homo sapiens
ggagaaaacgaaauaacua

SEQ ID NO: 24107 - RNA, 19 nt, Homo sapiens
cuuauucugucuggcauua

SEQ ID NO: 24108 - RNA, 19 nt, Homo sapiens
caucaucaguuucuuugag

SEQ ID NO: 24109 - RNA, 19 nt, Homo sapiens
ggcaauuuccugacauaaa

SEQ ID NO: 24110 - RNA, 19 nt, Homo sapiens
ccaccucuuucuauuuaug

SEQ ID NO: 24111 - RNA, 19 nt, Homo sapiens
ggggaaagcugaugagaca

SEQ ID NO: 24112 - RNA, 19 nt, Homo sapiens
ucccaccaauucuaaagua

SEQ ID NO: 24113 - RNA, 19 nt, Homo sapiens
caauggagcaugugugcaa

SEQ ID NO: 24114 - RNA, 19 nt, Homo sapiens
ggcaacaaguacugcaaga

SEQ ID NO: 24115 - RNA, 19 nt, Homo sapiens
guggaaacacugcaugauu

SEQ ID NO: 24116 - RNA, 19 nt, Homo sapiens
caggagaacaucaucaguu

SEQ ID NO: 24117 - RNA, 19 nt, Homo sapiens
cagaagaugugaugaauua

SEQ ID NO: 24118 - RNA, 19 nt, Homo sapiens
gaaaguguuugaagaguuu

SEQ ID NO: 24119 - RNA, 19 nt, Homo sapiens
gcaagaaggagcucaguua

SEQ ID NO: 24120 - RNA, 19 nt, Homo sapiens
gaacuucacccgacgcuua

SEQ ID NO: 24121 - RNA, 19 nt, Homo sapiens
ggaauugccuccuggcuuu

SEQ ID NO: 24122 - RNA, 19 nt, Homo sapiens
gacaagcacugauuuggua

SEQ ID NO: 24123 - RNA, 19 nt, Homo sapiens
aaacagcuccucuauauuu

SEQ ID NO: 24124 - RNA, 19 nt, Homo sapiens
gcagaaggcuacauauaca

SEQ ID NO: 24125 - RNA, 19 nt, Homo sapiens
gaugaauuauccuguagua

SEQ ID NO: 24126 - RNA, 19 nt, Homo sapiens
gcaauuuccugacauaaag

SEQ ID NO: 24127 - RNA, 19 nt, Homo sapiens
gaacaucaucaguuucuuu

SEQ ID NO: 24128 - RNA, 19 nt, Homo sapiens
gaaaaugguuggugagaaa

SEQ ID NO: 24129 - RNA, 19 nt, Homo sapiens
uggaaacacugcaugauuu

SEQ ID NO: 24130 - RNA, 19 nt, Homo sapiens
gacaacaccuucccagaau

SEQ ID NO: 24131 - RNA, 19 nt, Homo sapiens
acagagaccuugccaccua

SEQ ID NO: 24132 - RNA, 19 nt, Homo sapiens
ugacuuacaagaagaguua

SEQ ID NO: 24133 - RNA, 19 nt, Homo sapiens
gagauuggguagaaagaug

SEQ ID NO: 24134 - RNA, 19 nt, Homo sapiens
ccacaaaucaucuguaaca

SEQ ID NO: 24135 - RNA, 19 nt, Homo sapiens
gcuaagcagucuucucuuc

SEQ ID NO: 24136 - RNA, 19 nt, Homo sapiens
gaaagcacagaaaguguuu

SEQ ID NO: 24137 - RNA, 19 nt, Homo sapiens
ggaaagcugaugagacaaa

SEQ ID NO: 24138 - RNA, 19 nt, Homo sapiens
caucagguguaucguauug

SEQ ID NO: 24139 - RNA, 19 nt, Homo sapiens
caaacuguaugaagugaug

SEQ ID NO: 24140 - RNA, 19 nt, Homo sapiens
cgaguuggauuuuauguua

SEQ ID NO: 24141 - RNA, 19 nt, Homo sapiens
gcugugucauuccaaauaa

SEQ ID NO: 24142 - RNA, 19 nt, Homo sapiens
caacagugccucaggagaa

SEQ ID NO: 24143 - RNA, 19 nt, Homo sapiens
ccaggauacuucauuauuc

SEQ ID NO: 24144 - RNA, 19 nt, Homo sapiens
gaagaguuaccaucauuau

SEQ ID NO: 24145 - RNA, 19 nt, Homo sapiens
aagaauauguccagaacuu

SEQ ID NO: 24146 - RNA, 19 nt, Homo sapiens
gcaaaagagucaacaguau

SEQ ID NO: 24147 - RNA, 19 nt, Homo sapiens
aaacuaaacugcugcaaaa

SEQ ID NO: 24148 - RNA, 19 nt, Homo sapiens
gaucagacuuuaauuucuc

SEQ ID NO: 24149 - RNA, 19 nt, Homo sapiens
gggaagauguaucaaugga

SEQ ID NO: 24150 - RNA, 19 nt, Homo sapiens
uaaggcagaagaagaauuu

SEQ ID NO: 24151 - RNA, 19 nt, Homo sapiens
agacaaaccuugggaagau

SEQ ID NO: 24152 - RNA, 19 nt, Homo sapiens
ggaggccucucaggaauug

SEQ ID NO: 24153 - RNA, 19 nt, Homo sapiens
ggacgacaagcacugauuu

SEQ ID NO: 24154 - RNA, 19 nt, Homo sapiens
caacuuuguuccagaaauc

SEQ ID NO: 24155 - RNA, 19 nt, Homo sapiens
uguaugaagugaugacaaa

SEQ ID NO: 24156 - RNA, 19 nt, Homo sapiens
ccagaucagacuuuaauuu

SEQ ID NO: 24157 - RNA, 19 nt, Homo sapiens
aagaagaguuaccaucauu

SEQ ID NO: 24158 - RNA, 19 nt, Homo sapiens
guggauggguccuugcuaa

SEQ ID NO: 24159 - RNA, 19 nt, Homo sapiens
gcucuuugccucucaauug

SEQ ID NO: 24160 - RNA, 19 nt, Homo sapiens
gcacagaaaguguuugaag

SEQ ID NO: 24161 - RNA, 19 nt, Homo sapiens
uagauuagggcaacaagua

SEQ ID NO: 24162 - RNA, 19 nt, Homo sapiens
caggauacuucauuauuca

SEQ ID NO: 24163 - RNA, 19 nt, Homo sapiens
aggagaacaucaucaguuu

SEQ ID NO: 24164 - RNA, 19 nt, Homo sapiens
gaagccaaguuucauaagg

SEQ ID NO: 24165 - RNA, 19 nt, Homo sapiens
uaaaauagaugguguaugc

SEQ ID NO: 24166 - RNA, 19 nt, Homo sapiens
cuucacagauuguucuaaa

SEQ ID NO: 24167 - RNA, 19 nt, Homo sapiens
cauaguugcuucuuuccuu

SEQ ID NO: 24168 - RNA, 19 nt, Homo sapiens
gaagaguucacuuuuguua

SEQ ID NO: 24169 - RNA, 19 nt, Homo sapiens
aguaugaucugcaacuuga

SEQ ID NO: 24170 - RNA, 19 nt, Homo sapiens
cacagaaaguguuugaaga

SEQ ID NO: 24171 - RNA, 19 nt, Homo sapiens
ucuaugagccugacuggua

SEQ ID NO: 24172 - RNA, 19 nt, Homo sapiens
cagagucgcugcaugaagu

SEQ ID NO: 24173 - RNA, 19 nt, Homo sapiens
ucacagagucgcugcauga

SEQ ID NO: 24174 - RNA, 19 nt, Homo sapiens
auacauaguugcuucuuuc

SEQ ID NO: 24175 - RNA, 19 nt, Homo sapiens
gaagaugugaugaauuauc

SEQ ID NO: 24176 - RNA, 19 nt, Homo sapiens
cgaagaauauguccagaac

SEQ ID NO: 24177 - RNA, 19 nt, Homo sapiens
caagaagaguuaccaucau

SEQ ID NO: 24178 - RNA, 19 nt, Homo sapiens
uuccaccucuuucuauuua

SEQ ID NO: 24179 - RNA, 19 nt, Homo sapiens
ggaaggagaaaacgaaaua

SEQ ID NO: 24180 - RNA, 19 nt, Homo sapiens
uaacguugacuuacaagaa

SEQ ID NO: 24181 - RNA, 19 nt, Homo sapiens
cuucaacgauuacccuaaa

SEQ ID NO: 24182 - RNA, 19 nt, Homo sapiens
cacagauuguucuaaagua

SEQ ID NO: 24183 - RNA, 19 nt, Homo sapiens
gaacuccgaggauauuuag

SEQ ID NO: 24184 - RNA, 19 nt, Homo sapiens
ugacaacaccuucccagaa

SEQ ID NO: 24185 - RNA, 19 nt, Homo sapiens
gaauauguccagaacuuca

SEQ ID NO: 24186 - RNA, 19 nt, Homo sapiens
gaggauauuuagcagcaau

SEQ ID NO: 24187 - RNA, 19 nt, Homo sapiens
caacaccuucccagaauga

SEQ ID NO: 24188 - RNA, 19 nt, Homo sapiens
uugaagaguuuaacguuga

SEQ ID NO: 24189 - RNA, 19 nt, Homo sapiens
agaaaguguuugaagaguu

SEQ ID NO: 24190 - RNA, 19 nt, Homo sapiens
gauacaugcauugcucuua

SEQ ID NO: 24191 - RNA, 19 nt, Homo sapiens
gcagaagaugugaugaauu

SEQ ID NO: 24192 - RNA, 19 nt, Homo sapiens
gaacuucaaacggcaagaa

SEQ ID NO: 24193 - RNA, 19 nt, Homo sapiens
ucccugaggugaagaaaga

SEQ ID NO: 24194 - RNA, 19 nt, Homo sapiens
gccacaaacuguaugaagu

SEQ ID NO: 24195 - RNA, 19 nt, Homo sapiens
agucuucucuucugccuuu

SEQ ID NO: 24196 - RNA, 19 nt, Homo sapiens
uggagacucuuguacuuga

SEQ ID NO: 24197 - RNA, 19 nt, Homo sapiens
caacaaguacugcaagaag

SEQ ID NO: 24198 - RNA, 19 nt, Homo sapiens
ggcagcaaauucugaugaa

SEQ ID NO: 24199 - RNA, 19 nt, Homo sapiens
auacaugcauugcucuuau

SEQ ID NO: 24200 - RNA, 19 nt, Homo sapiens
cugaugaacuuaccuuaca

SEQ ID NO: 24201 - RNA, 19 nt, Homo sapiens
aggaugagaugacagauag

SEQ ID NO: 24202 - RNA, 19 nt, Homo sapiens
ugugaugaauuauccugua

SEQ ID NO: 24203 - RNA, 19 nt, Homo sapiens
cagaucagacuuuaauuuc

SEQ ID NO: 24204 - RNA, 19 nt, Homo sapiens
ggagaaaacgaaauaacua

SEQ ID NO: 24205 - RNA, 19 nt, Homo sapiens
cuuauucugucuggcauua

SEQ ID NO: 24206 - RNA, 19 nt, Homo sapiens
caucaucaguuucuuugag

SEQ ID NO: 24207 - RNA, 19 nt, Homo sapiens
ggcaauuuccugacauaaa

SEQ ID NO: 24208 - RNA, 19 nt, Homo sapiens
ccaccucuuucuauuuaug

SEQ ID NO: 24209 - RNA, 19 nt, Homo sapiens
ucccaccaauucuaaagua

SEQ ID NO: 24210 - RNA, 19 nt, Homo sapiens
caauggagcaugugugcaa

SEQ ID NO: 24211 - RNA, 19 nt, Homo sapiens
ggcaacaaguacugcaaga

SEQ ID NO: 24212 - RNA, 19 nt, Homo sapiens
guggaaacacugcaugauu

SEQ ID NO: 24213 - RNA, 19 nt, Homo sapiens
caggagaacaucaucaguu

SEQ ID NO: 24214 - RNA, 19 nt, Homo sapiens
cgacagcaaguccaaauca

SEQ ID NO: 24215 - RNA, 19 nt, Homo sapiens
ggggaaagcugaugagaca

SEQ ID NO: 24216 - RNA, 19 nt, Homo sapiens
guagaaagauggggcauau

SEQ ID NO: 24217 - RNA, 19 nt, Homo sapiens
caaacaagaucgcagagaa

SEQ ID NO: 24218 - RNA, 19 nt, Homo sapiens
gcagaaagaagaacaguga

SEQ ID NO: 24219 - RNA, 19 nt, Homo sapiens
acaaggagcuggagaagug

SEQ ID NO: 24220 - RNA, 19 nt, Homo sapiens
gcucaaggcuggugaugug

SEQ ID NO: 24221 - RNA, 19 nt, Homo sapiens
aaagaaggaugaagccaaa

SEQ ID NO: 24222 - RNA, 19 nt, Homo sapiens
gaccaaggaugagcaguuu

SEQ ID NO: 24223 - RNA, 19 nt, Homo sapiens
gacaucaagucacgcauug

SEQ ID NO: 24224 - RNA, 19 nt, Homo sapiens
gaaagaagaacagugacaa

SEQ ID NO: 24225 - RNA, 19 nt, Homo sapiens
gagcaaagggaaaucaaga

SEQ ID NO: 24226 - RNA, 19 nt, Homo sapiens
uggcagagaugggcaguaa

SEQ ID NO: 24227 - RNA, 19 nt, Homo sapiens
gaacagccgcguagguuuc

SEQ ID NO: 24228 - RNA, 19 nt, Homo sapiens
cagaugagaccaaggauga

SEQ ID NO: 24229 - RNA, 19 nt, Homo sapiens
gagcagugcguccagaauu

SEQ ID NO: 24230 - RNA, 19 nt, Homo sapiens
ccagcaacgugcagaagaa

SEQ ID NO: 24231 - RNA, 19 nt, Homo sapiens
ggcguucucccaaagauua

SEQ ID NO: 24232 - RNA, 19 nt, Homo sapiens
guggagaccuucccagcaa

SEQ ID NO: 24233 - RNA, 19 nt, Homo sapiens
agaaggaucuccggaccua

SEQ ID NO: 24234 - RNA, 19 nt, Homo sapiens
ggcgcaagcugguggacua

SEQ ID NO: 24235 - RNA, 19 nt, Homo sapiens
gaagguguuugaggagaug

SEQ ID NO: 24236 - RNA, 19 nt, Homo sapiens
gaccugcuguggauggauu

SEQ ID NO: 24237 - RNA, 19 nt, Homo sapiens
cccgagaacuucacugaga

SEQ ID NO: 24238 - RNA, 19 nt, Homo sapiens
gcagagaugggcaguaaag

SEQ ID NO: 24239 - RNA, 19 nt, Homo sapiens
ggaacagccgcguagguuu

SEQ ID NO: 24240 - RNA, 19 nt, Homo sapiens
gcaagcugguggacuacga

SEQ ID NO: 24241 - RNA, 19 nt, Homo sapiens
gaagagcaaagggaaauca

SEQ ID NO: 24242 - RNA, 19 nt, Homo sapiens
ccaaggaugagcaguuuga

SEQ ID NO: 24243 - RNA, 19 nt, Homo sapiens
cgggaaagaucgccagcaa

SEQ ID NO: 24244 - RNA, 19 nt, Homo sapiens
gaacaccuccucccgaaaa

SEQ ID NO: 24245 - RNA, 19 nt, Homo sapiens
gcagggaugaggcaaacaa

SEQ ID NO: 24246 - RNA, 19 nt, Homo sapiens
acaacgaccugcuguggau

SEQ ID NO: 24247 - RNA, 19 nt, Homo sapiens
gacggucugugugcuguuu

SEQ ID NO: 24248 - RNA, 19 nt, Homo sapiens
ugaaggagagcgacuggaa

SEQ ID NO: 24249 - RNA, 19 nt, Homo sapiens
gggaugaggcaaacaagau

SEQ ID NO: 24250 - RNA, 19 nt, Homo sapiens
ccaccaugcuugccugaag

SEQ ID NO: 24251 - RNA, 19 nt, Homo sapiens
gcugcuguguccucuaguu

SEQ ID NO: 24252 - RNA, 19 nt, Homo sapiens
gcaaacaagaucgcagaga

SEQ ID NO: 24253 - RNA, 19 nt, Homo sapiens
ucccaaagauuaggucguu

SEQ ID NO: 24254 - RNA, 19 nt, Homo sapiens
ucaaccagaaccucaauga

SEQ ID NO: 24255 - RNA, 19 nt, Homo sapiens
cgacaucaagucacgcauu

SEQ ID NO: 24256 - RNA, 19 nt, Homo sapiens
cuaccuggccuccgucaaa

SEQ ID NO: 24257 - RNA, 19 nt, Homo sapiens
gcaacaccuucacggucaa

SEQ ID NO: 24258 - RNA, 19 nt, Homo sapiens
accagaaccucaaugaugu

SEQ ID NO: 24259 - RNA, 19 nt, Homo sapiens
aaccagaaccucaaugaug

SEQ ID NO: 24260 - RNA, 19 nt, Homo sapiens
aggaggagcucaucaaagc

SEQ ID NO: 24261 - RNA, 19 nt, Homo sapiens
ggaaggcagaugagaccaa

SEQ ID NO: 24262 - RNA, 19 nt, Homo sapiens
agcagugcguccagaauuu

SEQ ID NO: 24263 - RNA, 19 nt, Homo sapiens
cgaggaggagcucaucaaa

SEQ ID NO: 24264 - RNA, 19 nt, Homo sapiens
gggcaaggguccucuuuuc

SEQ ID NO: 24265 - RNA, 19 nt, Homo sapiens
ucaaggcccagcccagaaa

SEQ ID NO: 24266 - RNA, 19 nt, Homo sapiens
ucaaagcccagaagguguu

SEQ ID NO: 24267 - RNA, 19 nt, Homo sapiens
gcacaaggagcuggagaag

SEQ ID NO: 24268 - RNA, 19 nt, Homo sapiens
cggcggaauucaccagugu

SEQ ID NO: 24269 - RNA, 19 nt, Homo sapiens
gcccggaguggcccuuuaa

SEQ ID NO: 24270 - RNA, 19 nt, Homo sapiens
acaaggagaugagcaagcu

SEQ ID NO: 24271 - RNA, 19 nt, Homo sapiens
gaggaggagcucaucaaag

SEQ ID NO: 24272 - RNA, 19 nt, Homo sapiens
gaaggaugaagccaaaauu

SEQ ID NO: 24273 - RNA, 19 nt, Homo sapiens
ccacuacgagucccuucaa

SEQ ID NO: 24274 - RNA, 19 nt, Homo sapiens
ggaugaggcaaacaagauc

SEQ ID NO: 24275 - RNA, 19 nt, Homo sapiens
aagcugcuguguccucuag

SEQ ID NO: 24276 - RNA, 19 nt, Homo sapiens
caaccagaaccucaaugau

SEQ ID NO: 24277 - RNA, 19 nt, Homo sapiens
ggauggauuaccaccagaa

SEQ ID NO: 24278 - RNA, 19 nt, Homo sapiens
gcagugcguccagaauuuc

SEQ ID NO: 24279 - RNA, 19 nt, Homo sapiens
cggcugcgcagaaagaaga

SEQ ID NO: 24280 - RNA, 19 nt, Homo sapiens
caagaucgcagagaacaac

SEQ ID NO: 24281 - RNA, 19 nt, Homo sapiens
gcuguguccucuaguugag

SEQ ID NO: 24282 - RNA, 19 nt, Homo sapiens
ugacaacgcgccugcaaaa

SEQ ID NO: 24283 - RNA, 19 nt, Homo sapiens
agaagguguuugaggagau

SEQ ID NO: 24284 - RNA, 19 nt, Homo sapiens
cuacgagucccuucaaacu

SEQ ID NO: 24285 - RNA, 19 nt, Homo sapiens
agaccaaggaugagcaguu

SEQ ID NO: 24286 - RNA, 19 nt, Homo sapiens
cacuacgagucccuucaaa

SEQ ID NO: 24287 - RNA, 19 nt, Homo sapiens
gccagcaacgugcagaaga

SEQ ID NO: 24288 - RNA, 19 nt, Homo sapiens
ucaacacguuccagagcau

SEQ ID NO: 24289 - RNA, 19 nt, Homo sapiens
gcggaauucaccaguguuc

SEQ ID NO: 24290 - RNA, 19 nt, Homo sapiens
cguccagaauuucaacaag

SEQ ID NO: 24291 - RNA, 19 nt, Homo sapiens
agaaagaagaacagugaca

SEQ ID NO: 24292 - RNA, 19 nt, Homo sapiens
cuacacggccacugacaca

SEQ ID NO: 24293 - RNA, 19 nt, Homo sapiens
uccagaauuucaacaagca

SEQ ID NO: 24294 - RNA, 19 nt, Homo sapiens
gcucaaccagaaccucaau

SEQ ID NO: 24295 - RNA, 19 nt, Homo sapiens
uggaacagccgcguagguu

SEQ ID NO: 24296 - RNA, 19 nt, Homo sapiens
gcucaucaaagcccagaag

SEQ ID NO: 24297 - RNA, 19 nt, Homo sapiens
caaacaagaucgcagagaa

SEQ ID NO: 24298 - RNA, 19 nt, Homo sapiens
aaacuaaccugcuccgaaa

SEQ ID NO: 24299 - RNA, 19 nt, Homo sapiens
acaaggagcuggagaagug

SEQ ID NO: 24300 - RNA, 19 nt, Homo sapiens
gcucaaggcuggugaugug

SEQ ID NO: 24301 - RNA, 19 nt, Homo sapiens
aaagaaggaugaagccaaa

SEQ ID NO: 24302 - RNA, 19 nt, Homo sapiens
gaccaaggaugagcaguuu

SEQ ID NO: 24303 - RNA, 19 nt, Homo sapiens
gacaucaagucacgcauug

SEQ ID NO: 24304 - RNA, 19 nt, Homo sapiens
gagcaaagggaaaucaaga

SEQ ID NO: 24305 - RNA, 19 nt, Homo sapiens
uggcagagaugggcaguaa

SEQ ID NO: 24306 - RNA, 19 nt, Homo sapiens
gaacagccgcguagguuuc

SEQ ID NO: 24307 - RNA, 19 nt, Homo sapiens
cagaugagaccaaggauga

SEQ ID NO: 24308 - RNA, 19 nt, Homo sapiens
gagcagugcguccagaauu

SEQ ID NO: 24309 - RNA, 19 nt, Homo sapiens
ccagcaacgugcagaagaa

SEQ ID NO: 24310 - RNA, 19 nt, Homo sapiens
ggcguucucccaaagauua

SEQ ID NO: 24311 - RNA, 19 nt, Homo sapiens
guggagaccuucccagcaa

SEQ ID NO: 24312 - RNA, 19 nt, Homo sapiens
agaaggaucuccggaccua

SEQ ID NO: 24313 - RNA, 19 nt, Homo sapiens
ggcgcaagcugguggacua

SEQ ID NO: 24314 - RNA, 19 nt, Homo sapiens
gaagguguuugaggagaug

SEQ ID NO: 24315 - RNA, 19 nt, Homo sapiens
gaccugcuguggauggauu

SEQ ID NO: 24316 - RNA, 19 nt, Homo sapiens
cccgagaacuucacugaga

SEQ ID NO: 24317 - RNA, 19 nt, Homo sapiens
gcagagaugggcaguaaag

SEQ ID NO: 24318 - RNA, 19 nt, Homo sapiens
ggaacagccgcguagguuu

SEQ ID NO: 24319 - RNA, 19 nt, Homo sapiens
gcaagcugguggacuacga

SEQ ID NO: 24320 - RNA, 19 nt, Homo sapiens
gaagagcaaagggaaauca

SEQ ID NO: 24321 - RNA, 19 nt, Homo sapiens
cgggaaagaucgccagcaa

SEQ ID NO: 24322 - RNA, 19 nt, Homo sapiens
ccaaggaugagcaguuuga

SEQ ID NO: 24323 - RNA, 19 nt, Homo sapiens
gaacaccuccucccgaaaa

SEQ ID NO: 24324 - RNA, 19 nt, Homo sapiens
gcagauccucagccuguuu

SEQ ID NO: 24325 - RNA, 19 nt, Homo sapiens
gcagggaugaggcaaacaa

SEQ ID NO: 24326 - RNA, 19 nt, Homo sapiens
gagggcaccuuugcugugu

SEQ ID NO: 24327 - RNA, 19 nt, Homo sapiens
acaacgaccugcuguggau

SEQ ID NO: 24328 - RNA, 19 nt, Homo sapiens
ucucguagcucaaacuaac

SEQ ID NO: 24329 - RNA, 19 nt, Homo sapiens
gacggucugugugcuguuu

SEQ ID NO: 24330 - RNA, 19 nt, Homo sapiens
ugaaggagagcgacuggaa

SEQ ID NO: 24331 - RNA, 19 nt, Homo sapiens
gggaugaggcaaacaagau

SEQ ID NO: 24332 - RNA, 19 nt, Homo sapiens
ccaccaugcuugccugaag

SEQ ID NO: 24333 - RNA, 19 nt, Homo sapiens
gcugcuguguccucuaguu

SEQ ID NO: 24334 - RNA, 19 nt, Homo sapiens
gcucaucucguagcucaaa

SEQ ID NO: 24335 - RNA, 19 nt, Homo sapiens
gcaaacaagaucgcagaga

SEQ ID NO: 24336 - RNA, 19 nt, Homo sapiens
ucccaaagauuaggucguu

SEQ ID NO: 24337 - RNA, 19 nt, Homo sapiens
ucaaccagaaccucaauga

SEQ ID NO: 24338 - RNA, 19 nt, Homo sapiens
cgacaucaagucacgcauu

SEQ ID NO: 24339 - RNA, 19 nt, Homo sapiens
cuaccuggccuccgucaaa

SEQ ID NO: 24340 - RNA, 19 nt, Homo sapiens
caucucagcuccggaaagg

SEQ ID NO: 24341 - RNA, 19 nt, Homo sapiens
gcaacaccuucacggucaa

SEQ ID NO: 24342 - RNA, 19 nt, Homo sapiens
accagaaccucaaugaugu

SEQ ID NO: 24343 - RNA, 19 nt, Homo sapiens
aaccagaaccucaaugaug

SEQ ID NO: 24344 - RNA, 19 nt, Homo sapiens
aggaggagcucaucaaagc

SEQ ID NO: 24345 - RNA, 19 nt, Homo sapiens
acugcaggcucaucucgua

SEQ ID NO: 24346 - RNA, 19 nt, Homo sapiens
ggaaggcagaugagaccaa

SEQ ID NO: 24347 - RNA, 19 nt, Homo sapiens
cgaggaggagcucaucaaa

SEQ ID NO: 24348 - RNA, 19 nt, Homo sapiens
agcagugcguccagaauuu

SEQ ID NO: 24349 - RNA, 19 nt, Homo sapiens
gcaaacugcaggcucaucu

SEQ ID NO: 24350 - RNA, 19 nt, Homo sapiens
gggcaaggguccucuuuuc

SEQ ID NO: 24351 - RNA, 19 nt, Homo sapiens
ucaaagcccagaagguguu

SEQ ID NO: 24352 - RNA, 19 nt, Homo sapiens
gcacaaggagcuggagaag

SEQ ID NO: 24353 - RNA, 19 nt, Homo sapiens
ucaaggcccagcccaguga

SEQ ID NO: 24354 - RNA, 19 nt, Homo sapiens
cggcggaauucaccagugu

SEQ ID NO: 24355 - RNA, 19 nt, Homo sapiens
gcccggaguggcccuuuaa

SEQ ID NO: 24356 - RNA, 19 nt, Homo sapiens
acaaggagaugagcaagcu

SEQ ID NO: 24357 - RNA, 19 nt, Homo sapiens
gaggaggagcucaucaaag

SEQ ID NO: 24358 - RNA, 19 nt, Homo sapiens
ugcuggaccuggacuuuga

SEQ ID NO: 24359 - RNA, 19 nt, Homo sapiens
gaaggaugaagccaaaauu

SEQ ID NO: 24360 - RNA, 19 nt, Homo sapiens
ccacuacgagucccuucaa

SEQ ID NO: 24361 - RNA, 19 nt, Homo sapiens
ggaugaggcaaacaagauc

SEQ ID NO: 24362 - RNA, 19 nt, Homo sapiens
aagcugcuguguccucuag

SEQ ID NO: 24363 - RNA, 19 nt, Homo sapiens
caaccagaaccucaaugau

SEQ ID NO: 24364 - RNA, 19 nt, Homo sapiens
ggauggauuaccaccagaa

SEQ ID NO: 24365 - RNA, 19 nt, Homo sapiens
gcagugcguccagaauuuc

SEQ ID NO: 24366 - RNA, 19 nt, Homo sapiens
caagaucgcagagaacaac

SEQ ID NO: 24367 - RNA, 19 nt, Homo sapiens
gcuguguccucuaguugag

SEQ ID NO: 24368 - RNA, 19 nt, Homo sapiens
agaccaaggaugagcaguu

SEQ ID NO: 24369 - RNA, 19 nt, Homo sapiens
ugacaacgcgccugcaaaa

SEQ ID NO: 24370 - RNA, 19 nt, Homo sapiens
agaagguguuugaggagau

SEQ ID NO: 24371 - RNA, 19 nt, Homo sapiens
cuaaccugcuccgaaauca

SEQ ID NO: 24372 - RNA, 19 nt, Homo sapiens
cuacgagucccuucaaacu

SEQ ID NO: 24373 - RNA, 19 nt, Homo sapiens
cacuacgagucccuucaaa

SEQ ID NO: 24374 - RNA, 19 nt, Homo sapiens
gccagcaacgugcagaaga

SEQ ID NO: 24375 - RNA, 19 nt, Homo sapiens
ucaacacguuccagagcau

SEQ ID NO: 24376 - RNA, 19 nt, Homo sapiens
caucucguagcucaaacua

SEQ ID NO: 24377 - RNA, 19 nt, Homo sapiens
gcggaauucaccaguguuc

SEQ ID NO: 24378 - RNA, 19 nt, Homo sapiens
acacguuugucccugagau

SEQ ID NO: 24379 - RNA, 19 nt, Homo sapiens
cguccagaauuucaacaag

SEQ ID NO: 24380 - RNA, 19 nt, Homo sapiens
cuacacggccacugacaca

SEQ ID NO: 24381 - RNA, 19 nt, Homo sapiens
uccagaauuucaacaagca

SEQ ID NO: 24382 - RNA, 19 nt, Homo sapiens
gcucaaccagaaccucaau

SEQ ID NO: 24383 - RNA, 19 nt, Homo sapiens
uggaacagccgcguagguu

SEQ ID NO: 24384 - RNA, 19 nt, Homo sapiens
gcucaucaaagcccagaag

SEQ ID NO: 24385 - RNA, 19 nt, Homo sapiens
caaacaagaucgcagagaa

SEQ ID NO: 24386 - RNA, 19 nt, Homo sapiens
aaacuaaccugcuccgaaa

SEQ ID NO: 24387 - RNA, 19 nt, Homo sapiens
acaaggagcuggagaagug

SEQ ID NO: 24388 - RNA, 19 nt, Homo sapiens
gcucaaggcuggugaugug

SEQ ID NO: 24389 - RNA, 19 nt, Homo sapiens
aaagaaggaugaagccaaa

SEQ ID NO: 24390 - RNA, 19 nt, Homo sapiens
gaccaaggaugagcaguuu

SEQ ID NO: 24391 - RNA, 19 nt, Homo sapiens
gacaucaagucacgcauug

SEQ ID NO: 24392 - RNA, 19 nt, Homo sapiens
gagcaaagggaaaucaaga

SEQ ID NO: 24393 - RNA, 19 nt, Homo sapiens
uggcagagaugggcaguaa

SEQ ID NO: 24394 - RNA, 19 nt, Homo sapiens
gaacagccgcguagguuuc

SEQ ID NO: 24395 - RNA, 19 nt, Homo sapiens
cagaugagaccaaggauga

SEQ ID NO: 24396 - RNA, 19 nt, Homo sapiens
gagcagugcguccagaauu

SEQ ID NO: 24397 - RNA, 19 nt, Homo sapiens
ccagcaacgugcagaagaa

SEQ ID NO: 24398 - RNA, 19 nt, Homo sapiens
ggcguucucccaaagauua

SEQ ID NO: 24399 - RNA, 19 nt, Homo sapiens
guggagaccuucccagcaa

SEQ ID NO: 24400 - RNA, 19 nt, Homo sapiens
agaaggaucuccggaccua

SEQ ID NO: 24401 - RNA, 19 nt, Homo sapiens
ggcgcaagcugguggacua

SEQ ID NO: 24402 - RNA, 19 nt, Homo sapiens
gaagguguuugaggagaug

SEQ ID NO: 24403 - RNA, 19 nt, Homo sapiens
gaccugcuguggauggauu

SEQ ID NO: 24404 - RNA, 19 nt, Homo sapiens
cccgagaacuucacugaga

SEQ ID NO: 24405 - RNA, 19 nt, Homo sapiens
gcagagaugggcaguaaag

SEQ ID NO: 24406 - RNA, 19 nt, Homo sapiens
ggaacagccgcguagguuu

SEQ ID NO: 24407 - RNA, 19 nt, Homo sapiens
gcaagcugguggacuacga

SEQ ID NO: 24408 - RNA, 19 nt, Homo sapiens
gaagagcaaagggaaauca

SEQ ID NO: 24409 - RNA, 19 nt, Homo sapiens
cgggaaagaucgccagcaa

SEQ ID NO: 24410 - RNA, 19 nt, Homo sapiens
ccaaggaugagcaguuuga

SEQ ID NO: 24411 - RNA, 19 nt, Homo sapiens
gaacaccuccucccgaaaa

SEQ ID NO: 24412 - RNA, 19 nt, Homo sapiens
gcagggaugaggcaaacaa

SEQ ID NO: 24413 - RNA, 19 nt, Homo sapiens
gagggcaccuuugcugugu

SEQ ID NO: 24414 - RNA, 19 nt, Homo sapiens
acaacgaccugcuguggau

SEQ ID NO: 24415 - RNA, 19 nt, Homo sapiens
ucucguagcucaaacuaac

SEQ ID NO: 24416 - RNA, 19 nt, Homo sapiens
gacggucugugugcuguuu

SEQ ID NO: 24417 - RNA, 19 nt, Homo sapiens
ugaaggagagcgacuggaa

SEQ ID NO: 24418 - RNA, 19 nt, Homo sapiens
gggaugaggcaaacaagau

SEQ ID NO: 24419 - RNA, 19 nt, Homo sapiens
ccaccaugcuugccugaag

SEQ ID NO: 24420 - RNA, 19 nt, Homo sapiens
gcugcuguguccucuaguu

SEQ ID NO: 24421 - RNA, 19 nt, Homo sapiens
gcucaucucguagcucaaa

SEQ ID NO: 24422 - RNA, 19 nt, Homo sapiens
gcaaacaagaucgcagaga

SEQ ID NO: 24423 - RNA, 19 nt, Homo sapiens
ucccaaagauuaggucguu

SEQ ID NO: 24424 - RNA, 19 nt, Homo sapiens
ucaaccagaaccucaauga

SEQ ID NO: 24425 - RNA, 19 nt, Homo sapiens
cgacaucaagucacgcauu

SEQ ID NO: 24426 - RNA, 19 nt, Homo sapiens
cuaccuggccuccgucaaa

SEQ ID NO: 24427 - RNA, 19 nt, Homo sapiens
gcaacaccuucacggucaa

SEQ ID NO: 24428 - RNA, 19 nt, Homo sapiens
accagaaccucaaugaugu

SEQ ID NO: 24429 - RNA, 19 nt, Homo sapiens
aaccagaaccucaaugaug

SEQ ID NO: 24430 - RNA, 19 nt, Homo sapiens
aggaggagcucaucaaagc

SEQ ID NO: 24431 - RNA, 19 nt, Homo sapiens
acugcaggcucaucucgua

SEQ ID NO: 24432 - RNA, 19 nt, Homo sapiens
cgaggaggagcucaucaaa

SEQ ID NO: 24433 - RNA, 19 nt, Homo sapiens
ggaaggcagaugagaccaa

SEQ ID NO: 24434 - RNA, 19 nt, Homo sapiens
gcaaacugcaggcucaucu

SEQ ID NO: 24435 - RNA, 19 nt, Homo sapiens
agcagugcguccagaauuu

SEQ ID NO: 24436 - RNA, 19 nt, Homo sapiens
gggcaaggguccucuuuuc

SEQ ID NO: 24437 - RNA, 19 nt, Homo sapiens
ucaaagcccagaagguguu

SEQ ID NO: 24438 - RNA, 19 nt, Homo sapiens
gcacaaggagcuggagaag

SEQ ID NO: 24439 - RNA, 19 nt, Homo sapiens
ucaaggcccagcccaguga

SEQ ID NO: 24440 - RNA, 19 nt, Homo sapiens
cggcggaauucaccagugu

SEQ ID NO: 24441 - RNA, 19 nt, Homo sapiens
gcccggaguggcccuuuaa

SEQ ID NO: 24442 - RNA, 19 nt, Homo sapiens
acaaggagaugagcaagcu

SEQ ID NO: 24443 - RNA, 19 nt, Homo sapiens
gaggaggagcucaucaaag

SEQ ID NO: 24444 - RNA, 19 nt, Homo sapiens
ugcuggaccuggacuuuga

SEQ ID NO: 24445 - RNA, 19 nt, Homo sapiens
gaaggaugaagccaaaauu

SEQ ID NO: 24446 - RNA, 19 nt, Homo sapiens
ccacuacgagucccuucaa

SEQ ID NO: 24447 - RNA, 19 nt, Homo sapiens
ggaugaggcaaacaagauc

SEQ ID NO: 24448 - RNA, 19 nt, Homo sapiens
aagcugcuguguccucuag

SEQ ID NO: 24449 - RNA, 19 nt, Homo sapiens
caaccagaaccucaaugau

SEQ ID NO: 24450 - RNA, 19 nt, Homo sapiens
ggauggauuaccaccagaa

SEQ ID NO: 24451 - RNA, 19 nt, Homo sapiens
gcagugcguccagaauuuc

SEQ ID NO: 24452 - RNA, 19 nt, Homo sapiens
caagaucgcagagaacaac

SEQ ID NO: 24453 - RNA, 19 nt, Homo sapiens
gcuguguccucuaguugag

SEQ ID NO: 24454 - RNA, 19 nt, Homo sapiens
ugacaacgcgccugcaaaa

SEQ ID NO: 24455 - RNA, 19 nt, Homo sapiens
agaagguguuugaggagau

SEQ ID NO: 24456 - RNA, 19 nt, Homo sapiens
cuaaccugcuccgaaauca

SEQ ID NO: 24457 - RNA, 19 nt, Homo sapiens
cuacgagucccuucaaacu

SEQ ID NO: 24458 - RNA, 19 nt, Homo sapiens
agaccaaggaugagcaguu

SEQ ID NO: 24459 - RNA, 19 nt, Homo sapiens
cacuacgagucccuucaaa

SEQ ID NO: 24460 - RNA, 19 nt, Homo sapiens
ucaacacguuccagagcau

SEQ ID NO: 24461 - RNA, 19 nt, Homo sapiens
caucucguagcucaaacua

SEQ ID NO: 24462 - RNA, 19 nt, Homo sapiens
gccagcaacgugcagaaga

SEQ ID NO: 24463 - RNA, 19 nt, Homo sapiens
gcggaauucaccaguguuc

SEQ ID NO: 24464 - RNA, 19 nt, Homo sapiens
cguccagaauuucaacaag

SEQ ID NO: 24465 - RNA, 19 nt, Homo sapiens
cuacacggccacugacaca

SEQ ID NO: 24466 - RNA, 19 nt, Homo sapiens
gcucaaccagaaccucaau

SEQ ID NO: 24467 - RNA, 19 nt, Homo sapiens
uggaacagccgcguagguu

SEQ ID NO: 24468 - RNA, 19 nt, Homo sapiens
gcucaucaaagcccagaag

SEQ ID NO: 24469 - RNA, 19 nt, Homo sapiens
uccagaauuucaacaagca

SEQ ID NO: 24470 - RNA, 19 nt, Homo sapiens
caaacaagaucgcagagaa

SEQ ID NO: 24471 - RNA, 19 nt, Homo sapiens
aaacuaaccugcuccgaaa

SEQ ID NO: 24472 - RNA, 19 nt, Homo sapiens
acaaggagcuggagaagug

SEQ ID NO: 24473 - RNA, 19 nt, Homo sapiens
gcucaaggcuggugaugug

SEQ ID NO: 24474 - RNA, 19 nt, Homo sapiens
aaagaaggaugaagccaaa

SEQ ID NO: 24475 - RNA, 19 nt, Homo sapiens
gaccaaggaugagcaguuu

SEQ ID NO: 24476 - RNA, 19 nt, Homo sapiens
gacaucaagucacgcauug

SEQ ID NO: 24477 - RNA, 19 nt, Homo sapiens
gagcaaagggaaaucaaga

SEQ ID NO: 24478 - RNA, 19 nt, Homo sapiens
uggcagagaugggcaguaa

SEQ ID NO: 24479 - RNA, 19 nt, Homo sapiens
gaacagccgcguagguuuc

SEQ ID NO: 24480 - RNA, 19 nt, Homo sapiens
cagaugagaccaaggauga

SEQ ID NO: 24481 - RNA, 19 nt, Homo sapiens
gagcagugcguccagaauu

SEQ ID NO: 24482 - RNA, 19 nt, Homo sapiens
ccagcaacgugcagaagaa

SEQ ID NO: 24483 - RNA, 19 nt, Homo sapiens
ggcguucucccaaagauua

SEQ ID NO: 24484 - RNA, 19 nt, Homo sapiens
guggagaccuucccagcaa

SEQ ID NO: 24485 - RNA, 19 nt, Homo sapiens
agaaggaucuccggaccua

SEQ ID NO: 24486 - RNA, 19 nt, Homo sapiens
ggcgcaagcugguggacua

SEQ ID NO: 24487 - RNA, 19 nt, Homo sapiens
gaagguguuugaggagaug

SEQ ID NO: 24488 - RNA, 19 nt, Homo sapiens
gaccugcuguggauggauu

SEQ ID NO: 24489 - RNA, 19 nt, Homo sapiens
cccgagaacuucacugaga

SEQ ID NO: 24490 - RNA, 19 nt, Homo sapiens
gcagagaugggcaguaaag

SEQ ID NO: 24491 - RNA, 19 nt, Homo sapiens
ggaacagccgcguagguuu

SEQ ID NO: 24492 - RNA, 19 nt, Homo sapiens
gcaagcugguggacuacga

SEQ ID NO: 24493 - RNA, 19 nt, Homo sapiens
gaagagcaaagggaaauca

SEQ ID NO: 24494 - RNA, 19 nt, Homo sapiens
cgggaaagaucgccagcaa

SEQ ID NO: 24495 - RNA, 19 nt, Homo sapiens
ccaaggaugagcaguuuga

SEQ ID NO: 24496 - RNA, 19 nt, Homo sapiens
gaacaccuccucccgaaaa

SEQ ID NO: 24497 - RNA, 19 nt, Homo sapiens
gcagggaugaggcaaacaa

SEQ ID NO: 24498 - RNA, 19 nt, Homo sapiens
gagggcaccuuugcugugu

SEQ ID NO: 24499 - RNA, 19 nt, Homo sapiens
acaacgaccugcuguggau

SEQ ID NO: 24500 - RNA, 19 nt, Homo sapiens
ucucguagcucaaacuaac

SEQ ID NO: 24501 - RNA, 19 nt, Homo sapiens
gacggucugugugcuguuu

SEQ ID NO: 24502 - RNA, 19 nt, Homo sapiens
ugaaggagagcgacuggaa

SEQ ID NO: 24503 - RNA, 19 nt, Homo sapiens
gggaugaggcaaacaagau

SEQ ID NO: 24504 - RNA, 19 nt, Homo sapiens
ccaccaugcuugccugaag

SEQ ID NO: 24505 - RNA, 19 nt, Homo sapiens
gcugcuguguccucuaguu

SEQ ID NO: 24506 - RNA, 19 nt, Homo sapiens
gcucaucucguagcucaaa

SEQ ID NO: 24507 - RNA, 19 nt, Homo sapiens
gcaaacaagaucgcagaga

SEQ ID NO: 24508 - RNA, 19 nt, Homo sapiens
ucccaaagauuaggucguu

SEQ ID NO: 24509 - RNA, 19 nt, Homo sapiens
ucaaccagaaccucaauga

SEQ ID NO: 24510 - RNA, 19 nt, Homo sapiens
cgacaucaagucacgcauu

SEQ ID NO: 24511 - RNA, 19 nt, Homo sapiens
cuaccuggccuccgucaaa

SEQ ID NO: 24512 - RNA, 19 nt, Homo sapiens
gcaacaccuucacggucaa

SEQ ID NO: 24513 - RNA, 19 nt, Homo sapiens
accagaaccucaaugaugu

SEQ ID NO: 24514 - RNA, 19 nt, Homo sapiens
aaccagaaccucaaugaug

SEQ ID NO: 24515 - RNA, 19 nt, Homo sapiens
aggaggagcucaucaaagc

SEQ ID NO: 24516 - RNA, 19 nt, Homo sapiens
acugcaggcucaucucgua

SEQ ID NO: 24517 - RNA, 19 nt, Homo sapiens
cgaggaggagcucaucaaa

SEQ ID NO: 24518 - RNA, 19 nt, Homo sapiens
ggaaggcagaugagaccaa

SEQ ID NO: 24519 - RNA, 19 nt, Homo sapiens
gcaaacugcaggcucaucu

SEQ ID NO: 24520 - RNA, 19 nt, Homo sapiens
agcagugcguccagaauuu

SEQ ID NO: 24521 - RNA, 19 nt, Homo sapiens
gggcaaggguccucuuuuc

SEQ ID NO: 24522 - RNA, 19 nt, Homo sapiens
ucaaagcccagaagguguu

SEQ ID NO: 24523 - RNA, 19 nt, Homo sapiens
gcacaaggagcuggagaag

SEQ ID NO: 24524 - RNA, 19 nt, Homo sapiens
ucaaggcccagcccaguga

SEQ ID NO: 24525 - RNA, 19 nt, Homo sapiens
cggcggaauucaccagugu

SEQ ID NO: 24526 - RNA, 19 nt, Homo sapiens
gcccggaguggcccuuuaa

SEQ ID NO: 24527 - RNA, 19 nt, Homo sapiens
acaaggagaugagcaagcu

SEQ ID NO: 24528 - RNA, 19 nt, Homo sapiens
gaggaggagcucaucaaag

SEQ ID NO: 24529 - RNA, 19 nt, Homo sapiens
gaaggaugaagccaaaauu

SEQ ID NO: 24530 - RNA, 19 nt, Homo sapiens
ccacuacgagucccuucaa

SEQ ID NO: 24531 - RNA, 19 nt, Homo sapiens
ggaugaggcaaacaagauc

SEQ ID NO: 24532 - RNA, 19 nt, Homo sapiens
aagcugcuguguccucuag

SEQ ID NO: 24533 - RNA, 19 nt, Homo sapiens
caaccagaaccucaaugau

SEQ ID NO: 24534 - RNA, 19 nt, Homo sapiens
ggauggauuaccaccagaa

SEQ ID NO: 24535 - RNA, 19 nt, Homo sapiens
gcagugcguccagaauuuc

SEQ ID NO: 24536 - RNA, 19 nt, Homo sapiens
caagaucgcagagaacaac

SEQ ID NO: 24537 - RNA, 19 nt, Homo sapiens
gcuguguccucuaguugag

SEQ ID NO: 24538 - RNA, 19 nt, Homo sapiens
ugacaacgcgccugcaaaa

SEQ ID NO: 24539 - RNA, 19 nt, Homo sapiens
agaagguguuugaggagau

SEQ ID NO: 24540 - RNA, 19 nt, Homo sapiens
cuaaccugcuccgaaauca

SEQ ID NO: 24541 - RNA, 19 nt, Homo sapiens
cuacgagucccuucaaacu

SEQ ID NO: 24542 - RNA, 19 nt, Homo sapiens
agaccaaggaugagcaguu

SEQ ID NO: 24543 - RNA, 19 nt, Homo sapiens
cacuacgagucccuucaaa

SEQ ID NO: 24544 - RNA, 19 nt, Homo sapiens
ucaacacguuccagagcau

SEQ ID NO: 24545 - RNA, 19 nt, Homo sapiens
caucucguagcucaaacua

SEQ ID NO: 24546 - RNA, 19 nt, Homo sapiens
gccagcaacgugcagaaga

SEQ ID NO: 24547 - RNA, 19 nt, Homo sapiens
gcggaauucaccaguguuc

SEQ ID NO: 24548 - RNA, 19 nt, Homo sapiens
cguccagaauuucaacaag

SEQ ID NO: 24549 - RNA, 19 nt, Homo sapiens
cuacacggccacugacaca

SEQ ID NO: 24550 - RNA, 19 nt, Homo sapiens
gcucaaccagaaccucaau

SEQ ID NO: 24551 - RNA, 19 nt, Homo sapiens
uggaacagccgcguagguu

SEQ ID NO: 24552 - RNA, 19 nt, Homo sapiens
gcucaucaaagcccagaag

SEQ ID NO: 24553 - RNA, 19 nt, Homo sapiens
uccagaauuucaacaagca

SEQ ID NO: 24554 - RNA, 19 nt, Homo sapiens
caaacaagaucgcagagaa

SEQ ID NO: 24555 - RNA, 19 nt, Homo sapiens
gcagaaagaagaacaguga

SEQ ID NO: 24556 - RNA, 19 nt, Homo sapiens
acaaggagcuggagaagug

SEQ ID NO: 24557 - RNA, 19 nt, Homo sapiens
gcucaaggcuggugaugug

SEQ ID NO: 24558 - RNA, 19 nt, Homo sapiens
aaagaaggaugaagccaaa

SEQ ID NO: 24559 - RNA, 19 nt, Homo sapiens
gaccaaggaugagcaguuu

SEQ ID NO: 24560 - RNA, 19 nt, Homo sapiens
gacaucaagucacgcauug

SEQ ID NO: 24561 - RNA, 19 nt, Homo sapiens
gaaagaagaacagugacaa

SEQ ID NO: 24562 - RNA, 19 nt, Homo sapiens
gagcaaagggaaaucaaga

SEQ ID NO: 24563 - RNA, 19 nt, Homo sapiens
uggcagagaugggcaguaa

SEQ ID NO: 24564 - RNA, 19 nt, Homo sapiens
gaacagccgcguagguuuc

SEQ ID NO: 24565 - RNA, 19 nt, Homo sapiens
cagaugagaccaaggauga

SEQ ID NO: 24566 - RNA, 19 nt, Homo sapiens
gagcagugcguccagaauu

SEQ ID NO: 24567 - RNA, 19 nt, Homo sapiens
ccagcaacgugcagaagaa

SEQ ID NO: 24568 - RNA, 19 nt, Homo sapiens
ggcguucucccaaagauua

SEQ ID NO: 24569 - RNA, 19 nt, Homo sapiens
guggagaccuucccagcaa

SEQ ID NO: 24570 - RNA, 19 nt, Homo sapiens
agaaggaucuccggaccua

SEQ ID NO: 24571 - RNA, 19 nt, Homo sapiens
ggcgcaagcugguggacua

SEQ ID NO: 24572 - RNA, 19 nt, Homo sapiens
gaagguguuugaggagaug

SEQ ID NO: 24573 - RNA, 19 nt, Homo sapiens
gaccugcuguggauggauu

SEQ ID NO: 24574 - RNA, 19 nt, Homo sapiens
cccgagaacuucacugaga

SEQ ID NO: 24575 - RNA, 19 nt, Homo sapiens
gcagagaugggcaguaaag

SEQ ID NO: 24576 - RNA, 19 nt, Homo sapiens
ggaacagccgcguagguuu

SEQ ID NO: 24577 - RNA, 19 nt, Homo sapiens
gcaagcugguggacuacga

SEQ ID NO: 24578 - RNA, 19 nt, Homo sapiens
gaagagcaaagggaaauca

SEQ ID NO: 24579 - RNA, 19 nt, Homo sapiens
ccaaggaugagcaguuuga

SEQ ID NO: 24580 - RNA, 19 nt, Homo sapiens
cgggaaagaucgccagcaa

SEQ ID NO: 24581 - RNA, 19 nt, Homo sapiens
gaacaccuccucccgaaaa

SEQ ID NO: 24582 - RNA, 19 nt, Homo sapiens
gcagauccucagccuguuu

SEQ ID NO: 24583 - RNA, 19 nt, Homo sapiens
gcagggaugaggcaaacaa

SEQ ID NO: 24584 - RNA, 19 nt, Homo sapiens
acaacgaccugcuguggau

SEQ ID NO: 24585 - RNA, 19 nt, Homo sapiens
gacggucugugugcuguuu

SEQ ID NO: 24586 - RNA, 19 nt, Homo sapiens
ugaaggagagcgacuggaa

SEQ ID NO: 24587 - RNA, 19 nt, Homo sapiens
gggaugaggcaaacaagau

SEQ ID NO: 24588 - RNA, 19 nt, Homo sapiens
ccaccaugcuugccugaag

SEQ ID NO: 24589 - RNA, 19 nt, Homo sapiens
gcugcuguguccucuaguu

SEQ ID NO: 24590 - RNA, 19 nt, Homo sapiens
gcaaacaagaucgcagaga

SEQ ID NO: 24591 - RNA, 19 nt, Homo sapiens
ucccaaagauuaggucguu

SEQ ID NO: 24592 - RNA, 19 nt, Homo sapiens
ucaaccagaaccucaauga

SEQ ID NO: 24593 - RNA, 19 nt, Homo sapiens
cgacaucaagucacgcauu

SEQ ID NO: 24594 - RNA, 19 nt, Homo sapiens
cuaccuggccuccgucaaa

SEQ ID NO: 24595 - RNA, 19 nt, Homo sapiens
caucucagcuccggaaagg

SEQ ID NO: 24596 - RNA, 19 nt, Homo sapiens
gcaacaccuucacggucaa

SEQ ID NO: 24597 - RNA, 19 nt, Homo sapiens
accagaaccucaaugaugu

SEQ ID NO: 24598 - RNA, 19 nt, Homo sapiens
aaccagaaccucaaugaug

SEQ ID NO: 24599 - RNA, 19 nt, Homo sapiens
aggaggagcucaucaaagc

SEQ ID NO: 24600 - RNA, 19 nt, Homo sapiens
agcagugcguccagaauuu

SEQ ID NO: 24601 - RNA, 19 nt, Homo sapiens
ggaaggcagaugagaccaa

SEQ ID NO: 24602 - RNA, 19 nt, Homo sapiens
cgaggaggagcucaucaaa

SEQ ID NO: 24603 - RNA, 19 nt, Homo sapiens
gggcaaggguccucuuuuc

SEQ ID NO: 24604 - RNA, 19 nt, Homo sapiens
ucaaggcccagcccagaaa

SEQ ID NO: 24605 - RNA, 19 nt, Homo sapiens
ucaaagcccagaagguguu

SEQ ID NO: 24606 - RNA, 19 nt, Homo sapiens
gcacaaggagcuggagaag

SEQ ID NO: 24607 - RNA, 19 nt, Homo sapiens
cggcggaauucaccagugu

SEQ ID NO: 24608 - RNA, 19 nt, Homo sapiens
gcccggaguggcccuuuaa

SEQ ID NO: 24609 - RNA, 19 nt, Homo sapiens
acaaggagaugagcaagcu

SEQ ID NO: 24610 - RNA, 19 nt, Homo sapiens
gaggaggagcucaucaaag

SEQ ID NO: 24611 - RNA, 19 nt, Homo sapiens
gaaggaugaagccaaaauu

SEQ ID NO: 24612 - RNA, 19 nt, Homo sapiens
ccacuacgagucccuucaa

SEQ ID NO: 24613 - RNA, 19 nt, Homo sapiens
ggaugaggcaaacaagauc

SEQ ID NO: 24614 - RNA, 19 nt, Homo sapiens
aagcugcuguguccucuag

SEQ ID NO: 24615 - RNA, 19 nt, Homo sapiens
caaccagaaccucaaugau

SEQ ID NO: 24616 - RNA, 19 nt, Homo sapiens
ggauggauuaccaccagaa

SEQ ID NO: 24617 - RNA, 19 nt, Homo sapiens
gcagugcguccagaauuuc

SEQ ID NO: 24618 - RNA, 19 nt, Homo sapiens
cggcugcgcagaaagaaga

SEQ ID NO: 24619 - RNA, 19 nt, Homo sapiens
caagaucgcagagaacaac

SEQ ID NO: 24620 - RNA, 19 nt, Homo sapiens
gcuguguccucuaguugag

SEQ ID NO: 24621 - RNA, 19 nt, Homo sapiens
ugacaacgcgccugcaaaa

SEQ ID NO: 24622 - RNA, 19 nt, Homo sapiens
agaagguguuugaggagau

SEQ ID NO: 24623 - RNA, 19 nt, Homo sapiens
cuacgagucccuucaaacu

SEQ ID NO: 24624 - RNA, 19 nt, Homo sapiens
agaccaaggaugagcaguu

SEQ ID NO: 24625 - RNA, 19 nt, Homo sapiens
cacuacgagucccuucaaa

SEQ ID NO: 24626 - RNA, 19 nt, Homo sapiens
gccagcaacgugcagaaga

SEQ ID NO: 24627 - RNA, 19 nt, Homo sapiens
ucaacacguuccagagcau

SEQ ID NO: 24628 - RNA, 19 nt, Homo sapiens
gcggaauucaccaguguuc

SEQ ID NO: 24629 - RNA, 19 nt, Homo sapiens
acacguuugucccugagau

SEQ ID NO: 24630 - RNA, 19 nt, Homo sapiens
agaaagaagaacagugaca

SEQ ID NO: 24631 - RNA, 19 nt, Homo sapiens
cguccagaauuucaacaag

SEQ ID NO: 24632 - RNA, 19 nt, Homo sapiens
cuacacggccacugacaca

SEQ ID NO: 24633 - RNA, 19 nt, Homo sapiens
gcucaaccagaaccucaau

SEQ ID NO: 24634 - RNA, 19 nt, Homo sapiens
uggaacagccgcguagguu

SEQ ID NO: 24635 - RNA, 19 nt, Homo sapiens
gcucaucaaagcccagaag

SEQ ID NO: 24636 - RNA, 19 nt, Homo sapiens
uccagaauuucaacaagca

SEQ ID NO: 24637 - RNA, 19 nt, Homo sapiens
caaacaagaucgcagagaa

SEQ ID NO: 24638 - RNA, 19 nt, Homo sapiens
acaaggagcuggagaagug

SEQ ID NO: 24639 - RNA, 19 nt, Homo sapiens
gcucaaggcuggugaugug

SEQ ID NO: 24640 - RNA, 19 nt, Homo sapiens
aaagaaggaugaagccaaa

SEQ ID NO: 24641 - RNA, 19 nt, Homo sapiens
gaccaaggaugagcaguuu

SEQ ID NO: 24642 - RNA, 19 nt, Homo sapiens
gacaucaagucacgcauug

SEQ ID NO: 24643 - RNA, 19 nt, Homo sapiens
gagcaaagggaaaucaaga

SEQ ID NO: 24644 - RNA, 19 nt, Homo sapiens
gaacagccgcguagguuuc

SEQ ID NO: 24645 - RNA, 19 nt, Homo sapiens
uggcagagaugggcaguaa

SEQ ID NO: 24646 - RNA, 19 nt, Homo sapiens
cagaugagaccaaggauga

SEQ ID NO: 24647 - RNA, 19 nt, Homo sapiens
gagcagugcguccagaauu

SEQ ID NO: 24648 - RNA, 19 nt, Homo sapiens
ccagcaacgugcagaagaa

SEQ ID NO: 24649 - RNA, 19 nt, Homo sapiens
ggcguucucccaaagauua

SEQ ID NO: 24650 - RNA, 19 nt, Homo sapiens
guggagaccuucccagcaa

SEQ ID NO: 24651 - RNA, 19 nt, Homo sapiens
agaaggaucuccggaccua

SEQ ID NO: 24652 - RNA, 19 nt, Homo sapiens
ggcgcaagcugguggacua

SEQ ID NO: 24653 - RNA, 19 nt, Homo sapiens
gaagguguuugaggagaug

SEQ ID NO: 24654 - RNA, 19 nt, Homo sapiens
gaccugcuguggauggauu

SEQ ID NO: 24655 - RNA, 19 nt, Homo sapiens
cccgagaacuucacugaga

SEQ ID NO: 24656 - RNA, 19 nt, Homo sapiens
gcagagaugggcaguaaag

SEQ ID NO: 24657 - RNA, 19 nt, Homo sapiens
ggaacagccgcguagguuu

SEQ ID NO: 24658 - RNA, 19 nt, Homo sapiens
gcaagcugguggacuacga

SEQ ID NO: 24659 - RNA, 19 nt, Homo sapiens
gaagagcaaagggaaauca

SEQ ID NO: 24660 - RNA, 19 nt, Homo sapiens
cgggaaagaucgccagcaa

SEQ ID NO: 24661 - RNA, 19 nt, Homo sapiens
ccaaggaugagcaguuuga

SEQ ID NO: 24662 - RNA, 19 nt, Homo sapiens
gaacaccuccucccgaaaa

SEQ ID NO: 24663 - RNA, 19 nt, Homo sapiens
gcagauccucagccuguuu

SEQ ID NO: 24664 - RNA, 19 nt, Homo sapiens
gcagggaugaggcaaacaa

SEQ ID NO: 24665 - RNA, 19 nt, Homo sapiens
gagggcaccuuugcugugu

SEQ ID NO: 24666 - RNA, 19 nt, Homo sapiens
acaacgaccugcuguggau

SEQ ID NO: 24667 - RNA, 19 nt, Homo sapiens
gacggucugugugcuguuu

SEQ ID NO: 24668 - RNA, 19 nt, Homo sapiens
ugaaggagagcgacuggaa

SEQ ID NO: 24669 - RNA, 19 nt, Homo sapiens
gggaugaggcaaacaagau

SEQ ID NO: 24670 - RNA, 19 nt, Homo sapiens
ccaccaugcuugccugaag

SEQ ID NO: 24671 - RNA, 19 nt, Homo sapiens
gcugcuguguccucuaguu

SEQ ID NO: 24672 - RNA, 19 nt, Homo sapiens
gcaaacaagaucgcagaga

SEQ ID NO: 24673 - RNA, 19 nt, Homo sapiens
ucccaaagauuaggucguu

SEQ ID NO: 24674 - RNA, 19 nt, Homo sapiens
ucaaccagaaccucaauga

SEQ ID NO: 24675 - RNA, 19 nt, Homo sapiens
cgacaucaagucacgcauu

SEQ ID NO: 24676 - RNA, 19 nt, Homo sapiens
cuaccuggccuccgucaaa

SEQ ID NO: 24677 - RNA, 19 nt, Homo sapiens
caucucagcuccggaaagg

SEQ ID NO: 24678 - RNA, 19 nt, Homo sapiens
gcaacaccuucacggucaa

SEQ ID NO: 24679 - RNA, 19 nt, Homo sapiens
accagaaccucaaugaugu

SEQ ID NO: 24680 - RNA, 19 nt, Homo sapiens
aaccagaaccucaaugaug

SEQ ID NO: 24681 - RNA, 19 nt, Homo sapiens
aggaggagcucaucaaagc

SEQ ID NO: 24682 - RNA, 19 nt, Homo sapiens
agcagugcguccagaauuu

SEQ ID NO: 24683 - RNA, 19 nt, Homo sapiens
cgaggaggagcucaucaaa

SEQ ID NO: 24684 - RNA, 19 nt, Homo sapiens
ggaaggcagaugagaccaa

SEQ ID NO: 24685 - RNA, 19 nt, Homo sapiens
gggcaaggguccucuuuuc

SEQ ID NO: 24686 - RNA, 19 nt, Homo sapiens
ucaaagcccagaagguguu

SEQ ID NO: 24687 - RNA, 19 nt, Homo sapiens
gcacaaggagcuggagaag

SEQ ID NO: 24688 - RNA, 19 nt, Homo sapiens
ucaaggcccagcccaguga

SEQ ID NO: 24689 - RNA, 19 nt, Homo sapiens
cggcggaauucaccagugu

SEQ ID NO: 24690 - RNA, 19 nt, Homo sapiens
gcccggaguggcccuuuaa

SEQ ID NO: 24691 - RNA, 19 nt, Homo sapiens
acaaggagaugagcaagcu

SEQ ID NO: 24692 - RNA, 19 nt, Homo sapiens
gaggaggagcucaucaaag

SEQ ID NO: 24693 - RNA, 19 nt, Homo sapiens
gaaggaugaagccaaaauu

SEQ ID NO: 24694 - RNA, 19 nt, Homo sapiens
ccacuacgagucccuucaa

SEQ ID NO: 24695 - RNA, 19 nt, Homo sapiens
ggaugaggcaaacaagauc

SEQ ID NO: 24696 - RNA, 19 nt, Homo sapiens
aagcugcuguguccucuag

SEQ ID NO: 24697 - RNA, 19 nt, Homo sapiens
caaccagaaccucaaugau

SEQ ID NO: 24698 - RNA, 19 nt, Homo sapiens
ggauggauuaccaccagaa

SEQ ID NO: 24699 - RNA, 19 nt, Homo sapiens
gcagugcguccagaauuuc

SEQ ID NO: 24700 - RNA, 19 nt, Homo sapiens
caagaucgcagagaacaac

SEQ ID NO: 24701 - RNA, 19 nt, Homo sapiens
gcuguguccucuaguugag

SEQ ID NO: 24702 - RNA, 19 nt, Homo sapiens
ugacaacgcgccugcaaaa

SEQ ID NO: 24703 - RNA, 19 nt, Homo sapiens
agaagguguuugaggagau

SEQ ID NO: 24704 - RNA, 19 nt, Homo sapiens
cuacgagucccuucaaacu

SEQ ID NO: 24705 - RNA, 19 nt, Homo sapiens
agaccaaggaugagcaguu

SEQ ID NO: 24706 - RNA, 19 nt, Homo sapiens
cacuacgagucccuucaaa

SEQ ID NO: 24707 - RNA, 19 nt, Homo sapiens
ucaacacguuccagagcau

SEQ ID NO: 24708 - RNA, 19 nt, Homo sapiens
gccagcaacgugcagaaga

SEQ ID NO: 24709 - RNA, 19 nt, Homo sapiens
gcggaauucaccaguguuc

SEQ ID NO: 24710 - RNA, 19 nt, Homo sapiens
acacguuugucccugagau

SEQ ID NO: 24711 - RNA, 19 nt, Homo sapiens
cguccagaauuucaacaag

SEQ ID NO: 24712 - RNA, 19 nt, Homo sapiens
cuacacggccacugacaca

SEQ ID NO: 24713 - RNA, 19 nt, Homo sapiens
uccagaauuucaacaagca

SEQ ID NO: 24714 - RNA, 19 nt, Homo sapiens
gcucaaccagaaccucaau

SEQ ID NO: 24715 - RNA, 19 nt, Homo sapiens
uggaacagccgcguagguu

SEQ ID NO: 24716 - RNA, 19 nt, Homo sapiens
gcucaucaaagcccagaag

SEQ ID NO: 24717 - RNA, 19 nt, Homo sapiens
caaacaagaucgcagagaa

SEQ ID NO: 24718 - RNA, 19 nt, Homo sapiens
acaaggagcuggagaagug

SEQ ID NO: 24719 - RNA, 19 nt, Homo sapiens
gcucaaggcuggugaugug

SEQ ID NO: 24720 - RNA, 19 nt, Homo sapiens
aaagaaggaugaagccaaa

SEQ ID NO: 24721 - RNA, 19 nt, Homo sapiens
gaccaaggaugagcaguuu

SEQ ID NO: 24722 - RNA, 19 nt, Homo sapiens
gacaucaagucacgcauug

SEQ ID NO: 24723 - RNA, 19 nt, Homo sapiens
gagcaaagggaaaucaaga

SEQ ID NO: 24724 - RNA, 19 nt, Homo sapiens
gaacagccgcguagguuuc

SEQ ID NO: 24725 - RNA, 19 nt, Homo sapiens
uggcagagaugggcaguaa

SEQ ID NO: 24726 - RNA, 19 nt, Homo sapiens
cagaugagaccaaggauga

SEQ ID NO: 24727 - RNA, 19 nt, Homo sapiens
gagcagugcguccagaauu

SEQ ID NO: 24728 - RNA, 19 nt, Homo sapiens
ccagcaacgugcagaagaa

SEQ ID NO: 24729 - RNA, 19 nt, Homo sapiens
ggcguucucccaaagauua

SEQ ID NO: 24730 - RNA, 19 nt, Homo sapiens
guggagaccuucccagcaa

SEQ ID NO: 24731 - RNA, 19 nt, Homo sapiens
agaaggaucuccggaccua

SEQ ID NO: 24732 - RNA, 19 nt, Homo sapiens
ggcgcaagcugguggacua

SEQ ID NO: 24733 - RNA, 19 nt, Homo sapiens
gaagguguuugaggagaug

SEQ ID NO: 24734 - RNA, 19 nt, Homo sapiens
gaccugcuguggauggauu

SEQ ID NO: 24735 - RNA, 19 nt, Homo sapiens
cccgagaacuucacugaga

SEQ ID NO: 24736 - RNA, 19 nt, Homo sapiens
gcagagaugggcaguaaag

SEQ ID NO: 24737 - RNA, 19 nt, Homo sapiens
ggaacagccgcguagguuu

SEQ ID NO: 24738 - RNA, 19 nt, Homo sapiens
gcaagcugguggacuacga

SEQ ID NO: 24739 - RNA, 19 nt, Homo sapiens
gaagagcaaagggaaauca

SEQ ID NO: 24740 - RNA, 19 nt, Homo sapiens
cgggaaagaucgccagcaa

SEQ ID NO: 24741 - RNA, 19 nt, Homo sapiens
ccaaggaugagcaguuuga

SEQ ID NO: 24742 - RNA, 19 nt, Homo sapiens
gaacaccuccucccgaaaa

SEQ ID NO: 24743 - RNA, 19 nt, Homo sapiens
gcagauccucagccuguuu

SEQ ID NO: 24744 - RNA, 19 nt, Homo sapiens
gcagggaugaggcaaacaa

SEQ ID NO: 24745 - RNA, 19 nt, Homo sapiens
acaacgaccugcuguggau

SEQ ID NO: 24746 - RNA, 19 nt, Homo sapiens
gacggucugugugcuguuu

SEQ ID NO: 24747 - RNA, 19 nt, Homo sapiens
ugaaggagagcgacuggaa

SEQ ID NO: 24748 - RNA, 19 nt, Homo sapiens
gggaugaggcaaacaagau

SEQ ID NO: 24749 - RNA, 19 nt, Homo sapiens
ccaccaugcuugccugaag

SEQ ID NO: 24750 - RNA, 19 nt, Homo sapiens
gcugcuguguccucuaguu

SEQ ID NO: 24751 - RNA, 19 nt, Homo sapiens
gcaaacaagaucgcagaga

SEQ ID NO: 24752 - RNA, 19 nt, Homo sapiens
ucccaaagauuaggucguu

SEQ ID NO: 24753 - RNA, 19 nt, Homo sapiens
ucaaccagaaccucaauga

SEQ ID NO: 24754 - RNA, 19 nt, Homo sapiens
cgacaucaagucacgcauu

SEQ ID NO: 24755 - RNA, 19 nt, Homo sapiens
cuaccuggccuccgucaaa

SEQ ID NO: 24756 - RNA, 19 nt, Homo sapiens
caucucagcuccggaaagg

SEQ ID NO: 24757 - RNA, 19 nt, Homo sapiens
gcaacaccuucacggucaa

SEQ ID NO: 24758 - RNA, 19 nt, Homo sapiens
accagaaccucaaugaugu

SEQ ID NO: 24759 - RNA, 19 nt, Homo sapiens
aaccagaaccucaaugaug

SEQ ID NO: 24760 - RNA, 19 nt, Homo sapiens
aggaggagcucaucaaagc

SEQ ID NO: 24761 - RNA, 19 nt, Homo sapiens
ggaaggcagaugagaccaa

SEQ ID NO: 24762 - RNA, 19 nt, Homo sapiens
cgaggaggagcucaucaaa

SEQ ID NO: 24763 - RNA, 19 nt, Homo sapiens
agcagugcguccagaauuu

SEQ ID NO: 24764 - RNA, 19 nt, Homo sapiens
gggcaaggguccucuuuuc

SEQ ID NO: 24765 - RNA, 19 nt, Homo sapiens
ucaaagcccagaagguguu

SEQ ID NO: 24766 - RNA, 19 nt, Homo sapiens
gcacaaggagcuggagaag

SEQ ID NO: 24767 - RNA, 19 nt, Homo sapiens
ucaaggcccagcccaguga

SEQ ID NO: 24768 - RNA, 19 nt, Homo sapiens
cggcggaauucaccagugu

SEQ ID NO: 24769 - RNA, 19 nt, Homo sapiens
gcccggaguggcccuuuaa

SEQ ID NO: 24770 - RNA, 19 nt, Homo sapiens
acaaggagaugagcaagcu

SEQ ID NO: 24771 - RNA, 19 nt, Homo sapiens
gaggaggagcucaucaaag

SEQ ID NO: 24772 - RNA, 19 nt, Homo sapiens
gaaggaugaagccaaaauu

SEQ ID NO: 24773 - RNA, 19 nt, Homo sapiens
ccacuacgagucccuucaa

SEQ ID NO: 24774 - RNA, 19 nt, Homo sapiens
ggaugaggcaaacaagauc

SEQ ID NO: 24775 - RNA, 19 nt, Homo sapiens
aagcugcuguguccucuag

SEQ ID NO: 24776 - RNA, 19 nt, Homo sapiens
caaccagaaccucaaugau

SEQ ID NO: 24777 - RNA, 19 nt, Homo sapiens
ggauggauuaccaccagaa

SEQ ID NO: 24778 - RNA, 19 nt, Homo sapiens
gcagugcguccagaauuuc

SEQ ID NO: 24779 - RNA, 19 nt, Homo sapiens
caagaucgcagagaacaac

SEQ ID NO: 24780 - RNA, 19 nt, Homo sapiens
agaccaaggaugagcaguu

SEQ ID NO: 24781 - RNA, 19 nt, Homo sapiens
gcuguguccucuaguugag

SEQ ID NO: 24782 - RNA, 19 nt, Homo sapiens
ugacaacgcgccugcaaaa

SEQ ID NO: 24783 - RNA, 19 nt, Homo sapiens
agaagguguuugaggagau

SEQ ID NO: 24784 - RNA, 19 nt, Homo sapiens
cuacgagucccuucaaacu

SEQ ID NO: 24785 - RNA, 19 nt, Homo sapiens
cacuacgagucccuucaaa

SEQ ID NO: 24786 - RNA, 19 nt, Homo sapiens
ucaacacguuccagagcau

SEQ ID NO: 24787 - RNA, 19 nt, Homo sapiens
gccagcaacgugcagaaga

SEQ ID NO: 24788 - RNA, 19 nt, Homo sapiens
cguccagaauuucaacaag

SEQ ID NO: 24789 - RNA, 19 nt, Homo sapiens
gcggaauucaccaguguuc

SEQ ID NO: 24790 - RNA, 19 nt, Homo sapiens
acacguuugucccugagau

SEQ ID NO: 24791 - RNA, 19 nt, Homo sapiens
cuacacggccacugacaca

SEQ ID NO: 24792 - RNA, 19 nt, Homo sapiens
gcucaaccagaaccucaau

SEQ ID NO: 24793 - RNA, 19 nt, Homo sapiens
uggaacagccgcguagguu

SEQ ID NO: 24794 - RNA, 19 nt, Homo sapiens
gcucaucaaagcccagaag

SEQ ID NO: 24795 - RNA, 19 nt, Homo sapiens
uccagaauuucaacaagca

SEQ ID NO: 24796 - RNA, 19 nt, Homo sapiens
caaacaagaucgcagagaa

SEQ ID NO: 24797 - RNA, 19 nt, Homo sapiens
acaaggagcuggagaagug

SEQ ID NO: 24798 - RNA, 19 nt, Homo sapiens
gcucaaggcuggugaugug

SEQ ID NO: 24799 - RNA, 19 nt, Homo sapiens
aaagaaggaugaagccaaa

SEQ ID NO: 24800 - RNA, 19 nt, Homo sapiens
gaccaaggaugagcaguuu

SEQ ID NO: 24801 - RNA, 19 nt, Homo sapiens
gacaucaagucacgcauug

SEQ ID NO: 24802 - RNA, 19 nt, Homo sapiens
gagcaaagggaaaucaaga

SEQ ID NO: 24803 - RNA, 19 nt, Homo sapiens
gaacagccgcguagguuuc

SEQ ID NO: 24804 - RNA, 19 nt, Homo sapiens
uggcagagaugggcaguaa

SEQ ID NO: 24805 - RNA, 19 nt, Homo sapiens
cagaugagaccaaggauga

SEQ ID NO: 24806 - RNA, 19 nt, Homo sapiens
gagcagugcguccagaauu

SEQ ID NO: 24807 - RNA, 19 nt, Homo sapiens
ccagcaacgugcagaagaa

SEQ ID NO: 24808 - RNA, 19 nt, Homo sapiens
ggcguucucccaaagauua

SEQ ID NO: 24809 - RNA, 19 nt, Homo sapiens
guggagaccuucccagcaa

SEQ ID NO: 24810 - RNA, 19 nt, Homo sapiens
agaaggaucuccggaccua

SEQ ID NO: 24811 - RNA, 19 nt, Homo sapiens
ggcgcaagcugguggacua

SEQ ID NO: 24812 - RNA, 19 nt, Homo sapiens
gaagguguuugaggagaug

SEQ ID NO: 24813 - RNA, 19 nt, Homo sapiens
gaccugcuguggauggauu

SEQ ID NO: 24814 - RNA, 19 nt, Homo sapiens
cccgagaacuucacugaga

SEQ ID NO: 24815 - RNA, 19 nt, Homo sapiens
gcagagaugggcaguaaag

SEQ ID NO: 24816 - RNA, 19 nt, Homo sapiens
ggaacagccgcguagguuu

SEQ ID NO: 24817 - RNA, 19 nt, Homo sapiens
gcaagcugguggacuacga

SEQ ID NO: 24818 - RNA, 19 nt, Homo sapiens
gaagagcaaagggaaauca

SEQ ID NO: 24819 - RNA, 19 nt, Homo sapiens
cgggaaagaucgccagcaa

SEQ ID NO: 24820 - RNA, 19 nt, Homo sapiens
ccaaggaugagcaguuuga

SEQ ID NO: 24821 - RNA, 19 nt, Homo sapiens
gaacaccuccucccgaaaa

SEQ ID NO: 24822 - RNA, 19 nt, Homo sapiens
gcagggaugaggcaaacaa

SEQ ID NO: 24823 - RNA, 19 nt, Homo sapiens
gagggcaccuuugcugugu

SEQ ID NO: 24824 - RNA, 19 nt, Homo sapiens
acaacgaccugcuguggau

SEQ ID NO: 24825 - RNA, 19 nt, Homo sapiens
gacggucugugugcuguuu

SEQ ID NO: 24826 - RNA, 19 nt, Homo sapiens
ugaaggagagcgacuggaa

SEQ ID NO: 24827 - RNA, 19 nt, Homo sapiens
gggaugaggcaaacaagau

SEQ ID NO: 24828 - RNA, 19 nt, Homo sapiens
ccaccaugcuugccugaag

SEQ ID NO: 24829 - RNA, 19 nt, Homo sapiens
gcugcuguguccucuaguu

SEQ ID NO: 24830 - RNA, 19 nt, Homo sapiens
gcaaacaagaucgcagaga

SEQ ID NO: 24831 - RNA, 19 nt, Homo sapiens
ucccaaagauuaggucguu

SEQ ID NO: 24832 - RNA, 19 nt, Homo sapiens
ucaaccagaaccucaauga

SEQ ID NO: 24833 - RNA, 19 nt, Homo sapiens
cgacaucaagucacgcauu

SEQ ID NO: 24834 - RNA, 19 nt, Homo sapiens
cuaccuggccuccgucaaa

SEQ ID NO: 24835 - RNA, 19 nt, Homo sapiens
gcaacaccuucacggucaa

SEQ ID NO: 24836 - RNA, 19 nt, Homo sapiens
accagaaccucaaugaugu

SEQ ID NO: 24837 - RNA, 19 nt, Homo sapiens
aaccagaaccucaaugaug

SEQ ID NO: 24838 - RNA, 19 nt, Homo sapiens
aggaggagcucaucaaagc

SEQ ID NO: 24839 - RNA, 19 nt, Homo sapiens
ggaaggcagaugagaccaa

SEQ ID NO: 24840 - RNA, 19 nt, Homo sapiens
cgaggaggagcucaucaaa

SEQ ID NO: 24841 - RNA, 19 nt, Homo sapiens
agcagugcguccagaauuu

SEQ ID NO: 24842 - RNA, 19 nt, Homo sapiens
gggcaaggguccucuuuuc

SEQ ID NO: 24843 - RNA, 19 nt, Homo sapiens
ucaaagcccagaagguguu

SEQ ID NO: 24844 - RNA, 19 nt, Homo sapiens
gcacaaggagcuggagaag

SEQ ID NO: 24845 - RNA, 19 nt, Homo sapiens
ucaaggcccagcccaguga

SEQ ID NO: 24846 - RNA, 19 nt, Homo sapiens
cggcggaauucaccagugu

SEQ ID NO: 24847 - RNA, 19 nt, Homo sapiens
gcccggaguggcccuuuaa

SEQ ID NO: 24848 - RNA, 19 nt, Homo sapiens
acaaggagaugagcaagcu

SEQ ID NO: 24849 - RNA, 19 nt, Homo sapiens
gaggaggagcucaucaaag

SEQ ID NO: 24850 - RNA, 19 nt, Homo sapiens
gaaggaugaagccaaaauu

SEQ ID NO: 24851 - RNA, 19 nt, Homo sapiens
ccacuacgagucccuucaa

SEQ ID NO: 24852 - RNA, 19 nt, Homo sapiens
ggaugaggcaaacaagauc

SEQ ID NO: 24853 - RNA, 19 nt, Homo sapiens
aagcugcuguguccucuag

SEQ ID NO: 24854 - RNA, 19 nt, Homo sapiens
caaccagaaccucaaugau

SEQ ID NO: 24855 - RNA, 19 nt, Homo sapiens
ggauggauuaccaccagaa

SEQ ID NO: 24856 - RNA, 19 nt, Homo sapiens
gcagugcguccagaauuuc

SEQ ID NO: 24857 - RNA, 19 nt, Homo sapiens
caagaucgcagagaacaac

SEQ ID NO: 24858 - RNA, 19 nt, Homo sapiens
agaccaaggaugagcaguu

SEQ ID NO: 24859 - RNA, 19 nt, Homo sapiens
gcuguguccucuaguugag

SEQ ID NO: 24860 - RNA, 19 nt, Homo sapiens
ugacaacgcgccugcaaaa

SEQ ID NO: 24861 - RNA, 19 nt, Homo sapiens
agaagguguuugaggagau

SEQ ID NO: 24862 - RNA, 19 nt, Homo sapiens
cuacgagucccuucaaacu

SEQ ID NO: 24863 - RNA, 19 nt, Homo sapiens
cacuacgagucccuucaaa

SEQ ID NO: 24864 - RNA, 19 nt, Homo sapiens
ucaacacguuccagagcau

SEQ ID NO: 24865 - RNA, 19 nt, Homo sapiens
gccagcaacgugcagaaga

SEQ ID NO: 24866 - RNA, 19 nt, Homo sapiens
gcggaauucaccaguguuc

SEQ ID NO: 24867 - RNA, 19 nt, Homo sapiens
cguccagaauuucaacaag

SEQ ID NO: 24868 - RNA, 19 nt, Homo sapiens
cuacacggccacugacaca

SEQ ID NO: 24869 - RNA, 19 nt, Homo sapiens
gcucaaccagaaccucaau

SEQ ID NO: 24870 - RNA, 19 nt, Homo sapiens
uggaacagccgcguagguu

SEQ ID NO: 24871 - RNA, 19 nt, Homo sapiens
gcucaucaaagcccagaag

SEQ ID NO: 24872 - RNA, 19 nt, Homo sapiens
uccagaauuucaacaagca

SEQ ID NO: 24873 - RNA, 19 nt, Homo sapiens
caaacaagaucgcagagaa

SEQ ID NO: 24874 - RNA, 19 nt, Homo sapiens
acaaggagcuggagaagug

SEQ ID NO: 24875 - RNA, 19 nt, Homo sapiens
gcucaaggcuggugaugug

SEQ ID NO: 24876 - RNA, 19 nt, Homo sapiens
aaagaaggaugaagccaaa

SEQ ID NO: 24877 - RNA, 19 nt, Homo sapiens
gaccaaggaugagcaguuu

SEQ ID NO: 24878 - RNA, 19 nt, Homo sapiens
gacaucaagucacgcauug

SEQ ID NO: 24879 - RNA, 19 nt, Homo sapiens
gagcaaagggaaaucaaga

SEQ ID NO: 24880 - RNA, 19 nt, Homo sapiens
gaacagccgcguagguuuc

SEQ ID NO: 24881 - RNA, 19 nt, Homo sapiens
uggcagagaugggcaguaa

SEQ ID NO: 24882 - RNA, 19 nt, Homo sapiens
cagaugagaccaaggauga

SEQ ID NO: 24883 - RNA, 19 nt, Homo sapiens
gagcagugcguccagaauu

SEQ ID NO: 24884 - RNA, 19 nt, Homo sapiens
ccagcaacgugcagaagaa

SEQ ID NO: 24885 - RNA, 19 nt, Homo sapiens
ggcguucucccaaagauua

SEQ ID NO: 24886 - RNA, 19 nt, Homo sapiens
guggagaccuucccagcaa

SEQ ID NO: 24887 - RNA, 19 nt, Homo sapiens
agaaggaucuccggaccua

SEQ ID NO: 24888 - RNA, 19 nt, Homo sapiens
ggcgcaagcugguggacua

SEQ ID NO: 24889 - RNA, 19 nt, Homo sapiens
gaagguguuugaggagaug

SEQ ID NO: 24890 - RNA, 19 nt, Homo sapiens
gaccugcuguggauggauu

SEQ ID NO: 24891 - RNA, 19 nt, Homo sapiens
cccgagaacuucacugaga

SEQ ID NO: 24892 - RNA, 19 nt, Homo sapiens
gcagagaugggcaguaaag

SEQ ID NO: 24893 - RNA, 19 nt, Homo sapiens
ggaacagccgcguagguuu

SEQ ID NO: 24894 - RNA, 19 nt, Homo sapiens
gcaagcugguggacuacga

SEQ ID NO: 24895 - RNA, 19 nt, Homo sapiens
gaagagcaaagggaaauca

SEQ ID NO: 24896 - RNA, 19 nt, Homo sapiens
cgggaaagaucgccagcaa

SEQ ID NO: 24897 - RNA, 19 nt, Homo sapiens
ccaaggaugagcaguuuga

SEQ ID NO: 24898 - RNA, 19 nt, Homo sapiens
gaacaccuccucccgaaaa

SEQ ID NO: 24899 - RNA, 19 nt, Homo sapiens
gcagggaugaggcaaacaa

SEQ ID NO: 24900 - RNA, 19 nt, Homo sapiens
acaacgaccugcuguggau

SEQ ID NO: 24901 - RNA, 19 nt, Homo sapiens
gacggucugugugcuguuu

SEQ ID NO: 24902 - RNA, 19 nt, Homo sapiens
ugaaggagagcgacuggaa

SEQ ID NO: 24903 - RNA, 19 nt, Homo sapiens
gggaugaggcaaacaagau

SEQ ID NO: 24904 - RNA, 19 nt, Homo sapiens
ccaccaugcuugccugaag

SEQ ID NO: 24905 - RNA, 19 nt, Homo sapiens
gcugcuguguccucuaguu

SEQ ID NO: 24906 - RNA, 19 nt, Homo sapiens
gcaaacaagaucgcagaga

SEQ ID NO: 24907 - RNA, 19 nt, Homo sapiens
ucccaaagauuaggucguu

SEQ ID NO: 24908 - RNA, 19 nt, Homo sapiens
ucaaccagaaccucaauga

SEQ ID NO: 24909 - RNA, 19 nt, Homo sapiens
cgacaucaagucacgcauu

SEQ ID NO: 24910 - RNA, 19 nt, Homo sapiens
cuaccuggccuccgucaaa

SEQ ID NO: 24911 - RNA, 19 nt, Homo sapiens
gcaacaccuucacggucaa

SEQ ID NO: 24912 - RNA, 19 nt, Homo sapiens
accagaaccucaaugaugu

SEQ ID NO: 24913 - RNA, 19 nt, Homo sapiens
aaccagaaccucaaugaug

SEQ ID NO: 24914 - RNA, 19 nt, Homo sapiens
aggaggagcucaucaaagc

SEQ ID NO: 24915 - RNA, 19 nt, Homo sapiens
ggaaggcagaugagaccaa

SEQ ID NO: 24916 - RNA, 19 nt, Homo sapiens
cgaggaggagcucaucaaa

SEQ ID NO: 24917 - RNA, 19 nt, Homo sapiens
agcagugcguccagaauuu

SEQ ID NO: 24918 - RNA, 19 nt, Homo sapiens
gggcaaggguccucuuuuc

SEQ ID NO: 24919 - RNA, 19 nt, Homo sapiens
ucaaagcccagaagguguu

SEQ ID NO: 24920 - RNA, 19 nt, Homo sapiens
gcacaaggagcuggagaag

SEQ ID NO: 24921 - RNA, 19 nt, Homo sapiens
ucaaggcccagcccaguga

SEQ ID NO: 24922 - RNA, 19 nt, Homo sapiens
cggcggaauucaccagugu

SEQ ID NO: 24923 - RNA, 19 nt, Homo sapiens
gcccggaguggcccuuuaa

SEQ ID NO: 24924 - RNA, 19 nt, Homo sapiens
acaaggagaugagcaagcu

SEQ ID NO: 24925 - RNA, 19 nt, Homo sapiens
gaggaggagcucaucaaag

SEQ ID NO: 24926 - RNA, 19 nt, Homo sapiens
gaaggaugaagccaaaauu

SEQ ID NO: 24927 - RNA, 19 nt, Homo sapiens
ccacuacgagucccuucaa

SEQ ID NO: 24928 - RNA, 19 nt, Homo sapiens
ggaugaggcaaacaagauc

SEQ ID NO: 24929 - RNA, 19 nt, Homo sapiens
aagcugcuguguccucuag

SEQ ID NO: 24930 - RNA, 19 nt, Homo sapiens
caaccagaaccucaaugau

SEQ ID NO: 24931 - RNA, 19 nt, Homo sapiens
ggauggauuaccaccagaa

SEQ ID NO: 24932 - RNA, 19 nt, Homo sapiens
gcagugcguccagaauuuc

SEQ ID NO: 24933 - RNA, 19 nt, Homo sapiens
caagaucgcagagaacaac

SEQ ID NO: 24934 - RNA, 19 nt, Homo sapiens
gcuguguccucuaguugag

SEQ ID NO: 24935 - RNA, 19 nt, Homo sapiens
agaccaaggaugagcaguu

SEQ ID NO: 24936 - RNA, 19 nt, Homo sapiens
ugacaacgcgccugcaaaa

SEQ ID NO: 24937 - RNA, 19 nt, Homo sapiens
agaagguguuugaggagau

SEQ ID NO: 24938 - RNA, 19 nt, Homo sapiens
cuacgagucccuucaaacu

SEQ ID NO: 24939 - RNA, 19 nt, Homo sapiens
cacuacgagucccuucaaa

SEQ ID NO: 24940 - RNA, 19 nt, Homo sapiens
ucaacacguuccagagcau

SEQ ID NO: 24941 - RNA, 19 nt, Homo sapiens
gccagcaacgugcagaaga

SEQ ID NO: 24942 - RNA, 19 nt, Homo sapiens
gcggaauucaccaguguuc

SEQ ID NO: 24943 - RNA, 19 nt, Homo sapiens
cguccagaauuucaacaag

SEQ ID NO: 24944 - RNA, 19 nt, Homo sapiens
uccagaauuucaacaagca

SEQ ID NO: 24945 - RNA, 19 nt, Homo sapiens
cuacacggccacugacaca

SEQ ID NO: 24946 - RNA, 19 nt, Homo sapiens
gcucaaccagaaccucaau

SEQ ID NO: 24947 - RNA, 19 nt, Homo sapiens
uggaacagccgcguagguu

SEQ ID NO: 24948 - RNA, 19 nt, Homo sapiens
gcucaucaaagcccagaag

SEQ ID NO: 24949 - RNA, 19 nt, Homo sapiens
caaacaagaucgcagagaa

SEQ ID NO: 24950 - RNA, 19 nt, Homo sapiens
acaaggagcuggagaagug

SEQ ID NO: 24951 - RNA, 19 nt, Homo sapiens
gcucaaggcuggugaugug

SEQ ID NO: 24952 - RNA, 19 nt, Homo sapiens
aaagaaggaugaagccaaa

SEQ ID NO: 24953 - RNA, 19 nt, Homo sapiens
gaccaaggaugagcaguuu

SEQ ID NO: 24954 - RNA, 19 nt, Homo sapiens
gacaucaagucacgcauug

SEQ ID NO: 24955 - RNA, 19 nt, Homo sapiens
gagcaaagggaaaucaaga

SEQ ID NO: 24956 - RNA, 19 nt, Homo sapiens
gaacagccgcguagguuuc

SEQ ID NO: 24957 - RNA, 19 nt, Homo sapiens
uggcagagaugggcaguaa

SEQ ID NO: 24958 - RNA, 19 nt, Homo sapiens
cagaugagaccaaggauga

SEQ ID NO: 24959 - RNA, 19 nt, Homo sapiens
gagcagugcguccagaauu

SEQ ID NO: 24960 - RNA, 19 nt, Homo sapiens
ccagcaacgugcagaagaa

SEQ ID NO: 24961 - RNA, 19 nt, Homo sapiens
ggcguucucccaaagauua

SEQ ID NO: 24962 - RNA, 19 nt, Homo sapiens
guggagaccuucccagcaa

SEQ ID NO: 24963 - RNA, 19 nt, Homo sapiens
agaaggaucuccggaccua

SEQ ID NO: 24964 - RNA, 19 nt, Homo sapiens
ggcgcaagcugguggacua

SEQ ID NO: 24965 - RNA, 19 nt, Homo sapiens
gaagguguuugaggagaug

SEQ ID NO: 24966 - RNA, 19 nt, Homo sapiens
gaccugcuguggauggauu

SEQ ID NO: 24967 - RNA, 19 nt, Homo sapiens
cccgagaacuucacugaga

SEQ ID NO: 24968 - RNA, 19 nt, Homo sapiens
gcagagaugggcaguaaag

SEQ ID NO: 24969 - RNA, 19 nt, Homo sapiens
ggaacagccgcguagguuu

SEQ ID NO: 24970 - RNA, 19 nt, Homo sapiens
gcaagcugguggacuacga

SEQ ID NO: 24971 - RNA, 19 nt, Homo sapiens
gaagagcaaagggaaauca

SEQ ID NO: 24972 - RNA, 19 nt, Homo sapiens
cgggaaagaucgccagcaa

SEQ ID NO: 24973 - RNA, 19 nt, Homo sapiens
ccaaggaugagcaguuuga

SEQ ID NO: 24974 - RNA, 19 nt, Homo sapiens
gaacaccuccucccgaaaa

SEQ ID NO: 24975 - RNA, 19 nt, Homo sapiens
gcagggaugaggcaaacaa

SEQ ID NO: 24976 - RNA, 19 nt, Homo sapiens
acaacgaccugcuguggau

SEQ ID NO: 24977 - RNA, 19 nt, Homo sapiens
gacggucugugugcuguuu

SEQ ID NO: 24978 - RNA, 19 nt, Homo sapiens
ugaaggagagcgacuggaa

SEQ ID NO: 24979 - RNA, 19 nt, Homo sapiens
gggaugaggcaaacaagau

SEQ ID NO: 24980 - RNA, 19 nt, Homo sapiens
ccaccaugcuugccugaag

SEQ ID NO: 24981 - RNA, 19 nt, Homo sapiens
gcugcuguguccucuaguu

SEQ ID NO: 24982 - RNA, 19 nt, Homo sapiens
gcaaacaagaucgcagaga

SEQ ID NO: 24983 - RNA, 19 nt, Homo sapiens
ucccaaagauuaggucguu

SEQ ID NO: 24984 - RNA, 19 nt, Homo sapiens
ucaaccagaaccucaauga

SEQ ID NO: 24985 - RNA, 19 nt, Homo sapiens
cgacaucaagucacgcauu

SEQ ID NO: 24986 - RNA, 19 nt, Homo sapiens
cuaccuggccuccgucaaa

SEQ ID NO: 24987 - RNA, 19 nt, Homo sapiens
gcaacaccuucacggucaa

SEQ ID NO: 24988 - RNA, 19 nt, Homo sapiens
accagaaccucaaugaugu

SEQ ID NO: 24989 - RNA, 19 nt, Homo sapiens
aaccagaaccucaaugaug

SEQ ID NO: 24990 - RNA, 19 nt, Homo sapiens
aggaggagcucaucaaagc

SEQ ID NO: 24991 - RNA, 19 nt, Homo sapiens
ggaaggcagaugagaccaa

SEQ ID NO: 24992 - RNA, 19 nt, Homo sapiens
cgaggaggagcucaucaaa

SEQ ID NO: 24993 - RNA, 19 nt, Homo sapiens
agcagugcguccagaauuu

SEQ ID NO: 24994 - RNA, 19 nt, Homo sapiens
gggcaaggguccucuuuuc

SEQ ID NO: 24995 - RNA, 19 nt, Homo sapiens
ucaaagcccagaagguguu

SEQ ID NO: 24996 - RNA, 19 nt, Homo sapiens
gcacaaggagcuggagaag

SEQ ID NO: 24997 - RNA, 19 nt, Homo sapiens
ucaaggcccagcccaguga

SEQ ID NO: 24998 - RNA, 19 nt, Homo sapiens
cggcggaauucaccagugu

SEQ ID NO: 24999 - RNA, 19 nt, Homo sapiens
gcccggaguggcccuuuaa

SEQ ID NO: 25000 - RNA, 19 nt, Homo sapiens
acaaggagaugagcaagcu

SEQ ID NO: 25001 - RNA, 19 nt, Homo sapiens
gaggaggagcucaucaaag

SEQ ID NO: 25002 - RNA, 19 nt, Homo sapiens
gaaggaugaagccaaaauu

SEQ ID NO: 25003 - RNA, 19 nt, Homo sapiens
ccacuacgagucccuucaa

SEQ ID NO: 25004 - RNA, 19 nt, Homo sapiens
ggaugaggcaaacaagauc

SEQ ID NO: 25005 - RNA, 19 nt, Homo sapiens
aagcugcuguguccucuag

SEQ ID NO: 25006 - RNA, 19 nt, Homo sapiens
caaccagaaccucaaugau

SEQ ID NO: 25007 - RNA, 19 nt, Homo sapiens
ggauggauuaccaccagaa

SEQ ID NO: 25008 - RNA, 19 nt, Homo sapiens
gcagugcguccagaauuuc

SEQ ID NO: 25009 - RNA, 19 nt, Homo sapiens
caagaucgcagagaacaac

SEQ ID NO: 25010 - RNA, 19 nt, Homo sapiens
gcuguguccucuaguugag

SEQ ID NO: 25011 - RNA, 19 nt, Homo sapiens
agaccaaggaugagcaguu

SEQ ID NO: 25012 - RNA, 19 nt, Homo sapiens
ugacaacgcgccugcaaaa

SEQ ID NO: 25013 - RNA, 19 nt, Homo sapiens
agaagguguuugaggagau

SEQ ID NO: 25014 - RNA, 19 nt, Homo sapiens
cuacgagucccuucaaacu

SEQ ID NO: 25015 - RNA, 19 nt, Homo sapiens
cacuacgagucccuucaaa

SEQ ID NO: 25016 - RNA, 19 nt, Homo sapiens
ucaacacguuccagagcau

SEQ ID NO: 25017 - RNA, 19 nt, Homo sapiens
gccagcaacgugcagaaga

SEQ ID NO: 25018 - RNA, 19 nt, Homo sapiens
gcggaauucaccaguguuc

SEQ ID NO: 25019 - RNA, 19 nt, Homo sapiens
cguccagaauuucaacaag

SEQ ID NO: 25020 - RNA, 19 nt, Homo sapiens
uccagaauuucaacaagca

SEQ ID NO: 25021 - RNA, 19 nt, Homo sapiens
cuacacggccacugacaca

SEQ ID NO: 25022 - RNA, 19 nt, Homo sapiens
gcucaaccagaaccucaau

SEQ ID NO: 25023 - RNA, 19 nt, Homo sapiens
uggaacagccgcguagguu

SEQ ID NO: 25024 - RNA, 19 nt, Homo sapiens
gcucaucaaagcccagaag

SEQ ID NO: 25025 - RNA, 19 nt, Homo sapiens
gaacauagacucacucuuc

SEQ ID NO: 25026 - RNA, 19 nt, Homo sapiens
ggacaccgcucuaugacuu

SEQ ID NO: 25027 - RNA, 19 nt, Homo sapiens
ggacaaugcugcugguaga

SEQ ID NO: 25028 - RNA, 19 nt, Homo sapiens
ggcaacagcuauucugaaa

SEQ ID NO: 25029 - RNA, 19 nt, Homo sapiens
gauaaaaccucccaaccua

SEQ ID NO: 25030 - RNA, 19 nt, Homo sapiens
ccaccuaacucaugccauu

SEQ ID NO: 25031 - RNA, 19 nt, Homo sapiens
ucaagaagcugaggcagaa

SEQ ID NO: 25032 - RNA, 19 nt, Homo sapiens
gcagaggccuggacuacau

SEQ ID NO: 25033 - RNA, 19 nt, Homo sapiens
gcaggacaccgcucuauga

SEQ ID NO: 25034 - RNA, 19 nt, Homo sapiens
uaaacuuccuucuuacuug

SEQ ID NO: 25035 - RNA, 19 nt, Homo sapiens
ggacccugcuucugaguga

SEQ ID NO: 25036 - RNA, 19 nt, Homo sapiens
ccaguuugcuuuccguaaa

SEQ ID NO: 25037 - RNA, 19 nt, Homo sapiens
guaaugagaagcuuugguu

SEQ ID NO: 25038 - RNA, 19 nt, Homo sapiens
caaauuguccuuacugcaa

SEQ ID NO: 25039 - RNA, 19 nt, Homo sapiens
caaccuaccucaccauggu

SEQ ID NO: 25040 - RNA, 19 nt, Homo sapiens
gccuggagguguuggauaa

SEQ ID NO: 25041 - RNA, 19 nt, Homo sapiens
gguggaggcugauucuaau

SEQ ID NO: 25042 - RNA, 19 nt, Homo sapiens
ucagggagcuucagaacca

SEQ ID NO: 25043 - RNA, 19 nt, Homo sapiens
gauggagagucuagugguu

SEQ ID NO: 25044 - RNA, 19 nt, Homo sapiens
ggaggcugauucuaauugu

SEQ ID NO: 25045 - RNA, 19 nt, Homo sapiens
gcagugugguggccucugu

SEQ ID NO: 25046 - RNA, 19 nt, Homo sapiens
ucagcaagaugcccuuugu

SEQ ID NO: 25047 - RNA, 19 nt, Homo sapiens
ugaggaaacugcccuucau

SEQ ID NO: 25048 - RNA, 19 nt, Homo sapiens
cauggaggguaccaagauu

SEQ ID NO: 25049 - RNA, 19 nt, Homo sapiens
gcagaugaccugaggaaac

SEQ ID NO: 25050 - RNA, 19 nt, Homo sapiens
caugggcagugcggacuua

SEQ ID NO: 25051 - RNA, 19 nt, Homo sapiens
cggaccagcucacacaaug

SEQ ID NO: 25052 - RNA, 19 nt, Homo sapiens
ugacauugaugaacacacu

SEQ ID NO: 25053 - RNA, 19 nt, Homo sapiens
cagaugaccugaggaaacu

SEQ ID NO: 25054 - RNA, 19 nt, Homo sapiens
ucuagugguuggagacauu

SEQ ID NO: 25055 - RNA, 19 nt, Homo sapiens
agaauguggcgauggguua

SEQ ID NO: 25056 - RNA, 19 nt, Homo sapiens
uugcagagcuaagaccaaa

SEQ ID NO: 25057 - RNA, 19 nt, Homo sapiens
aaacuacuauacccucaag

SEQ ID NO: 25058 - RNA, 19 nt, Homo sapiens
cuagugugcugcccaguag

SEQ ID NO: 25059 - RNA, 19 nt, Homo sapiens
gagcagaggccuggacuac

SEQ ID NO: 25060 - RNA, 19 nt, Homo sapiens
cuacuauacccucaaguga

SEQ ID NO: 25061 - RNA, 19 nt, Homo sapiens
ggagguguuuggcgugucu

SEQ ID NO: 25062 - RNA, 19 nt, Homo sapiens
gaaccagggcagagaugug

SEQ ID NO: 25063 - RNA, 19 nt, Homo sapiens
caagauugguacugugacu

SEQ ID NO: 25064 - RNA, 19 nt, Homo sapiens
guaagcugauggagagucu

SEQ ID NO: 25065 - RNA, 19 nt, Homo sapiens
caccaccuauucugaguuc

SEQ ID NO: 25066 - RNA, 19 nt, Homo sapiens
gacucacucuuccacauuc

SEQ ID NO: 25067 - RNA, 19 nt, Homo sapiens
gagggaacauagacucacu

SEQ ID NO: 25068 - RNA, 19 nt, Homo sapiens
ugcaaaggguaauaacaug

SEQ ID NO: 25069 - RNA, 19 nt, Homo sapiens
gcagacucaccaccuauuc

SEQ ID NO: 25070 - RNA, 19 nt, Homo sapiens
caugaccagugcugugaug

SEQ ID NO: 25071 - RNA, 19 nt, Homo sapiens
ugacagguguaagcugaug

SEQ ID NO: 25072 - RNA, 19 nt, Homo sapiens
guaaaugcaaauuguccuu

SEQ ID NO: 25073 - RNA, 19 nt, Homo sapiens
gaggaaacugcccuucaug

SEQ ID NO: 25074 - RNA, 19 nt, Homo sapiens
ucuuugacgugucucauau

SEQ ID NO: 25075 - RNA, 19 nt, Homo sapiens
cacugucgcuguuuaccaa

SEQ ID NO: 25076 - RNA, 19 nt, Homo sapiens
gcuggaggguaaugagaag

SEQ ID NO: 25077 - RNA, 19 nt, Homo sapiens
gagaggaugguguggagau

SEQ ID NO: 25078 - RNA, 19 nt, Homo sapiens
ggaaacugcccuucaugac

SEQ ID NO: 25079 - RNA, 19 nt, Homo sapiens
gaaagauuuggcccucaug

SEQ ID NO: 25080 - RNA, 19 nt, Homo sapiens
agaaagauuuggcccucau

SEQ ID NO: 25081 - RNA, 19 nt, Homo sapiens
cugcuaugccuguguguaa

SEQ ID NO: 25082 - RNA, 19 nt, Homo sapiens
ggaggguaaugagaagcuu

SEQ ID NO: 25083 - RNA, 19 nt, Homo sapiens
ggccuugugucguccacuu

SEQ ID NO: 25084 - RNA, 19 nt, Homo sapiens
gcaaaccauggcagacuca

SEQ ID NO: 25085 - RNA, 19 nt, Homo sapiens
acuauacccucaagugaag

SEQ ID NO: 25086 - RNA, 19 nt, Homo sapiens
gugcugugauggagguguu

SEQ ID NO: 25087 - RNA, 19 nt, Homo sapiens
gcugcugggagaaagauuu

SEQ ID NO: 25088 - RNA, 19 nt, Homo sapiens
ggagacauugcagagcuaa

SEQ ID NO: 25089 - RNA, 19 nt, Homo sapiens
ugacggaccagcucacaca

SEQ ID NO: 25090 - RNA, 19 nt, Homo sapiens
cugcaagucaggaaugauu

SEQ ID NO: 25091 - RNA, 19 nt, Homo sapiens
caguuugcuuuccguaaau

SEQ ID NO: 25092 - RNA, 19 nt, Homo sapiens
gaggguaaugagaagcuuu

SEQ ID NO: 25093 - RNA, 19 nt, Homo sapiens
agacauugcagagcuaaga

SEQ ID NO: 25094 - RNA, 19 nt, Homo sapiens
uagacucacucuuccacau

SEQ ID NO: 25095 - RNA, 19 nt, Homo sapiens
aggaaugauugcugacuca

SEQ ID NO: 25096 - RNA, 19 nt, Homo sapiens
ggaaaaugguggcguuugc

SEQ ID NO: 25097 - RNA, 19 nt, Homo sapiens
gaauguggcgauggguuau

SEQ ID NO: 25098 - RNA, 19 nt, Homo sapiens
guuggauaaugcccugcua

SEQ ID NO: 25099 - RNA, 19 nt, Homo sapiens
uggagacauugcagagcua

SEQ ID NO: 25100 - RNA, 19 nt, Homo sapiens
ggauggcugagggaacaua

SEQ ID NO: 25101 - RNA, 19 nt, Homo sapiens
gaaugauugcugacucaca

SEQ ID NO: 25102 - RNA, 19 nt, Homo sapiens
aaaugcaaauuguccuuac

SEQ ID NO: 25103 - RNA, 19 nt, Homo sapiens
uuccguaaaugcaaauugu

SEQ ID NO: 25104 - RNA, 19 nt, Homo sapiens
gcacugcucgcucuuugac

SEQ ID NO: 25105 - RNA, 19 nt, Homo sapiens
gaccagcucacacaauguc

SEQ ID NO: 25106 - RNA, 19 nt, Homo sapiens
guuaugugcccugcgagua

SEQ ID NO: 25107 - RNA, 19 nt, Homo sapiens
uagaugacuugauuguaac

SEQ ID NO: 25108 - RNA, 19 nt, Homo sapiens
cgaggcuggaggcaucuua

SEQ ID NO: 25109 - RNA, 19 nt, Homo sapiens
agacucacucuuccacauu

SEQ ID NO: 25110 - RNA, 19 nt, Homo sapiens
cagcucacacaaugucuug

SEQ ID NO: 25111 - RNA, 19 nt, Homo sapiens
gggcuuccucccagacuug

SEQ ID NO: 25112 - RNA, 19 nt, Homo sapiens
ggaccagcucacacaaugu

SEQ ID NO: 25113 - RNA, 19 nt, Homo sapiens
gaggcugauucuaauuguc

SEQ ID NO: 25114 - RNA, 19 nt, Homo sapiens
ggagccaaggucauuguuc

SEQ ID NO: 25115 - RNA, 19 nt, Homo sapiens
ggacaaggucagggagcuu

SEQ ID NO: 25116 - RNA, 19 nt, Homo sapiens
ggcagacucaccaccuauu

SEQ ID NO: 25117 - RNA, 19 nt, Homo sapiens
aggaaacugcccuucauga

SEQ ID NO: 25118 - RNA, 19 nt, Homo sapiens
gcugauggagagucuagug

SEQ ID NO: 25119 - RNA, 19 nt, Homo sapiens
agguggaggcugauucuaa

SEQ ID NO: 25120 - RNA, 19 nt, Homo sapiens
uacuauacccucaagugaa

SEQ ID NO: 25121 - RNA, 19 nt, Homo sapiens
ggccuggagguguuggaua

SEQ ID NO: 25122 - RNA, 19 nt, Homo sapiens
ucuagugugcugcccagua

SEQ ID NO: 25123 - RNA, 19 nt, Homo sapiens
gcugucccuuccaggaguu

SEQ ID NO: 25124 - RNA, 19 nt, Homo sapiens
caaacuacuauacccucaa

SEQ ID NO: 25125 - RNA, 19 nt, Homo sapiens
gaacaucgauggcgccaaa

SEQ ID NO: 25126 - RNA, 19 nt, Homo sapiens
guucuaagauugccgaaua

SEQ ID NO: 25127 - RNA, 19 nt, Homo sapiens
gaagauccauuuauugcaa

SEQ ID NO: 25128 - RNA, 19 nt, Homo sapiens
gaaagauaccaaccaguua

SEQ ID NO: 25129 - RNA, 19 nt, Homo sapiens
ggaaagauaccaaccaguu

SEQ ID NO: 25130 - RNA, 19 nt, Homo sapiens
gaauggcgauggguugaua

SEQ ID NO: 25131 - RNA, 19 nt, Homo sapiens
caaauaaggaacaugguua

SEQ ID NO: 25132 - RNA, 19 nt, Homo sapiens
ggaaacagaggauucauug

SEQ ID NO: 25133 - RNA, 19 nt, Homo sapiens
ggagauaucgagaacuaua

SEQ ID NO: 25134 - RNA, 19 nt, Homo sapiens
cacaagaucuggaaaugaa

SEQ ID NO: 25135 - RNA, 19 nt, Homo sapiens
gaaacauggugacuagaug

SEQ ID NO: 25136 - RNA, 19 nt, Homo sapiens
caacaaggacgaacaucua

SEQ ID NO: 25137 - RNA, 19 nt, Homo sapiens
gguaguaaaccuuucauuu

SEQ ID NO: 25138 - RNA, 19 nt, Homo sapiens
guggagauaucgagaacua

SEQ ID NO: 25139 - RNA, 19 nt, Homo sapiens
ggacaaacugcauaaucua

SEQ ID NO: 25140 - RNA, 19 nt, Homo sapiens
gcgcuugucuuuguggaua

SEQ ID NO: 25141 - RNA, 19 nt, Homo sapiens
ugacagaauucaaguaugg

SEQ ID NO: 25142 - RNA, 19 nt, Homo sapiens
ggauaaccaugacaaucaa

SEQ ID NO: 25143 - RNA, 19 nt, Homo sapiens
acagagcgcuugucuuugu

SEQ ID NO: 25144 - RNA, 19 nt, Homo sapiens
ugauauugcucuugaaugu

SEQ ID NO: 25145 - RNA, 19 nt, Homo sapiens
gcacaggcauuaaaaucua

SEQ ID NO: 25146 - RNA, 19 nt, Homo sapiens
caacugcacaggcauuaaa

SEQ ID NO: 25147 - RNA, 19 nt, Homo sapiens
gauaauggaguaacuaaag

SEQ ID NO: 25148 - RNA, 19 nt, Homo sapiens
uaagauugccgaauauaug

SEQ ID NO: 25149 - RNA, 19 nt, Homo sapiens
gugacuagaugcaacaaug

SEQ ID NO: 25150 - RNA, 19 nt, Homo sapiens
gcacaagaucuggaaauga

SEQ ID NO: 25151 - RNA, 19 nt, Homo sapiens
ugucauuucuggagauaaa

SEQ ID NO: 25152 - RNA, 19 nt, Homo sapiens
gaugucauuucuggagaua

SEQ ID NO: 25153 - RNA, 19 nt, Homo sapiens
gcacaguuauucgcaagug

SEQ ID NO: 25154 - RNA, 19 nt, Homo sapiens
gacaaacugcauaaucuaa

SEQ ID NO: 25155 - RNA, 19 nt, Homo sapiens
caaggacgaacaucuauug

SEQ ID NO: 25156 - RNA, 19 nt, Homo sapiens
aaucauaugugugguaaug

SEQ ID NO: 25157 - RNA, 19 nt, Homo sapiens
guucaggucucuccaccaa

SEQ ID NO: 25158 - RNA, 19 nt, Homo sapiens
uuagaaacauggugacuag

SEQ ID NO: 25159 - RNA, 19 nt, Homo sapiens
ugaaugugagcgauauuua

SEQ ID NO: 25160 - RNA, 19 nt, Homo sapiens
aaaucuacguuucugauga

SEQ ID NO: 25161 - RNA, 19 nt, Homo sapiens
gcaaugacugggucuguga

SEQ ID NO: 25162 - RNA, 19 nt, Homo sapiens
ccgaauauaugaaccaucu

SEQ ID NO: 25163 - RNA, 19 nt, Homo sapiens
gaacuauaaugaugcuacu

SEQ ID NO: 25164 - RNA, 19 nt, Homo sapiens
gagauaucgagaacuauaa

SEQ ID NO: 25165 - RNA, 19 nt, Homo sapiens
uuauguggaugcuguaauu

SEQ ID NO: 25166 - RNA, 19 nt, Homo sapiens
gaauauaugaaccaucuca

SEQ ID NO: 25167 - RNA, 19 nt, Homo sapiens
ggguugauauugcucuuga

SEQ ID NO: 25168 - RNA, 19 nt, Homo sapiens
ccaaccaguuagcuauaaa

SEQ ID NO: 25169 - RNA, 19 nt, Homo sapiens
ucaggucucuccaccaaau

SEQ ID NO: 25170 - RNA, 19 nt, Homo sapiens
gcagugacuacuuugguaa

SEQ ID NO: 25171 - RNA, 19 nt, Homo sapiens
cuacucaggucagagauug

SEQ ID NO: 25172 - RNA, 19 nt, Homo sapiens
gaaguggagauaucgagaa

SEQ ID NO: 25173 - RNA, 19 nt, Homo sapiens
caaguggaauggagagaag

SEQ ID NO: 25174 - RNA, 19 nt, Homo sapiens
guugcaggguucagaauug

SEQ ID NO: 25175 - RNA, 19 nt, Homo sapiens
gauuaugugcguucuaaga

SEQ ID NO: 25176 - RNA, 19 nt, Homo sapiens
gcugaagauccauuuauug

SEQ ID NO: 25177 - RNA, 19 nt, Homo sapiens
caucgauggcgccaaauaa

SEQ ID NO: 25178 - RNA, 19 nt, Homo sapiens
ggagacauaaaggcaauuu

SEQ ID NO: 25179 - RNA, 19 nt, Homo sapiens
uaugugcguucuaagauug

SEQ ID NO: 25180 - RNA, 19 nt, Homo sapiens
gaaugugagcgauauuuag

SEQ ID NO: 25181 - RNA, 19 nt, Homo sapiens
ccaaauaaggaacaugguu

SEQ ID NO: 25182 - RNA, 19 nt, Homo sapiens
ggugacagaauucaaguau

SEQ ID NO: 25183 - RNA, 19 nt, Homo sapiens
auauugcucuugaauguga

SEQ ID NO: 25184 - RNA, 19 nt, Homo sapiens
uaguaacucugcugaagau

SEQ ID NO: 25185 - RNA, 19 nt, Homo sapiens
gagaggaaacagaggauuc

SEQ ID NO: 25186 - RNA, 19 nt, Homo sapiens
caaacugcauaaucuaaac

SEQ ID NO: 25187 - RNA, 19 nt, Homo sapiens
uggacaaacugcauaaucu

SEQ ID NO: 25188 - RNA, 19 nt, Homo sapiens
aggauuaugugcguucuaa

SEQ ID NO: 25189 - RNA, 19 nt, Homo sapiens
gaccuuggugggaaagaua

SEQ ID NO: 25190 - RNA, 19 nt, Homo sapiens
ggagcaaccaaguggcuuu

SEQ ID NO: 25191 - RNA, 19 nt, Homo sapiens
gauaccaaccaguuagcua

SEQ ID NO: 25192 - RNA, 19 nt, Homo sapiens
gcaaguggaauggagagaa

SEQ ID NO: 25193 - RNA, 19 nt, Homo sapiens
ugaaccaucucauugacau

SEQ ID NO: 25194 - RNA, 19 nt, Homo sapiens
gagccucuauacuuaccuu

SEQ ID NO: 25195 - RNA, 19 nt, Homo sapiens
gaauucaaguauggugcaa

SEQ ID NO: 25196 - RNA, 19 nt, Homo sapiens
cugcauaaucuaaacagua

SEQ ID NO: 25197 - RNA, 19 nt, Homo sapiens
gcaguaccuguggaaguua

SEQ ID NO: 25198 - RNA, 19 nt, Homo sapiens
ugcugaagauccauuuauu

SEQ ID NO: 25199 - RNA, 19 nt, Homo sapiens
uaacucugcugaagaucca

SEQ ID NO: 25200 - RNA, 19 nt, Homo sapiens
caucuauuguucaucuguu

SEQ ID NO: 25201 - RNA, 19 nt, Homo sapiens
gcauuaaaaucuacguuuc

SEQ ID NO: 25202 - RNA, 19 nt, Homo sapiens
gacuggacauuuucuuuaa

SEQ ID NO: 25203 - RNA, 19 nt, Homo sapiens
uggauaaccaugacaauca

SEQ ID NO: 25204 - RNA, 19 nt, Homo sapiens
uuaugugcguucuaagauu

SEQ ID NO: 25205 - RNA, 19 nt, Homo sapiens
gaugguaaauguaaaacug

SEQ ID NO: 25206 - RNA, 19 nt, Homo sapiens
uggaugcuguaauuaauca

SEQ ID NO: 25207 - RNA, 19 nt, Homo sapiens
uguggaugcuguaauuaau

SEQ ID NO: 25208 - RNA, 19 nt, Homo sapiens
gaaacagaggauucauugu

SEQ ID NO: 25209 - RNA, 19 nt, Homo sapiens
gcaggguucagaauugaug

SEQ ID NO: 25210 - RNA, 19 nt, Homo sapiens
caagaucuggaaaugaaga

SEQ ID NO: 25211 - RNA, 19 nt, Homo sapiens
caugcugaaucuaaauugu

SEQ ID NO: 25212 - RNA, 19 nt, Homo sapiens
guuaauuuccgcaauguag

SEQ ID NO: 25213 - RNA, 19 nt, Homo sapiens
agacacuacuuguggcaau

SEQ ID NO: 25214 - RNA, 19 nt, Homo sapiens
gcagucccauauucuggau

SEQ ID NO: 25215 - RNA, 19 nt, Homo sapiens
gggcucaguauuccucaaa

SEQ ID NO: 25216 - RNA, 19 nt, Homo sapiens
ggcgauggguugauauugc

SEQ ID NO: 25217 - RNA, 19 nt, Homo sapiens
cuaagauugccgaauauau

SEQ ID NO: 25218 - RNA, 19 nt, Homo sapiens
aaucuacguuucugaugau

SEQ ID NO: 25219 - RNA, 19 nt, Homo sapiens
gcaacugcacaggcauuaa

SEQ ID NO: 25220 - RNA, 19 nt, Homo sapiens
cacgaguaaugucaagcua

SEQ ID NO: 25221 - RNA, 19 nt, Homo sapiens
uuauggauuuacacgagua

SEQ ID NO: 25222 - RNA, 19 nt, Homo sapiens
uaugcuugcucauccuuau

SEQ ID NO: 25223 - RNA, 19 nt, Homo sapiens
gugacagaauucaaguaug

SEQ ID NO: 25224 - RNA, 19 nt, Homo sapiens
gaaccaucucauugacauu

SEQ ID NO: 25225 - RNA, 19 nt, Homo sapiens
gaaacgauguuaaugauug

SEQ ID NO: 25226 - RNA, 19 nt, Homo sapiens
gaacaucgauggcgccaaa

SEQ ID NO: 25227 - RNA, 19 nt, Homo sapiens
ggaaguaaaccuuucauuu

SEQ ID NO: 25228 - RNA, 19 nt, Homo sapiens
guucuaagauugccgaaua

SEQ ID NO: 25229 - RNA, 19 nt, Homo sapiens
gaagauccauuuauugcaa

SEQ ID NO: 25230 - RNA, 19 nt, Homo sapiens
ggacggacaucuauuguuc

SEQ ID NO: 25231 - RNA, 19 nt, Homo sapiens
gaaagauaccaaccaguua

SEQ ID NO: 25232 - RNA, 19 nt, Homo sapiens
ggaaagauaccaaccaguu

SEQ ID NO: 25233 - RNA, 19 nt, Homo sapiens
gaauggcgauggguugaua

SEQ ID NO: 25234 - RNA, 19 nt, Homo sapiens
ggacaucuauuguucaucu

SEQ ID NO: 25235 - RNA, 19 nt, Homo sapiens
caaauaaggaacaugguua

SEQ ID NO: 25236 - RNA, 19 nt, Homo sapiens
gaaaggacacugacaacuu

SEQ ID NO: 25237 - RNA, 19 nt, Homo sapiens
ggaaacagaggauucauug

SEQ ID NO: 25238 - RNA, 19 nt, Homo sapiens
cacaagaucuggaaaugaa

SEQ ID NO: 25239 - RNA, 19 nt, Homo sapiens
gaaacauggugacuagaug

SEQ ID NO: 25240 - RNA, 19 nt, Homo sapiens
guggagauaucgagaacua

SEQ ID NO: 25241 - RNA, 19 nt, Homo sapiens
caacaaggacggacaucua

SEQ ID NO: 25242 - RNA, 19 nt, Homo sapiens
uuaaaugcauguccucaaa

SEQ ID NO: 25243 - RNA, 19 nt, Homo sapiens
ggacaaacugcauaaucua

SEQ ID NO: 25244 - RNA, 19 nt, Homo sapiens
ggauuucaaugaugguaaa

SEQ ID NO: 25245 - RNA, 19 nt, Homo sapiens
gcgcuugucuuuguggaua

SEQ ID NO: 25246 - RNA, 19 nt, Homo sapiens
ugacagaauucaaguaugg

SEQ ID NO: 25247 - RNA, 19 nt, Homo sapiens
ggauaaccaugacaaucaa

SEQ ID NO: 25248 - RNA, 19 nt, Homo sapiens
acagagcgcuugucuuugu

SEQ ID NO: 25249 - RNA, 19 nt, Homo sapiens
gaacuacaaugaugcuacu

SEQ ID NO: 25250 - RNA, 19 nt, Homo sapiens
ugauauugcucuugaaugu

SEQ ID NO: 25251 - RNA, 19 nt, Homo sapiens
aaaggacacugacaacuuc

SEQ ID NO: 25252 - RNA, 19 nt, Homo sapiens
gugacuagauguaacaaug

SEQ ID NO: 25253 - RNA, 19 nt, Homo sapiens
uaagauugccgaauauaug

SEQ ID NO: 25254 - RNA, 19 nt, Homo sapiens
gcacaagaucuggaaauga

SEQ ID NO: 25255 - RNA, 19 nt, Homo sapiens
ugucauuucuggagauaaa

SEQ ID NO: 25256 - RNA, 19 nt, Homo sapiens
gaugucauuucuggagaua

SEQ ID NO: 25257 - RNA, 19 nt, Homo sapiens
gcacaguuauucgcaagug

SEQ ID NO: 25258 - RNA, 19 nt, Homo sapiens
gacaaacugcauaaucuaa

SEQ ID NO: 25259 - RNA, 19 nt, Homo sapiens
guucaggucucuccaccaa

SEQ ID NO: 25260 - RNA, 19 nt, Homo sapiens
ugacuggucuucuugaucu

SEQ ID NO: 25261 - RNA, 19 nt, Homo sapiens
uuagaaacauggugacuag

SEQ ID NO: 25262 - RNA, 19 nt, Homo sapiens
ugaaugugagcgauauuua

SEQ ID NO: 25263 - RNA, 19 nt, Homo sapiens
gcaaugacugggucuguga

SEQ ID NO: 25264 - RNA, 19 nt, Homo sapiens
ccgaauauaugaaccaucu

SEQ ID NO: 25265 - RNA, 19 nt, Homo sapiens
uuacgugcguucuaagauu

SEQ ID NO: 25266 - RNA, 19 nt, Homo sapiens
uuauguggaugcuguaauu

SEQ ID NO: 25267 - RNA, 19 nt, Homo sapiens
caaggacggacaucuauug

SEQ ID NO: 25268 - RNA, 19 nt, Homo sapiens
gaauauaugaaccaucuca

SEQ ID NO: 25269 - RNA, 19 nt, Homo sapiens
ggguugauauugcucuuga

SEQ ID NO: 25270 - RNA, 19 nt, Homo sapiens
ggaaacgauguuaaugauu

SEQ ID NO: 25271 - RNA, 19 nt, Homo sapiens
ccaaccaguuagcuauaaa

SEQ ID NO: 25272 - RNA, 19 nt, Homo sapiens
ucaggucucuccaccaaau

SEQ ID NO: 25273 - RNA, 19 nt, Homo sapiens
gaaguucuuucuguugcuu

SEQ ID NO: 25274 - RNA, 19 nt, Homo sapiens
gagccucuauucuuaccuu

SEQ ID NO: 25275 - RNA, 19 nt, Homo sapiens
gcagugacuacuuugguaa

SEQ ID NO: 25276 - RNA, 19 nt, Homo sapiens
cuacucaggucagagauug

SEQ ID NO: 25277 - RNA, 19 nt, Homo sapiens
gaaguggagauaucgagaa

SEQ ID NO: 25278 - RNA, 19 nt, Homo sapiens
ggaugggauuucaaugaug

SEQ ID NO: 25279 - RNA, 19 nt, Homo sapiens
ggacacugacaacuucaaa

SEQ ID NO: 25280 - RNA, 19 nt, Homo sapiens
uggaaacgauguuaaugau

SEQ ID NO: 25281 - RNA, 19 nt, Homo sapiens
uuacggauuuacacgagua

SEQ ID NO: 25282 - RNA, 19 nt, Homo sapiens
caaguggaauggagagaag

SEQ ID NO: 25283 - RNA, 19 nt, Homo sapiens
gcugaagauccauuuauug

SEQ ID NO: 25284 - RNA, 19 nt, Homo sapiens
gcaauugcacaggcauuaa

SEQ ID NO: 25285 - RNA, 19 nt, Homo sapiens
caucgauggcgccaaauaa

SEQ ID NO: 25286 - RNA, 19 nt, Homo sapiens
ggagacauaaaggcaauuu

SEQ ID NO: 25287 - RNA, 19 nt, Homo sapiens
gaaugugagcgauauuuag

SEQ ID NO: 25288 - RNA, 19 nt, Homo sapiens
ccaaauaaggaacaugguu

SEQ ID NO: 25289 - RNA, 19 nt, Homo sapiens
ggugacagaauucaaguau

SEQ ID NO: 25290 - RNA, 19 nt, Homo sapiens
ggagauaucgagaacuaca

SEQ ID NO: 25291 - RNA, 19 nt, Homo sapiens
uaguaacucugcugaagau

SEQ ID NO: 25292 - RNA, 19 nt, Homo sapiens
gagaggaaacagaggauuc

SEQ ID NO: 25293 - RNA, 19 nt, Homo sapiens
caaauugguaugauaaugg

SEQ ID NO: 25294 - RNA, 19 nt, Homo sapiens
caaacugcauaaucuaaac

SEQ ID NO: 25295 - RNA, 19 nt, Homo sapiens
uggacaaacugcauaaucu

SEQ ID NO: 25296 - RNA, 19 nt, Homo sapiens
auauugcucuugaauguga

SEQ ID NO: 25297 - RNA, 19 nt, Homo sapiens
caauugcacaggcauuaaa

SEQ ID NO: 25298 - RNA, 19 nt, Homo sapiens
ggcaauugcacaggcauua

SEQ ID NO: 25299 - RNA, 19 nt, Homo sapiens
gaccuuggugggaaagaua

SEQ ID NO: 25300 - RNA, 19 nt, Homo sapiens
ggagcaaccaaguggcuuu

SEQ ID NO: 25301 - RNA, 19 nt, Homo sapiens
gauaccaaccaguuagcua

SEQ ID NO: 25302 - RNA, 19 nt, Homo sapiens
gcaaguggaauggagagaa

SEQ ID NO: 25303 - RNA, 19 nt, Homo sapiens
ugaaccaucucauugacau

SEQ ID NO: 25304 - RNA, 19 nt, Homo sapiens
ccaagacaguuucaaaaug

SEQ ID NO: 25305 - RNA, 19 nt, Homo sapiens
aggauuacgugcguucuaa

SEQ ID NO: 25306 - RNA, 19 nt, Homo sapiens
caagacaguuucaaaaugg

SEQ ID NO: 25307 - RNA, 19 nt, Homo sapiens
gaauucaaguauggugcaa

SEQ ID NO: 25308 - RNA, 19 nt, Homo sapiens
cugcauaaucuaaacagua

SEQ ID NO: 25309 - RNA, 19 nt, Homo sapiens
guugcaggguucagacuug

SEQ ID NO: 25310 - RNA, 19 nt, Homo sapiens
gcaguaccuguggaaguua

SEQ ID NO: 25311 - RNA, 19 nt, Homo sapiens
ugcugaagauccauuuauu

SEQ ID NO: 25312 - RNA, 19 nt, Homo sapiens
uaacucugcugaagaucca

SEQ ID NO: 25313 - RNA, 19 nt, Homo sapiens
gcaggaaguaaaccuuuca

SEQ ID NO: 25314 - RNA, 19 nt, Homo sapiens
acugacaacuucaaagcaa

SEQ ID NO: 25315 - RNA, 19 nt, Homo sapiens
gcaauuuacaacccuuuca

SEQ ID NO: 25316 - RNA, 19 nt, Homo sapiens
caucuauuguucaucuguu

SEQ ID NO: 25317 - RNA, 19 nt, Homo sapiens
uggauaaccaugacaauca

SEQ ID NO: 25318 - RNA, 19 nt, Homo sapiens
gaugguaaauguaaaacug

SEQ ID NO: 25319 - RNA, 19 nt, Homo sapiens
uggaugggauuucaaugau

SEQ ID NO: 25320 - RNA, 19 nt, Homo sapiens
uggaugcuguaauuaauca

SEQ ID NO: 25321 - RNA, 19 nt, Homo sapiens
uguggaugcuguaauuaau

SEQ ID NO: 25322 - RNA, 19 nt, Homo sapiens
gaaacagaggauucauugu

SEQ ID NO: 25323 - RNA, 19 nt, Homo sapiens
caagaucuggaaaugaaga

SEQ ID NO: 25324 - RNA, 19 nt, Homo sapiens
caugcugaaucuaaauugu

SEQ ID NO: 25325 - RNA, 19 nt, Homo sapiens
gcacaucacucaacuacua

SEQ ID NO: 25326 - RNA, 19 nt, Homo sapiens
gaaacgauguuaaugauug

SEQ ID NO: 25327 - RNA, 19 nt, Homo sapiens
gaacaucgauggcgccaaa

SEQ ID NO: 25328 - RNA, 19 nt, Homo sapiens
ggaaguaaaccuuucauuu

SEQ ID NO: 25329 - RNA, 19 nt, Homo sapiens
gcacuugucuuuguggaua

SEQ ID NO: 25330 - RNA, 19 nt, Homo sapiens
ggacggacaucuauuguuc

SEQ ID NO: 25331 - RNA, 19 nt, Homo sapiens
gaaagauaccaaccaguua

SEQ ID NO: 25332 - RNA, 19 nt, Homo sapiens
guucagcucuuaguuauuu

SEQ ID NO: 25333 - RNA, 19 nt, Homo sapiens
ggaaagauaccaaccaguu

SEQ ID NO: 25334 - RNA, 19 nt, Homo sapiens
gaauggcgauggguugaua

SEQ ID NO: 25335 - RNA, 19 nt, Homo sapiens
ggacaucuauuguucaucu

SEQ ID NO: 25336 - RNA, 19 nt, Homo sapiens
caaauaaggaacaugguua

SEQ ID NO: 25337 - RNA, 19 nt, Homo sapiens
gaaaggacacugacaacuu

SEQ ID NO: 25338 - RNA, 19 nt, Homo sapiens
ggaaacagaggauucauug

SEQ ID NO: 25339 - RNA, 19 nt, Homo sapiens
guuccaagauugccgaaua

SEQ ID NO: 25340 - RNA, 19 nt, Homo sapiens
cacaagaucuggaaaugaa

SEQ ID NO: 25341 - RNA, 19 nt, Homo sapiens
gaaacauggugacuagaug

SEQ ID NO: 25342 - RNA, 19 nt, Homo sapiens
aaacuaaugaccuguguua

SEQ ID NO: 25343 - RNA, 19 nt, Homo sapiens
guggagauaucgagaacua

SEQ ID NO: 25344 - RNA, 19 nt, Homo sapiens
caacaaggacggacaucua

SEQ ID NO: 25345 - RNA, 19 nt, Homo sapiens
ggacaaacugcauaaucua

SEQ ID NO: 25346 - RNA, 19 nt, Homo sapiens
gaggauccauuuauugcaa

SEQ ID NO: 25347 - RNA, 19 nt, Homo sapiens
ugacagaauucaaguaugg

SEQ ID NO: 25348 - RNA, 19 nt, Homo sapiens
ggauaaccaugacaaucaa

SEQ ID NO: 25349 - RNA, 19 nt, Homo sapiens
gaacuacaaugaugcuacu

SEQ ID NO: 25350 - RNA, 19 nt, Homo sapiens
ugauauugcucuugaaugu

SEQ ID NO: 25351 - RNA, 19 nt, Homo sapiens
gcacaggcauuaaaaucua

SEQ ID NO: 25352 - RNA, 19 nt, Homo sapiens
caagauugccgaauauaug

SEQ ID NO: 25353 - RNA, 19 nt, Homo sapiens
gugacuagauguaacaaug

SEQ ID NO: 25354 - RNA, 19 nt, Homo sapiens
aaaggacacugacaacuuc

SEQ ID NO: 25355 - RNA, 19 nt, Homo sapiens
gcacaagaucuggaaauga

SEQ ID NO: 25356 - RNA, 19 nt, Homo sapiens
cuaaugaccuguguuauac

SEQ ID NO: 25357 - RNA, 19 nt, Homo sapiens
acuauuagcuggcgaguca

SEQ ID NO: 25358 - RNA, 19 nt, Homo sapiens
ugucauuucuggagauaaa

SEQ ID NO: 25359 - RNA, 19 nt, Homo sapiens
gaugucauuucuggagaua

SEQ ID NO: 25360 - RNA, 19 nt, Homo sapiens
acagagcacuugucuuugu

SEQ ID NO: 25361 - RNA, 19 nt, Homo sapiens
gcacaguuauucgcaagug

SEQ ID NO: 25362 - RNA, 19 nt, Homo sapiens
gacaaacugcauaaucuaa

SEQ ID NO: 25363 - RNA, 19 nt, Homo sapiens
auggagggcugacuauaua

SEQ ID NO: 25364 - RNA, 19 nt, Homo sapiens
ugaaucaucucauugacau

SEQ ID NO: 25365 - RNA, 19 nt, Homo sapiens
aaucauaugucugguaaug

SEQ ID NO: 25366 - RNA, 19 nt, Homo sapiens
guucaggucucuccaccaa

SEQ ID NO: 25367 - RNA, 19 nt, Homo sapiens
uuagaaacauggugacuag

SEQ ID NO: 25368 - RNA, 19 nt, Homo sapiens
ugaaugugagcgauauuua

SEQ ID NO: 25369 - RNA, 19 nt, Homo sapiens
gcaaugacugggucuguga

SEQ ID NO: 25370 - RNA, 19 nt, Homo sapiens
uuauguggaugcuguaauu

SEQ ID NO: 25371 - RNA, 19 nt, Homo sapiens
acuaaugaccuguguuaua

SEQ ID NO: 25372 - RNA, 19 nt, Homo sapiens
caaggacggacaucuauug

SEQ ID NO: 25373 - RNA, 19 nt, Homo sapiens
ggguugauauugcucuuga

SEQ ID NO: 25374 - RNA, 19 nt, Homo sapiens
ggaaacgauguuaaugauu

SEQ ID NO: 25375 - RNA, 19 nt, Homo sapiens
ccaaccaguuagcuauaaa

SEQ ID NO: 25376 - RNA, 19 nt, Homo sapiens
ucaggucucuccaccaaau

SEQ ID NO: 25377 - RNA, 19 nt, Homo sapiens
gagccucuauucuuaccuu

SEQ ID NO: 25378 - RNA, 19 nt, Homo sapiens
cuacucaggucagagauug

SEQ ID NO: 25379 - RNA, 19 nt, Homo sapiens
gaaguggagauaucgagaa

SEQ ID NO: 25380 - RNA, 19 nt, Homo sapiens
gaaguucuuucuguugcuu

SEQ ID NO: 25381 - RNA, 19 nt, Homo sapiens
ggacacugacaacuucaaa

SEQ ID NO: 25382 - RNA, 19 nt, Homo sapiens
gaaugacuagggacaacua

SEQ ID NO: 25383 - RNA, 19 nt, Homo sapiens
uggaaacgauguuaaugau

SEQ ID NO: 25384 - RNA, 19 nt, Homo sapiens
gggaugcuaggcuguauaa

SEQ ID NO: 25385 - RNA, 19 nt, Homo sapiens
caaguggaauggagagaag

SEQ ID NO: 25386 - RNA, 19 nt, Homo sapiens
gguugaaucuggcgaugug

SEQ ID NO: 25387 - RNA, 19 nt, Homo sapiens
gcaauucacaacccuuuca

SEQ ID NO: 25388 - RNA, 19 nt, Homo sapiens
gauguggaacccauggaua

SEQ ID NO: 25389 - RNA, 19 nt, Homo sapiens
gcaauugcacaggcauuaa

SEQ ID NO: 25390 - RNA, 19 nt, Homo sapiens
caucgauggcgccaaauaa

SEQ ID NO: 25391 - RNA, 19 nt, Homo sapiens
ggagacauaaaggcaauuu

SEQ ID NO: 25392 - RNA, 19 nt, Homo sapiens
gaaugugagcgauauuuag

SEQ ID NO: 25393 - RNA, 19 nt, Homo sapiens
gacuauauacaccauguuu

SEQ ID NO: 25394 - RNA, 19 nt, Homo sapiens
ggauauggagggcugacua

SEQ ID NO: 25395 - RNA, 19 nt, Homo sapiens
ccaaauaaggaacaugguu

SEQ ID NO: 25396 - RNA, 19 nt, Homo sapiens
gggcuuuuaugauguuuua

SEQ ID NO: 25397 - RNA, 19 nt, Homo sapiens
ggugacagaauucaaguau

SEQ ID NO: 25398 - RNA, 19 nt, Homo sapiens
ggagauaucgagaacuaca

SEQ ID NO: 25399 - RNA, 19 nt, Homo sapiens
caucacucaacuacuauua

SEQ ID NO: 25400 - RNA, 19 nt, Homo sapiens
gagaggaaacagaggauuc

SEQ ID NO: 25401 - RNA, 19 nt, Homo sapiens
caaacugcauaaucuaaac

SEQ ID NO: 25402 - RNA, 19 nt, Homo sapiens
uggacaaacugcauaaucu

SEQ ID NO: 25403 - RNA, 19 nt, Homo sapiens
auauugcucuugaauguga

SEQ ID NO: 25404 - RNA, 19 nt, Homo sapiens
gaucuuucaucccaggaau

SEQ ID NO: 25405 - RNA, 19 nt, Homo sapiens
gcugaggauccauuuauug

SEQ ID NO: 25406 - RNA, 19 nt, Homo sapiens
caauugcacaggcauuaaa

SEQ ID NO: 25407 - RNA, 19 nt, Homo sapiens
ggcaauugcacaggcauua

SEQ ID NO: 25408 - RNA, 19 nt, Homo sapiens
uaugugcguuccaagauug

SEQ ID NO: 25409 - RNA, 19 nt, Homo sapiens
gaccuuggugggaaagaua

SEQ ID NO: 25410 - RNA, 19 nt, Homo sapiens
ggagcaaccaaguggcuuu

SEQ ID NO: 25411 - RNA, 19 nt, Homo sapiens
gcagugacuacuuuggaaa

SEQ ID NO: 25412 - RNA, 19 nt, Homo sapiens
ccaagauugccgaauauau

SEQ ID NO: 25413 - RNA, 19 nt, Homo sapiens
gauaccaaccaguuagcua

SEQ ID NO: 25414 - RNA, 19 nt, Homo sapiens
cuauggaacuuugguugaa

SEQ ID NO: 25415 - RNA, 19 nt, Homo sapiens
uuucaucccaggaauauaa

SEQ ID NO: 25416 - RNA, 19 nt, Homo sapiens
ggauccauuuauugcaauu

SEQ ID NO: 25417 - RNA, 19 nt, Homo sapiens
gcaaguggaauggagagaa

SEQ ID NO: 25418 - RNA, 19 nt, Homo sapiens
caucccaggaauauaaaua

SEQ ID NO: 25419 - RNA, 19 nt, Homo sapiens
ccaagacaguuucaaaaug

SEQ ID NO: 25420 - RNA, 19 nt, Homo sapiens
caagacaguuucaaaaugg

SEQ ID NO: 25421 - RNA, 19 nt, Homo sapiens
gaauucaaguauggugcaa

SEQ ID NO: 25422 - RNA, 19 nt, Homo sapiens
cugcauaaucuaaacagua

SEQ ID NO: 25423 - RNA, 19 nt, Homo sapiens
gauauggagggcugacuau

SEQ ID NO: 25424 - RNA, 19 nt, Homo sapiens
guugcaggguucagacuug

SEQ ID NO: 25425 - RNA, 19 nt, Homo sapiens
gcaaagacaucaacacauu

SEQ ID NO: 25426 - RNA, 19 nt, Homo sapiens
gaacagugguggcaacauu

SEQ ID NO: 25427 - RNA, 19 nt, Homo sapiens
ggucaccacuugcaagcua

SEQ ID NO: 25428 - RNA, 19 nt, Homo sapiens
gaauaagcaagucuucuuu

SEQ ID NO: 25429 - RNA, 19 nt, Homo sapiens
ccacuuggaucagucaauu

SEQ ID NO: 25430 - RNA, 19 nt, Homo sapiens
uggcuuaccuguccacuug

SEQ ID NO: 25431 - RNA, 19 nt, Homo sapiens
gaauggaaacccucacaga

SEQ ID NO: 25432 - RNA, 19 nt, Homo sapiens
gcacuaugaugccaaacca

SEQ ID NO: 25433 - RNA, 19 nt, Homo sapiens
caggauaacuccagguaca

SEQ ID NO: 25434 - RNA, 19 nt, Homo sapiens
uggaaacccucacagagaa

SEQ ID NO: 25435 - RNA, 19 nt, Homo sapiens
gacaucaacacauuuauuc

SEQ ID NO: 25436 - RNA, 19 nt, Homo sapiens
gcaucaaggccaucuguga

SEQ ID NO: 25437 - RNA, 19 nt, Homo sapiens
caaagacaucaacacauuu

SEQ ID NO: 25438 - RNA, 19 nt, Homo sapiens
guucagaaacguuguuguu

SEQ ID NO: 25439 - RNA, 19 nt, Homo sapiens
ccaagggcccaaagaaaga

SEQ ID NO: 25440 - RNA, 19 nt, Homo sapiens
cuaauuuggugaugcuguu

SEQ ID NO: 25441 - RNA, 19 nt, Homo sapiens
gcaacaagcgcagcaucaa

SEQ ID NO: 25442 - RNA, 19 nt, Homo sapiens
caucaaggccaucugugaa

SEQ ID NO: 25443 - RNA, 19 nt, Homo sapiens
ccagcacuaugaugccaaa

SEQ ID NO: 25444 - RNA, 19 nt, Homo sapiens
ggaaacccucacagagaaa

SEQ ID NO: 25445 - RNA, 19 nt, Homo sapiens
gccaagggcccaaagaaag

SEQ ID NO: 25446 - RNA, 19 nt, Homo sapiens
aaacguuguuguugcuugu

SEQ ID NO: 25447 - RNA, 19 nt, Homo sapiens
gagccuguguuggaagaga

SEQ ID NO: 25448 - RNA, 19 nt, Homo sapiens
gagaaaaccuaagaauaag

SEQ ID NO: 25449 - RNA, 19 nt, Homo sapiens
cagagaaaaccuaagaaua

SEQ ID NO: 25450 - RNA, 19 nt, Homo sapiens
gaccuuuuguuuucuguuu

SEQ ID NO: 25451 - RNA, 19 nt, Homo sapiens
cagaaacguuguuguugcu

SEQ ID NO: 25452 - RNA, 19 nt, Homo sapiens
caacaagcgcagcaucaag

SEQ ID NO: 25453 - RNA, 19 nt, Homo sapiens
ggucuaccacaccuccuuu

SEQ ID NO: 25454 - RNA, 19 nt, Homo sapiens
gugaugggccugggcguuu

SEQ ID NO: 25455 - RNA, 19 nt, Homo sapiens
ggcaacaagcgcagcauca

SEQ ID NO: 25456 - RNA, 19 nt, Homo sapiens
ugccaagggcccaaagaaa

SEQ ID NO: 25457 - RNA, 19 nt, Homo sapiens
agagcuaccuggaccuuuu

SEQ ID NO: 25458 - RNA, 19 nt, Homo sapiens
ucacagagaaaaccuaaga

SEQ ID NO: 25459 - RNA, 19 nt, Homo sapiens
cagcaucaaggccaucugu

SEQ ID NO: 25460 - RNA, 19 nt, Homo sapiens
ugaccucacccugcaaaga

SEQ ID NO: 25461 - RNA, 19 nt, Homo sapiens
ggauaacuccagguacaca

SEQ ID NO: 25462 - RNA, 19 nt, Homo sapiens
gaaaaccuaagaauaagca

SEQ ID NO: 25463 - RNA, 19 nt, Homo sapiens
cugcaaagacaucaacaca

SEQ ID NO: 25464 - RNA, 19 nt, Homo sapiens
gaccucacccugcaaagac

SEQ ID NO: 25465 - RNA, 19 nt, Homo sapiens
gaacaaagcuaacaaaugg

SEQ ID NO: 25466 - RNA, 19 nt, Homo sapiens
gaaacaugcuuaccagauu

SEQ ID NO: 25467 - RNA, 19 nt, Homo sapiens
gaaagggucuagaauaugu

SEQ ID NO: 25468 - RNA, 19 nt, Homo sapiens
gaacagcauuguccucuga

SEQ ID NO: 25469 - RNA, 19 nt, Homo sapiens
ggaagaaacugcugagcuu

SEQ ID NO: 25470 - RNA, 19 nt, Homo sapiens
ccagaaagcugacagaugu

SEQ ID NO: 25471 - RNA, 19 nt, Homo sapiens
gaaacaaacuccauuacuc

SEQ ID NO: 25472 - RNA, 19 nt, Homo sapiens
uaacacaaaugcucaaaga

SEQ ID NO: 25473 - RNA, 19 nt, Homo sapiens
caaaugugcccucauguua

SEQ ID NO: 25474 - RNA, 19 nt, Homo sapiens
gcuaacaaauggcuaguuu

SEQ ID NO: 25475 - RNA, 19 nt, Homo sapiens
caauaaaucucagcuacua

SEQ ID NO: 25476 - RNA, 19 nt, Homo sapiens
gaaauauuccuaugggaua

SEQ ID NO: 25477 - RNA, 19 nt, Homo sapiens
gaaacaagccugccauaau

SEQ ID NO: 25478 - RNA, 19 nt, Homo sapiens
gagaagauauaaccggauu

SEQ ID NO: 25479 - RNA, 19 nt, Homo sapiens
caaagaggcuggaaggaau

SEQ ID NO: 25480 - RNA, 19 nt, Homo sapiens
gcacuaaagaugcugauaa

SEQ ID NO: 25481 - RNA, 19 nt, Homo sapiens
gaaccagccuccucucuca

SEQ ID NO: 25482 - RNA, 19 nt, Homo sapiens
gaggaaagggucuagaaua

SEQ ID NO: 25483 - RNA, 19 nt, Homo sapiens
aaacaagccugccauaauc

SEQ ID NO: 25484 - RNA, 19 nt, Homo sapiens
gaagauggaagucuagauu

SEQ ID NO: 25485 - RNA, 19 nt, Homo sapiens
gcaaaccuacuaacaaauu

SEQ ID NO: 25486 - RNA, 19 nt, Homo sapiens
gcaaaguucuucauaucau

SEQ ID NO: 25487 - RNA, 19 nt, Homo sapiens
caagugauauuugcaggua

SEQ ID NO: 25488 - RNA, 19 nt, Homo sapiens
guagccagaugauaaauau

SEQ ID NO: 25489 - RNA, 19 nt, Homo sapiens
ucacguggcucgacuauag

SEQ ID NO: 25490 - RNA, 19 nt, Homo sapiens
ggaaaucccuccggugaau

SEQ ID NO: 25491 - RNA, 19 nt, Homo sapiens
gcaacauuguccuuaauug

SEQ ID NO: 25492 - RNA, 19 nt, Homo sapiens
caaguacucuggagcaguu

SEQ ID NO: 25493 - RNA, 19 nt, Homo sapiens
cuaaagaugcugauaauga

SEQ ID NO: 25494 - RNA, 19 nt, Homo sapiens
gaacuaugguagccagaug

SEQ ID NO: 25495 - RNA, 19 nt, Homo sapiens
gaagagaaaccauuuagag

SEQ ID NO: 25496 - RNA, 19 nt, Homo sapiens
aaacaucauugcagugaaa

SEQ ID NO: 25497 - RNA, 19 nt, Homo sapiens
acacagagaggaaacaaua

SEQ ID NO: 25498 - RNA, 19 nt, Homo sapiens
gcuugaaguuacugcauua

SEQ ID NO: 25499 - RNA, 19 nt, Homo sapiens
ccuaugggauaauguauuu

SEQ ID NO: 25500 - RNA, 19 nt, Homo sapiens
guagaaacaaacuccauua

SEQ ID NO: 25501 - RNA, 19 nt, Homo sapiens
gguguuauaucuaugcaaa

SEQ ID NO: 25502 - RNA, 19 nt, Homo sapiens
guaagccucuccuucuaaa

SEQ ID NO: 25503 - RNA, 19 nt, Homo sapiens
ggaaagagucaaacaaaca

SEQ ID NO: 25504 - RNA, 19 nt, Homo sapiens
gcuuggaugugcaaccuua

SEQ ID NO: 25505 - RNA, 19 nt, Homo sapiens
gcuaagaauugaguuaaug

SEQ ID NO: 25506 - RNA, 19 nt, Homo sapiens
gauggcaacugucgugaga

SEQ ID NO: 25507 - RNA, 19 nt, Homo sapiens
gaaagagucaaacaaacaa

SEQ ID NO: 25508 - RNA, 19 nt, Homo sapiens
gauccacuaugccuuaaug

SEQ ID NO: 25509 - RNA, 19 nt, Homo sapiens
cuacagacacuuucuuaaa

SEQ ID NO: 25510 - RNA, 19 nt, Homo sapiens
gcaaaugugcccucauguu

SEQ ID NO: 25511 - RNA, 19 nt, Homo sapiens
acagacaaaugaaaucuug

SEQ ID NO: 25512 - RNA, 19 nt, Homo sapiens
acacaaaugcucaaagaaa

SEQ ID NO: 25513 - RNA, 19 nt, Homo sapiens
cacaaaugcucaaagaaau

SEQ ID NO: 25514 - RNA, 19 nt, Homo sapiens
caacauuguccuuaauuga

SEQ ID NO: 25515 - RNA, 19 nt, Homo sapiens
cugaguugguuaaauguua

SEQ ID NO: 25516 - RNA, 19 nt, Homo sapiens
ccucugaguugguuaaaug

SEQ ID NO: 25517 - RNA, 19 nt, Homo sapiens
ggaggauggugguuugaug

SEQ ID NO: 25518 - RNA, 19 nt, Homo sapiens
aggaaagggucuagaauau

SEQ ID NO: 25519 - RNA, 19 nt, Homo sapiens
gugcaaaugugcccucaug

SEQ ID NO: 25520 - RNA, 19 nt, Homo sapiens
cagcuacuaugcaauaaau

SEQ ID NO: 25521 - RNA, 19 nt, Homo sapiens
uaugaugauucgaccuuua

SEQ ID NO: 25522 - RNA, 19 nt, Homo sapiens
gagaaaccauuuagagacu

SEQ ID NO: 25523 - RNA, 19 nt, Homo sapiens
gaacauaaucaaguaagga

SEQ ID NO: 25524 - RNA, 19 nt, Homo sapiens
caaucuaaauggaauguuc

SEQ ID NO: 25525 - RNA, 19 nt, Homo sapiens
gaagggaaccgagccuauu

SEQ ID NO: 25526 - RNA, 19 nt, Homo sapiens
aaucaaacuucucgacuug

SEQ ID NO: 25527 - RNA, 19 nt, Homo sapiens
gcucaaagaaaucuacuau

SEQ ID NO: 25528 - RNA, 19 nt, Homo sapiens
ggacaauaaguguguggua

SEQ ID NO: 25529 - RNA, 19 nt, Homo sapiens
gauaaugacaacuguaugu

SEQ ID NO: 25530 - RNA, 19 nt, Homo sapiens
gaaagcaugauauuuacug

SEQ ID NO: 25531 - RNA, 19 nt, Homo sapiens
caauaagugugugguagaa

SEQ ID NO: 25532 - RNA, 19 nt, Homo sapiens
gaaaccauuuagagacugu

SEQ ID NO: 25533 - RNA, 19 nt, Homo sapiens
ggaagaguuggacaccuua

SEQ ID NO: 25534 - RNA, 19 nt, Homo sapiens
gcaaugugccuacacuuuc

SEQ ID NO: 25535 - RNA, 19 nt, Homo sapiens
gauauaaccggauucaaca

SEQ ID NO: 25536 - RNA, 19 nt, Homo sapiens
ucacugaggucugggagaa

SEQ ID NO: 25537 - RNA, 19 nt, Homo sapiens
uaugguagccagaugauaa

SEQ ID NO: 25538 - RNA, 19 nt, Homo sapiens
ggcaguacaugcuaagaau

SEQ ID NO: 25539 - RNA, 19 nt, Homo sapiens
uagagacugugcagaugua

SEQ ID NO: 25540 - RNA, 19 nt, Homo sapiens
gaggaagagaaaccauuua

SEQ ID NO: 25541 - RNA, 19 nt, Homo sapiens
gaagaaaggagcaaguuuu

SEQ ID NO: 25542 - RNA, 19 nt, Homo sapiens
guacauggacaauaagugu

SEQ ID NO: 25543 - RNA, 19 nt, Homo sapiens
ggaugugcaaccuuaauaa

SEQ ID NO: 25544 - RNA, 19 nt, Homo sapiens
gaggaaacaauaaaucuca

SEQ ID NO: 25545 - RNA, 19 nt, Homo sapiens
gaagauauaaccggauuca

SEQ ID NO: 25546 - RNA, 19 nt, Homo sapiens
guacauguuuauggcaauu

SEQ ID NO: 25547 - RNA, 19 nt, Homo sapiens
cacuaugccuuaaugguuu

SEQ ID NO: 25548 - RNA, 19 nt, Homo sapiens
gacaguuguuggcaaggua

SEQ ID NO: 25549 - RNA, 19 nt, Homo sapiens
ccaagguuaugacaguaaa

SEQ ID NO: 25550 - RNA, 19 nt, Homo sapiens
uggaguauguuaaguugaa

SEQ ID NO: 25551 - RNA, 19 nt, Homo sapiens
uaaagaugcugauaaugac

SEQ ID NO: 25552 - RNA, 19 nt, Homo sapiens
gcagauaggguagaggaaa

SEQ ID NO: 25553 - RNA, 19 nt, Homo sapiens
ggagugugcuggcaguaca

SEQ ID NO: 25554 - RNA, 19 nt, Homo sapiens
gaaauucugacugcuaguu

SEQ ID NO: 25555 - RNA, 19 nt, Homo sapiens
acuaguugauuucugcuua

SEQ ID NO: 25556 - RNA, 19 nt, Homo sapiens
gaugugcaaccuuaauaaa

SEQ ID NO: 25557 - RNA, 19 nt, Homo sapiens
augcaaaccuacuaacaaa

SEQ ID NO: 25558 - RNA, 19 nt, Homo sapiens
cagaagcgauuaugaaagc

SEQ ID NO: 25559 - RNA, 19 nt, Homo sapiens
caucauugcagugaaauaa

SEQ ID NO: 25560 - RNA, 19 nt, Homo sapiens
cacuaaagaugcugauaau

SEQ ID NO: 25561 - RNA, 19 nt, Homo sapiens
aaacagagcagccugaucu

SEQ ID NO: 25562 - RNA, 19 nt, Homo sapiens
ggaagagaaaccauuuaga

SEQ ID NO: 25563 - RNA, 19 nt, Homo sapiens
uaaaggaagagaaagagaa

SEQ ID NO: 25564 - RNA, 19 nt, Homo sapiens
ccacuaugccuuaaugguu

SEQ ID NO: 25565 - RNA, 19 nt, Homo sapiens
gaacaaagcuaacaaaugg

SEQ ID NO: 25566 - RNA, 19 nt, Homo sapiens
gaaagggucuagaauaugu

SEQ ID NO: 25567 - RNA, 19 nt, Homo sapiens
ccagaaagcugacagaugu

SEQ ID NO: 25568 - RNA, 19 nt, Homo sapiens
gaagaugaggcaugauuua

SEQ ID NO: 25569 - RNA, 19 nt, Homo sapiens
gaugaccuuucuugaauua

SEQ ID NO: 25570 - RNA, 19 nt, Homo sapiens
gcuaacaaauggcuaguuu

SEQ ID NO: 25571 - RNA, 19 nt, Homo sapiens
caauaaaucucagcuacua

SEQ ID NO: 25572 - RNA, 19 nt, Homo sapiens
gagaagauauaaccggauu

SEQ ID NO: 25573 - RNA, 19 nt, Homo sapiens
caaagaggcuggaaggaau

SEQ ID NO: 25574 - RNA, 19 nt, Homo sapiens
gaaccagccuccucucuca

SEQ ID NO: 25575 - RNA, 19 nt, Homo sapiens
gaggaaagggucuagaaua

SEQ ID NO: 25576 - RNA, 19 nt, Homo sapiens
gaagauggaagucuagauu

SEQ ID NO: 25577 - RNA, 19 nt, Homo sapiens
ggaaaucccuccggugaau

SEQ ID NO: 25578 - RNA, 19 nt, Homo sapiens
gaagagaaaccauuuagag

SEQ ID NO: 25579 - RNA, 19 nt, Homo sapiens
aaacaucauugcagugaaa

SEQ ID NO: 25580 - RNA, 19 nt, Homo sapiens
acacagagaggaaacaaua

SEQ ID NO: 25581 - RNA, 19 nt, Homo sapiens
ggaaagagucaaacaaaca

SEQ ID NO: 25582 - RNA, 19 nt, Homo sapiens
gcuaagaauugaguuaaug

SEQ ID NO: 25583 - RNA, 19 nt, Homo sapiens
gcuuggaugugcaaccuua

SEQ ID NO: 25584 - RNA, 19 nt, Homo sapiens
gauggcaacugucgugaga

SEQ ID NO: 25585 - RNA, 19 nt, Homo sapiens
gaaagagucaaacaaacaa

SEQ ID NO: 25586 - RNA, 19 nt, Homo sapiens
gagaagaugaggcaugauu

SEQ ID NO: 25587 - RNA, 19 nt, Homo sapiens
acagacaaaugaaaucuug

SEQ ID NO: 25588 - RNA, 19 nt, Homo sapiens
ccuagccacuuaauaauug

SEQ ID NO: 25589 - RNA, 19 nt, Homo sapiens
uuaccuagccacuuaauaa

SEQ ID NO: 25590 - RNA, 19 nt, Homo sapiens
augagaagcucgucuacua

SEQ ID NO: 25591 - RNA, 19 nt, Homo sapiens
cagcuacuaugcaauaaau

SEQ ID NO: 25592 - RNA, 19 nt, Homo sapiens
aggaaagggucuagaauau

SEQ ID NO: 25593 - RNA, 19 nt, Homo sapiens
caaacucauuggcuuaaau

SEQ ID NO: 25594 - RNA, 19 nt, Homo sapiens
gagaaaccauuuagagacu

SEQ ID NO: 25595 - RNA, 19 nt, Homo sapiens
ugaaugaagucaagcauac

SEQ ID NO: 25596 - RNA, 19 nt, Homo sapiens
gaagggaaccgagccuauu

SEQ ID NO: 25597 - RNA, 19 nt, Homo sapiens
aaucaaacuucucgacuug

SEQ ID NO: 25598 - RNA, 19 nt, Homo sapiens
gaugaggcaugauuuagag

SEQ ID NO: 25599 - RNA, 19 nt, Homo sapiens
gaaaccauuuagagacugu

SEQ ID NO: 25600 - RNA, 19 nt, Homo sapiens
ggaagaguuggacaccuua

SEQ ID NO: 25601 - RNA, 19 nt, Homo sapiens
gcaaugugccuacacuuuc

SEQ ID NO: 25602 - RNA, 19 nt, Homo sapiens
gauauaaccggauucaaca

SEQ ID NO: 25603 - RNA, 19 nt, Homo sapiens
gaagucaagcauacuguug

SEQ ID NO: 25604 - RNA, 19 nt, Homo sapiens
ggcaguacaugcuaagaau

SEQ ID NO: 25605 - RNA, 19 nt, Homo sapiens
uagagacugugcagaugua

SEQ ID NO: 25606 - RNA, 19 nt, Homo sapiens
gaggaagagaaaccauuua

SEQ ID NO: 25607 - RNA, 19 nt, Homo sapiens
gaagaaaggagcaaguuuu

SEQ ID NO: 25608 - RNA, 19 nt, Homo sapiens
ucacugaggucugggagaa

SEQ ID NO: 25609 - RNA, 19 nt, Homo sapiens
caguugcagugaauucaua

SEQ ID NO: 25610 - RNA, 19 nt, Homo sapiens
ggaugugcaaccuuaauaa

SEQ ID NO: 25611 - RNA, 19 nt, Homo sapiens
gaagauauaaccggauuca

SEQ ID NO: 25612 - RNA, 19 nt, Homo sapiens
gaggaaacaauaaaucuca

SEQ ID NO: 25613 - RNA, 19 nt, Homo sapiens
gcagauaggguagaggaaa

SEQ ID NO: 25614 - RNA, 19 nt, Homo sapiens
ggagugugcuggcaguaca

SEQ ID NO: 25615 - RNA, 19 nt, Homo sapiens
aagagaagaugaggcauga

SEQ ID NO: 25616 - RNA, 19 nt, Homo sapiens
ggaagagaaaccauuuaga

SEQ ID NO: 25617 - RNA, 19 nt, Homo sapiens
uaaaggaagagaaagagaa

SEQ ID NO: 25618 - RNA, 19 nt, Homo sapiens
gaugugcaaccuuaauaaa

SEQ ID NO: 25619 - RNA, 19 nt, Homo sapiens
caucauugcagugaaauaa

SEQ ID NO: 25620 - RNA, 19 nt, Homo sapiens
ccaaagaggcuggaaggaa

SEQ ID NO: 25621 - RNA, 19 nt, Homo sapiens
caacaacaguguccuucag

SEQ ID NO: 25622 - RNA, 19 nt, Homo sapiens
caaugugccuacacuuuca

SEQ ID NO: 25623 - RNA, 19 nt, Homo sapiens
ggaaagggucuagaauaug

SEQ ID NO: 25624 - RNA, 19 nt, Homo sapiens
gaggcuggaaggaauauaa

SEQ ID NO: 25625 - RNA, 19 nt, Homo sapiens
gggaaagagucaaacaaac

SEQ ID NO: 25626 - RNA, 19 nt, Homo sapiens
uugaugaccuuucuugaau

SEQ ID NO: 25627 - RNA, 19 nt, Homo sapiens
gagaggaagagaaaccauu

SEQ ID NO: 25628 - RNA, 19 nt, Homo sapiens
aaaucaaacuucucgacuu

SEQ ID NO: 25629 - RNA, 19 nt, Homo sapiens
cucauuggcuuaaauaauc

SEQ ID NO: 25630 - RNA, 19 nt, Homo sapiens
cugauaaguuucauacuca

SEQ ID NO: 25631 - RNA, 19 nt, Homo sapiens
gcaguacaaugacaguuuu

SEQ ID NO: 25632 - RNA, 19 nt, Homo sapiens
gagaggaaacaauaaaucu

SEQ ID NO: 25633 - RNA, 19 nt, Homo sapiens
ggcaugauuuagaggguuu

SEQ ID NO: 25634 - RNA, 19 nt, Homo sapiens
cagaggcaguacaugcuaa

SEQ ID NO: 25635 - RNA, 19 nt, Homo sapiens
gaaaucccuccggugaaua

SEQ ID NO: 25636 - RNA, 19 nt, Homo sapiens
guagguugacuaucuuuga

SEQ ID NO: 25637 - RNA, 19 nt, Homo sapiens
ugacagauuccacauagga

SEQ ID NO: 25638 - RNA, 19 nt, Homo sapiens
ggaagggaaccgagccuau

SEQ ID NO: 25639 - RNA, 19 nt, Homo sapiens
gguacuaaaucaaacuucu

SEQ ID NO: 25640 - RNA, 19 nt, Homo sapiens
acaaauggcuaguuuucua

SEQ ID NO: 25641 - RNA, 19 nt, Homo sapiens
ucucagcuacuaugcaaua

SEQ ID NO: 25642 - RNA, 19 nt, Homo sapiens
aaucucagcuacuaugcaa

SEQ ID NO: 25643 - RNA, 19 nt, Homo sapiens
ucuuagaaauggaaggaaa

SEQ ID NO: 25644 - RNA, 19 nt, Homo sapiens
gaaagcugacagauguuga

SEQ ID NO: 25645 - RNA, 19 nt, Homo sapiens
ggcaguacaaugacaguuu

SEQ ID NO: 25646 - RNA, 19 nt, Homo sapiens
ucaaugagaagcucgucua

SEQ ID NO: 25647 - RNA, 19 nt, Homo sapiens
gugaaugaagucaagcaua

SEQ ID NO: 25648 - RNA, 19 nt, Homo sapiens
uuuagggaauggugaauga

SEQ ID NO: 25649 - RNA, 19 nt, Homo sapiens
gagccuauucacaguauga

SEQ ID NO: 25650 - RNA, 19 nt, Homo sapiens
aagucuagauuuccaaaga

SEQ ID NO: 25651 - RNA, 19 nt, Homo sapiens
agauggaagucuagauuuc

SEQ ID NO: 25652 - RNA, 19 nt, Homo sapiens
gcaauauggaugucaaugg

SEQ ID NO: 25653 - RNA, 19 nt, Homo sapiens
gaagaguuggacaccuuaa

SEQ ID NO: 25654 - RNA, 19 nt, Homo sapiens
ccuacaagcuagagaagca

SEQ ID NO: 25655 - RNA, 19 nt, Homo sapiens
agacccagguacuaaauca

SEQ ID NO: 25656 - RNA, 19 nt, Homo sapiens
cccagaaacuucaacaucu

SEQ ID NO: 25657 - RNA, 19 nt, Homo sapiens
uuucguagguugacuaucu

SEQ ID NO: 25658 - RNA, 19 nt, Homo sapiens
ugucuagaccuauuacaaa

SEQ ID NO: 25659 - RNA, 19 nt, Homo sapiens
gcaguacaugcuaagaauu

SEQ ID NO: 25660 - RNA, 19 nt, Homo sapiens
agaacaaagcuaacaaaug

SEQ ID NO: 25661 - RNA, 19 nt, Homo sapiens
acagagaggaaacaauaaa

SEQ ID NO: 25662 - RNA, 19 nt, Homo sapiens
agaacacgauggcaacugu

SEQ ID NO: 25663 - RNA, 19 nt, Homo sapiens
ucacauagggugcagcaau

SEQ ID NO: 25664 - RNA, 19 nt, Homo sapiens
aauacaacaucgugaagau

SEQ ID NO: 25665 - RNA, 19 nt, Homo sapiens
gaaguuaacugauguggaa

SEQ ID NO: 25666 - RNA, 19 nt, Homo sapiens
gaaagaauguggcagauug

SEQ ID NO: 25667 - RNA, 19 nt, Homo sapiens
gaacaacacuguaggaucu

SEQ ID NO: 25668 - RNA, 19 nt, Homo sapiens
ggaggcggguggacaauua

SEQ ID NO: 25669 - RNA, 19 nt, Homo sapiens
ggacaaaccuguugaacca

SEQ ID NO: 25670 - RNA, 19 nt, Homo sapiens
gugaagaacucaauuauag

SEQ ID NO: 25671 - RNA, 19 nt, Homo sapiens
cgugaaagcugcucuguaa

SEQ ID NO: 25672 - RNA, 19 nt, Homo sapiens
gaacaccuaugcaaagaug

SEQ ID NO: 25673 - RNA, 19 nt, Homo sapiens
gaaagaaaugguagagaua

SEQ ID NO: 25674 - RNA, 19 nt, Homo sapiens
cuaagcugcugguuuauua

SEQ ID NO: 25675 - RNA, 19 nt, Homo sapiens
ggaacugucucgaacuauu

SEQ ID NO: 25676 - RNA, 19 nt, Homo sapiens
uaagaacaguuuccuagaa

SEQ ID NO: 25677 - RNA, 19 nt, Homo sapiens
gaacauuucuaucucucaa

SEQ ID NO: 25678 - RNA, 19 nt, Homo sapiens
gaggaacugucucgaacua

SEQ ID NO: 25679 - RNA, 19 nt, Homo sapiens
ggacuuggaaagaauauaa

SEQ ID NO: 25680 - RNA, 19 nt, Homo sapiens
uugcuaagcugcugguuua

SEQ ID NO: 25681 - RNA, 19 nt, Homo sapiens
gaacucaauuauaggauuc

SEQ ID NO: 25682 - RNA, 19 nt, Homo sapiens
caaaucagcuucagagacu

SEQ ID NO: 25683 - RNA, 19 nt, Homo sapiens
uauaacaacuuucggaaga

SEQ ID NO: 25684 - RNA, 19 nt, Homo sapiens
gauuagagccuguaaacuu

SEQ ID NO: 25685 - RNA, 19 nt, Homo sapiens
caagugaagaacucaauua

SEQ ID NO: 25686 - RNA, 19 nt, Homo sapiens
caaauggcaucuacacguu

SEQ ID NO: 25687 - RNA, 19 nt, Homo sapiens
uguggaagcccaaguauua

SEQ ID NO: 25688 - RNA, 19 nt, Homo sapiens
gagcaaacgcggaaguuaa

SEQ ID NO: 25689 - RNA, 19 nt, Homo sapiens
ccaagaauguuaugugcaa

SEQ ID NO: 25690 - RNA, 19 nt, Homo sapiens
ggaccagaccagugaaaua

SEQ ID NO: 25691 - RNA, 19 nt, Homo sapiens
ccagacggcugugaugaua

SEQ ID NO: 25692 - RNA, 19 nt, Homo sapiens
gagcugugaucuugucuug

SEQ ID NO: 25693 - RNA, 19 nt, Homo sapiens
gaacugucucgaacuauuu

SEQ ID NO: 25694 - RNA, 19 nt, Homo sapiens
ggaauguacuauccacaga

SEQ ID NO: 25695 - RNA, 19 nt, Homo sapiens
ggagagaacacagcaguaa

SEQ ID NO: 25696 - RNA, 19 nt, Homo sapiens
acacagcccucccaaguga

SEQ ID NO: 25697 - RNA, 19 nt, Homo sapiens
cagagacugugcugaagua

SEQ ID NO: 25698 - RNA, 19 nt, Homo sapiens
gaagaacucaauuauagga

SEQ ID NO: 25699 - RNA, 19 nt, Homo sapiens
gaccagaccagugaaauaa

SEQ ID NO: 25700 - RNA, 19 nt, Homo sapiens
agacugugcugaaguauuc

SEQ ID NO: 25701 - RNA, 19 nt, Homo sapiens
agaaagaaaugguagagau

SEQ ID NO: 25702 - RNA, 19 nt, Homo sapiens
gaccaaagcaagacccuaa

SEQ ID NO: 25703 - RNA, 19 nt, Homo sapiens
aauauuggcugggaaauga

SEQ ID NO: 25704 - RNA, 19 nt, Homo sapiens
ggagacaacgacaaaugua

SEQ ID NO: 25705 - RNA, 19 nt, Homo sapiens
gcccaaguauuaaaucaga

SEQ ID NO: 25706 - RNA, 19 nt, Homo sapiens
gggaagggaaugaggcuua

SEQ ID NO: 25707 - RNA, 19 nt, Homo sapiens
gcaacgcuaugugcuuaaa

SEQ ID NO: 25708 - RNA, 19 nt, Homo sapiens
ucagaggacuuggaaagaa

SEQ ID NO: 25709 - RNA, 19 nt, Homo sapiens
gaaccaaacagcugagcaa

SEQ ID NO: 25710 - RNA, 19 nt, Homo sapiens
agaauuauauccaggacaa

SEQ ID NO: 25711 - RNA, 19 nt, Homo sapiens
gcauaggaaagaagcaaua

SEQ ID NO: 25712 - RNA, 19 nt, Homo sapiens
caagugagcaggacuguuc

SEQ ID NO: 25713 - RNA, 19 nt, Homo sapiens
cagcagauuucuaaacauc

SEQ ID NO: 25714 - RNA, 19 nt, Homo sapiens
gaacaaaggaccgugaaag

SEQ ID NO: 25715 - RNA, 19 nt, Homo sapiens
gaagagcauggacagcaua

SEQ ID NO: 25716 - RNA, 19 nt, Homo sapiens
uugcaaauguucacaaaug

SEQ ID NO: 25717 - RNA, 19 nt, Homo sapiens
gaauauaaagugggauuug

SEQ ID NO: 25718 - RNA, 19 nt, Homo sapiens
guaaauaacuggaaaacag

SEQ ID NO: 25719 - RNA, 19 nt, Homo sapiens
cagaacaccuaugcaaaga

SEQ ID NO: 25720 - RNA, 19 nt, Homo sapiens
ggaagagcauggacagcau

SEQ ID NO: 25721 - RNA, 19 nt, Homo sapiens
gaaaacagaacacuuaugu

SEQ ID NO: 25722 - RNA, 19 nt, Homo sapiens
gcaagacccuaaacaucca

SEQ ID NO: 25723 - RNA, 19 nt, Homo sapiens
ggauggagacaacgacaaa

SEQ ID NO: 25724 - RNA, 19 nt, Homo sapiens
gcacaaaggauggagacaa

SEQ ID NO: 25725 - RNA, 19 nt, Homo sapiens
ucauggagacaguuaauaa

SEQ ID NO: 25726 - RNA, 19 nt, Homo sapiens
ugacugccacggugaauaa

SEQ ID NO: 25727 - RNA, 19 nt, Homo sapiens
caacaugaagaaagaaaug

SEQ ID NO: 25728 - RNA, 19 nt, Homo sapiens
acaggaggcuggugguuug

SEQ ID NO: 25729 - RNA, 19 nt, Homo sapiens
aagagaagacuuucauuga

SEQ ID NO: 25730 - RNA, 19 nt, Homo sapiens
uaaaugguacuacuggaaa

SEQ ID NO: 25731 - RNA, 19 nt, Homo sapiens
caaauguucacaaaugcua

SEQ ID NO: 25732 - RNA, 19 nt, Homo sapiens
gaacacucccucucgacaa

SEQ ID NO: 25733 - RNA, 19 nt, Homo sapiens
ccaaacagcugagcaaacg

SEQ ID NO: 25734 - RNA, 19 nt, Homo sapiens
acaaaccuguugaaccaaa

SEQ ID NO: 25735 - RNA, 19 nt, Homo sapiens
acucugagcugugaucuug

SEQ ID NO: 25736 - RNA, 19 nt, Homo sapiens
cccuaaacauccauaauug

SEQ ID NO: 25737 - RNA, 19 nt, Homo sapiens
auuagagccuguaaacuuu

SEQ ID NO: 25738 - RNA, 19 nt, Homo sapiens
gagaauauuggcugggaaa

SEQ ID NO: 25739 - RNA, 19 nt, Homo sapiens
ccacaucaaacucagcuaa

SEQ ID NO: 25740 - RNA, 19 nt, Homo sapiens
gaaaagaaggugcuagcua

SEQ ID NO: 25741 - RNA, 19 nt, Homo sapiens
gaaccagacggcugugaug

SEQ ID NO: 25742 - RNA, 19 nt, Homo sapiens
gagcauggacagcauagga

SEQ ID NO: 25743 - RNA, 19 nt, Homo sapiens
ugugcaaguuuaucaguaa

SEQ ID NO: 25744 - RNA, 19 nt, Homo sapiens
gacagaacaccuaugcaaa

SEQ ID NO: 25745 - RNA, 19 nt, Homo sapiens
cagaggacuuggaaagaau

SEQ ID NO: 25746 - RNA, 19 nt, Homo sapiens
gcaucuacacguuaacauu

SEQ ID NO: 25747 - RNA, 19 nt, Homo sapiens
gcugcugguuuauuacuga

SEQ ID NO: 25748 - RNA, 19 nt, Homo sapiens
ggacccacaugcuccagau

SEQ ID NO: 25749 - RNA, 19 nt, Homo sapiens
uaaguucaacggcauuaaa

SEQ ID NO: 25750 - RNA, 19 nt, Homo sapiens
ccacagaggcagaacacaa

SEQ ID NO: 25751 - RNA, 19 nt, Homo sapiens
gagagaacacagcaguaaa

SEQ ID NO: 25752 - RNA, 19 nt, Homo sapiens
caaccaagaauguuaugug

SEQ ID NO: 25753 - RNA, 19 nt, Homo sapiens
uggaaaggcucaggcuauu

SEQ ID NO: 25754 - RNA, 19 nt, Homo sapiens
ggaggcuggugguuugaug

SEQ ID NO: 25755 - RNA, 19 nt, Homo sapiens
uaacauucccuaauucuac

SEQ ID NO: 25756 - RNA, 19 nt, Homo sapiens
guagagauacagcagaaug

SEQ ID NO: 25757 - RNA, 19 nt, Homo sapiens
uaggaaagaagcaauauca

SEQ ID NO: 25758 - RNA, 19 nt, Homo sapiens
gcugggaaaugaguuuguu

SEQ ID NO: 25759 - RNA, 19 nt, Homo sapiens
aaaagaaggugcuagcuau

SEQ ID NO: 25760 - RNA, 19 nt, Homo sapiens
agacggcugugaugauaga

SEQ ID NO: 25761 - RNA, 19 nt, Homo sapiens
ugacacagcccucccaagu

SEQ ID NO: 25762 - RNA, 19 nt, Homo sapiens
agaggcagaacacaaauaa

SEQ ID NO: 25763 - RNA, 19 nt, Homo sapiens
gagacaacgacaaauguau

SEQ ID NO: 25764 - RNA, 19 nt, Homo sapiens
uuucgcaacugacuaauca

SEQ ID NO: 25765 - RNA, 19 nt, Homo sapiens
ggaaugaguuucagaauau

SEQ ID NO: 25766 - RNA, 19 nt, Homo sapiens
ggaaguggccaaauauuua

SEQ ID NO: 25767 - RNA, 19 nt, Homo sapiens
gaacaaagccaaagucaau

SEQ ID NO: 25768 - RNA, 19 nt, Homo sapiens
gaaagggucuccucucuca

SEQ ID NO: 25769 - RNA, 19 nt, Homo sapiens
agaaggagcugcuggauuu

SEQ ID NO: 25770 - RNA, 19 nt, Homo sapiens
gggaaugaguuucagaaua

SEQ ID NO: 25771 - RNA, 19 nt, Homo sapiens
cggaugagcuugucacuaa

SEQ ID NO: 25772 - RNA, 19 nt, Homo sapiens
gaaaucaguuuaacaccuu

SEQ ID NO: 25773 - RNA, 19 nt, Homo sapiens
gaaggaaugucccuguuug

SEQ ID NO: 25774 - RNA, 19 nt, Homo sapiens
gaacaaguaccaugacuga

SEQ ID NO: 25775 - RNA, 19 nt, Homo sapiens
gcaauacgacgcagagaua

SEQ ID NO: 25776 - RNA, 19 nt, Homo sapiens
acacggaaguggccaaaua

SEQ ID NO: 25777 - RNA, 19 nt, Homo sapiens
gggaagaacucaucagcuu

SEQ ID NO: 25778 - RNA, 19 nt, Homo sapiens
gcaaaccaauagaaacauu

SEQ ID NO: 25779 - RNA, 19 nt, Homo sapiens
caaggugguucgacagaua

SEQ ID NO: 25780 - RNA, 19 nt, Homo sapiens
gcaaggcgaugaaguacga

SEQ ID NO: 25781 - RNA, 19 nt, Homo sapiens
gcacagcccugccuggaau

SEQ ID NO: 25782 - RNA, 19 nt, Homo sapiens
ggagagagagggauagaaa

SEQ ID NO: 25783 - RNA, 19 nt, Homo sapiens
cgacagagccgcaacuuga

SEQ ID NO: 25784 - RNA, 19 nt, Homo sapiens
gcaggcaucuaaagaguau

SEQ ID NO: 25785 - RNA, 19 nt, Homo sapiens
gaagagaagcugccagguu

SEQ ID NO: 25786 - RNA, 19 nt, Homo sapiens
cgaaugaguuucccugaga

SEQ ID NO: 25787 - RNA, 19 nt, Homo sapiens
gcaagaugcugcacaaggu

SEQ ID NO: 25788 - RNA, 19 nt, Homo sapiens
ggacagagcaggcagagau

SEQ ID NO: 25789 - RNA, 19 nt, Homo sapiens
ccaaauauuuacuccagaa

SEQ ID NO: 25790 - RNA, 19 nt, Homo sapiens
gaguagggcuagugaaugu

SEQ ID NO: 25791 - RNA, 19 nt, Homo sapiens
ggucagaggucagaagaga

SEQ ID NO: 25792 - RNA, 19 nt, Homo sapiens
caaugucucugccagguuu

SEQ ID NO: 25793 - RNA, 19 nt, Homo sapiens
gcaucuggcuucuaaggaa

SEQ ID NO: 25794 - RNA, 19 nt, Homo sapiens
guaaucagccuuguguaua

SEQ ID NO: 25795 - RNA, 19 nt, Homo sapiens
gauacagcauucucaguga

SEQ ID NO: 25796 - RNA, 19 nt, Homo sapiens
ggauucagaugccacaaau

SEQ ID NO: 25797 - RNA, 19 nt, Homo sapiens
caugacagaugauaaagug

SEQ ID NO: 25798 - RNA, 19 nt, Homo sapiens
ccaccaaacuuguauaugc

SEQ ID NO: 25799 - RNA, 19 nt, Homo sapiens
caacgucaaugcccaguca

SEQ ID NO: 25800 - RNA, 19 nt, Homo sapiens
gcuugcaucuggcuucuaa

SEQ ID NO: 25801 - RNA, 19 nt, Homo sapiens
gcaacauugucaccaagaa

SEQ ID NO: 25802 - RNA, 19 nt, Homo sapiens
gagcaggcaucuaaagagu

SEQ ID NO: 25803 - RNA, 19 nt, Homo sapiens
ggaaugggguagauauuaa

SEQ ID NO: 25804 - RNA, 19 nt, Homo sapiens
ccagggauguugaugaaga

SEQ ID NO: 25805 - RNA, 19 nt, Homo sapiens
uaaggaaggccaugugaaa

SEQ ID NO: 25806 - RNA, 19 nt, Homo sapiens
uaaucagccuuguguauau

SEQ ID NO: 25807 - RNA, 19 nt, Homo sapiens
gcaccagcauguccauaga

SEQ ID NO: 25808 - RNA, 19 nt, Homo sapiens
acaaauggccuuaucgauu

SEQ ID NO: 25809 - RNA, 19 nt, Homo sapiens
ggaaggaaugucccuguuu

SEQ ID NO: 25810 - RNA, 19 nt, Homo sapiens
ggacauagagguguuggaa

SEQ ID NO: 25811 - RNA, 19 nt, Homo sapiens
uggaggagcuagagaagaa

SEQ ID NO: 25812 - RNA, 19 nt, Homo sapiens
gaaaugggcacgugcgaau

SEQ ID NO: 25813 - RNA, 19 nt, Homo sapiens
gagaugaagauggcuguua

SEQ ID NO: 25814 - RNA, 19 nt, Homo sapiens
aaugaagugucucuuguuu

SEQ ID NO: 25815 - RNA, 19 nt, Homo sapiens
ccucccagaugaaugguua

SEQ ID NO: 25816 - RNA, 19 nt, Homo sapiens
cagaugugcugaucaaaca

SEQ ID NO: 25817 - RNA, 19 nt, Homo sapiens
aaauggagcuaaccagaau

SEQ ID NO: 25818 - RNA, 19 nt, Homo sapiens
gaggucagcucggauggaa

SEQ ID NO: 25819 - RNA, 19 nt, Homo sapiens
acaucaagcuggugaaguu

SEQ ID NO: 25820 - RNA, 19 nt, Homo sapiens
guuagggacuuaagaaucu

SEQ ID NO: 25821 - RNA, 19 nt, Homo sapiens
cugaagcuguggauaaauu

SEQ ID NO: 25822 - RNA, 19 nt, Homo sapiens
ggaaguggagccgaagaua

SEQ ID NO: 25823 - RNA, 19 nt, Homo sapiens
gcagggacauagagguguu

SEQ ID NO: 25824 - RNA, 19 nt, Homo sapiens
gagaccaccucgacugugu

SEQ ID NO: 25825 - RNA, 19 nt, Homo sapiens
ggagaggagucaggacaga

SEQ ID NO: 25826 - RNA, 19 nt, Homo sapiens
gggcaggacucagagaaug

SEQ ID NO: 25827 - RNA, 19 nt, Homo sapiens
ucauggagcugcugcugaa

SEQ ID NO: 25828 - RNA, 19 nt, Homo sapiens
guaagggacuccugcuagu

SEQ ID NO: 25829 - RNA, 19 nt, Homo sapiens
gcuacugcaugacagauga

SEQ ID NO: 25830 - RNA, 19 nt, Homo sapiens
gagaaugccgucaccaaga

SEQ ID NO: 25831 - RNA, 19 nt, Homo sapiens
gaggagccagcgucaauuu

SEQ ID NO: 25832 - RNA, 19 nt, Homo sapiens
uccgggagcuugucaacua

SEQ ID NO: 25833 - RNA, 19 nt, Homo sapiens
auaaagaaauggacuaagg

SEQ ID NO: 25834 - RNA, 19 nt, Homo sapiens
ggaggagccuuaaguucca

SEQ ID NO: 25835 - RNA, 19 nt, Homo sapiens
ccagaucgcucuacaugac

SEQ ID NO: 25836 - RNA, 19 nt, Homo sapiens
gaaugaagugucucuuguu

SEQ ID NO: 25837 - RNA, 19 nt, Homo sapiens
agaaugaagugucucuugu

SEQ ID NO: 25838 - RNA, 19 nt, Homo sapiens
ggccaaauucgucaucuuu

SEQ ID NO: 25839 - RNA, 19 nt, Homo sapiens
acacagacaucgugacucu

SEQ ID NO: 25840 - RNA, 19 nt, Homo sapiens
ucgcgcaccucaucaacua

SEQ ID NO: 25841 - RNA, 19 nt, Homo sapiens
ccacccugcuguacaaaga

SEQ ID NO: 25842 - RNA, 19 nt, Homo sapiens
gagaggaagucgccacaac

SEQ ID NO: 25843 - RNA, 19 nt, Homo sapiens
ccacguggccuccuucaug

SEQ ID NO: 25844 - RNA, 19 nt, Homo sapiens
gaacacggcccugcacauc

SEQ ID NO: 25845 - RNA, 19 nt, Homo sapiens
ccacucgccuccacugaau

SEQ ID NO: 25846 - RNA, 19 nt, Homo sapiens
gagcagggcaacauuguca

SEQ ID NO: 25847 - RNA, 19 nt, Homo sapiens
gaaccaccaaacuuguaua

SEQ ID NO: 25848 - RNA, 19 nt, Homo sapiens
uaacaccuguaaccagaau

SEQ ID NO: 25849 - RNA, 19 nt, Homo sapiens
gagaaggagcugcuggauu

SEQ ID NO: 25850 - RNA, 19 nt, Homo sapiens
gauaagcaucgaaugaguu

SEQ ID NO: 25851 - RNA, 19 nt, Homo sapiens
guacauggcagcacaagag

SEQ ID NO: 25852 - RNA, 19 nt, Homo sapiens
guucaaaguguaaacugua

SEQ ID NO: 25853 - RNA, 19 nt, Homo sapiens
ggaaaaucauuaccuugaa

SEQ ID NO: 25854 - RNA, 19 nt, Homo sapiens
gagcacacguggacagaac

SEQ ID NO: 25855 - RNA, 19 nt, Homo sapiens
agaugaagauggcuguuau

SEQ ID NO: 25856 - RNA, 19 nt, Homo sapiens
gaaguggagccgaagauag

SEQ ID NO: 25857 - RNA, 19 nt, Homo sapiens
ucaacgggauggacgaaga

SEQ ID NO: 25858 - RNA, 19 nt, Homo sapiens
gcaccaggcagaugucaau

SEQ ID NO: 25859 - RNA, 19 nt, Homo sapiens
gaacaagagcggacucacu

SEQ ID NO: 25860 - RNA, 19 nt, Homo sapiens
cggaaguggccaaauauuu

SEQ ID NO: 25861 - RNA, 19 nt, Homo sapiens
ucucccacaugcucuguua

SEQ ID NO: 25862 - RNA, 19 nt, Homo sapiens
cauaguccguguucaaagu

SEQ ID NO: 25863 - RNA, 19 nt, Homo sapiens
gcaaggcugaggacucuga

SEQ ID NO: 25864 - RNA, 19 nt, Homo sapiens
gcacaggagccgcuaugga

SEQ ID NO: 25865 - RNA, 19 nt, Homo sapiens
ggaaugaguuucagaauau

SEQ ID NO: 25866 - RNA, 19 nt, Homo sapiens
ggaaguggccaaauauuua

SEQ ID NO: 25867 - RNA, 19 nt, Homo sapiens
gaacaaagccaaagucaau

SEQ ID NO: 25868 - RNA, 19 nt, Homo sapiens
gaaagggucuccucucuca

SEQ ID NO: 25869 - RNA, 19 nt, Homo sapiens
agaaggagcugcuggauuu

SEQ ID NO: 25870 - RNA, 19 nt, Homo sapiens
gggaaugaguuucagaaua

SEQ ID NO: 25871 - RNA, 19 nt, Homo sapiens
cggaugagcuugucacuaa

SEQ ID NO: 25872 - RNA, 19 nt, Homo sapiens
gaaaucaguuuaacaccuu

SEQ ID NO: 25873 - RNA, 19 nt, Homo sapiens
gaaggaaugucccuguuug

SEQ ID NO: 25874 - RNA, 19 nt, Homo sapiens
gaacaaguaccaugacuga

SEQ ID NO: 25875 - RNA, 19 nt, Homo sapiens
gcaauacgacgcagagaua

SEQ ID NO: 25876 - RNA, 19 nt, Homo sapiens
acacggaaguggccaaaua

SEQ ID NO: 25877 - RNA, 19 nt, Homo sapiens
gggaagaacucaucagcuu

SEQ ID NO: 25878 - RNA, 19 nt, Homo sapiens
gcaaaccaauagaaacauu

SEQ ID NO: 25879 - RNA, 19 nt, Homo sapiens
caaggugguucgacagaua

SEQ ID NO: 25880 - RNA, 19 nt, Homo sapiens
gcaaggcgaugaaguacga

SEQ ID NO: 25881 - RNA, 19 nt, Homo sapiens
gcacagcccugccuggaau

SEQ ID NO: 25882 - RNA, 19 nt, Homo sapiens
ggagagagagggauagaaa

SEQ ID NO: 25883 - RNA, 19 nt, Homo sapiens
cgacagagccgcaacuuga

SEQ ID NO: 25884 - RNA, 19 nt, Homo sapiens
gcaggcaucuaaagaguau

SEQ ID NO: 25885 - RNA, 19 nt, Homo sapiens
gaagagaagcugccagguu

SEQ ID NO: 25886 - RNA, 19 nt, Homo sapiens
cgaaugaguuucccugaga

SEQ ID NO: 25887 - RNA, 19 nt, Homo sapiens
gcaagaugcugcacaaggu

SEQ ID NO: 25888 - RNA, 19 nt, Homo sapiens
ggacagagcaggcagagau

SEQ ID NO: 25889 - RNA, 19 nt, Homo sapiens
ccaaauauuuacuccagaa

SEQ ID NO: 25890 - RNA, 19 nt, Homo sapiens
gaguagggcuagugaaugu

SEQ ID NO: 25891 - RNA, 19 nt, Homo sapiens
ggucagaggucagaagaga

SEQ ID NO: 25892 - RNA, 19 nt, Homo sapiens
caaugucucugccagguuu

SEQ ID NO: 25893 - RNA, 19 nt, Homo sapiens
gcaucuggcuucuaaggaa

SEQ ID NO: 25894 - RNA, 19 nt, Homo sapiens
guaaucagccuuguguaua

SEQ ID NO: 25895 - RNA, 19 nt, Homo sapiens
gauacagcauucucaguga

SEQ ID NO: 25896 - RNA, 19 nt, Homo sapiens
ggauucagaugccacaaau

SEQ ID NO: 25897 - RNA, 19 nt, Homo sapiens
caugacagaugauaaagug

SEQ ID NO: 25898 - RNA, 19 nt, Homo sapiens
ccaccaaacuuguauaugc

SEQ ID NO: 25899 - RNA, 19 nt, Homo sapiens
caacgucaaugcccaguca

SEQ ID NO: 25900 - RNA, 19 nt, Homo sapiens
gcuugcaucuggcuucuaa

SEQ ID NO: 25901 - RNA, 19 nt, Homo sapiens
gcaacauugucaccaagaa

SEQ ID NO: 25902 - RNA, 19 nt, Homo sapiens
gagcaggcaucuaaagagu

SEQ ID NO: 25903 - RNA, 19 nt, Homo sapiens
ggaaugggguagauauuaa

SEQ ID NO: 25904 - RNA, 19 nt, Homo sapiens
ccagggauguugaugaaga

SEQ ID NO: 25905 - RNA, 19 nt, Homo sapiens
uaaggaaggccaugugaaa

SEQ ID NO: 25906 - RNA, 19 nt, Homo sapiens
uaaucagccuuguguauau

SEQ ID NO: 25907 - RNA, 19 nt, Homo sapiens
gcaccagcauguccauaga

SEQ ID NO: 25908 - RNA, 19 nt, Homo sapiens
acaaauggccuuaucgauu

SEQ ID NO: 25909 - RNA, 19 nt, Homo sapiens
ggaaggaaugucccuguuu

SEQ ID NO: 25910 - RNA, 19 nt, Homo sapiens
ggacauagagguguuggaa

SEQ ID NO: 25911 - RNA, 19 nt, Homo sapiens
uggaggagcuagagaagaa

SEQ ID NO: 25912 - RNA, 19 nt, Homo sapiens
gaaaugggcacgugcgaau

SEQ ID NO: 25913 - RNA, 19 nt, Homo sapiens
gagaugaagauggcuguua

SEQ ID NO: 25914 - RNA, 19 nt, Homo sapiens
aaugaagugucucuuguuu

SEQ ID NO: 25915 - RNA, 19 nt, Homo sapiens
ccucccagaugaaugguua

SEQ ID NO: 25916 - RNA, 19 nt, Homo sapiens
cagaugugcugaucaaaca

SEQ ID NO: 25917 - RNA, 19 nt, Homo sapiens
aaauggagcuaaccagaau

SEQ ID NO: 25918 - RNA, 19 nt, Homo sapiens
gaggucagcucggauggaa

SEQ ID NO: 25919 - RNA, 19 nt, Homo sapiens
acaucaagcuggugaaguu

SEQ ID NO: 25920 - RNA, 19 nt, Homo sapiens
guuagggacuuaagaaucu

SEQ ID NO: 25921 - RNA, 19 nt, Homo sapiens
cugaagcuguggauaaauu

SEQ ID NO: 25922 - RNA, 19 nt, Homo sapiens
ggaaguggagccgaagaua

SEQ ID NO: 25923 - RNA, 19 nt, Homo sapiens
gcagggacauagagguguu

SEQ ID NO: 25924 - RNA, 19 nt, Homo sapiens
gagaccaccucgacugugu

SEQ ID NO: 25925 - RNA, 19 nt, Homo sapiens
ggagaggagucaggacaga

SEQ ID NO: 25926 - RNA, 19 nt, Homo sapiens
gggcaggacucagagaaug

SEQ ID NO: 25927 - RNA, 19 nt, Homo sapiens
ucauggagcugcugcugaa

SEQ ID NO: 25928 - RNA, 19 nt, Homo sapiens
guaagggacuccugcuagu

SEQ ID NO: 25929 - RNA, 19 nt, Homo sapiens
gcuacugcaugacagauga

SEQ ID NO: 25930 - RNA, 19 nt, Homo sapiens
gagaaugccgucaccaaga

SEQ ID NO: 25931 - RNA, 19 nt, Homo sapiens
gaggagccagcgucaauuu

SEQ ID NO: 25932 - RNA, 19 nt, Homo sapiens
uccgggagcuugucaacua

SEQ ID NO: 25933 - RNA, 19 nt, Homo sapiens
auaaagaaauggacuaagg

SEQ ID NO: 25934 - RNA, 19 nt, Homo sapiens
ggaggagccuuaaguucca

SEQ ID NO: 25935 - RNA, 19 nt, Homo sapiens
ccagaucgcucuacaugac

SEQ ID NO: 25936 - RNA, 19 nt, Homo sapiens
gaaugaagugucucuuguu

SEQ ID NO: 25937 - RNA, 19 nt, Homo sapiens
agaaugaagugucucuugu

SEQ ID NO: 25938 - RNA, 19 nt, Homo sapiens
ggccaaauucgucaucuuu

SEQ ID NO: 25939 - RNA, 19 nt, Homo sapiens
acacagacaucgugacucu

SEQ ID NO: 25940 - RNA, 19 nt, Homo sapiens
ucgcgcaccucaucaacua

SEQ ID NO: 25941 - RNA, 19 nt, Homo sapiens
ccacccugcuguacaaaga

SEQ ID NO: 25942 - RNA, 19 nt, Homo sapiens
gagaggaagucgccacaac

SEQ ID NO: 25943 - RNA, 19 nt, Homo sapiens
ccacguggccuccuucaug

SEQ ID NO: 25944 - RNA, 19 nt, Homo sapiens
gaacacggcccugcacauc

SEQ ID NO: 25945 - RNA, 19 nt, Homo sapiens
ccacucgccuccacugaau

SEQ ID NO: 25946 - RNA, 19 nt, Homo sapiens
gagcagggcaacauuguca

SEQ ID NO: 25947 - RNA, 19 nt, Homo sapiens
gaaccaccaaacuuguaua

SEQ ID NO: 25948 - RNA, 19 nt, Homo sapiens
uaacaccuguaaccagaau

SEQ ID NO: 25949 - RNA, 19 nt, Homo sapiens
gagaaggagcugcuggauu

SEQ ID NO: 25950 - RNA, 19 nt, Homo sapiens
gauaagcaucgaaugaguu

SEQ ID NO: 25951 - RNA, 19 nt, Homo sapiens
guacauggcagcacaagag

SEQ ID NO: 25952 - RNA, 19 nt, Homo sapiens
guucaaaguguaaacugua

SEQ ID NO: 25953 - RNA, 19 nt, Homo sapiens
ggaaaaucauuaccuugaa

SEQ ID NO: 25954 - RNA, 19 nt, Homo sapiens
gagcacacguggacagaac

SEQ ID NO: 25955 - RNA, 19 nt, Homo sapiens
agaugaagauggcuguuau

SEQ ID NO: 25956 - RNA, 19 nt, Homo sapiens
gaaguggagccgaagauag

SEQ ID NO: 25957 - RNA, 19 nt, Homo sapiens
ucaacgggauggacgaaga

SEQ ID NO: 25958 - RNA, 19 nt, Homo sapiens
gcaccaggcagaugucaau

SEQ ID NO: 25959 - RNA, 19 nt, Homo sapiens
gaacaagagcggacucacu

SEQ ID NO: 25960 - RNA, 19 nt, Homo sapiens
cggaaguggccaaauauuu

SEQ ID NO: 25961 - RNA, 19 nt, Homo sapiens
ucucccacaugcucuguua

SEQ ID NO: 25962 - RNA, 19 nt, Homo sapiens
cauaguccguguucaaagu

SEQ ID NO: 25963 - RNA, 19 nt, Homo sapiens
gcaaggcugaggacucuga

SEQ ID NO: 25964 - RNA, 19 nt, Homo sapiens
gcacaggagccgcuaugga

SEQ ID NO: 25965 - RNA, 19 nt, Homo sapiens
ggaaugaguuucagaauau

SEQ ID NO: 25966 - RNA, 19 nt, Homo sapiens
ggaaguggccaaauauuua

SEQ ID NO: 25967 - RNA, 19 nt, Homo sapiens
gaacaaagccaaagucaau

SEQ ID NO: 25968 - RNA, 19 nt, Homo sapiens
gaaagggucuccucucuca

SEQ ID NO: 25969 - RNA, 19 nt, Homo sapiens
agaaggagcugcuggauuu

SEQ ID NO: 25970 - RNA, 19 nt, Homo sapiens
gggaaugaguuucagaaua

SEQ ID NO: 25971 - RNA, 19 nt, Homo sapiens
cggaugagcuugucacuaa

SEQ ID NO: 25972 - RNA, 19 nt, Homo sapiens
gaaaucaguuuaacaccuu

SEQ ID NO: 25973 - RNA, 19 nt, Homo sapiens
gaaggaaugucccuguuug

SEQ ID NO: 25974 - RNA, 19 nt, Homo sapiens
gaacaaguaccaugacuga

SEQ ID NO: 25975 - RNA, 19 nt, Homo sapiens
gcaauacgacgcagagaua

SEQ ID NO: 25976 - RNA, 19 nt, Homo sapiens
acacggaaguggccaaaua

SEQ ID NO: 25977 - RNA, 19 nt, Homo sapiens
gggaagaacucaucagcuu

SEQ ID NO: 25978 - RNA, 19 nt, Homo sapiens
gcaaaccaauagaaacauu

SEQ ID NO: 25979 - RNA, 19 nt, Homo sapiens
caaggugguucgacagaua

SEQ ID NO: 25980 - RNA, 19 nt, Homo sapiens
gcaaggcgaugaaguacga

SEQ ID NO: 25981 - RNA, 19 nt, Homo sapiens
gcacagcccugccuggaau

SEQ ID NO: 25982 - RNA, 19 nt, Homo sapiens
ggagagagagggauagaaa

SEQ ID NO: 25983 - RNA, 19 nt, Homo sapiens
cgacagagccgcaacuuga

SEQ ID NO: 25984 - RNA, 19 nt, Homo sapiens
gcaggcaucuaaagaguau

SEQ ID NO: 25985 - RNA, 19 nt, Homo sapiens
gaagagaagcugccagguu

SEQ ID NO: 25986 - RNA, 19 nt, Homo sapiens
cgaaugaguuucccugaga

SEQ ID NO: 25987 - RNA, 19 nt, Homo sapiens
gcaagaugcugcacaaggu

SEQ ID NO: 25988 - RNA, 19 nt, Homo sapiens
ggacagagcaggcagagau

SEQ ID NO: 25989 - RNA, 19 nt, Homo sapiens
ccaaauauuuacuccagaa

SEQ ID NO: 25990 - RNA, 19 nt, Homo sapiens
gaguagggcuagugaaugu

SEQ ID NO: 25991 - RNA, 19 nt, Homo sapiens
ggucagaggucagaagaga

SEQ ID NO: 25992 - RNA, 19 nt, Homo sapiens
caaugucucugccagguuu

SEQ ID NO: 25993 - RNA, 19 nt, Homo sapiens
gcaucuggcuucuaaggaa

SEQ ID NO: 25994 - RNA, 19 nt, Homo sapiens
guaaucagccuuguguaua

SEQ ID NO: 25995 - RNA, 19 nt, Homo sapiens
gauacagcauucucaguga

SEQ ID NO: 25996 - RNA, 19 nt, Homo sapiens
ggauucagaugccacaaau

SEQ ID NO: 25997 - RNA, 19 nt, Homo sapiens
caugacagaugauaaagug

SEQ ID NO: 25998 - RNA, 19 nt, Homo sapiens
ccaccaaacuuguauaugc

SEQ ID NO: 25999 - RNA, 19 nt, Homo sapiens
caacgucaaugcccaguca

SEQ ID NO: 26000 - RNA, 19 nt, Homo sapiens
gcuugcaucuggcuucuaa

SEQ ID NO: 26001 - RNA, 19 nt, Homo sapiens
gcaacauugucaccaagaa

SEQ ID NO: 26002 - RNA, 19 nt, Homo sapiens
gagcaggcaucuaaagagu

SEQ ID NO: 26003 - RNA, 19 nt, Homo sapiens
ggaaugggguagauauuaa

SEQ ID NO: 26004 - RNA, 19 nt, Homo sapiens
ccagggauguugaugaaga

SEQ ID NO: 26005 - RNA, 19 nt, Homo sapiens
uaaggaaggccaugugaaa

SEQ ID NO: 26006 - RNA, 19 nt, Homo sapiens
uaaucagccuuguguauau

SEQ ID NO: 26007 - RNA, 19 nt, Homo sapiens
gcaccagcauguccauaga

SEQ ID NO: 26008 - RNA, 19 nt, Homo sapiens
acaaauggccuuaucgauu

SEQ ID NO: 26009 - RNA, 19 nt, Homo sapiens
ggaaggaaugucccuguuu

SEQ ID NO: 26010 - RNA, 19 nt, Homo sapiens
ggacauagagguguuggaa

SEQ ID NO: 26011 - RNA, 19 nt, Homo sapiens
uggaggagcuagagaagaa

SEQ ID NO: 26012 - RNA, 19 nt, Homo sapiens
gaaaugggcacgugcgaau

SEQ ID NO: 26013 - RNA, 19 nt, Homo sapiens
gagaugaagauggcuguua

SEQ ID NO: 26014 - RNA, 19 nt, Homo sapiens
aaugaagugucucuuguuu

SEQ ID NO: 26015 - RNA, 19 nt, Homo sapiens
ccucccagaugaaugguua

SEQ ID NO: 26016 - RNA, 19 nt, Homo sapiens
cagaugugcugaucaaaca

SEQ ID NO: 26017 - RNA, 19 nt, Homo sapiens
aaauggagcuaaccagaau

SEQ ID NO: 26018 - RNA, 19 nt, Homo sapiens
ggucgauauugauuacuuu

SEQ ID NO: 26019 - RNA, 19 nt, Homo sapiens
ggaggucgauauugauuac

SEQ ID NO: 26020 - RNA, 19 nt, Homo sapiens
gaggucagcucggauggaa

SEQ ID NO: 26021 - RNA, 19 nt, Homo sapiens
acaucaagcuggugaaguu

SEQ ID NO: 26022 - RNA, 19 nt, Homo sapiens
guuagggacuuaagaaucu

SEQ ID NO: 26023 - RNA, 19 nt, Homo sapiens
cugaagcuguggauaaauu

SEQ ID NO: 26024 - RNA, 19 nt, Homo sapiens
ggaaguggagccgaagaua

SEQ ID NO: 26025 - RNA, 19 nt, Homo sapiens
gcagggacauagagguguu

SEQ ID NO: 26026 - RNA, 19 nt, Homo sapiens
gagaccaccucgacugugu

SEQ ID NO: 26027 - RNA, 19 nt, Homo sapiens
ggagaggagucaggacaga

SEQ ID NO: 26028 - RNA, 19 nt, Homo sapiens
gggcaggacucagagaaug

SEQ ID NO: 26029 - RNA, 19 nt, Homo sapiens
ucauggagcugcugcugaa

SEQ ID NO: 26030 - RNA, 19 nt, Homo sapiens
guaagggacuccugcuagu

SEQ ID NO: 26031 - RNA, 19 nt, Homo sapiens
gcuacugcaugacagauga

SEQ ID NO: 26032 - RNA, 19 nt, Homo sapiens
gagaaugccgucaccaaga

SEQ ID NO: 26033 - RNA, 19 nt, Homo sapiens
gaggagccagcgucaauuu

SEQ ID NO: 26034 - RNA, 19 nt, Homo sapiens
uccgggagcuugucaacua

SEQ ID NO: 26035 - RNA, 19 nt, Homo sapiens
auaaagaaauggacuaagg

SEQ ID NO: 26036 - RNA, 19 nt, Homo sapiens
ggaggagccuuaaguucca

SEQ ID NO: 26037 - RNA, 19 nt, Homo sapiens
ccagaucgcucuacaugac

SEQ ID NO: 26038 - RNA, 19 nt, Homo sapiens
gaaugaagugucucuuguu

SEQ ID NO: 26039 - RNA, 19 nt, Homo sapiens
agaaugaagugucucuugu

SEQ ID NO: 26040 - RNA, 19 nt, Homo sapiens
ggccaaauucgucaucuuu

SEQ ID NO: 26041 - RNA, 19 nt, Homo sapiens
acacagacaucgugacucu

SEQ ID NO: 26042 - RNA, 19 nt, Homo sapiens
ucgcgcaccucaucaacua

SEQ ID NO: 26043 - RNA, 19 nt, Homo sapiens
ccacccugcuguacaaaga

SEQ ID NO: 26044 - RNA, 19 nt, Homo sapiens
gagaggaagucgccacaac

SEQ ID NO: 26045 - RNA, 19 nt, Homo sapiens
ccacguggccuccuucaug

SEQ ID NO: 26046 - RNA, 19 nt, Homo sapiens
gaacacggcccugcacauc

SEQ ID NO: 26047 - RNA, 19 nt, Homo sapiens
ccacucgccuccacugaau

SEQ ID NO: 26048 - RNA, 19 nt, Homo sapiens
gagcagggcaacauuguca

SEQ ID NO: 26049 - RNA, 19 nt, Homo sapiens
gaaccaccaaacuuguaua

SEQ ID NO: 26050 - RNA, 19 nt, Homo sapiens
uaacaccuguaaccagaau

SEQ ID NO: 26051 - RNA, 19 nt, Homo sapiens
gagaaggagcugcuggauu

SEQ ID NO: 26052 - RNA, 19 nt, Homo sapiens
gauaagcaucgaaugaguu

SEQ ID NO: 26053 - RNA, 19 nt, Homo sapiens
guacauggcagcacaagag

SEQ ID NO: 26054 - RNA, 19 nt, Homo sapiens
guucaaaguguaaacugua

SEQ ID NO: 26055 - RNA, 19 nt, Homo sapiens
ggaaaaucauuaccuugaa

SEQ ID NO: 26056 - RNA, 19 nt, Homo sapiens
gagcacacguggacagaac

SEQ ID NO: 26057 - RNA, 19 nt, Homo sapiens
agaugaagauggcuguuau

SEQ ID NO: 26058 - RNA, 19 nt, Homo sapiens
gaaguggagccgaagauag

SEQ ID NO: 26059 - RNA, 19 nt, Homo sapiens
ucaacgggauggacgaaga

SEQ ID NO: 26060 - RNA, 19 nt, Homo sapiens
gcaccaggcagaugucaau

SEQ ID NO: 26061 - RNA, 19 nt, Homo sapiens
gaacaagagcggacucacu

SEQ ID NO: 26062 - RNA, 19 nt, Homo sapiens
cggaaguggccaaauauuu

SEQ ID NO: 26063 - RNA, 19 nt, Homo sapiens
ucucccacaugcucuguua

SEQ ID NO: 26064 - RNA, 19 nt, Homo sapiens
cauaguccguguucaaagu

SEQ ID NO: 26065 - RNA, 19 nt, Homo sapiens
ggaaugaguuucagaauau

SEQ ID NO: 26066 - RNA, 19 nt, Homo sapiens
ggaaguggccaaauauuua

SEQ ID NO: 26067 - RNA, 19 nt, Homo sapiens
gaacaaagccaaagucaau

SEQ ID NO: 26068 - RNA, 19 nt, Homo sapiens
gaaagggucuccucucuca

SEQ ID NO: 26069 - RNA, 19 nt, Homo sapiens
agaaggagcugcuggauuu

SEQ ID NO: 26070 - RNA, 19 nt, Homo sapiens
gggaaugaguuucagaaua

SEQ ID NO: 26071 - RNA, 19 nt, Homo sapiens
cggaugagcuugucacuaa

SEQ ID NO: 26072 - RNA, 19 nt, Homo sapiens
gaaaucaguuuaacaccuu

SEQ ID NO: 26073 - RNA, 19 nt, Homo sapiens
gaaggaaugucccuguuug

SEQ ID NO: 26074 - RNA, 19 nt, Homo sapiens
gaacaaguaccaugacuga

SEQ ID NO: 26075 - RNA, 19 nt, Homo sapiens
gcaauacgacgcagagaua

SEQ ID NO: 26076 - RNA, 19 nt, Homo sapiens
acacggaaguggccaaaua

SEQ ID NO: 26077 - RNA, 19 nt, Homo sapiens
gggaagaacucaucagcuu

SEQ ID NO: 26078 - RNA, 19 nt, Homo sapiens
gcaaaccaauagaaacauu

SEQ ID NO: 26079 - RNA, 19 nt, Homo sapiens
caaggugguucgacagaua

SEQ ID NO: 26080 - RNA, 19 nt, Homo sapiens
gcaaggcgaugaaguacga

SEQ ID NO: 26081 - RNA, 19 nt, Homo sapiens
gcacagcccugccuggaau

SEQ ID NO: 26082 - RNA, 19 nt, Homo sapiens
ggagagagagggauagaaa

SEQ ID NO: 26083 - RNA, 19 nt, Homo sapiens
cgacagagccgcaacuuga

SEQ ID NO: 26084 - RNA, 19 nt, Homo sapiens
gcaggcaucuaaagaguau

SEQ ID NO: 26085 - RNA, 19 nt, Homo sapiens
cgaaugaguuucccugaga

SEQ ID NO: 26086 - RNA, 19 nt, Homo sapiens
gcaagaugcugcacaaggu

SEQ ID NO: 26087 - RNA, 19 nt, Homo sapiens
ggacagagcaggcagagau

SEQ ID NO: 26088 - RNA, 19 nt, Homo sapiens
ccaaauauuuacuccagaa

SEQ ID NO: 26089 - RNA, 19 nt, Homo sapiens
gaguagggcuagugaaugu

SEQ ID NO: 26090 - RNA, 19 nt, Homo sapiens
caaugucucugccagguuu

SEQ ID NO: 26091 - RNA, 19 nt, Homo sapiens
gcaucuggcuucuaaggaa

SEQ ID NO: 26092 - RNA, 19 nt, Homo sapiens
guaaucagccuuguguaua

SEQ ID NO: 26093 - RNA, 19 nt, Homo sapiens
gauacagcauucucaguga

SEQ ID NO: 26094 - RNA, 19 nt, Homo sapiens
caugacagaugauaaagug

SEQ ID NO: 26095 - RNA, 19 nt, Homo sapiens
ccaccaaacuuguauaugc

SEQ ID NO: 26096 - RNA, 19 nt, Homo sapiens
caacgucaaugcccaguca

SEQ ID NO: 26097 - RNA, 19 nt, Homo sapiens
gcuugcaucuggcuucuaa

SEQ ID NO: 26098 - RNA, 19 nt, Homo sapiens
gcaacauugucaccaagaa

SEQ ID NO: 26099 - RNA, 19 nt, Homo sapiens
gagcaggcaucuaaagagu

SEQ ID NO: 26100 - RNA, 19 nt, Homo sapiens
ccagggauguugaugaaga

SEQ ID NO: 26101 - RNA, 19 nt, Homo sapiens
uaaggaaggccaugugaaa

SEQ ID NO: 26102 - RNA, 19 nt, Homo sapiens
ggaaugggguagauauuaa

SEQ ID NO: 26103 - RNA, 19 nt, Homo sapiens
uaaucagccuuguguauau

SEQ ID NO: 26104 - RNA, 19 nt, Homo sapiens
gcaccagcauguccauaga

SEQ ID NO: 26105 - RNA, 19 nt, Homo sapiens
ggaaggaaugucccuguuu

SEQ ID NO: 26106 - RNA, 19 nt, Homo sapiens
ggacauagagguguuggaa

SEQ ID NO: 26107 - RNA, 19 nt, Homo sapiens
uggaggagcuagagaagaa

SEQ ID NO: 26108 - RNA, 19 nt, Homo sapiens
gaaaugggcacgugcgaau

SEQ ID NO: 26109 - RNA, 19 nt, Homo sapiens
gagaugaagauggcuguua

SEQ ID NO: 26110 - RNA, 19 nt, Homo sapiens
cagaugugcugaucaaaca

SEQ ID NO: 26111 - RNA, 19 nt, Homo sapiens
aaauggagcuaaccagaau

SEQ ID NO: 26112 - RNA, 19 nt, Homo sapiens
ggucgauauugauuacuuu

SEQ ID NO: 26113 - RNA, 19 nt, Homo sapiens
ggaggucgauauugauuac

SEQ ID NO: 26114 - RNA, 19 nt, Homo sapiens
gaggucagcucggauggaa

SEQ ID NO: 26115 - RNA, 19 nt, Homo sapiens
acaucaagcuggugaaguu

SEQ ID NO: 26116 - RNA, 19 nt, Homo sapiens
guuagggacuuaagaaucu

SEQ ID NO: 26117 - RNA, 19 nt, Homo sapiens
cugaagcuguggauaaauu

SEQ ID NO: 26118 - RNA, 19 nt, Homo sapiens
ggaaguggagccgaagaua

SEQ ID NO: 26119 - RNA, 19 nt, Homo sapiens
gcagggacauagagguguu

SEQ ID NO: 26120 - RNA, 19 nt, Homo sapiens
gagaccaccucgacugugu

SEQ ID NO: 26121 - RNA, 19 nt, Homo sapiens
ggagaggagucaggacaga

SEQ ID NO: 26122 - RNA, 19 nt, Homo sapiens
ucauggagcugcugcugaa

SEQ ID NO: 26123 - RNA, 19 nt, Homo sapiens
guaagggacuccugcuagu

SEQ ID NO: 26124 - RNA, 19 nt, Homo sapiens
gcuacugcaugacagauga

SEQ ID NO: 26125 - RNA, 19 nt, Homo sapiens
gagaaugccgucaccaaga

SEQ ID NO: 26126 - RNA, 19 nt, Homo sapiens
gaggagccagcgucaauuu

SEQ ID NO: 26127 - RNA, 19 nt, Homo sapiens
uccgggagcuugucaacua

SEQ ID NO: 26128 - RNA, 19 nt, Homo sapiens
auaaagaaauggacuaagg

SEQ ID NO: 26129 - RNA, 19 nt, Homo sapiens
ggaggagccuuaaguucca

SEQ ID NO: 26130 - RNA, 19 nt, Homo sapiens
ccagaucgcucuacaugac

SEQ ID NO: 26131 - RNA, 19 nt, Homo sapiens
ggccaaauucgucaucuuu

SEQ ID NO: 26132 - RNA, 19 nt, Homo sapiens
acacagacaucgugacucu

SEQ ID NO: 26133 - RNA, 19 nt, Homo sapiens
ucgcgcaccucaucaacua

SEQ ID NO: 26134 - RNA, 19 nt, Homo sapiens
ccacccugcuguacaaaga

SEQ ID NO: 26135 - RNA, 19 nt, Homo sapiens
gagaggaagucgccacaac

SEQ ID NO: 26136 - RNA, 19 nt, Homo sapiens
ccacguggccuccuucaug

SEQ ID NO: 26137 - RNA, 19 nt, Homo sapiens
gaacacggcccugcacauc

SEQ ID NO: 26138 - RNA, 19 nt, Homo sapiens
ccacucgccuccacugaau

SEQ ID NO: 26139 - RNA, 19 nt, Homo sapiens
gagcagggcaacauuguca

SEQ ID NO: 26140 - RNA, 19 nt, Homo sapiens
gaaccaccaaacuuguaua

SEQ ID NO: 26141 - RNA, 19 nt, Homo sapiens
gagaaggagcugcuggauu

SEQ ID NO: 26142 - RNA, 19 nt, Homo sapiens
gauaagcaucgaaugaguu

SEQ ID NO: 26143 - RNA, 19 nt, Homo sapiens
uaacaccuguaaccagaau

SEQ ID NO: 26144 - RNA, 19 nt, Homo sapiens
guacauggcagcacaagag

SEQ ID NO: 26145 - RNA, 19 nt, Homo sapiens
guucaaaguguaaacugua

SEQ ID NO: 26146 - RNA, 19 nt, Homo sapiens
ggaaaaucauuaccuugaa

SEQ ID NO: 26147 - RNA, 19 nt, Homo sapiens
gagcacacguggacagaac

SEQ ID NO: 26148 - RNA, 19 nt, Homo sapiens
agaugaagauggcuguuau

SEQ ID NO: 26149 - RNA, 19 nt, Homo sapiens
gaaguggagccgaagauag

SEQ ID NO: 26150 - RNA, 19 nt, Homo sapiens
ucaacgggauggacgaaga

SEQ ID NO: 26151 - RNA, 19 nt, Homo sapiens
gcaccaggcagaugucaau

SEQ ID NO: 26152 - RNA, 19 nt, Homo sapiens
gaacaagagcggacucacu

SEQ ID NO: 26153 - RNA, 19 nt, Homo sapiens
cggaaguggccaaauauuu

SEQ ID NO: 26154 - RNA, 19 nt, Homo sapiens
ucucccacaugcucuguua

SEQ ID NO: 26155 - RNA, 19 nt, Homo sapiens
cauaguccguguucaaagu

SEQ ID NO: 26156 - RNA, 19 nt, Homo sapiens
gcacaggagccgcuaugga

SEQ ID NO: 26157 - RNA, 19 nt, Homo sapiens
gcagcaagaucagguaacu

SEQ ID NO: 26158 - RNA, 19 nt, Homo sapiens
ugagacaguugaugagauc

SEQ ID NO: 26159 - RNA, 19 nt, Homo sapiens
acacaaacauggugaagcu

SEQ ID NO: 26160 - RNA, 19 nt, Homo sapiens
gaauguagccacagaagac

SEQ ID NO: 26161 - RNA, 19 nt, Homo sapiens
gaaaggaguagggcuagug

SEQ ID NO: 26162 - RNA, 19 nt, Homo sapiens
caacccacauaccuccauu

SEQ ID NO: 26163 - RNA, 19 nt, Homo sapiens
gagcccagauagaaaccaa

SEQ ID NO: 26164 - RNA, 19 nt, Homo sapiens
gcacauugcggcucacuac

SEQ ID NO: 26165 - RNA, 19 nt, Homo sapiens
ggaaugaguuucagaauau

SEQ ID NO: 26166 - RNA, 19 nt, Homo sapiens
gggaaugaguuucagaaua

SEQ ID NO: 26167 - RNA, 19 nt, Homo sapiens
caaggugguucgacagaua

SEQ ID NO: 26168 - RNA, 19 nt, Homo sapiens
ggagagagagggauagaaa

SEQ ID NO: 26169 - RNA, 19 nt, Homo sapiens
gcaacauugucaccaagaa

SEQ ID NO: 26170 - RNA, 19 nt, Homo sapiens
caagagagcaaaccagaga

SEQ ID NO: 26171 - RNA, 19 nt, Homo sapiens
guaagggacuccugcuagu

SEQ ID NO: 26172 - RNA, 19 nt, Homo sapiens
gagcagggcaacauuguca

SEQ ID NO: 26173 - RNA, 19 nt, Homo sapiens
cagagagaguaaacaguga

SEQ ID NO: 26174 - RNA, 19 nt, Homo sapiens
gagaguaaacagugagaga

SEQ ID NO: 26175 - RNA, 19 nt, Homo sapiens
gagcaaaccagagagauag

SEQ ID NO: 26176 - RNA, 19 nt, Homo sapiens
gcaaggugguucgacagau

SEQ ID NO: 26177 - RNA, 19 nt, Homo sapiens
ggggauggguuuugguuuu

SEQ ID NO: 26178 - RNA, 19 nt, Homo sapiens
gaugagcagggcaacauug

SEQ ID NO: 26179 - RNA, 19 nt, Homo sapiens
gcgaggauguggacuuucg

SEQ ID NO: 26180 - RNA, 19 nt, Homo sapiens
agagcaaaccagagagaua

SEQ ID NO: 26181 - RNA, 19 nt, Homo sapiens
gagagggaguggccuacag

SEQ ID NO: 26182 - RNA, 19 nt, Homo sapiens
aauccugccucuugcaaug

SEQ ID NO: 26183 - RNA, 19 nt, Homo sapiens
augaaugacugacuguaga

SEQ ID NO: 26184 - RNA, 19 nt, Homo sapiens
gcuucaauccugccucuug

SEQ ID NO: 26185 - RNA, 19 nt, Homo sapiens
aggcgaggauguggacuuu

SEQ ID NO: 26186 - RNA, 19 nt, Homo sapiens
ccacagagagaguaaacag

SEQ ID NO: 26187 - RNA, 19 nt, Homo sapiens
ggaugagcagggcaacauu

SEQ ID NO: 26188 - RNA, 19 nt, Homo sapiens
gaacgugaugcacauuguc

SEQ ID NO: 26189 - RNA, 19 nt, Homo sapiens
agaacgugaugcacauugu

SEQ ID NO: 26190 - RNA, 19 nt, Homo sapiens
guaaacagugagagaccaa

SEQ ID NO: 26191 - RNA, 19 nt, Homo sapiens
gcaugaaugacugacugua

SEQ ID NO: 26192 - RNA, 19 nt, Homo sapiens
gagagaguaaacagugaga

SEQ ID NO: 26193 - RNA, 19 nt, Homo sapiens
gacggcaugaccucuguaa

SEQ ID NO: 26194 - RNA, 19 nt, Homo sapiens
ugagagaccaagagagcaa

SEQ ID NO: 26195 - RNA, 19 nt, Homo sapiens
gucagaacgugaugcacau

SEQ ID NO: 26196 - RNA, 19 nt, Homo sapiens
caugaaugacugacuguag

SEQ ID NO: 26197 - RNA, 19 nt, Homo sapiens
caacauugucaccaagaag

SEQ ID NO: 26198 - RNA, 19 nt, Homo sapiens
aggagcaauucacggauga

SEQ ID NO: 26199 - RNA, 19 nt, Homo sapiens
ggugacagaggagcaauuc

SEQ ID NO: 26200 - RNA, 19 nt, Homo sapiens
aaacagugagagaccaaga

SEQ ID NO: 26201 - RNA, 19 nt, Homo sapiens
ccuacagccggaccugaua

SEQ ID NO: 26202 - RNA, 19 nt, Homo sapiens
gggucccaguggagaauga

SEQ ID NO: 26203 - RNA, 19 nt, Homo sapiens
ucccugugcuuugugcuaa

SEQ ID NO: 26204 - RNA, 19 nt, Homo sapiens
cagaacgugaugcacauug

SEQ ID NO: 26205 - RNA, 19 nt, Homo sapiens
ggacacaaaagcagcaaga

SEQ ID NO: 26206 - RNA, 19 nt, Homo sapiens
cggcaugaccucuguaagg

SEQ ID NO: 26207 - RNA, 19 nt, Homo sapiens
gucggaaccaggacacaaa

SEQ ID NO: 26208 - RNA, 19 nt, Homo sapiens
gaggcgaggauguggacuu

SEQ ID NO: 26209 - RNA, 19 nt, Homo sapiens
uucccaaccucaucuguca

SEQ ID NO: 26210 - RNA, 19 nt, Homo sapiens
gcaggugacagaggagcaa

SEQ ID NO: 26211 - RNA, 19 nt, Homo sapiens
gagagaccaagagagcaaa

SEQ ID NO: 26212 - RNA, 19 nt, Homo sapiens
ggaaugaguuucagaauau

SEQ ID NO: 26213 - RNA, 19 nt, Homo sapiens
gggaaugaguuucagaaua

SEQ ID NO: 26214 - RNA, 19 nt, Homo sapiens
ggagagagagggauagaaa

SEQ ID NO: 26215 - RNA, 19 nt, Homo sapiens
gcaacauugucaccaagaa

SEQ ID NO: 26216 - RNA, 19 nt, Homo sapiens
caagagagcaaaccagaga

SEQ ID NO: 26217 - RNA, 19 nt, Homo sapiens
guaagggacuccugcuagu

SEQ ID NO: 26218 - RNA, 19 nt, Homo sapiens
gagcagggcaacauuguca

SEQ ID NO: 26219 - RNA, 19 nt, Homo sapiens
cagagagaguaaacaguga

SEQ ID NO: 26220 - RNA, 19 nt, Homo sapiens
gagaguaaacagugagaga

SEQ ID NO: 26221 - RNA, 19 nt, Homo sapiens
gagcaaaccagagagauag

SEQ ID NO: 26222 - RNA, 19 nt, Homo sapiens
ggggauggguuuugguuuu

SEQ ID NO: 26223 - RNA, 19 nt, Homo sapiens
gaugagcagggcaacauug

SEQ ID NO: 26224 - RNA, 19 nt, Homo sapiens
gcgaggauguggacuuucg

SEQ ID NO: 26225 - RNA, 19 nt, Homo sapiens
agagcaaaccagagagaua

SEQ ID NO: 26226 - RNA, 19 nt, Homo sapiens
gagagggaguggccuacag

SEQ ID NO: 26227 - RNA, 19 nt, Homo sapiens
aauccugccucuugcaaug

SEQ ID NO: 26228 - RNA, 19 nt, Homo sapiens
augaaugacugacuguaga

SEQ ID NO: 26229 - RNA, 19 nt, Homo sapiens
gcuucaauccugccucuug

SEQ ID NO: 26230 - RNA, 19 nt, Homo sapiens
aggcgaggauguggacuuu

SEQ ID NO: 26231 - RNA, 19 nt, Homo sapiens
ggaugagcagggcaacauu

SEQ ID NO: 26232 - RNA, 19 nt, Homo sapiens
gaacgugaugcacauuguc

SEQ ID NO: 26233 - RNA, 19 nt, Homo sapiens
agaacgugaugcacauugu

SEQ ID NO: 26234 - RNA, 19 nt, Homo sapiens
ccacagagagaguaaacag

SEQ ID NO: 26235 - RNA, 19 nt, Homo sapiens
gcaugaaugacugacugua

SEQ ID NO: 26236 - RNA, 19 nt, Homo sapiens
guaaacagugagagaccaa

SEQ ID NO: 26237 - RNA, 19 nt, Homo sapiens
gagagaguaaacagugaga

SEQ ID NO: 26238 - RNA, 19 nt, Homo sapiens
gacggcaugaccucuguaa

SEQ ID NO: 26239 - RNA, 19 nt, Homo sapiens
ugagagaccaagagagcaa

SEQ ID NO: 26240 - RNA, 19 nt, Homo sapiens
gucagaacgugaugcacau

SEQ ID NO: 26241 - RNA, 19 nt, Homo sapiens
caugaaugacugacuguag

SEQ ID NO: 26242 - RNA, 19 nt, Homo sapiens
caacauugucaccaagaag

SEQ ID NO: 26243 - RNA, 19 nt, Homo sapiens
aggagcaauucacggauga

SEQ ID NO: 26244 - RNA, 19 nt, Homo sapiens
ggugacagaggagcaauuc

SEQ ID NO: 26245 - RNA, 19 nt, Homo sapiens
ccuacagccggaccugaua

SEQ ID NO: 26246 - RNA, 19 nt, Homo sapiens
aaacagugagagaccaaga

SEQ ID NO: 26247 - RNA, 19 nt, Homo sapiens
ucccugugcuuugugcuaa

SEQ ID NO: 26248 - RNA, 19 nt, Homo sapiens
cagaacgugaugcacauug

SEQ ID NO: 26249 - RNA, 19 nt, Homo sapiens
gggucccaguggagaauga

SEQ ID NO: 26250 - RNA, 19 nt, Homo sapiens
ggacacaaaagcagcaaga

SEQ ID NO: 26251 - RNA, 19 nt, Homo sapiens
cggcaugaccucuguaagg

SEQ ID NO: 26252 - RNA, 19 nt, Homo sapiens
gucggaaccaggacacaaa

SEQ ID NO: 26253 - RNA, 19 nt, Homo sapiens
caagaagguggagcugaga

SEQ ID NO: 26254 - RNA, 19 nt, Homo sapiens
gaggcgaggauguggacuu

SEQ ID NO: 26255 - RNA, 19 nt, Homo sapiens
uucccaaccucaucuguca

SEQ ID NO: 26256 - RNA, 19 nt, Homo sapiens
gagagaccaagagagcaaa

SEQ ID NO: 26257 - RNA, 19 nt, Homo sapiens
gcaggugacagaggagcaa

SEQ ID NO: 26258 - RNA, 19 nt, Homo sapiens
ggaaugaguuucagaauau

SEQ ID NO: 26259 - RNA, 19 nt, Homo sapiens
gggaaugaguuucagaaua

SEQ ID NO: 26260 - RNA, 19 nt, Homo sapiens
ggagagagagggauagaaa

SEQ ID NO: 26261 - RNA, 19 nt, Homo sapiens
gcaacauugucaccaagaa

SEQ ID NO: 26262 - RNA, 19 nt, Homo sapiens
caagagagcaaaccagaga

SEQ ID NO: 26263 - RNA, 19 nt, Homo sapiens
guaagggacuccugcuagu

SEQ ID NO: 26264 - RNA, 19 nt, Homo sapiens
gagcagggcaacauuguca

SEQ ID NO: 26265 - RNA, 19 nt, Homo sapiens
cagagagaguaaacaguga

SEQ ID NO: 26266 - RNA, 19 nt, Homo sapiens
gagaguaaacagugagaga

SEQ ID NO: 26267 - RNA, 19 nt, Homo sapiens
gagcaaaccagagagauag

SEQ ID NO: 26268 - RNA, 19 nt, Homo sapiens
ggggauggguuuugguuuu

SEQ ID NO: 26269 - RNA, 19 nt, Homo sapiens
gaugagcagggcaacauug

SEQ ID NO: 26270 - RNA, 19 nt, Homo sapiens
gcgaggauguggacuuucg

SEQ ID NO: 26271 - RNA, 19 nt, Homo sapiens
agagcaaaccagagagaua

SEQ ID NO: 26272 - RNA, 19 nt, Homo sapiens
aauccugccucuugcaaug

SEQ ID NO: 26273 - RNA, 19 nt, Homo sapiens
augaaugacugacuguaga

SEQ ID NO: 26274 - RNA, 19 nt, Homo sapiens
gcuucaauccugccucuug

SEQ ID NO: 26275 - RNA, 19 nt, Homo sapiens
aggcgaggauguggacuuu

SEQ ID NO: 26276 - RNA, 19 nt, Homo sapiens
ggaugagcagggcaacauu

SEQ ID NO: 26277 - RNA, 19 nt, Homo sapiens
gaacgugaugcacauuguc

SEQ ID NO: 26278 - RNA, 19 nt, Homo sapiens
agaacgugaugcacauugu

SEQ ID NO: 26279 - RNA, 19 nt, Homo sapiens
ccacagagagaguaaacag

SEQ ID NO: 26280 - RNA, 19 nt, Homo sapiens
gcaugaaugacugacugua

SEQ ID NO: 26281 - RNA, 19 nt, Homo sapiens
guaaacagugagagaccaa

SEQ ID NO: 26282 - RNA, 19 nt, Homo sapiens
gagagaguaaacagugaga

SEQ ID NO: 26283 - RNA, 19 nt, Homo sapiens
ugagagaccaagagagcaa

SEQ ID NO: 26284 - RNA, 19 nt, Homo sapiens
gacggcaugaccucuguaa

SEQ ID NO: 26285 - RNA, 19 nt, Homo sapiens
gucagaacgugaugcacau

SEQ ID NO: 26286 - RNA, 19 nt, Homo sapiens
caugaaugacugacuguag

SEQ ID NO: 26287 - RNA, 19 nt, Homo sapiens
caacauugucaccaagaag

SEQ ID NO: 26288 - RNA, 19 nt, Homo sapiens
aggagcaauucacggauga

SEQ ID NO: 26289 - RNA, 19 nt, Homo sapiens
ggugacagaggagcaauuc

SEQ ID NO: 26290 - RNA, 19 nt, Homo sapiens
ucccugugcuuugugcuaa

SEQ ID NO: 26291 - RNA, 19 nt, Homo sapiens
aaacagugagagaccaaga

SEQ ID NO: 26292 - RNA, 19 nt, Homo sapiens
cagaacgugaugcacauug

SEQ ID NO: 26293 - RNA, 19 nt, Homo sapiens
gggucccaguggagaauga

SEQ ID NO: 26294 - RNA, 19 nt, Homo sapiens
ggacacaaaagcagcaaga

SEQ ID NO: 26295 - RNA, 19 nt, Homo sapiens
cggcaugaccucuguaagg

SEQ ID NO: 26296 - RNA, 19 nt, Homo sapiens
gucggaaccaggacacaaa

SEQ ID NO: 26297 - RNA, 19 nt, Homo sapiens
gaggcgaggauguggacuu

SEQ ID NO: 26298 - RNA, 19 nt, Homo sapiens
uucccaaccucaucuguca

SEQ ID NO: 26299 - RNA, 19 nt, Homo sapiens
gagagaccaagagagcaaa

SEQ ID NO: 26300 - RNA, 19 nt, Homo sapiens
gcaggugacagaggagcaa

SEQ ID NO: 26301 - RNA, 19 nt, Homo sapiens
ggagagagagggauagaaa

SEQ ID NO: 26302 - RNA, 19 nt, Homo sapiens
caagagagcaaaccagaga

SEQ ID NO: 26303 - RNA, 19 nt, Homo sapiens
guaagggacuccugcuagu

SEQ ID NO: 26304 - RNA, 19 nt, Homo sapiens
cagagagaguaaacaguga

SEQ ID NO: 26305 - RNA, 19 nt, Homo sapiens
gagaguaaacagugagaga

SEQ ID NO: 26306 - RNA, 19 nt, Homo sapiens
gagcaaaccagagagauag

SEQ ID NO: 26307 - RNA, 19 nt, Homo sapiens
ggggauggguuuugguuuu

SEQ ID NO: 26308 - RNA, 19 nt, Homo sapiens
gcgaggauguggacuuucg

SEQ ID NO: 26309 - RNA, 19 nt, Homo sapiens
agagcaaaccagagagaua

SEQ ID NO: 26310 - RNA, 19 nt, Homo sapiens
gagagggaguggccuacag

SEQ ID NO: 26311 - RNA, 19 nt, Homo sapiens
aauccugccucuugcaaug

SEQ ID NO: 26312 - RNA, 19 nt, Homo sapiens
augaaugacugacuguaga

SEQ ID NO: 26313 - RNA, 19 nt, Homo sapiens
gcuucaauccugccucuug

SEQ ID NO: 26314 - RNA, 19 nt, Homo sapiens
aggcgaggauguggacuuu

SEQ ID NO: 26315 - RNA, 19 nt, Homo sapiens
gaacgugaugcacauuguc

SEQ ID NO: 26316 - RNA, 19 nt, Homo sapiens
agaacgugaugcacauugu

SEQ ID NO: 26317 - RNA, 19 nt, Homo sapiens
ccacagagagaguaaacag

SEQ ID NO: 26318 - RNA, 19 nt, Homo sapiens
gcaugaaugacugacugua

SEQ ID NO: 26319 - RNA, 19 nt, Homo sapiens
guaaacagugagagaccaa

SEQ ID NO: 26320 - RNA, 19 nt, Homo sapiens
gagagaguaaacagugaga

SEQ ID NO: 26321 - RNA, 19 nt, Homo sapiens
gacggcaugaccucuguaa

SEQ ID NO: 26322 - RNA, 19 nt, Homo sapiens
ugagagaccaagagagcaa

SEQ ID NO: 26323 - RNA, 19 nt, Homo sapiens
gucagaacgugaugcacau

SEQ ID NO: 26324 - RNA, 19 nt, Homo sapiens
caugaaugacugacuguag

SEQ ID NO: 26325 - RNA, 19 nt, Homo sapiens
ccuacagccggaccugaua

SEQ ID NO: 26326 - RNA, 19 nt, Homo sapiens
ucccugugcuuugugcuaa

SEQ ID NO: 26327 - RNA, 19 nt, Homo sapiens
cagaacgugaugcacauug

SEQ ID NO: 26328 - RNA, 19 nt, Homo sapiens
aaacagugagagaccaaga

SEQ ID NO: 26329 - RNA, 19 nt, Homo sapiens
gggucccaguggagaauga

SEQ ID NO: 26330 - RNA, 19 nt, Homo sapiens
ggacacaaaagcagcaaga

SEQ ID NO: 26331 - RNA, 19 nt, Homo sapiens
cggcaugaccucuguaagg

SEQ ID NO: 26332 - RNA, 19 nt, Homo sapiens
gucggaaccaggacacaaa

SEQ ID NO: 26333 - RNA, 19 nt, Homo sapiens
gaggcgaggauguggacuu

SEQ ID NO: 26334 - RNA, 19 nt, Homo sapiens
uucccaaccucaucuguca

SEQ ID NO: 26335 - RNA, 19 nt, Homo sapiens
gagagaccaagagagcaaa

SEQ ID NO: 26336 - RNA, 19 nt, Homo sapiens
gaaaguaccuugugggaaa

SEQ ID NO: 26337 - RNA, 19 nt, Homo sapiens
gaacagacaccuuuacaua

SEQ ID NO: 26338 - RNA, 19 nt, Homo sapiens
gcacauagcugcacauuac

SEQ ID NO: 26339 - RNA, 19 nt, Homo sapiens
gagaagagcuugauguuuc

SEQ ID NO: 26340 - RNA, 19 nt, Homo sapiens
gaagucagcuaugagguua

SEQ ID NO: 26341 - RNA, 19 nt, Homo sapiens
agagaaagcugaacuuaaa

SEQ ID NO: 26342 - RNA, 19 nt, Homo sapiens
ugaugaggcuuccaaauua

SEQ ID NO: 26343 - RNA, 19 nt, Homo sapiens
ggaagacgaugaagccuuu

SEQ ID NO: 26344 - RNA, 19 nt, Homo sapiens
uaaagaagguuacuaggaa

SEQ ID NO: 26345 - RNA, 19 nt, Homo sapiens
ggagcaagcuguuucuaaa

SEQ ID NO: 26346 - RNA, 19 nt, Homo sapiens
gagaaacacucaccuguau

SEQ ID NO: 26347 - RNA, 19 nt, Homo sapiens
gagcaaauguuaacgcaaa

SEQ ID NO: 26348 - RNA, 19 nt, Homo sapiens
caaacucccugucaaagua

SEQ ID NO: 26349 - RNA, 19 nt, Homo sapiens
caacuuaacucccaaaugg

SEQ ID NO: 26350 - RNA, 19 nt, Homo sapiens
gaaauuaucugcguaccuu

SEQ ID NO: 26351 - RNA, 19 nt, Homo sapiens
gaaagacacccaccuguuu

SEQ ID NO: 26352 - RNA, 19 nt, Homo sapiens
gaaaggcacucuccugugu

SEQ ID NO: 26353 - RNA, 19 nt, Homo sapiens
gaaauugaacagaccauua

SEQ ID NO: 26354 - RNA, 19 nt, Homo sapiens
gaacuacgccauuaacauu

SEQ ID NO: 26355 - RNA, 19 nt, Homo sapiens
gaagaaagccacagagaga

SEQ ID NO: 26356 - RNA, 19 nt, Homo sapiens
gaagaggaauggguuauug

SEQ ID NO: 26357 - RNA, 19 nt, Homo sapiens
gcaaagucaucaucacaaa

SEQ ID NO: 26358 - RNA, 19 nt, Homo sapiens
ucucaagacucauccauua

SEQ ID NO: 26359 - RNA, 19 nt, Homo sapiens
gaugaaggcuuuccaguca

SEQ ID NO: 26360 - RNA, 19 nt, Homo sapiens
ggccacaucuccuuugaua

SEQ ID NO: 26361 - RNA, 19 nt, Homo sapiens
gaagaagaauacauugaug

SEQ ID NO: 26362 - RNA, 19 nt, Homo sapiens
gacaucagcugaaucacua

SEQ ID NO: 26363 - RNA, 19 nt, Homo sapiens
gauaaggcagguucuauua

SEQ ID NO: 26364 - RNA, 19 nt, Homo sapiens
gaagauaaagugaauguug

SEQ ID NO: 26365 - RNA, 19 nt, Homo sapiens
gaacagaaaucaguaaucg

SEQ ID NO: 26366 - RNA, 19 nt, Homo sapiens
gaacaaauaagcaaaguca

SEQ ID NO: 26367 - RNA, 19 nt, Homo sapiens
gaaugaagauacucaggaa

SEQ ID NO: 26368 - RNA, 19 nt, Homo sapiens
ugaccuaacuggccuaauu

SEQ ID NO: 26369 - RNA, 19 nt, Homo sapiens
guaaggagcauuucuuuga

SEQ ID NO: 26370 - RNA, 19 nt, Homo sapiens
aaacugauguggauucuga

SEQ ID NO: 26371 - RNA, 19 nt, Homo sapiens
agaaacaucuguccugaaa

SEQ ID NO: 26372 - RNA, 19 nt, Homo sapiens
acagugagcugguuaagaa

SEQ ID NO: 26373 - RNA, 19 nt, Homo sapiens
ggacagaauuagcaagaga

SEQ ID NO: 26374 - RNA, 19 nt, Homo sapiens
gcaccaaccuguaucaaca

SEQ ID NO: 26375 - RNA, 19 nt, Homo sapiens
ugaacuaccuuacugauga

SEQ ID NO: 26376 - RNA, 19 nt, Homo sapiens
aaagucaccugguuaauga

SEQ ID NO: 26377 - RNA, 19 nt, Homo sapiens
gcaccaaccuuaagauuac

SEQ ID NO: 26378 - RNA, 19 nt, Homo sapiens
ggaaguaucaguaauugaa

SEQ ID NO: 26379 - RNA, 19 nt, Homo sapiens
gaacagccagucaucuaua

SEQ ID NO: 26380 - RNA, 19 nt, Homo sapiens
ggaagacaaugacaaauac

SEQ ID NO: 26381 - RNA, 19 nt, Homo sapiens
uaaggcagguucuauuaaa

SEQ ID NO: 26382 - RNA, 19 nt, Homo sapiens
ggaaggagccaauauuaau

SEQ ID NO: 26383 - RNA, 19 nt, Homo sapiens
guaaagccaucacacagaa

SEQ ID NO: 26384 - RNA, 19 nt, Homo sapiens
caaugaauguguuuccuuu

SEQ ID NO: 26385 - RNA, 19 nt, Homo sapiens
caagugaugucauguugaa

SEQ ID NO: 26386 - RNA, 19 nt, Homo sapiens
gaauggcuauacuccguua

SEQ ID NO: 26387 - RNA, 19 nt, Homo sapiens
ccacaaugcugacguacaa

SEQ ID NO: 26388 - RNA, 19 nt, Homo sapiens
gcaaaucacaccacaaguu

SEQ ID NO: 26389 - RNA, 19 nt, Homo sapiens
gaaaggcacccuccaguau

SEQ ID NO: 26390 - RNA, 19 nt, Homo sapiens
ggccaaauuuguaguguuu

SEQ ID NO: 26391 - RNA, 19 nt, Homo sapiens
aaacgaaucugccgcauca

SEQ ID NO: 26392 - RNA, 19 nt, Homo sapiens
ccagagcccugaaugguuu

SEQ ID NO: 26393 - RNA, 19 nt, Homo sapiens
gcauggagcugaucaggau

SEQ ID NO: 26394 - RNA, 19 nt, Homo sapiens
cagaauggcuuuacuccuu

SEQ ID NO: 26395 - RNA, 19 nt, Homo sapiens
gaagagggcuguggugaag

SEQ ID NO: 26396 - RNA, 19 nt, Homo sapiens
uauaaagcguguuguauug

SEQ ID NO: 26397 - RNA, 19 nt, Homo sapiens
gcaagcaucgcaccagaua

SEQ ID NO: 26398 - RNA, 19 nt, Homo sapiens
gaaaugcucagaugaacaa

SEQ ID NO: 26399 - RNA, 19 nt, Homo sapiens
gaauggauauuguucaucu

SEQ ID NO: 26400 - RNA, 19 nt, Homo sapiens
gaaaggcuggcuuauauug

SEQ ID NO: 26401 - RNA, 19 nt, Homo sapiens
caagaagucugacagcaau

SEQ ID NO: 26402 - RNA, 19 nt, Homo sapiens
gaggaagguuuacaagcua

SEQ ID NO: 26403 - RNA, 19 nt, Homo sapiens
ggugaaggcugcugaggaa

SEQ ID NO: 26404 - RNA, 19 nt, Homo sapiens
ugacugagguucuugaugu

SEQ ID NO: 26405 - RNA, 19 nt, Homo sapiens
gaagguggcgcugcuguua

SEQ ID NO: 26406 - RNA, 19 nt, Homo sapiens
acagacaccuuuacauauu

SEQ ID NO: 26407 - RNA, 19 nt, Homo sapiens
gaaaauccauugaucagaa

SEQ ID NO: 26408 - RNA, 19 nt, Homo sapiens
caagacaccugaggaaguu

SEQ ID NO: 26409 - RNA, 19 nt, Homo sapiens
gagcauuucuuugaccuuu

SEQ ID NO: 26410 - RNA, 19 nt, Homo sapiens
gaccaaagauacuuacauc

SEQ ID NO: 26411 - RNA, 19 nt, Homo sapiens
gcagagaaagcugaacuua

SEQ ID NO: 26412 - RNA, 19 nt, Homo sapiens
gaaguuacacugagacaga

SEQ ID NO: 26413 - RNA, 19 nt, Homo sapiens
ugaaaucguugaaagaguu

SEQ ID NO: 26414 - RNA, 19 nt, Homo sapiens
gacagaaucuacagaaaca

SEQ ID NO: 26415 - RNA, 19 nt, Homo sapiens
ugacuacacugaagaugaa

SEQ ID NO: 26416 - RNA, 19 nt, Homo sapiens
ucaaaguucuuguuaagga

SEQ ID NO: 26417 - RNA, 19 nt, Homo sapiens
gugaaagacucgaugaaga

SEQ ID NO: 26418 - RNA, 19 nt, Homo sapiens
aggaaaggcuggcuuauau

SEQ ID NO: 26419 - RNA, 19 nt, Homo sapiens
ccacaaagacucucuggaa

SEQ ID NO: 26420 - RNA, 19 nt, Homo sapiens
agacaaacguccaccugua

SEQ ID NO: 26421 - RNA, 19 nt, Homo sapiens
ggaaauaccgcucuucaca

SEQ ID NO: 26422 - RNA, 19 nt, Homo sapiens
gcaguggugucucguauca

SEQ ID NO: 26423 - RNA, 19 nt, Homo sapiens
caacguggcucuuucuucu

SEQ ID NO: 26424 - RNA, 19 nt, Homo sapiens
gagaaauggugcccuuguu

SEQ ID NO: 26425 - RNA, 19 nt, Homo sapiens
gaauggcuuuacuccuuua

SEQ ID NO: 26426 - RNA, 19 nt, Homo sapiens
gaaagcaaauccaaaauuc

SEQ ID NO: 26427 - RNA, 19 nt, Homo sapiens
gaagaacagaaaucaguaa

SEQ ID NO: 26428 - RNA, 19 nt, Homo sapiens
gauauuugguuugauggua

SEQ ID NO: 26429 - RNA, 19 nt, Homo sapiens
caaaucacaccacaaguuu

SEQ ID NO: 26430 - RNA, 19 nt, Homo sapiens
ccacagaaauucguucaga

SEQ ID NO: 26431 - RNA, 19 nt, Homo sapiens
gaagaaacucccauugguu

SEQ ID NO: 26432 - RNA, 19 nt, Homo sapiens
gagacagaaucuacagaaa

SEQ ID NO: 26433 - RNA, 19 nt, Homo sapiens
gaacuggccaccuccauug

SEQ ID NO: 26434 - RNA, 19 nt, Homo sapiens
gcagcuuccuguuucagua

SEQ ID NO: 26435 - RNA, 19 nt, Homo sapiens
gucaugcacuguugaagua

SEQ ID NO: 26436 - RNA, 19 nt, Homo sapiens
gaacagacaccuuuacaua

SEQ ID NO: 26437 - RNA, 19 nt, Homo sapiens
gcacauagcugcacauuac

SEQ ID NO: 26438 - RNA, 19 nt, Homo sapiens
uaaagaagguuacuaggaa

SEQ ID NO: 26439 - RNA, 19 nt, Homo sapiens
ggagcaagcuguuucuaaa

SEQ ID NO: 26440 - RNA, 19 nt, Homo sapiens
gagcaaauguuaacgcaaa

SEQ ID NO: 26441 - RNA, 19 nt, Homo sapiens
gaaauuaucugcguaccuu

SEQ ID NO: 26442 - RNA, 19 nt, Homo sapiens
gaaauugaacagaccauua

SEQ ID NO: 26443 - RNA, 19 nt, Homo sapiens
gaacuacgccauuaacauu

SEQ ID NO: 26444 - RNA, 19 nt, Homo sapiens
gaagaagaauacauugaug

SEQ ID NO: 26445 - RNA, 19 nt, Homo sapiens
gaagauaaagugaauguug

SEQ ID NO: 26446 - RNA, 19 nt, Homo sapiens
ugaccuaacuggccuaauu

SEQ ID NO: 26447 - RNA, 19 nt, Homo sapiens
acagugagcugguuaagaa

SEQ ID NO: 26448 - RNA, 19 nt, Homo sapiens
ggacagaauuagcaagaga

SEQ ID NO: 26449 - RNA, 19 nt, Homo sapiens
gcaccaaccuuaagauuac

SEQ ID NO: 26450 - RNA, 19 nt, Homo sapiens
ggaaggagccaauauuaau

SEQ ID NO: 26451 - RNA, 19 nt, Homo sapiens
guaaagccaucacacagaa

SEQ ID NO: 26452 - RNA, 19 nt, Homo sapiens
caaugaauguguuuccuuu

SEQ ID NO: 26453 - RNA, 19 nt, Homo sapiens
caagugaugucauguugaa

SEQ ID NO: 26454 - RNA, 19 nt, Homo sapiens
gaauggcuauacuccguua

SEQ ID NO: 26455 - RNA, 19 nt, Homo sapiens
ccacaaugcugacguacaa

SEQ ID NO: 26456 - RNA, 19 nt, Homo sapiens
ggccaaauuuguaguguuu

SEQ ID NO: 26457 - RNA, 19 nt, Homo sapiens
aaacgaaucugccgcauca

SEQ ID NO: 26458 - RNA, 19 nt, Homo sapiens
ccagagcccugaaugguuu

SEQ ID NO: 26459 - RNA, 19 nt, Homo sapiens
gcauggagcugaucaggau

SEQ ID NO: 26460 - RNA, 19 nt, Homo sapiens
cagaauggcuuuacuccuu

SEQ ID NO: 26461 - RNA, 19 nt, Homo sapiens
gaagagggcuguggugaag

SEQ ID NO: 26462 - RNA, 19 nt, Homo sapiens
uauaaagcguguuguauug

SEQ ID NO: 26463 - RNA, 19 nt, Homo sapiens
gaaaugcucagaugaacaa

SEQ ID NO: 26464 - RNA, 19 nt, Homo sapiens
gaauggauauuguucaucu

SEQ ID NO: 26465 - RNA, 19 nt, Homo sapiens
gaaaggcuggcuuauauug

SEQ ID NO: 26466 - RNA, 19 nt, Homo sapiens
ugacugagguucuugaugu

SEQ ID NO: 26467 - RNA, 19 nt, Homo sapiens
gaagguggcgcugcuguua

SEQ ID NO: 26468 - RNA, 19 nt, Homo sapiens
caagaagucugacagcaau

SEQ ID NO: 26469 - RNA, 19 nt, Homo sapiens
acagacaccuuuacauauu

SEQ ID NO: 26470 - RNA, 19 nt, Homo sapiens
gaaaauccauugaucagaa

SEQ ID NO: 26471 - RNA, 19 nt, Homo sapiens
caagacaccugaggaaguu

SEQ ID NO: 26472 - RNA, 19 nt, Homo sapiens
ugacuacacugaagaugaa

SEQ ID NO: 26473 - RNA, 19 nt, Homo sapiens
ucaaaguucuuguuaagga

SEQ ID NO: 26474 - RNA, 19 nt, Homo sapiens
gugaaagacucgaugaaga

SEQ ID NO: 26475 - RNA, 19 nt, Homo sapiens
aggaaaggcuggcuuauau

SEQ ID NO: 26476 - RNA, 19 nt, Homo sapiens
gcaguggugucucguauca

SEQ ID NO: 26477 - RNA, 19 nt, Homo sapiens
caacguggcucuuucuucu

SEQ ID NO: 26478 - RNA, 19 nt, Homo sapiens
gagaaauggugcccuuguu

SEQ ID NO: 26479 - RNA, 19 nt, Homo sapiens
gaauggcuuuacuccuuua

SEQ ID NO: 26480 - RNA, 19 nt, Homo sapiens
ggaaauaccgcucuucaca

SEQ ID NO: 26481 - RNA, 19 nt, Homo sapiens
gaacuggccaccuccauug

SEQ ID NO: 26482 - RNA, 19 nt, Homo sapiens
gcagcuuccuguuucagua

SEQ ID NO: 26483 - RNA, 19 nt, Homo sapiens
gucaugcacuguugaagua

SEQ ID NO: 26484 - RNA, 19 nt, Homo sapiens
gaggaaaggcuggcuuaua

SEQ ID NO: 26485 - RNA, 19 nt, Homo sapiens
caagcuauuugcaacuuaa

SEQ ID NO: 26486 - RNA, 19 nt, Homo sapiens
ucacaaguauacagagaaa

SEQ ID NO: 26487 - RNA, 19 nt, Homo sapiens
uggaacugcuggugaaaua

SEQ ID NO: 26488 - RNA, 19 nt, Homo sapiens
aaauaccgcucuucacauu

SEQ ID NO: 26489 - RNA, 19 nt, Homo sapiens
ggauggcuauuccaaaguu

SEQ ID NO: 26490 - RNA, 19 nt, Homo sapiens
gaagacauuucuguugguu

SEQ ID NO: 26491 - RNA, 19 nt, Homo sapiens
aaacaucacuuugccgauu

SEQ ID NO: 26492 - RNA, 19 nt, Homo sapiens
uaacuggccuaauuaaugg

SEQ ID NO: 26493 - RNA, 19 nt, Homo sapiens
gaauguguuuccuuuacaa

SEQ ID NO: 26494 - RNA, 19 nt, Homo sapiens
gaaauggugcccuuguuga

SEQ ID NO: 26495 - RNA, 19 nt, Homo sapiens
caaggaauaucuauguaca

SEQ ID NO: 26496 - RNA, 19 nt, Homo sapiens
gagacgauaugccugaaau

SEQ ID NO: 26497 - RNA, 19 nt, Homo sapiens
gcgcaucagucauaguuau

SEQ ID NO: 26498 - RNA, 19 nt, Homo sapiens
gcagggauguggagguguu

SEQ ID NO: 26499 - RNA, 19 nt, Homo sapiens
gaagccagguugagguguu

SEQ ID NO: 26500 - RNA, 19 nt, Homo sapiens
uaccuuauauggccaaauu

SEQ ID NO: 26501 - RNA, 19 nt, Homo sapiens
acacagauaugguuaccuu

SEQ ID NO: 26502 - RNA, 19 nt, Homo sapiens
ggaaagacgacaccaaauc

SEQ ID NO: 26503 - RNA, 19 nt, Homo sapiens
ggagaugcaccaaccuuaa

SEQ ID NO: 26504 - RNA, 19 nt, Homo sapiens
gaugucauguugaaugguu

SEQ ID NO: 26505 - RNA, 19 nt, Homo sapiens
gcacugagaacuuagacaa

SEQ ID NO: 26506 - RNA, 19 nt, Homo sapiens
ccaggaagauaaagugaau

SEQ ID NO: 26507 - RNA, 19 nt, Homo sapiens
ccaagaugauggugaauag

SEQ ID NO: 26508 - RNA, 19 nt, Homo sapiens
acacugggcaucagaauaa

SEQ ID NO: 26509 - RNA, 19 nt, Homo sapiens
gaccuaacuggccuaauua

SEQ ID NO: 26510 - RNA, 19 nt, Homo sapiens
gaagcaagaggccaaguga

SEQ ID NO: 26511 - RNA, 19 nt, Homo sapiens
cagaaacagucacagaaga

SEQ ID NO: 26512 - RNA, 19 nt, Homo sapiens
cugcaugacugaugauaaa

SEQ ID NO: 26513 - RNA, 19 nt, Homo sapiens
gcauguagcagccaaguau

SEQ ID NO: 26514 - RNA, 19 nt, Homo sapiens
caagagaacuggauuucac

SEQ ID NO: 26515 - RNA, 19 nt, Homo sapiens
cgagaggccuggugcauca

SEQ ID NO: 26516 - RNA, 19 nt, Homo sapiens
ccaucuacguugauuguuu

SEQ ID NO: 26517 - RNA, 19 nt, Homo sapiens
gaagauauuacaggaacua

SEQ ID NO: 26518 - RNA, 19 nt, Homo sapiens
ccacuaccguguaaccaaa

SEQ ID NO: 26519 - RNA, 19 nt, Homo sapiens
gcacaaggcaccuguugau

SEQ ID NO: 26520 - RNA, 19 nt, Homo sapiens
gaagggaaauaccgcucuu

SEQ ID NO: 26521 - RNA, 19 nt, Homo sapiens
uaaagcguguuguauugaa

SEQ ID NO: 26522 - RNA, 19 nt, Homo sapiens
ggauaagacccuugaacaa

SEQ ID NO: 26523 - RNA, 19 nt, Homo sapiens
uaaaagaacugggugauga

SEQ ID NO: 26524 - RNA, 19 nt, Homo sapiens
uuaccuugcuucuggauaa

SEQ ID NO: 26525 - RNA, 19 nt, Homo sapiens
caaggcaccuguugaugau

SEQ ID NO: 26526 - RNA, 19 nt, Homo sapiens
uggcaacucuucuucuaaa

SEQ ID NO: 26527 - RNA, 19 nt, Homo sapiens
gaaagacgacaccaaaucu

SEQ ID NO: 26528 - RNA, 19 nt, Homo sapiens
gaaggagccaauauuaaug

SEQ ID NO: 26529 - RNA, 19 nt, Homo sapiens
uggaauaucagcaggaaua

SEQ ID NO: 26530 - RNA, 19 nt, Homo sapiens
agucaucucuggaauauca

SEQ ID NO: 26531 - RNA, 19 nt, Homo sapiens
agacauuucuguugguuau

SEQ ID NO: 26532 - RNA, 19 nt, Homo sapiens
ggauauuguucaucucaug

SEQ ID NO: 26533 - RNA, 19 nt, Homo sapiens
caccaaaucugccgcacuu

SEQ ID NO: 26534 - RNA, 19 nt, Homo sapiens
gaaaaccagccucguaaua

SEQ ID NO: 26535 - RNA, 19 nt, Homo sapiens
gaggaagacauuucuguug

SEQ ID NO: 26536 - RNA, 19 nt, Homo sapiens
gaugugaucucuuggauaa

SEQ ID NO: 26537 - RNA, 19 nt, Homo sapiens
cgacaacucugcuggaaua

SEQ ID NO: 26538 - RNA, 19 nt, Homo sapiens
gaacaacuccuuugacguu

SEQ ID NO: 26539 - RNA, 19 nt, Homo sapiens
aagcguaucugcaggauua

SEQ ID NO: 26540 - RNA, 19 nt, Homo sapiens
ggaaggagcaucaguuuga

SEQ ID NO: 26541 - RNA, 19 nt, Homo sapiens
gcaguaggcugguagaaau

SEQ ID NO: 26542 - RNA, 19 nt, Homo sapiens
gaaugaaguucuugauaug

SEQ ID NO: 26543 - RNA, 19 nt, Homo sapiens
gcaaagauauugagguucu

SEQ ID NO: 26544 - RNA, 19 nt, Homo sapiens
cgucuucucuguagcauua

SEQ ID NO: 26545 - RNA, 19 nt, Homo sapiens
cagauucucuuagacauua

SEQ ID NO: 26546 - RNA, 19 nt, Homo sapiens
gcagugguuucccggauua

SEQ ID NO: 26547 - RNA, 19 nt, Homo sapiens
gaaauuccauaaaccaauc

SEQ ID NO: 26548 - RNA, 19 nt, Homo sapiens
ggacaaaacuuuagagcaa

SEQ ID NO: 26549 - RNA, 19 nt, Homo sapiens
ucaagaagaucgagugaau

SEQ ID NO: 26550 - RNA, 19 nt, Homo sapiens
gaaaguggcccuucugcuu

SEQ ID NO: 26551 - RNA, 19 nt, Homo sapiens
gcaagaagaaucgaauuaa

SEQ ID NO: 26552 - RNA, 19 nt, Homo sapiens
gaagaaaccaugaccacaa

SEQ ID NO: 26553 - RNA, 19 nt, Homo sapiens
gcaagaagcaaagauauug

SEQ ID NO: 26554 - RNA, 19 nt, Homo sapiens
gcagacaccuuagacaaug

SEQ ID NO: 26555 - RNA, 19 nt, Homo sapiens
gggcauacgcauauaauaa

SEQ ID NO: 26556 - RNA, 19 nt, Homo sapiens
cacaggaccuuaaggaauu

SEQ ID NO: 26557 - RNA, 19 nt, Homo sapiens
ccacgcaacuguacagaga

SEQ ID NO: 26558 - RNA, 19 nt, Homo sapiens
ccauuuggcugcucaagaa

SEQ ID NO: 26559 - RNA, 19 nt, Homo sapiens
gaaagcagacauaguacaa

SEQ ID NO: 26560 - RNA, 19 nt, Homo sapiens
gaaaggagagggauuagca

SEQ ID NO: 26561 - RNA, 19 nt, Homo sapiens
gaacagaagcuccuaugca

SEQ ID NO: 26562 - RNA, 19 nt, Homo sapiens
agacggagcucagguagaa

SEQ ID NO: 26563 - RNA, 19 nt, Homo sapiens
ucuaugcgcucuaaauuau

SEQ ID NO: 26564 - RNA, 19 nt, Homo sapiens
gaagauagugaccgaagaa

SEQ ID NO: 26565 - RNA, 19 nt, Homo sapiens
aaacaccacuccacauuuc

SEQ ID NO: 26566 - RNA, 19 nt, Homo sapiens
gcaggauuaucacgaaaga

SEQ ID NO: 26567 - RNA, 19 nt, Homo sapiens
ggagagggauuagcaguag

SEQ ID NO: 26568 - RNA, 19 nt, Homo sapiens
gcaguuacccggcaaggaa

SEQ ID NO: 26569 - RNA, 19 nt, Homo sapiens
uaauggaacuccuucugaa

SEQ ID NO: 26570 - RNA, 19 nt, Homo sapiens
aagcaaagauauugagguu

SEQ ID NO: 26571 - RNA, 19 nt, Homo sapiens
gaaccaagaagacggaaau

SEQ ID NO: 26572 - RNA, 19 nt, Homo sapiens
ugauaugucugaugaugaa

SEQ ID NO: 26573 - RNA, 19 nt, Homo sapiens
cagaaacgaugaaugaagu

SEQ ID NO: 26574 - RNA, 19 nt, Homo sapiens
caacucugcuggaauaugg

SEQ ID NO: 26575 - RNA, 19 nt, Homo sapiens
caugacagaugacaaagug

SEQ ID NO: 26576 - RNA, 19 nt, Homo sapiens
aaagauccuuggaaacaaa

SEQ ID NO: 26577 - RNA, 19 nt, Homo sapiens
guacagagaauugauaugu

SEQ ID NO: 26578 - RNA, 19 nt, Homo sapiens
ggacacagacaaauaucuu

SEQ ID NO: 26579 - RNA, 19 nt, Homo sapiens
gagaagguguauccaaugg

SEQ ID NO: 26580 - RNA, 19 nt, Homo sapiens
guucagacauaguacauuc

SEQ ID NO: 26581 - RNA, 19 nt, Homo sapiens
gcacgggacagcaugauga

SEQ ID NO: 26582 - RNA, 19 nt, Homo sapiens
gaucauggagcgucuuuau

SEQ ID NO: 26583 - RNA, 19 nt, Homo sapiens
uaucacaacuaaugcauca

SEQ ID NO: 26584 - RNA, 19 nt, Homo sapiens
ccaaacaccaccaauguga

SEQ ID NO: 26585 - RNA, 19 nt, Homo sapiens
ggaagucgcaagaagcaaa

SEQ ID NO: 26586 - RNA, 19 nt, Homo sapiens
ggugaaaggagagggauua

SEQ ID NO: 26587 - RNA, 19 nt, Homo sapiens
gaaaccaugaccacaacua

SEQ ID NO: 26588 - RNA, 19 nt, Homo sapiens
caacuccuuugacguuuau

SEQ ID NO: 26589 - RNA, 19 nt, Homo sapiens
caaugucaaucuuguuuca

SEQ ID NO: 26590 - RNA, 19 nt, Homo sapiens
ccaaacaccacuccacauu

SEQ ID NO: 26591 - RNA, 19 nt, Homo sapiens
gaaucuuccuugcgauguu

SEQ ID NO: 26592 - RNA, 19 nt, Homo sapiens
ggauuaagcaggaaagcaa

SEQ ID NO: 26593 - RNA, 19 nt, Homo sapiens
caaaaugaauguuccagaa

SEQ ID NO: 26594 - RNA, 19 nt, Homo sapiens
gaccacaacuacugucaca

SEQ ID NO: 26595 - RNA, 19 nt, Homo sapiens
guaauggaacuccuucuga

SEQ ID NO: 26596 - RNA, 19 nt, Homo sapiens
gaagacaucacaggaacaa

SEQ ID NO: 26597 - RNA, 19 nt, Homo sapiens
cgaaucaccugccguuugg

SEQ ID NO: 26598 - RNA, 19 nt, Homo sapiens
guagaaaugcgaaugugaa

SEQ ID NO: 26599 - RNA, 19 nt, Homo sapiens
caaacaccacuccacauuu

SEQ ID NO: 26600 - RNA, 19 nt, Homo sapiens
acagagaauugauaugugu

SEQ ID NO: 26601 - RNA, 19 nt, Homo sapiens
gcaggaaagcaaccagauu

SEQ ID NO: 26602 - RNA, 19 nt, Homo sapiens
uggcauggaugaagaacuu

SEQ ID NO: 26603 - RNA, 19 nt, Homo sapiens
gggacagcaugaugauuga

SEQ ID NO: 26604 - RNA, 19 nt, Homo sapiens
ggcauacgcauauaauaaa

SEQ ID NO: 26605 - RNA, 19 nt, Homo sapiens
aaugugaaccugagcaaua

SEQ ID NO: 26606 - RNA, 19 nt, Homo sapiens
gaauugauauguguuccau

SEQ ID NO: 26607 - RNA, 19 nt, Homo sapiens
cauaaaccaaucacaauga

SEQ ID NO: 26608 - RNA, 19 nt, Homo sapiens
ugauagcccagaagaguua

SEQ ID NO: 26609 - RNA, 19 nt, Homo sapiens
ugauucagauucucuuaga

SEQ ID NO: 26610 - RNA, 19 nt, Homo sapiens
uggcagaaguccucguaaa

SEQ ID NO: 26611 - RNA, 19 nt, Homo sapiens
gcaacuguacagagaauug

SEQ ID NO: 26612 - RNA, 19 nt, Homo sapiens
cauucuggguuucugguua

SEQ ID NO: 26613 - RNA, 19 nt, Homo sapiens
uggagcgucuuuaucuaua

SEQ ID NO: 26614 - RNA, 19 nt, Homo sapiens
ggaggacagcaacuuguuu

SEQ ID NO: 26615 - RNA, 19 nt, Homo sapiens
ugaaugaucccguagaauc

SEQ ID NO: 26616 - RNA, 19 nt, Homo sapiens
acaacuccuuugacguuua

SEQ ID NO: 26617 - RNA, 19 nt, Homo sapiens
gaaagaaccaaagacaaca

SEQ ID NO: 26618 - RNA, 19 nt, Homo sapiens
aaagagagagaacucauug

SEQ ID NO: 26619 - RNA, 19 nt, Homo sapiens
ccacaggaccuuaaggaau

SEQ ID NO: 26620 - RNA, 19 nt, Homo sapiens
gguauacgccauuacauca

SEQ ID NO: 26621 - RNA, 19 nt, Homo sapiens
ccaaucuccugcuacagaa

SEQ ID NO: 26622 - RNA, 19 nt, Homo sapiens
uaugcgcucuaaauuauga

SEQ ID NO: 26623 - RNA, 19 nt, Homo sapiens
caggaaagcaaccagauug

SEQ ID NO: 26624 - RNA, 19 nt, Homo sapiens
uuaauggcauggaugaaga

SEQ ID NO: 26625 - RNA, 19 nt, Homo sapiens
caaaugcagccacaacuuc

SEQ ID NO: 26626 - RNA, 19 nt, Homo sapiens
cggccaagcugaaguugug

SEQ ID NO: 26627 - RNA, 19 nt, Homo sapiens
gcgguuugcaacuuaaaua

SEQ ID NO: 26628 - RNA, 19 nt, Homo sapiens
ggagaagguguauccaaug

SEQ ID NO: 26629 - RNA, 19 nt, Homo sapiens
ggauuaucacgaaagauuu

SEQ ID NO: 26630 - RNA, 19 nt, Homo sapiens
guggaaaucccucacuuug

SEQ ID NO: 26631 - RNA, 19 nt, Homo sapiens
cauggagcgucuuuaucua

SEQ ID NO: 26632 - RNA, 19 nt, Homo sapiens
cauggagccucaccaaaca

SEQ ID NO: 26633 - RNA, 19 nt, Homo sapiens
gaugugguuucgaaaauaa

SEQ ID NO: 26634 - RNA, 19 nt, Homo sapiens
aaugaaugaucccguagaa

SEQ ID NO: 26635 - RNA, 19 nt, Homo sapiens
uaagaaagcuaaccccaau

SEQ ID NO: 26636 - RNA, 19 nt, Homo sapiens
gaacugaaaugucaaguaa

SEQ ID NO: 26637 - RNA, 19 nt, Homo sapiens
gcuaauaucuucaccuuua

SEQ ID NO: 26638 - RNA, 19 nt, Homo sapiens
gaacagaaauccuuagcua

SEQ ID NO: 26639 - RNA, 19 nt, Homo sapiens
gaaaguaccucaagaaaca

SEQ ID NO: 26640 - RNA, 19 nt, Homo sapiens
gagaauagaugaugaagaa

SEQ ID NO: 26641 - RNA, 19 nt, Homo sapiens
ggaagugaguuaugaauuu

SEQ ID NO: 26642 - RNA, 19 nt, Homo sapiens
gcaacuaccucaucuguaa

SEQ ID NO: 26643 - RNA, 19 nt, Homo sapiens
agaaagaacuggaaaguaa

SEQ ID NO: 26644 - RNA, 19 nt, Homo sapiens
gagagaaguugauauauga

SEQ ID NO: 26645 - RNA, 19 nt, Homo sapiens
gaagaaaccagcaagcuua

SEQ ID NO: 26646 - RNA, 19 nt, Homo sapiens
gaagaugacuggauagaau

SEQ ID NO: 26647 - RNA, 19 nt, Homo sapiens
cgacaacucugcuggaaua

SEQ ID NO: 26648 - RNA, 19 nt, Homo sapiens
ggaaugacaucacuccuuu

SEQ ID NO: 26649 - RNA, 19 nt, Homo sapiens
uaacagaguugccuauauu

SEQ ID NO: 26650 - RNA, 19 nt, Homo sapiens
uaauaaggcugcuguguuu

SEQ ID NO: 26651 - RNA, 19 nt, Homo sapiens
ucagaaaucucuagaagaa

SEQ ID NO: 26652 - RNA, 19 nt, Homo sapiens
gauaagcgguccagagaaa

SEQ ID NO: 26653 - RNA, 19 nt, Homo sapiens
gagauuccauuaccucaua

SEQ ID NO: 26654 - RNA, 19 nt, Homo sapiens
gggaauauguugugaaaga

SEQ ID NO: 26655 - RNA, 19 nt, Homo sapiens
gaugauggcuugacagaga

SEQ ID NO: 26656 - RNA, 19 nt, Homo sapiens
gcuaugaccugcaagauga

SEQ ID NO: 26657 - RNA, 19 nt, Homo sapiens
gcucauagcuuauauacca

SEQ ID NO: 26658 - RNA, 19 nt, Homo sapiens
gaacaacuccuuugacguu

SEQ ID NO: 26659 - RNA, 19 nt, Homo sapiens
ccacucaggucauauguuu

SEQ ID NO: 26660 - RNA, 19 nt, Homo sapiens
aagcguaucugcaggauua

SEQ ID NO: 26661 - RNA, 19 nt, Homo sapiens
gaacacaaacagaauauug

SEQ ID NO: 26662 - RNA, 19 nt, Homo sapiens
gaacauaagucggcagugu

SEQ ID NO: 26663 - RNA, 19 nt, Homo sapiens
caaagccacugccacguua

SEQ ID NO: 26664 - RNA, 19 nt, Homo sapiens
ggaaggagcaucaguuuga

SEQ ID NO: 26665 - RNA, 19 nt, Homo sapiens
acacauagcucuaaugaca

SEQ ID NO: 26666 - RNA, 19 nt, Homo sapiens
gaagaaaugucagcaggaa

SEQ ID NO: 26667 - RNA, 19 nt, Homo sapiens
uaacuucggucuugacaaa

SEQ ID NO: 26668 - RNA, 19 nt, Homo sapiens
gcaguaggcugguagaaau

SEQ ID NO: 26669 - RNA, 19 nt, Homo sapiens
gaaugaaguucuugauaug

SEQ ID NO: 26670 - RNA, 19 nt, Homo sapiens
ccaaacagcuuccauccaa

SEQ ID NO: 26671 - RNA, 19 nt, Homo sapiens
uaaaggaaguggacgauga

SEQ ID NO: 26672 - RNA, 19 nt, Homo sapiens
caaagacucuaaccaaaga

SEQ ID NO: 26673 - RNA, 19 nt, Homo sapiens
gccaucagcuucuccguua

SEQ ID NO: 26674 - RNA, 19 nt, Homo sapiens
gaaaccagcaagcuuauaa

SEQ ID NO: 26675 - RNA, 19 nt, Homo sapiens
aggagaagcuggcaaauuu

SEQ ID NO: 26676 - RNA, 19 nt, Homo sapiens
agaaggcccuggagaaaua

SEQ ID NO: 26677 - RNA, 19 nt, Homo sapiens
gaaagaaggcccuggagaa

SEQ ID NO: 26678 - RNA, 19 nt, Homo sapiens
gaagaccgcucuccagcaa

SEQ ID NO: 26679 - RNA, 19 nt, Homo sapiens
gguaaaugcuugccgcuuu

SEQ ID NO: 26680 - RNA, 19 nt, Homo sapiens
ggaaaggaaucucccucua

SEQ ID NO: 26681 - RNA, 19 nt, Homo sapiens
guagagagaaguugauaua

SEQ ID NO: 26682 - RNA, 19 nt, Homo sapiens
gcaaagauauugagguucu

SEQ ID NO: 26683 - RNA, 19 nt, Homo sapiens
cgucuucucuguagcauua

SEQ ID NO: 26684 - RNA, 19 nt, Homo sapiens
cagauucucuuagacauua

SEQ ID NO: 26685 - RNA, 19 nt, Homo sapiens
ggaagaaaguaccucaaga

SEQ ID NO: 26686 - RNA, 19 nt, Homo sapiens
gauguaaaguccagaauuc

SEQ ID NO: 26687 - RNA, 19 nt, Homo sapiens
ccaaagcccuuacuacuuc

SEQ ID NO: 26688 - RNA, 19 nt, Homo sapiens
uuggagaggucaucaauua

SEQ ID NO: 26689 - RNA, 19 nt, Homo sapiens
gcagugguuucccggauua

SEQ ID NO: 26690 - RNA, 19 nt, Homo sapiens
caaagcccuucaucuaaua

SEQ ID NO: 26691 - RNA, 19 nt, Homo sapiens
ccagcaagcuuauaauaga

SEQ ID NO: 26692 - RNA, 19 nt, Homo sapiens
gaagaaaguaccucaagaa

SEQ ID NO: 26693 - RNA, 19 nt, Homo sapiens
acacagcacuuuaauucua

SEQ ID NO: 26694 - RNA, 19 nt, Homo sapiens
guaaggacaugucucaaga

SEQ ID NO: 26695 - RNA, 19 nt, Homo sapiens
guaagccaaucauuuguaa

SEQ ID NO: 26696 - RNA, 19 nt, Homo sapiens
gaauuuaguucggaagaaa

SEQ ID NO: 26697 - RNA, 19 nt, Homo sapiens
gacguggcaucuccaauua

SEQ ID NO: 26698 - RNA, 19 nt, Homo sapiens
ggaugcagcuacaaagaaa

SEQ ID NO: 26699 - RNA, 19 nt, Homo sapiens
caaguaauuuggugucauu

SEQ ID NO: 26700 - RNA, 19 nt, Homo sapiens
gagagaacgcaaauuguua

SEQ ID NO: 26701 - RNA, 19 nt, Homo sapiens
gaaaguguaucugugcaaa

SEQ ID NO: 26702 - RNA, 19 nt, Homo sapiens
ccauagaccucccagauga

SEQ ID NO: 26703 - RNA, 19 nt, Homo sapiens
gcacuauucuggcaauguu

SEQ ID NO: 26704 - RNA, 19 nt, Homo sapiens
gcaaaggcaugcguguuaa

SEQ ID NO: 26705 - RNA, 19 nt, Homo sapiens
ucucagagcuucauguuau

SEQ ID NO: 26706 - RNA, 19 nt, Homo sapiens
uaaaauggcugauuccuuu

SEQ ID NO: 26707 - RNA, 19 nt, Homo sapiens
gauuauaacuugaccaaag

SEQ ID NO: 26708 - RNA, 19 nt, Homo sapiens
agauguagcugaaaugaaa

SEQ ID NO: 26709 - RNA, 19 nt, Homo sapiens
gaaauuccauaaaccaauc

SEQ ID NO: 26710 - RNA, 19 nt, Homo sapiens
cagauaagaagcaucauua

SEQ ID NO: 26711 - RNA, 19 nt, Homo sapiens
ugaagaagaugaccacaau

SEQ ID NO: 26712 - RNA, 19 nt, Homo sapiens
ggacaaaacuuuagagcaa

SEQ ID NO: 26713 - RNA, 19 nt, Homo sapiens
ucaagaagaucgagugaau

SEQ ID NO: 26714 - RNA, 19 nt, Homo sapiens
gaaaguggcccuucugcuu

SEQ ID NO: 26715 - RNA, 19 nt, Homo sapiens
gcaagaagaaucgaauuaa

SEQ ID NO: 26716 - RNA, 19 nt, Homo sapiens
gaaaggaaacacagcauug

SEQ ID NO: 26717 - RNA, 19 nt, Homo sapiens
uggaugaccuagucgauua

SEQ ID NO: 26718 - RNA, 19 nt, Homo sapiens
gcuagaaggaccaauauuu

SEQ ID NO: 26719 - RNA, 19 nt, Homo sapiens
ugacagagagugauucuaa

SEQ ID NO: 26720 - RNA, 19 nt, Homo sapiens
gagcaaguauccuuucuag

SEQ ID NO: 26721 - RNA, 19 nt, Homo sapiens
acagagaacugaaauguca

SEQ ID NO: 26722 - RNA, 19 nt, Homo sapiens
gaaagccaguagugaagaa

SEQ ID NO: 26723 - RNA, 19 nt, Homo sapiens
gaaaguuagugaaauccuu

SEQ ID NO: 26724 - RNA, 19 nt, Homo sapiens
gaagaaaccaugaccacaa

SEQ ID NO: 26725 - RNA, 19 nt, Homo sapiens
guagaaauguugcuugauc

SEQ ID NO: 26726 - RNA, 19 nt, Homo sapiens
acacaaagcccuucaucua

SEQ ID NO: 26727 - RNA, 19 nt, Homo sapiens
gaaggcacauccaguagug

SEQ ID NO: 26728 - RNA, 19 nt, Homo sapiens
aaaccaaucuagagagaaa

SEQ ID NO: 26729 - RNA, 19 nt, Homo sapiens
ccacugaagucauuauuag

SEQ ID NO: 26730 - RNA, 19 nt, Homo sapiens
ccaguuaaaucacgaguug

SEQ ID NO: 26731 - RNA, 19 nt, Homo sapiens
gcaagaagcaaagauauug

SEQ ID NO: 26732 - RNA, 19 nt, Homo sapiens
gcagacaccuuagacaaug

SEQ ID NO: 26733 - RNA, 19 nt, Homo sapiens
gggcauacgcauauaauaa

SEQ ID NO: 26734 - RNA, 19 nt, Homo sapiens
ccagaguuauguagguuua

SEQ ID NO: 26735 - RNA, 19 nt, Homo sapiens
caauaagucucagaaagaa

SEQ ID NO: 26736 - RNA, 19 nt, Homo sapiens
gaagagaacuggaggaaga

SEQ ID NO: 26737 - RNA, 19 nt, Homo sapiens
gccaagggcuucuauauuu

SEQ ID NO: 26738 - RNA, 19 nt, Homo sapiens
ggaggaagauucagacuca

SEQ ID NO: 26739 - RNA, 19 nt, Homo sapiens
gcaagaagcucaacuacac

SEQ ID NO: 26740 - RNA, 19 nt, Homo sapiens
gaaauaauaccaacaacug

SEQ ID NO: 26741 - RNA, 19 nt, Homo sapiens
cuaaagacccuaaaucuga

SEQ ID NO: 26742 - RNA, 19 nt, Homo sapiens
ggaaugaccuguggcugaa

SEQ ID NO: 26743 - RNA, 19 nt, Homo sapiens
caacggaguuccagagugu

SEQ ID NO: 26744 - RNA, 19 nt, Homo sapiens
cagcagaucuguauauuuu

SEQ ID NO: 26745 - RNA, 19 nt, Homo sapiens
guaaagcguggaaucguua

SEQ ID NO: 26746 - RNA, 19 nt, Homo sapiens
agacucagcugcagagaga

SEQ ID NO: 26747 - RNA, 19 nt, Homo sapiens
gcagacagcagcaggacua

SEQ ID NO: 26748 - RNA, 19 nt, Homo sapiens
ucaagugggugaaggagaa

SEQ ID NO: 26749 - RNA, 19 nt, Homo sapiens
guaccugggugcugacuau

SEQ ID NO: 26750 - RNA, 19 nt, Homo sapiens
gcuauuaccgggugaacua

SEQ ID NO: 26751 - RNA, 19 nt, Homo sapiens
gagcccaccuggaacuuga

SEQ ID NO: 26752 - RNA, 19 nt, Homo sapiens
gaugcaaggugcccacaug

SEQ ID NO: 26753 - RNA, 19 nt, Homo sapiens
ggccaucccugucaucaau

SEQ ID NO: 26754 - RNA, 19 nt, Homo sapiens
ccagaucagugagcuguuu

SEQ ID NO: 26755 - RNA, 19 nt, Homo sapiens
gaacuugaaagaccucaug

SEQ ID NO: 26756 - RNA, 19 nt, Homo sapiens
caacaugcuucccaaaggu

SEQ ID NO: 26757 - RNA, 19 nt, Homo sapiens
gaacuacgacgaagagaac

SEQ ID NO: 26758 - RNA, 19 nt, Homo sapiens
gcaaggugcccacaugugu

SEQ ID NO: 26759 - RNA, 19 nt, Homo sapiens
gaacaaccgguccauccaa

SEQ ID NO: 26760 - RNA, 19 nt, Homo sapiens
gcagcagaucuguauauuu

SEQ ID NO: 26761 - RNA, 19 nt, Homo sapiens
ggagggcaaugucagaaag

SEQ ID NO: 26762 - RNA, 19 nt, Homo sapiens
agaacuaccugaagaagca

SEQ ID NO: 26763 - RNA, 19 nt, Homo sapiens
ccaagggcuucuauauuuc

SEQ ID NO: 26764 - RNA, 19 nt, Homo sapiens
ggacagccaguaugagaug

SEQ ID NO: 26765 - RNA, 19 nt, Homo sapiens
ccacugacgucaucaucau

SEQ ID NO: 26766 - RNA, 19 nt, Homo sapiens
ggaggccacugacgucauc

SEQ ID NO: 26767 - RNA, 19 nt, Homo sapiens
gaguucaacaucacgcuua

SEQ ID NO: 26768 - RNA, 19 nt, Homo sapiens
ggcagcagaucuguauauu

SEQ ID NO: 26769 - RNA, 19 nt, Homo sapiens
ucaaugugacgggcuauua

SEQ ID NO: 26770 - RNA, 19 nt, Homo sapiens
ggccaagggcuucuauauu

SEQ ID NO: 26771 - RNA, 19 nt, Homo sapiens
gcaggaggcugugaacaac

SEQ ID NO: 26772 - RNA, 19 nt, Homo sapiens
ugaaggacagccaguauga

SEQ ID NO: 26773 - RNA, 19 nt, Homo sapiens
caagaaggacaacgaggaa

SEQ ID NO: 26774 - RNA, 19 nt, Homo sapiens
caacagggcagcagaucug

SEQ ID NO: 26775 - RNA, 19 nt, Homo sapiens
ggucuggucugggacuuug

SEQ ID NO: 26776 - RNA, 19 nt, Homo sapiens
gcaggacuacuggcugaua

SEQ ID NO: 26777 - RNA, 19 nt, Homo sapiens
caaaguaaagcguggaauc

SEQ ID NO: 26778 - RNA, 19 nt, Homo sapiens
cuucuuugcuggucauuau

SEQ ID NO: 26779 - RNA, 19 nt, Homo sapiens
gggcagcagaucuguauau

SEQ ID NO: 26780 - RNA, 19 nt, Homo sapiens
gacgaaagccaacaucaag

SEQ ID NO: 26781 - RNA, 19 nt, Homo sapiens
gagcaagcccuggagaaga

SEQ ID NO: 26782 - RNA, 19 nt, Homo sapiens
gcaaagaguuguggauccu

SEQ ID NO: 26783 - RNA, 19 nt, Homo sapiens
gcagccgugugcacaauca

SEQ ID NO: 26784 - RNA, 19 nt, Homo sapiens
cgcccaagauguccacgua

SEQ ID NO: 26785 - RNA, 19 nt, Homo sapiens
ccaacaugcuucccaaagg

SEQ ID NO: 26786 - RNA, 19 nt, Homo sapiens
augaagaacuaccugaaga

SEQ ID NO: 26787 - RNA, 19 nt, Homo sapiens
caacacccucuuccugauu

SEQ ID NO: 26788 - RNA, 19 nt, Homo sapiens
gaagaacuaccugaagaag

SEQ ID NO: 26789 - RNA, 19 nt, Homo sapiens
ucaggaugcucuccagcuu

SEQ ID NO: 26790 - RNA, 19 nt, Homo sapiens
gagaagcaggcauccaaug

SEQ ID NO: 26791 - RNA, 19 nt, Homo sapiens
gcagugacacgacgauucu

SEQ ID NO: 26792 - RNA, 19 nt, Homo sapiens
gacgccaccucuaccauca

SEQ ID NO: 26793 - RNA, 19 nt, Homo sapiens
gaaaugccacacuggucaa

SEQ ID NO: 26794 - RNA, 19 nt, Homo sapiens
cuacuucaagcucauguuu

SEQ ID NO: 26795 - RNA, 19 nt, Homo sapiens
cugcugaaccucaauguga

SEQ ID NO: 26796 - RNA, 19 nt, Homo sapiens
ggcauccaauggugucuug

SEQ ID NO: 26797 - RNA, 19 nt, Homo sapiens
aguaaagcguggaaucguu

SEQ ID NO: 26798 - RNA, 19 nt, Homo sapiens
agcagaagcucucgaugga

SEQ ID NO: 26799 - RNA, 19 nt, Homo sapiens
cgaaagccaacaucaagug

SEQ ID NO: 26800 - RNA, 19 nt, Homo sapiens
gaaggacaacgaggaaaca

SEQ ID NO: 26801 - RNA, 19 nt, Homo sapiens
cguccuaccuccacaccuu

SEQ ID NO: 26802 - RNA, 19 nt, Homo sapiens
ugaagaacuaccugaagaa

SEQ ID NO: 26803 - RNA, 19 nt, Homo sapiens
acuacuggcugauagaugu

SEQ ID NO: 26804 - RNA, 19 nt, Homo sapiens
ccaacuggaaugucacuga

SEQ ID NO: 26805 - RNA, 19 nt, Homo sapiens
ccagucuaguuccugauga

SEQ ID NO: 26806 - RNA, 19 nt, Homo sapiens
ccugugagccagucuaguu

SEQ ID NO: 26807 - RNA, 19 nt, Homo sapiens
gaagacgaaagccaacauc

SEQ ID NO: 26808 - RNA, 19 nt, Homo sapiens
ucuaccaucaucagcauua

SEQ ID NO: 26809 - RNA, 19 nt, Homo sapiens
ugggagcaguuccgaaaug

SEQ ID NO: 26810 - RNA, 19 nt, Homo sapiens
ggauggagaaccccaauaa

SEQ ID NO: 26811 - RNA, 19 nt, Homo sapiens
ucaacuacguguggauugu

SEQ ID NO: 26812 - RNA, 19 nt, Homo sapiens
gcuucuauauuuccaaguc

SEQ ID NO: 26813 - RNA, 19 nt, Homo sapiens
ccaccuggaacuugaaaga

SEQ ID NO: 26814 - RNA, 19 nt, Homo sapiens
ucagugaguucgacuacgu

SEQ ID NO: 26815 - RNA, 19 nt, Homo sapiens
cccuaaaucugaggaauca

SEQ ID NO: 26816 - RNA, 19 nt, Homo sapiens
ccucuucauucacuucaga

SEQ ID NO: 26817 - RNA, 19 nt, Homo sapiens
ccucagaauucaacuacgu

SEQ ID NO: 26818 - RNA, 19 nt, Homo sapiens
gaagcaggcauccaauggu

SEQ ID NO: 26819 - RNA, 19 nt, Homo sapiens
gaaggccgaguucaacauc

SEQ ID NO: 26820 - RNA, 19 nt, Homo sapiens
ggugaaggacagccaguau

SEQ ID NO: 26821 - RNA, 19 nt, Homo sapiens
uguacccucuuucaccuuu

SEQ ID NO: 26822 - RNA, 19 nt, Homo sapiens
uggagcaguucaagaagga

SEQ ID NO: 26823 - RNA, 19 nt, Homo sapiens
gcccaucacauccaucaga

SEQ ID NO: 26824 - RNA, 19 nt, Homo sapiens
gaacaccaucuaccugaac

SEQ ID NO: 26825 - RNA, 19 nt, Homo sapiens
ggagcaagcccuggagaag

SEQ ID NO: 26826 - RNA, 19 nt, Homo sapiens
gguccaccgucuacugcaa

SEQ ID NO: 26827 - RNA, 19 nt, Homo sapiens
gaccaguacagcgagguua

SEQ ID NO: 26828 - RNA, 19 nt, Homo sapiens
aaucgggcacagaucauua

SEQ ID NO: 26829 - RNA, 19 nt, Homo sapiens
ggagaagcaggcauccaau

SEQ ID NO: 26830 - RNA, 19 nt, Homo sapiens
cagggcagcagaucuguau

SEQ ID NO: 26831 - RNA, 19 nt, Homo sapiens
gacccuaaaucugaggaau

SEQ ID NO: 26832 - RNA, 19 nt, Homo sapiens
ucuuucaccuuucccuaaa

SEQ ID NO: 26833 - RNA, 19 nt, Homo sapiens
agacgaaagccaacaucaa

SEQ ID NO: 26834 - RNA, 19 nt, Homo sapiens
ucaaugaggcugacaagcu

SEQ ID NO: 26835 - RNA, 19 nt, Homo sapiens
gauggucucuggccuuuuc

SEQ ID NO: 26836 - RNA, 19 nt, Homo sapiens
aaacacaaguucacagauu

SEQ ID NO: 26837 - RNA, 19 nt, Homo sapiens
caauaaagaccacuuaaug

SEQ ID NO: 26838 - RNA, 19 nt, Homo sapiens
guacaagcagcucuucuua

SEQ ID NO: 26839 - RNA, 19 nt, Homo sapiens
cuauagagcugccuacuuc

SEQ ID NO: 26840 - RNA, 19 nt, Homo sapiens
ggaggaagauugcaaaaga

SEQ ID NO: 26841 - RNA, 19 nt, Homo sapiens
uaaauucccacagcaaaua

SEQ ID NO: 26842 - RNA, 19 nt, Homo sapiens
caaggcaucauuaucuaua

SEQ ID NO: 26843 - RNA, 19 nt, Homo sapiens
ugaaaggaauaccucagaa

SEQ ID NO: 26844 - RNA, 19 nt, Homo sapiens
uccauugugugguuuaaua

SEQ ID NO: 26845 - RNA, 19 nt, Homo sapiens
cacccaagcucucaacuuc

SEQ ID NO: 26846 - RNA, 19 nt, Homo sapiens
uuugugagcuggaugauug

SEQ ID NO: 26847 - RNA, 19 nt, Homo sapiens
gcuuggagcuuccuaaagg

SEQ ID NO: 26848 - RNA, 19 nt, Homo sapiens
ccacagcaaauagaaauaa

SEQ ID NO: 26849 - RNA, 19 nt, Homo sapiens
aaaggugccugguccaaug

SEQ ID NO: 26850 - RNA, 19 nt, Homo sapiens
ccaagaacgugcacauuuu

SEQ ID NO: 26851 - RNA, 19 nt, Homo sapiens
caaguucacagauccauug

SEQ ID NO: 26852 - RNA, 19 nt, Homo sapiens
gccaaggccuucuucaaag

SEQ ID NO: 26853 - RNA, 19 nt, Homo sapiens
aaaccagacugaaaggaau

SEQ ID NO: 26854 - RNA, 19 nt, Homo sapiens
guauugguguuguaugaug

SEQ ID NO: 26855 - RNA, 19 nt, Homo sapiens
caucaauaaagaccacuua

SEQ ID NO: 26856 - RNA, 19 nt, Homo sapiens
acagauccauugugugguu

SEQ ID NO: 26857 - RNA, 19 nt, Homo sapiens
gcaguucuggcgcuacuuu

SEQ ID NO: 26858 - RNA, 19 nt, Homo sapiens
acaagcagcucuucuuagg

SEQ ID NO: 26859 - RNA, 19 nt, Homo sapiens
gaauaccucagaagagaug

SEQ ID NO: 26860 - RNA, 19 nt, Homo sapiens
gaaaggaauaccucagaag

SEQ ID NO: 26861 - RNA, 19 nt, Homo sapiens
acacaaguucacagauuua

SEQ ID NO: 26862 - RNA, 19 nt, Homo sapiens
aacacaaguucacagauuu

SEQ ID NO: 26863 - RNA, 19 nt, Homo sapiens
cagguuggcugcugaugug

SEQ ID NO: 26864 - RNA, 19 nt, Homo sapiens
aggaauaccucagaagaga

SEQ ID NO: 26865 - RNA, 19 nt, Homo sapiens
gauccauugugugguuuaa

SEQ ID NO: 26866 - RNA, 19 nt, Homo sapiens
uacaugaacuugaucuaca

SEQ ID NO: 26867 - RNA, 19 nt, Homo sapiens
cccaagaacgugcacauuu

SEQ ID NO: 26868 - RNA, 19 nt, Homo sapiens
ucauuaaaccacacaugua

SEQ ID NO: 26869 - RNA, 19 nt, Homo sapiens
ucaagaucuucaagucuga

SEQ ID NO: 26870 - RNA, 19 nt, Homo sapiens
gcgacuguaucaucaagau

SEQ ID NO: 26871 - RNA, 19 nt, Homo sapiens
cauuaaaccacacauguau

SEQ ID NO: 26872 - RNA, 19 nt, Homo sapiens
aaaggaauaccucagaaga

SEQ ID NO: 26873 - RNA, 19 nt, Homo sapiens
gguguuguaugaugagauc

SEQ ID NO: 26874 - RNA, 19 nt, Homo sapiens
gggcggugcuuuuguauug

SEQ ID NO: 26875 - RNA, 19 nt, Homo sapiens
gagccaaggccuucuucaa

SEQ ID NO: 26876 - RNA, 19 nt, Homo sapiens
ucaucaagaucuucaaguc

SEQ ID NO: 26877 - RNA, 19 nt, Homo sapiens
gcucucaacuucgccuuca

SEQ ID NO: 26878 - RNA, 19 nt, Homo sapiens
cuucauugaguguucauua

SEQ ID NO: 26879 - RNA, 19 nt, Homo sapiens
gguccagcaugccagcaaa

SEQ ID NO: 26880 - RNA, 19 nt, Homo sapiens
ucacagauuuacaugaacu

SEQ ID NO: 26881 - RNA, 19 nt, Homo sapiens
guugacugcuggaggaaga

SEQ ID NO: 26882 - RNA, 19 nt, Homo sapiens
uccaaggcaucauuaucua

SEQ ID NO: 26883 - RNA, 19 nt, Homo sapiens
aagagaugcuucauugagu

SEQ ID NO: 26884 - RNA, 19 nt, Homo sapiens
caaguucacagauuuacau

SEQ ID NO: 26885 - RNA, 19 nt, Homo sapiens
ccacacauguauuuuguau

SEQ ID NO: 26886 - RNA, 19 nt, Homo sapiens
ggauaaaaccagacugaaa

SEQ ID NO: 26887 - RNA, 19 nt, Homo sapiens
ccaccucccuuugcuuugu

SEQ ID NO: 26888 - RNA, 19 nt, Homo sapiens
cagcaugccagcaaacaga

SEQ ID NO: 26889 - RNA, 19 nt, Homo sapiens
acaugaacuugaucuacaa

SEQ ID NO: 26890 - RNA, 19 nt, Homo sapiens
ggucugggcgacuguauca

SEQ ID NO: 26891 - RNA, 19 nt, Homo sapiens
gaugcuucauugaguguuc

SEQ ID NO: 26892 - RNA, 19 nt, Homo sapiens
ggccaccucccuuugcuuu

SEQ ID NO: 26893 - RNA, 19 nt, Homo sapiens
agccaaggccuucuucaaa

SEQ ID NO: 26894 - RNA, 19 nt, Homo sapiens
ggcgcuacuuugcugguaa

SEQ ID NO: 26895 - RNA, 19 nt, Homo sapiens
gcaguacaaagggaucauu

SEQ ID NO: 26896 - RNA, 19 nt, Homo sapiens
uuguauugguguuguauga

SEQ ID NO: 26897 - RNA, 19 nt, Homo sapiens
gggcgacuguaucaucaag

SEQ ID NO: 26898 - RNA, 19 nt, Homo sapiens
ccgcuggacuuugcuagga

SEQ ID NO: 26899 - RNA, 19 nt, Homo sapiens
gggccgauauuauguacac

SEQ ID NO: 26900 - RNA, 19 nt, Homo sapiens
ugacacuguucgucguaga

SEQ ID NO: 26901 - RNA, 19 nt, Homo sapiens
guccaaggcaucauuaucu

SEQ ID NO: 26902 - RNA, 19 nt, Homo sapiens
gauaaaaccagacugaaag

SEQ ID NO: 26903 - RNA, 19 nt, Homo sapiens
uaaccuggccaacgugauc

SEQ ID NO: 26904 - RNA, 19 nt, Homo sapiens
auaaagaccacuuaaugca

SEQ ID NO: 26905 - RNA, 19 nt, Homo sapiens
cagauuuacaugaacuuga

SEQ ID NO: 26906 - RNA, 19 nt, Homo sapiens
gcuggaggaagauugcaaa

SEQ ID NO: 26907 - RNA, 19 nt, Homo sapiens
ccaaggcaucauuaucuau

SEQ ID NO: 26908 - RNA, 19 nt, Homo sapiens
cauugaguguucauuaaac

SEQ ID NO: 26909 - RNA, 19 nt, Homo sapiens
ggaauaccucagaagagau

SEQ ID NO: 26910 - RNA, 19 nt, Homo sapiens
uauugguguuguaugauga

SEQ ID NO: 26911 - RNA, 19 nt, Homo sapiens
caaaggugccugguccaau

SEQ ID NO: 26912 - RNA, 19 nt, Homo sapiens
gaagauugcaaaagacgaa

SEQ ID NO: 26913 - RNA, 19 nt, Homo sapiens
ucaaggacaaguacaagca

SEQ ID NO: 26914 - RNA, 19 nt, Homo sapiens
guucgucguagaaugauga

SEQ ID NO: 26915 - RNA, 19 nt, Homo sapiens
gcugagaagcaguacaaag

SEQ ID NO: 26916 - RNA, 19 nt, Homo sapiens
caugggcggugcuuuugua

SEQ ID NO: 26917 - RNA, 19 nt, Homo sapiens
ccacccaagcucucaacuu

SEQ ID NO: 26918 - RNA, 19 nt, Homo sapiens
gagaugcuucauugagugu

SEQ ID NO: 26919 - RNA, 19 nt, Homo sapiens
cagauccauugugugguuu

SEQ ID NO: 26920 - RNA, 19 nt, Homo sapiens
aggcaucauuaucuauaga

SEQ ID NO: 26921 - RNA, 19 nt, Homo sapiens
aauaaagaccacuuaaugc

SEQ ID NO: 26922 - RNA, 19 nt, Homo sapiens
uugauuguguggugagaau

SEQ ID NO: 26923 - RNA, 19 nt, Homo sapiens
uuaaauucccacagcaaau

SEQ ID NO: 26924 - RNA, 19 nt, Homo sapiens
gacacuguucgucguagaa

SEQ ID NO: 26925 - RNA, 19 nt, Homo sapiens
caucaagaucuucaagucu

SEQ ID NO: 26926 - RNA, 19 nt, Homo sapiens
gacuguaucaucaagaucu

SEQ ID NO: 26927 - RNA, 19 nt, Homo sapiens
gaagauugcucgugaugaa

SEQ ID NO: 26928 - RNA, 19 nt, Homo sapiens
caaaggaacugacaucaug

SEQ ID NO: 26929 - RNA, 19 nt, Homo sapiens
gcaauacaaaggcauuaua

SEQ ID NO: 26930 - RNA, 19 nt, Homo sapiens
gcgguaaccuggccaaugu

SEQ ID NO: 26931 - RNA, 19 nt, Homo sapiens
uaacuucgccuucaaagau

SEQ ID NO: 26932 - RNA, 19 nt, Homo sapiens
gugcuugucuuguaugaug

SEQ ID NO: 26933 - RNA, 19 nt, Homo sapiens
ggacaagagaacccaguuu

SEQ ID NO: 26934 - RNA, 19 nt, Homo sapiens
gcucuuaacuucgccuuca

SEQ ID NO: 26935 - RNA, 19 nt, Homo sapiens
agucacuccugauaaauaa

SEQ ID NO: 26936 - RNA, 19 nt, Homo sapiens
ugaugggacucaauuguau

SEQ ID NO: 26937 - RNA, 19 nt, Homo sapiens
uggccaaugucaucagaua

SEQ ID NO: 26938 - RNA, 19 nt, Homo sapiens
ggcauguuguauucuauaa

SEQ ID NO: 26939 - RNA, 19 nt, Homo sapiens
caagaaguacacauaaguu

SEQ ID NO: 26940 - RNA, 19 nt, Homo sapiens
cuaaagccauuuccaugau

SEQ ID NO: 26941 - RNA, 19 nt, Homo sapiens
gcagauaagcaauacaaag

SEQ ID NO: 26942 - RNA, 19 nt, Homo sapiens
auauucaucugaccaguuu

SEQ ID NO: 26943 - RNA, 19 nt, Homo sapiens
gcaaaggaacugacaucau

SEQ ID NO: 26944 - RNA, 19 nt, Homo sapiens
uaaagccauuuccaugaug

SEQ ID NO: 26945 - RNA, 19 nt, Homo sapiens
acaggcauguuguauucua

SEQ ID NO: 26946 - RNA, 19 nt, Homo sapiens
ucacugcagauaagcaaua

SEQ ID NO: 26947 - RNA, 19 nt, Homo sapiens
ggcaacuacuuuacugguu

SEQ ID NO: 26948 - RNA, 19 nt, Homo sapiens
cacccaggcucuuaacuuc

SEQ ID NO: 26949 - RNA, 19 nt, Homo sapiens
gaugaugggacucaauugu

SEQ ID NO: 26950 - RNA, 19 nt, Homo sapiens
aacacaaucuugagcauuc

SEQ ID NO: 26951 - RNA, 19 nt, Homo sapiens
ugguuaagaucuacaaauc

SEQ ID NO: 26952 - RNA, 19 nt, Homo sapiens
cagucacuccugauaaaua

SEQ ID NO: 26953 - RNA, 19 nt, Homo sapiens
ugucuuguaugaugaaauc

SEQ ID NO: 26954 - RNA, 19 nt, Homo sapiens
gugacugccugguuaagau

SEQ ID NO: 26955 - RNA, 19 nt, Homo sapiens
caauacaaaggcauuauag

SEQ ID NO: 26956 - RNA, 19 nt, Homo sapiens
aaagccauuuccaugauga

SEQ ID NO: 26957 - RNA, 19 nt, Homo sapiens
gaugaaaucaagaaguaca

SEQ ID NO: 26958 - RNA, 19 nt, Homo sapiens
gcagucagggcgcaaagga

SEQ ID NO: 26959 - RNA, 19 nt, Homo sapiens
cuaccgagccgccuacuuc

SEQ ID NO: 26960 - RNA, 19 nt, Homo sapiens
gaucacugcagauaagcaa

SEQ ID NO: 26961 - RNA, 19 nt, Homo sapiens
ucuaaagccauuuccauga

SEQ ID NO: 26962 - RNA, 19 nt, Homo sapiens
ucaagaaguacacauaagu

SEQ ID NO: 26963 - RNA, 19 nt, Homo sapiens
gaugaaggaggcaaagcuu

SEQ ID NO: 26964 - RNA, 19 nt, Homo sapiens
ccaaugucaucagauacuu

SEQ ID NO: 26965 - RNA, 19 nt, Homo sapiens
cagauaagcaauacaaagg

SEQ ID NO: 26966 - RNA, 19 nt, Homo sapiens
ggaagauugcucgugauga

SEQ ID NO: 26967 - RNA, 19 nt, Homo sapiens
ccauuuccaugaugaugau

SEQ ID NO: 26968 - RNA, 19 nt, Homo sapiens
gaaaucaagaaguacacau

SEQ ID NO: 26969 - RNA, 19 nt, Homo sapiens
gaaaaugggaagcaauaau

SEQ ID NO: 26970 - RNA, 19 nt, Homo sapiens
uaacacaaucuugagcauu

SEQ ID NO: 26971 - RNA, 19 nt, Homo sapiens
gcgcaaaggaacugacauc

SEQ ID NO: 26972 - RNA, 19 nt, Homo sapiens
cucggugacugccugguua

SEQ ID NO: 26973 - RNA, 19 nt, Homo sapiens
ccacccaggcucuuaacuu

SEQ ID NO: 26974 - RNA, 19 nt, Homo sapiens
guugacuuccuauccauuu

SEQ ID NO: 26975 - RNA, 19 nt, Homo sapiens
gcgcuacuuugcagggaau

SEQ ID NO: 26976 - RNA, 19 nt, Homo sapiens
uaaccuggccaaugucauc

SEQ ID NO: 26977 - RNA, 19 nt, Homo sapiens
gaugggacucaauuguauu

SEQ ID NO: 26978 - RNA, 19 nt, Homo sapiens
cuacuuuacugguugaaaa

SEQ ID NO: 26979 - RNA, 19 nt, Homo sapiens
ugcaggguauuaucaucua

SEQ ID NO: 26980 - RNA, 19 nt, Homo sapiens
uaagcaauacaaaggcauu

SEQ ID NO: 26981 - RNA, 19 nt, Homo sapiens
ggugcaugguccaauguuc

SEQ ID NO: 26982 - RNA, 19 nt, Homo sapiens
gaacacucacaucgucauc

SEQ ID NO: 26983 - RNA, 19 nt, Homo sapiens
gacaagagaacccaguuuu

SEQ ID NO: 26984 - RNA, 19 nt, Homo sapiens
aacuucgccuucaaagaua

SEQ ID NO: 26985 - RNA, 19 nt, Homo sapiens
ggauuaagggccuguacca

SEQ ID NO: 26986 - RNA, 19 nt, Homo sapiens
uagcagcugauguggguaa

SEQ ID NO: 26987 - RNA, 19 nt, Homo sapiens
gauaaauacaagcagaucu

SEQ ID NO: 26988 - RNA, 19 nt, Homo sapiens
gccauuuccaugaugauga

SEQ ID NO: 26989 - RNA, 19 nt, Homo sapiens
acuccuggcugucaguuuc

SEQ ID NO: 26990 - RNA, 19 nt, Homo sapiens
caggcauguuguauucuau

SEQ ID NO: 26991 - RNA, 19 nt, Homo sapiens
ugacuuccuauccauuuga

SEQ ID NO: 26992 - RNA, 19 nt, Homo sapiens
gcaggguauuaucaucuac

SEQ ID NO: 26993 - RNA, 19 nt, Homo sapiens
ccaaggcuuuaacgugucu

SEQ ID NO: 26994 - RNA, 19 nt, Homo sapiens
uaaauacaagcagaucuuc

SEQ ID NO: 26995 - RNA, 19 nt, Homo sapiens
gaugaugaugggacucaau

SEQ ID NO: 26996 - RNA, 19 nt, Homo sapiens
cagucugccuccucuuuca

SEQ ID NO: 26997 - RNA, 19 nt, Homo sapiens
gcggaagauugcucgugau

SEQ ID NO: 26998 - RNA, 19 nt, Homo sapiens
ucucaguggcaacuacuuu

SEQ ID NO: 26999 - RNA, 19 nt, Homo sapiens
uagacugcgugguccguau

SEQ ID NO: 27000 - RNA, 19 nt, Homo sapiens
cugcagauaagcaauacaa

SEQ ID NO: 27001 - RNA, 19 nt, Homo sapiens
ccaagaacacucacaucgu

SEQ ID NO: 27002 - RNA, 19 nt, Homo sapiens
cuacuucgguaucuaugac

SEQ ID NO: 27003 - RNA, 19 nt, Homo sapiens
uuguguacccucuugauuu

SEQ ID NO: 27004 - RNA, 19 nt, Homo sapiens
cuugagcauucuugacaga

SEQ ID NO: 27005 - RNA, 19 nt, Homo sapiens
ugccuccucuuucaacaug

SEQ ID NO: 27006 - RNA, 19 nt, Homo sapiens
aagggugcaugguccaaug

SEQ ID NO: 27007 - RNA, 19 nt, Homo sapiens
gauugcucgugaugaagga

SEQ ID NO: 27008 - RNA, 19 nt, Homo sapiens
auacaaaggcauuauagac

SEQ ID NO: 27009 - RNA, 19 nt, Homo sapiens
ggugacugccugguuaaga

SEQ ID NO: 27010 - RNA, 19 nt, Homo sapiens
cagcugauguggguaaagc

SEQ ID NO: 27011 - RNA, 19 nt, Homo sapiens
uguguacccucuugauuuu

SEQ ID NO: 27012 - RNA, 19 nt, Homo sapiens
aagcaauacaaaggcauua

SEQ ID NO: 27013 - RNA, 19 nt, Homo sapiens
guaucuaugacacugcaaa

SEQ ID NO: 27014 - RNA, 19 nt, Homo sapiens
gauuaagggccuguaccaa

SEQ ID NO: 27015 - RNA, 19 nt, Homo sapiens
augaugggacucaauugua

SEQ ID NO: 27016 - RNA, 19 nt, Homo sapiens
cuugacugcuggcggaaga

SEQ ID NO: 27017 - RNA, 19 nt, Homo sapiens
ccgcagccaucuccaagac

SEQ ID NO: 27018 - RNA, 19 nt, Homo sapiens
gguaaccuggccaauguca

SEQ ID NO: 27019 - RNA, 19 nt, Homo sapiens
caaaggagcugacaucaug

SEQ ID NO: 27020 - RNA, 19 nt, Homo sapiens
gcgaguauguucuauguug

SEQ ID NO: 27021 - RNA, 19 nt, Homo sapiens
caucaaccuucgagaaauu

SEQ ID NO: 27022 - RNA, 19 nt, Homo sapiens
gaaccaagagaaccacgua

SEQ ID NO: 27023 - RNA, 19 nt, Homo sapiens
ucaagaaggugaucuaagg

SEQ ID NO: 27024 - RNA, 19 nt, Homo sapiens
caagucguguucuaaguau

SEQ ID NO: 27025 - RNA, 19 nt, Homo sapiens
gagacugccuggugaagau

SEQ ID NO: 27026 - RNA, 19 nt, Homo sapiens
caacgucauucgcuacuuc

SEQ ID NO: 27027 - RNA, 19 nt, Homo sapiens
ggagccaagucguguucua

SEQ ID NO: 27028 - RNA, 19 nt, Homo sapiens
ccaagucguguucuaagua

SEQ ID NO: 27029 - RNA, 19 nt, Homo sapiens
gggcaaggccuucuucaag

SEQ ID NO: 27030 - RNA, 19 nt, Homo sapiens
agaaauuccaguugucuuu

SEQ ID NO: 27031 - RNA, 19 nt, Homo sapiens
ccaagagaaccacguagaa

SEQ ID NO: 27032 - RNA, 19 nt, Homo sapiens
gugagacacuccaguacug

SEQ ID NO: 27033 - RNA, 19 nt, Homo sapiens
gagccaagucguguucuaa

SEQ ID NO: 27034 - RNA, 19 nt, Homo sapiens
gcaaaggagcugacaucau

SEQ ID NO: 27035 - RNA, 19 nt, Homo sapiens
uaccagggcuucagugucu

SEQ ID NO: 27036 - RNA, 19 nt, Homo sapiens
gaccaucaaccuucgagaa

SEQ ID NO: 27037 - RNA, 19 nt, Homo sapiens
caagagaaccacguagaau

SEQ ID NO: 27038 - RNA, 19 nt, Homo sapiens
gaaucacguuuucccauuu

SEQ ID NO: 27039 - RNA, 19 nt, Homo sapiens
gcgcaaaggagcugacauc

SEQ ID NO: 27040 - RNA, 19 nt, Homo sapiens
caaccuugccaacgucauu

SEQ ID NO: 27041 - RNA, 19 nt, Homo sapiens
ggccaucuccuucgccaaa

SEQ ID NO: 27042 - RNA, 19 nt, Homo sapiens
uggcgaguauguucuaugu

SEQ ID NO: 27043 - RNA, 19 nt, Homo sapiens
gcucaagaaggugaucuaa

SEQ ID NO: 27044 - RNA, 19 nt, Homo sapiens
acacgcaguucuggaggua

SEQ ID NO: 27045 - RNA, 19 nt, Homo sapiens
ggggaaggcucuagaaaag

SEQ ID NO: 27046 - RNA, 19 nt, Homo sapiens
cagcgacgcccuccauuca

SEQ ID NO: 27047 - RNA, 19 nt, Homo sapiens
gccaagucguguucuaagu

SEQ ID NO: 27048 - RNA, 19 nt, Homo sapiens
ccaucaaccuucgagaaau

SEQ ID NO: 27049 - RNA, 19 nt, Homo sapiens
ccacucaagcccucaacuu

SEQ ID NO: 27050 - RNA, 19 nt, Homo sapiens
acgacgagcucaagaaggu

SEQ ID NO: 27051 - RNA, 19 nt, Homo sapiens
gucguguucuaaguauuua

SEQ ID NO: 27052 - RNA, 19 nt, Homo sapiens
gagaaauuccaguugucuu

SEQ ID NO: 27053 - RNA, 19 nt, Homo sapiens
ggagacugccuggugaaga

SEQ ID NO: 27054 - RNA, 19 nt, Homo sapiens
ggacaagcacacgcaguuc

SEQ ID NO: 27055 - RNA, 19 nt, Homo sapiens
guacgacgagcucaagaag

SEQ ID NO: 27056 - RNA, 19 nt, Homo sapiens
ucaaggauaaguacaagca

SEQ ID NO: 27057 - RNA, 19 nt, Homo sapiens
gggcaucguggacugcauu

SEQ ID NO: 27058 - RNA, 19 nt, Homo sapiens
ccgauuccgugucuugauc

SEQ ID NO: 27059 - RNA, 19 nt, Homo sapiens
gugcagggcaucaucaucu

SEQ ID NO: 27060 - RNA, 19 nt, Homo sapiens
gcgacgcccuccauucacu

SEQ ID NO: 27061 - RNA, 19 nt, Homo sapiens
cagcggacgugggaaaguc

SEQ ID NO: 27062 - RNA, 19 nt, Homo sapiens
gcccucaacuucgccuuca

SEQ ID NO: 27063 - RNA, 19 nt, Homo sapiens
agucguguucuaaguauuu

SEQ ID NO: 27064 - RNA, 19 nt, Homo sapiens
ucguguacccgcuggauuu

SEQ ID NO: 27065 - RNA, 19 nt, Homo sapiens
gcaguucuggagguacuuu

SEQ ID NO: 27066 - RNA, 19 nt, Homo sapiens
ugcagggcaucaucaucua

SEQ ID NO: 27067 - RNA, 19 nt, Homo sapiens
gauaaguacaagcagaucu

SEQ ID NO: 27068 - RNA, 19 nt, Homo sapiens
cggaacaggccaucuccuu

SEQ ID NO: 27069 - RNA, 19 nt, Homo sapiens
gaaauuccaguugucuuuu

SEQ ID NO: 27070 - RNA, 19 nt, Homo sapiens
ccaucuccuucgccaaaga

SEQ ID NO: 27071 - RNA, 19 nt, Homo sapiens
gaccuagaguccagaugcu

SEQ ID NO: 27072 - RNA, 19 nt, Homo sapiens
caaccgugcggaccaucaa

SEQ ID NO: 27073 - RNA, 19 nt, Homo sapiens
aagagaaccacguagaauc

SEQ ID NO: 27074 - RNA, 19 nt, Homo sapiens
ugggugagacacuccagua

SEQ ID NO: 27075 - RNA, 19 nt, Homo sapiens
ggcagccgauuccgugucu

SEQ ID NO: 27076 - RNA, 19 nt, Homo sapiens
ucgagaaauuccaguuguc

SEQ ID NO: 27077 - RNA, 19 nt, Homo sapiens
ccaagaacacgcacaucgu

SEQ ID NO: 27078 - RNA, 19 nt, Homo sapiens
gacaagcacacgcaguucu

SEQ ID NO: 27079 - RNA, 19 nt, Homo sapiens
uggacaagcacacgcaguu

SEQ ID NO: 27080 - RNA, 19 nt, Homo sapiens
caaaggagauuaugagaaa

SEQ ID NO: 27081 - RNA, 19 nt, Homo sapiens
gcaagaagguagagauaaa

SEQ ID NO: 27082 - RNA, 19 nt, Homo sapiens
ugagaaagaugucuaugua

SEQ ID NO: 27083 - RNA, 19 nt, Homo sapiens
gaagagagaucuggccaaa

SEQ ID NO: 27084 - RNA, 19 nt, Homo sapiens
gagaggaacugaagagaga

SEQ ID NO: 27085 - RNA, 19 nt, Homo sapiens
gcaauuugaugcugaugaa

SEQ ID NO: 27086 - RNA, 19 nt, Homo sapiens
agagagaucuggccaaaga

SEQ ID NO: 27087 - RNA, 19 nt, Homo sapiens
gaagauacucuaauugaga

SEQ ID NO: 27088 - RNA, 19 nt, Homo sapiens
ccaaagacauaaccucaga

SEQ ID NO: 27089 - RNA, 19 nt, Homo sapiens
gcaggaauauguucaaacu

SEQ ID NO: 27090 - RNA, 19 nt, Homo sapiens
gcuaugaucagaagacuuu

SEQ ID NO: 27091 - RNA, 19 nt, Homo sapiens
aagcaggccugguuuauug

SEQ ID NO: 27092 - RNA, 19 nt, Homo sapiens
agaaaugccucacagcuau

SEQ ID NO: 27093 - RNA, 19 nt, Homo sapiens
gagaaaugccucacagcua

SEQ ID NO: 27094 - RNA, 19 nt, Homo sapiens
ggaugaaacacuuaagaaa

SEQ ID NO: 27095 - RNA, 19 nt, Homo sapiens
guucugaaauugacaugaa

SEQ ID NO: 27096 - RNA, 19 nt, Homo sapiens
gaagugcgccacaagcaaa

SEQ ID NO: 27097 - RNA, 19 nt, Homo sapiens
gaaaggugacauugagaaa

SEQ ID NO: 27098 - RNA, 19 nt, Homo sapiens
ugaccgaucugaggacuuu

SEQ ID NO: 27099 - RNA, 19 nt, Homo sapiens
gaaaucagagacauuaaca

SEQ ID NO: 27100 - RNA, 19 nt, Homo sapiens
cagcauaucuccaggaaac

SEQ ID NO: 27101 - RNA, 19 nt, Homo sapiens
gagcaggaauauguucaaa

SEQ ID NO: 27102 - RNA, 19 nt, Homo sapiens
ggacuuuggugugaaugaa

SEQ ID NO: 27103 - RNA, 19 nt, Homo sapiens
cagaagcuauccacaacuu

SEQ ID NO: 27104 - RNA, 19 nt, Homo sapiens
aaacuaaacauucccuuga

SEQ ID NO: 27105 - RNA, 19 nt, Homo sapiens
caaagguggucccggauca

SEQ ID NO: 27106 - RNA, 19 nt, Homo sapiens
gaucaaagcagcauaucuc

SEQ ID NO: 27107 - RNA, 19 nt, Homo sapiens
gaacucgccauaaggcauu

SEQ ID NO: 27108 - RNA, 19 nt, Homo sapiens
gcagagaagcuucaucaag

SEQ ID NO: 27109 - RNA, 19 nt, Homo sapiens
caaagaaaucagagacauu

SEQ ID NO: 27110 - RNA, 19 nt, Homo sapiens
caucaagaacuaacaaaga

SEQ ID NO: 27111 - RNA, 19 nt, Homo sapiens
gaagguagagauaaagaca

SEQ ID NO: 27112 - RNA, 19 nt, Homo sapiens
gaugaaacacuuaagaaag

SEQ ID NO: 27113 - RNA, 19 nt, Homo sapiens
gguuaaagguguggaugaa

SEQ ID NO: 27114 - RNA, 19 nt, Homo sapiens
ccaaguacaguaagcauga

SEQ ID NO: 27115 - RNA, 19 nt, Homo sapiens
ggaugucgcugccuugcau

SEQ ID NO: 27116 - RNA, 19 nt, Homo sapiens
uaucagaagauguauggua

SEQ ID NO: 27117 - RNA, 19 nt, Homo sapiens
caugaaagguguuggaacu

SEQ ID NO: 27118 - RNA, 19 nt, Homo sapiens
guaaacguguucaauacca

SEQ ID NO: 27119 - RNA, 19 nt, Homo sapiens
gaagcaaccaucauugaca

SEQ ID NO: 27120 - RNA, 19 nt, Homo sapiens
aggaauauguucaaacugu

SEQ ID NO: 27121 - RNA, 19 nt, Homo sapiens
agacauaaccucagacaca

SEQ ID NO: 27122 - RNA, 19 nt, Homo sapiens
gaauauguucaaacuguga

SEQ ID NO: 27123 - RNA, 19 nt, Homo sapiens
guugaaaggugacauugag

SEQ ID NO: 27124 - RNA, 19 nt, Homo sapiens
uaucagaauuccucaagca

SEQ ID NO: 27125 - RNA, 19 nt, Homo sapiens
gcauugaucaggauuaugg

SEQ ID NO: 27126 - RNA, 19 nt, Homo sapiens
gaugaagauacucuaauug

SEQ ID NO: 27127 - RNA, 19 nt, Homo sapiens
gcacagcgucaacagauca

SEQ ID NO: 27128 - RNA, 19 nt, Homo sapiens
uaacuaagcgaaacaaugc

SEQ ID NO: 27129 - RNA, 19 nt, Homo sapiens
gaagagcaggaauauguuc

SEQ ID NO: 27130 - RNA, 19 nt, Homo sapiens
gaacugaugaagauacucu

SEQ ID NO: 27131 - RNA, 19 nt, Homo sapiens
ggaguugaaaggugacauu

SEQ ID NO: 27132 - RNA, 19 nt, Homo sapiens
gacauaaccucagacacau

SEQ ID NO: 27133 - RNA, 19 nt, Homo sapiens
ccaaaggagauuaugagaa

SEQ ID NO: 27134 - RNA, 19 nt, Homo sapiens
gaaauacaccaaguacagu

SEQ ID NO: 27135 - RNA, 19 nt, Homo sapiens
gaacuucgugcugccauga

SEQ ID NO: 27136 - RNA, 19 nt, Homo sapiens
gaugaaaccaaaggagauu

SEQ ID NO: 27137 - RNA, 19 nt, Homo sapiens
aaugaagacuuggcugauu

SEQ ID NO: 27138 - RNA, 19 nt, Homo sapiens
uuaacagggucuacagaga

SEQ ID NO: 27139 - RNA, 19 nt, Homo sapiens
aaauggcaaugguaucaga

SEQ ID NO: 27140 - RNA, 19 nt, Homo sapiens
ggaacgcuuugcuuucucu

SEQ ID NO: 27141 - RNA, 19 nt, Homo sapiens
ugaagauacucuaauugag

SEQ ID NO: 27142 - RNA, 19 nt, Homo sapiens
ccuuggaacugaugaagau

SEQ ID NO: 27143 - RNA, 19 nt, Homo sapiens
acaaagaaaucagagacau

SEQ ID NO: 27144 - RNA, 19 nt, Homo sapiens
uauccuaccuucaauccau

SEQ ID NO: 27145 - RNA, 19 nt, Homo sapiens
ggaugaaaccaaaggagau

SEQ ID NO: 27146 - RNA, 19 nt, Homo sapiens
gccagggccuuguaugaag

SEQ ID NO: 27147 - RNA, 19 nt, Homo sapiens
uggcaaugguaucagaauu

SEQ ID NO: 27148 - RNA, 19 nt, Homo sapiens
caagcaggccugguuuauu

SEQ ID NO: 27149 - RNA, 19 nt, Homo sapiens
aaaccaaaggagauuauga

SEQ ID NO: 27150 - RNA, 19 nt, Homo sapiens
gaucuggccaaagacauaa

SEQ ID NO: 27151 - RNA, 19 nt, Homo sapiens
gagaaagaugucuauguag

SEQ ID NO: 27152 - RNA, 19 nt, Homo sapiens
ugaaaggugacauugagaa

SEQ ID NO: 27153 - RNA, 19 nt, Homo sapiens
ucugaggacuuugguguga

SEQ ID NO: 27154 - RNA, 19 nt, Homo sapiens
gaacuaacaaagaaaucag

SEQ ID NO: 27155 - RNA, 19 nt, Homo sapiens
gaaagaugucuauguagcu

SEQ ID NO: 27156 - RNA, 19 nt, Homo sapiens
gauuaugguuucccguucu

SEQ ID NO: 27157 - RNA, 19 nt, Homo sapiens
caacuucgcagaguguuuc

SEQ ID NO: 27158 - RNA, 19 nt, Homo sapiens
cuacagagaggaacugaag

SEQ ID NO: 27159 - RNA, 19 nt, Homo sapiens
caaccaucauugacauucu

SEQ ID NO: 27160 - RNA, 19 nt, Homo sapiens
uguaugguaucucccuuug

SEQ ID NO: 27161 - RNA, 19 nt, Homo sapiens
uaucaaagcauucuaucag

SEQ ID NO: 27162 - RNA, 19 nt, Homo sapiens
caugaaugauaucaaagca

SEQ ID NO: 27163 - RNA, 19 nt, Homo sapiens
gguguuggaacucgccaua

SEQ ID NO: 27164 - RNA, 19 nt, Homo sapiens
aaauacaccaaguacagua

SEQ ID NO: 27165 - RNA, 19 nt, Homo sapiens
gaagcaggagaaaggagaa

SEQ ID NO: 27166 - RNA, 19 nt, Homo sapiens
guaugaagcaggagaaagg

SEQ ID NO: 27167 - RNA, 19 nt, Homo sapiens
gcaaugguaucagaauucc

SEQ ID NO: 27168 - RNA, 19 nt, Homo sapiens
aaccaucauugacauucua

SEQ ID NO: 27169 - RNA, 19 nt, Homo sapiens
gaaaccaaaggagauuaug

SEQ ID NO: 27170 - RNA, 19 nt, Homo sapiens
augaagagcaggaauaugu

SEQ ID NO: 27171 - RNA, 19 nt, Homo sapiens
gaaugaagacuuggcugau

SEQ ID NO: 27172 - RNA, 19 nt, Homo sapiens
gcuuugcuuucucuugcua

SEQ ID NO: 27173 - RNA, 19 nt, Homo sapiens
gcaaccaucauugacauuc

SEQ ID NO: 27174 - RNA, 19 nt, Homo sapiens
ggcaaugguaucagaauuc

SEQ ID NO: 27175 - RNA, 19 nt, Homo sapiens
aaacuccagcgcaauuuga

SEQ ID NO: 27176 - RNA, 19 nt, Homo sapiens
cuaacuaagcgaaacaaug

SEQ ID NO: 27177 - RNA, 19 nt, Homo sapiens
agaaauacaccaaguacag

SEQ ID NO: 27178 - RNA, 19 nt, Homo sapiens
ugaggacuuuggugugaau

SEQ ID NO: 27179 - RNA, 19 nt, Homo sapiens
ggaaagccccuggaugaaa

SEQ ID NO: 27180 - RNA, 19 nt, Homo sapiens
gcaagucccuguacuauua

SEQ ID NO: 27181 - RNA, 19 nt, Homo sapiens
gaagacaccugcucaguau

SEQ ID NO: 27182 - RNA, 19 nt, Homo sapiens
ggacacaucuggugacuuc

SEQ ID NO: 27183 - RNA, 19 nt, Homo sapiens
gaagugaagucuaugaugu

SEQ ID NO: 27184 - RNA, 19 nt, Homo sapiens
gcagugaaguggacauguu

SEQ ID NO: 27185 - RNA, 19 nt, Homo sapiens
gaggauggcucugucauug

SEQ ID NO: 27186 - RNA, 19 nt, Homo sapiens
gcacagagacaggauauug

SEQ ID NO: 27187 - RNA, 19 nt, Homo sapiens
ggucugaauucaagagaaa

SEQ ID NO: 27188 - RNA, 19 nt, Homo sapiens
gacgaggacucucucauug

SEQ ID NO: 27189 - RNA, 19 nt, Homo sapiens
guaugacgcuucugagcua

SEQ ID NO: 27190 - RNA, 19 nt, Homo sapiens
ugaagucuaugaugugaaa

SEQ ID NO: 27191 - RNA, 19 nt, Homo sapiens
gauaagguccugaucagaa

SEQ ID NO: 27192 - RNA, 19 nt, Homo sapiens
agacugaucuggagaagga

SEQ ID NO: 27193 - RNA, 19 nt, Homo sapiens
uaacagagucuacaaggaa

SEQ ID NO: 27194 - RNA, 19 nt, Homo sapiens
gagggugacguuagcauua

SEQ ID NO: 27195 - RNA, 19 nt, Homo sapiens
uuacagcccuuaugacaug

SEQ ID NO: 27196 - RNA, 19 nt, Homo sapiens
ugucuagucucuccuguaa

SEQ ID NO: 27197 - RNA, 19 nt, Homo sapiens
aaaaccagcuugcgaauaa

SEQ ID NO: 27198 - RNA, 19 nt, Homo sapiens
gagauaagguccugaucag

SEQ ID NO: 27199 - RNA, 19 nt, Homo sapiens
aaacagccaucaagaccaa

SEQ ID NO: 27200 - RNA, 19 nt, Homo sapiens
ucaccaugcuuccagcuaa

SEQ ID NO: 27201 - RNA, 19 nt, Homo sapiens
gggaugcuuugaacauuga

SEQ ID NO: 27202 - RNA, 19 nt, Homo sapiens
ggauggcucugucauugau

SEQ ID NO: 27203 - RNA, 19 nt, Homo sapiens
gaaauuaacagagucuaca

SEQ ID NO: 27204 - RNA, 19 nt, Homo sapiens
ugaagacaccugcucagua

SEQ ID NO: 27205 - RNA, 19 nt, Homo sapiens
guggacauguugaaaauua

SEQ ID NO: 27206 - RNA, 19 nt, Homo sapiens
ggucaccauugucaacauu

SEQ ID NO: 27207 - RNA, 19 nt, Homo sapiens
gaacaagccccuguauuuu

SEQ ID NO: 27208 - RNA, 19 nt, Homo sapiens
cggcccagcuuccuucaaa

SEQ ID NO: 27209 - RNA, 19 nt, Homo sapiens
cgacgaggacucucucauu

SEQ ID NO: 27210 - RNA, 19 nt, Homo sapiens
ggaagugaagucuaugaug

SEQ ID NO: 27211 - RNA, 19 nt, Homo sapiens
uaagggcgacuaccagaaa

SEQ ID NO: 27212 - RNA, 19 nt, Homo sapiens
ggagugaagaggaaaggaa

SEQ ID NO: 27213 - RNA, 19 nt, Homo sapiens
gaacugauugaccaagaug

SEQ ID NO: 27214 - RNA, 19 nt, Homo sapiens
uggaugaggucaccauugu

SEQ ID NO: 27215 - RNA, 19 nt, Homo sapiens
gcauaugggucugucaaag

SEQ ID NO: 27216 - RNA, 19 nt, Homo sapiens
acuauuauauccagcaaga

SEQ ID NO: 27217 - RNA, 19 nt, Homo sapiens
gcgggaugcuuugaacauu

SEQ ID NO: 27218 - RNA, 19 nt, Homo sapiens
gaggaaaggaacugauguu

SEQ ID NO: 27219 - RNA, 19 nt, Homo sapiens
gaccaaagguguggaugag

SEQ ID NO: 27220 - RNA, 19 nt, Homo sapiens
ucuaugaugugaaacacuu

SEQ ID NO: 27221 - RNA, 19 nt, Homo sapiens
gaugaggucaccauuguca

SEQ ID NO: 27222 - RNA, 19 nt, Homo sapiens
agaaagcgcugcuguaccu

SEQ ID NO: 27223 - RNA, 19 nt, Homo sapiens
caggaaagagguuaaagga

SEQ ID NO: 27224 - RNA, 19 nt, Homo sapiens
acaaggaaauguacaagac

SEQ ID NO: 27225 - RNA, 19 nt, Homo sapiens
ggagggugaucacucuaca

SEQ ID NO: 27226 - RNA, 19 nt, Homo sapiens
guacuauuauauccagcaa

SEQ ID NO: 27227 - RNA, 19 nt, Homo sapiens
ccgcagcaaugcacagaga

SEQ ID NO: 27228 - RNA, 19 nt, Homo sapiens
ccuguaagccaaagaaaug

SEQ ID NO: 27229 - RNA, 19 nt, Homo sapiens
cagcuaacaggucuagaaa

SEQ ID NO: 27230 - RNA, 19 nt, Homo sapiens
cagaaaguauuugauaggu

SEQ ID NO: 27231 - RNA, 19 nt, Homo sapiens
ggacauuauuucggacaca

SEQ ID NO: 27232 - RNA, 19 nt, Homo sapiens
gaaauguacaagacugauc

SEQ ID NO: 27233 - RNA, 19 nt, Homo sapiens
ccagcuaacaggucuagaa

SEQ ID NO: 27234 - RNA, 19 nt, Homo sapiens
cgagauaagguccugauca

SEQ ID NO: 27235 - RNA, 19 nt, Homo sapiens
uuugauagguacaagaguu

SEQ ID NO: 27236 - RNA, 19 nt, Homo sapiens
accaggagcugcaggaaau

SEQ ID NO: 27237 - RNA, 19 nt, Homo sapiens
guaccugugugguggagau

SEQ ID NO: 27238 - RNA, 19 nt, Homo sapiens
gaaguggacauguugaaaa

SEQ ID NO: 27239 - RNA, 19 nt, Homo sapiens
gaagaggaaaggaacugau

SEQ ID NO: 27240 - RNA, 19 nt, Homo sapiens
ggccugagcguccagaaau

SEQ ID NO: 27241 - RNA, 19 nt, Homo sapiens
agaacaagccccuguauuu

SEQ ID NO: 27242 - RNA, 19 nt, Homo sapiens
gaucuggagaaggacauua

SEQ ID NO: 27243 - RNA, 19 nt, Homo sapiens
agacaccugcucaguauga

SEQ ID NO: 27244 - RNA, 19 nt, Homo sapiens
cgggaugcuuugaacauug

SEQ ID NO: 27245 - RNA, 19 nt, Homo sapiens
gguuaaaggagaccuggaa

SEQ ID NO: 27246 - RNA, 19 nt, Homo sapiens
uggaaagcaucaggaaaga

SEQ ID NO: 27247 - RNA, 19 nt, Homo sapiens
agaguuacagcccuuauga

SEQ ID NO: 27248 - RNA, 19 nt, Homo sapiens
ggagaaggacauuauuucg

SEQ ID NO: 27249 - RNA, 19 nt, Homo sapiens
uuaacagagucuacaagga

SEQ ID NO: 27250 - RNA, 19 nt, Homo sapiens
gaaaaccagcuugcgaaua

SEQ ID NO: 27251 - RNA, 19 nt, Homo sapiens
gucaaagccuauacuaacu

SEQ ID NO: 27252 - RNA, 19 nt, Homo sapiens
cuccagaaaguauuugaua

SEQ ID NO: 27253 - RNA, 19 nt, Homo sapiens
cuaugacgcuggagugaag

SEQ ID NO: 27254 - RNA, 19 nt, Homo sapiens
ggaaauuaacagagucuac

SEQ ID NO: 27255 - RNA, 19 nt, Homo sapiens
ugucuacuguucacgaaau

SEQ ID NO: 27256 - RNA, 19 nt, Homo sapiens
auaagguccugaucagaau

SEQ ID NO: 27257 - RNA, 19 nt, Homo sapiens
cuuaugacauguuggaaag

SEQ ID NO: 27258 - RNA, 19 nt, Homo sapiens
ccaaguggaucagcaucau

SEQ ID NO: 27259 - RNA, 19 nt, Homo sapiens
caggagcugcaggaaauua

SEQ ID NO: 27260 - RNA, 19 nt, Homo sapiens
gaaccgacgaggacucucu

SEQ ID NO: 27261 - RNA, 19 nt, Homo sapiens
ccuguguacugugucauaa

SEQ ID NO: 27262 - RNA, 19 nt, Homo sapiens
ugucaaagccuauacuaac

SEQ ID NO: 27263 - RNA, 19 nt, Homo sapiens
gcuaacaggucuagaaaac

SEQ ID NO: 27264 - RNA, 19 nt, Homo sapiens
ugaacugauugaccaagau

SEQ ID NO: 27265 - RNA, 19 nt, Homo sapiens
ccaccuccagaaaguauuu

SEQ ID NO: 27266 - RNA, 19 nt, Homo sapiens
aacagagucuacaaggaaa

SEQ ID NO: 27267 - RNA, 19 nt, Homo sapiens
ggcaagucccuguacuauu

SEQ ID NO: 27268 - RNA, 19 nt, Homo sapiens
aagccuauacuaacuuuga

SEQ ID NO: 27269 - RNA, 19 nt, Homo sapiens
ccagaaagcgcugcuguac

SEQ ID NO: 27270 - RNA, 19 nt, Homo sapiens
ugaaguggacauguugaaa

SEQ ID NO: 27271 - RNA, 19 nt, Homo sapiens
uugcugaucggcuguauga

SEQ ID NO: 27272 - RNA, 19 nt, Homo sapiens
ucaaagccuauacuaacuu

SEQ ID NO: 27273 - RNA, 19 nt, Homo sapiens
uaacaggucuagaaaacca

SEQ ID NO: 27274 - RNA, 19 nt, Homo sapiens
ccagaaaguauuugauagg

SEQ ID NO: 27275 - RNA, 19 nt, Homo sapiens
uccagaaaguauuugauag

SEQ ID NO: 27276 - RNA, 19 nt, Homo sapiens
gacauuauuucggacacau

SEQ ID NO: 27277 - RNA, 19 nt, Homo sapiens
uggagaaggacauuauuuc

SEQ ID NO: 27278 - RNA, 19 nt, Homo sapiens
caagacugaucuggagaag

SEQ ID NO: 27279 - RNA, 19 nt, Homo sapiens
ugcaggaaauuaacagagu

SEQ ID NO: 27280 - RNA, 19 nt, Homo sapiens
gaaaggagcugaaagauga

SEQ ID NO: 27281 - RNA, 19 nt, Homo sapiens
gaagaugccuugauugaaa

SEQ ID NO: 27282 - RNA, 19 nt, Homo sapiens
gaagacaaauucacugaga

SEQ ID NO: 27283 - RNA, 19 nt, Homo sapiens
ucacugagauccuguguuu

SEQ ID NO: 27284 - RNA, 19 nt, Homo sapiens
ggagaugacugaaccaaga

SEQ ID NO: 27285 - RNA, 19 nt, Homo sapiens
caaacaagaugcccagauu

SEQ ID NO: 27286 - RNA, 19 nt, Homo sapiens
gaucucagcucaaggcaaa

SEQ ID NO: 27287 - RNA, 19 nt, Homo sapiens
aaacgaagaugccuugauu

SEQ ID NO: 27288 - RNA, 19 nt, Homo sapiens
caaagcagcuaaagaaauc

SEQ ID NO: 27289 - RNA, 19 nt, Homo sapiens
gcaauuaaaucggauacuu

SEQ ID NO: 27290 - RNA, 19 nt, Homo sapiens
cgaaacaucuggugacuuc

SEQ ID NO: 27291 - RNA, 19 nt, Homo sapiens
ggauaucucucaagccuau

SEQ ID NO: 27292 - RNA, 19 nt, Homo sapiens
caacuacuauccaacuuau

SEQ ID NO: 27293 - RNA, 19 nt, Homo sapiens
gcaggcaaaugaaggauau

SEQ ID NO: 27294 - RNA, 19 nt, Homo sapiens
caagaagcauuauggcuau

SEQ ID NO: 27295 - RNA, 19 nt, Homo sapiens
gaggaacaguaagagauua

SEQ ID NO: 27296 - RNA, 19 nt, Homo sapiens
gcugaaagaugacuugaag

SEQ ID NO: 27297 - RNA, 19 nt, Homo sapiens
gcaacuacuauccaacuua

SEQ ID NO: 27298 - RNA, 19 nt, Homo sapiens
gaucagaaauugaccuuuu

SEQ ID NO: 27299 - RNA, 19 nt, Homo sapiens
gggcacggaugaagacaaa

SEQ ID NO: 27300 - RNA, 19 nt, Homo sapiens
gaauaaugguguccagauc

SEQ ID NO: 27301 - RNA, 19 nt, Homo sapiens
gcaaagcagcuaaagaaau

SEQ ID NO: 27302 - RNA, 19 nt, Homo sapiens
ggacaccgaggaacaguaa

SEQ ID NO: 27303 - RNA, 19 nt, Homo sapiens
caccuuacuucuucucaua

SEQ ID NO: 27304 - RNA, 19 nt, Homo sapiens
gcagauggcagaagagaug

SEQ ID NO: 27305 - RNA, 19 nt, Homo sapiens
ggaaaggagcugaaagaug

SEQ ID NO: 27306 - RNA, 19 nt, Homo sapiens
ucaagccuauuauacagua

SEQ ID NO: 27307 - RNA, 19 nt, Homo sapiens
gcacggaugaagacaaauu

SEQ ID NO: 27308 - RNA, 19 nt, Homo sapiens
uaauguagcagcucauaaa

SEQ ID NO: 27309 - RNA, 19 nt, Homo sapiens
ggauacuucuggagacuau

SEQ ID NO: 27310 - RNA, 19 nt, Homo sapiens
gagauuauccagacuuuag

SEQ ID NO: 27311 - RNA, 19 nt, Homo sapiens
caacagcuccaccuuacuu

SEQ ID NO: 27312 - RNA, 19 nt, Homo sapiens
gaaagcaaucagaggaauu

SEQ ID NO: 27313 - RNA, 19 nt, Homo sapiens
gcaaaggugggauaucaug

SEQ ID NO: 27314 - RNA, 19 nt, Homo sapiens
gagcuuuccucaauuaaaa

SEQ ID NO: 27315 - RNA, 19 nt, Homo sapiens
ggacaagcaggcaaaugaa

SEQ ID NO: 27316 - RNA, 19 nt, Homo sapiens
aauuggaacugaugagaaa

SEQ ID NO: 27317 - RNA, 19 nt, Homo sapiens
ggacauuguggacagcaua

SEQ ID NO: 27318 - RNA, 19 nt, Homo sapiens
cuauaaagcuggugagaac

SEQ ID NO: 27319 - RNA, 19 nt, Homo sapiens
uuaaagaucugcaacuacu

SEQ ID NO: 27320 - RNA, 19 nt, Homo sapiens
ugacugaaccaagaagaua

SEQ ID NO: 27321 - RNA, 19 nt, Homo sapiens
cauuauggcuauucccuau

SEQ ID NO: 27322 - RNA, 19 nt, Homo sapiens
ugacauuaguuccgaaaca

SEQ ID NO: 27323 - RNA, 19 nt, Homo sapiens
gaauuggaacugaugagaa

SEQ ID NO: 27324 - RNA, 19 nt, Homo sapiens
ggagaauuaucugggcauu

SEQ ID NO: 27325 - RNA, 19 nt, Homo sapiens
gcagcugauuguuaaggaa

SEQ ID NO: 27326 - RNA, 19 nt, Homo sapiens
gggauaucauggcaucuau

SEQ ID NO: 27327 - RNA, 19 nt, Homo sapiens
ugaaggguauuggaacuga

SEQ ID NO: 27328 - RNA, 19 nt, Homo sapiens
acugagauccuguguuuaa

SEQ ID NO: 27329 - RNA, 19 nt, Homo sapiens
gagaugaaagucugaaagu

SEQ ID NO: 27330 - RNA, 19 nt, Homo sapiens
gcaaaugaaggauaucucu

SEQ ID NO: 27331 - RNA, 19 nt, Homo sapiens
cagcauaaaaggagaauua

SEQ ID NO: 27332 - RNA, 19 nt, Homo sapiens
ggagcuuuccucaauuaaa

SEQ ID NO: 27333 - RNA, 19 nt, Homo sapiens
ugaucucucuggccacuuu

SEQ ID NO: 27334 - RNA, 19 nt, Homo sapiens
aggcaaaggugggauauca

SEQ ID NO: 27335 - RNA, 19 nt, Homo sapiens
aagagauuauccagacuuu

SEQ ID NO: 27336 - RNA, 19 nt, Homo sapiens
gacauuaguuccgaaacau

SEQ ID NO: 27337 - RNA, 19 nt, Homo sapiens
ggaauuggaacugaugaga

SEQ ID NO: 27338 - RNA, 19 nt, Homo sapiens
gcaaauauaaacagcaacu

SEQ ID NO: 27339 - RNA, 19 nt, Homo sapiens
agaauuaucugggcauuuu

SEQ ID NO: 27340 - RNA, 19 nt, Homo sapiens
cgaggaacaguaagagauu

SEQ ID NO: 27341 - RNA, 19 nt, Homo sapiens
augcccagauucucuauaa

SEQ ID NO: 27342 - RNA, 19 nt, Homo sapiens
uuauggcuauucccuauau

SEQ ID NO: 27343 - RNA, 19 nt, Homo sapiens
caauuaaaucggauacuuc

SEQ ID NO: 27344 - RNA, 19 nt, Homo sapiens
gaagagaugaaagucugaa

SEQ ID NO: 27345 - RNA, 19 nt, Homo sapiens
augcaaagcagcuaaagaa

SEQ ID NO: 27346 - RNA, 19 nt, Homo sapiens
gacugaaccaagaagauaa

SEQ ID NO: 27347 - RNA, 19 nt, Homo sapiens
cagaguucaagaagcauua

SEQ ID NO: 27348 - RNA, 19 nt, Homo sapiens
gaaggguauuggaacugau

SEQ ID NO: 27349 - RNA, 19 nt, Homo sapiens
gagaugacugaaccaagaa

SEQ ID NO: 27350 - RNA, 19 nt, Homo sapiens
gcugauuguuaaggaauau

SEQ ID NO: 27351 - RNA, 19 nt, Homo sapiens
aaagaucugcaacuacuau

SEQ ID NO: 27352 - RNA, 19 nt, Homo sapiens
gagaauuaucugggcauuu

SEQ ID NO: 27353 - RNA, 19 nt, Homo sapiens
uaaagcuggugagaacaga

SEQ ID NO: 27354 - RNA, 19 nt, Homo sapiens
caagaugcccagauucucu

SEQ ID NO: 27355 - RNA, 19 nt, Homo sapiens
agcggcagcugauuguuaa

SEQ ID NO: 27356 - RNA, 19 nt, Homo sapiens
gcagaagagaugaaagucu

SEQ ID NO: 27357 - RNA, 19 nt, Homo sapiens
cgaagaugccuugauugaa

SEQ ID NO: 27358 - RNA, 19 nt, Homo sapiens
acgaagaugccuugauuga

SEQ ID NO: 27359 - RNA, 19 nt, Homo sapiens
gaugcaaagcagcuaaaga

SEQ ID NO: 27360 - RNA, 19 nt, Homo sapiens
ucaagcagcauauggaaag

SEQ ID NO: 27361 - RNA, 19 nt, Homo sapiens
cccaacagcuccaccuuac

SEQ ID NO: 27362 - RNA, 19 nt, Homo sapiens
cagaggaauuggaacugau

SEQ ID NO: 27363 - RNA, 19 nt, Homo sapiens
gaagcuauucagaaagcaa

SEQ ID NO: 27364 - RNA, 19 nt, Homo sapiens
agaaagcaaucagaggaau

SEQ ID NO: 27365 - RNA, 19 nt, Homo sapiens
aggaauaucaagcagcaua

SEQ ID NO: 27366 - RNA, 19 nt, Homo sapiens
uauaauguagcagcucaua

SEQ ID NO: 27367 - RNA, 19 nt, Homo sapiens
cuaugaaaucacacucuua

SEQ ID NO: 27368 - RNA, 19 nt, Homo sapiens
ucaaggcaaaggugggaua

SEQ ID NO: 27369 - RNA, 19 nt, Homo sapiens
cgaauaaugguguccagau

SEQ ID NO: 27370 - RNA, 19 nt, Homo sapiens
uaagagauuauccagacuu

SEQ ID NO: 27371 - RNA, 19 nt, Homo sapiens
gcccagauucucuauaaag

SEQ ID NO: 27372 - RNA, 19 nt, Homo sapiens
ccggaaagcucuguugacu

SEQ ID NO: 27373 - RNA, 19 nt, Homo sapiens
aaaugaaggauaucucuca

SEQ ID NO: 27374 - RNA, 19 nt, Homo sapiens
cagcuaaagaaauccauga

SEQ ID NO: 27375 - RNA, 19 nt, Homo sapiens
ggagcugaaagaugacuug

SEQ ID NO: 27376 - RNA, 19 nt, Homo sapiens
gacauuguggacagcauaa

SEQ ID NO: 27377 - RNA, 19 nt, Homo sapiens
gaugacauuaguuccgaaa

SEQ ID NO: 27378 - RNA, 19 nt, Homo sapiens
aggacaagcaggcaaauga

SEQ ID NO: 27379 - RNA, 19 nt, Homo sapiens
ggcagcugauuguuaagga

SEQ ID NO: 27380 - RNA, 19 nt, Homo sapiens
gaaagucucuguacucguu

SEQ ID NO: 27381 - RNA, 19 nt, Homo sapiens
gaugagggcugccuaauug

SEQ ID NO: 27382 - RNA, 19 nt, Homo sapiens
gaaaucaccuguugcaugu

SEQ ID NO: 27383 - RNA, 19 nt, Homo sapiens
gaaccgaaaucaccuguug

SEQ ID NO: 27384 - RNA, 19 nt, Homo sapiens
gcuaguaguuucuucauuu

SEQ ID NO: 27385 - RNA, 19 nt, Homo sapiens
gagcagaaauugacauguu

SEQ ID NO: 27386 - RNA, 19 nt, Homo sapiens
caaaggagguacugucaaa

SEQ ID NO: 27387 - RNA, 19 nt, Homo sapiens
gaaauugacauguuggaua

SEQ ID NO: 27388 - RNA, 19 nt, Homo sapiens
ugaaacaucugguagcuuu

SEQ ID NO: 27389 - RNA, 19 nt, Homo sapiens
gaugaagacgccauuauua

SEQ ID NO: 27390 - RNA, 19 nt, Homo sapiens
ggaggauucucaacacuuu

SEQ ID NO: 27391 - RNA, 19 nt, Homo sapiens
ggacagaugaggugaaauu

SEQ ID NO: 27392 - RNA, 19 nt, Homo sapiens
gaacucugaucuugaccua

SEQ ID NO: 27393 - RNA, 19 nt, Homo sapiens
gauguaaugcucugaauuu

SEQ ID NO: 27394 - RNA, 19 nt, Homo sapiens
guaaugcucugaauuuagu

SEQ ID NO: 27395 - RNA, 19 nt, Homo sapiens
guaagcauccggucaguaa

SEQ ID NO: 27396 - RNA, 19 nt, Homo sapiens
gaaagcaucuacaaaucuc

SEQ ID NO: 27397 - RNA, 19 nt, Homo sapiens
ggaaaguacugcuuguucu

SEQ ID NO: 27398 - RNA, 19 nt, Homo sapiens
gaggugaaauuucuaacug

SEQ ID NO: 27399 - RNA, 19 nt, Homo sapiens
ggacggagccuugaagaug

SEQ ID NO: 27400 - RNA, 19 nt, Homo sapiens
uaauccagcuugcaaguga

SEQ ID NO: 27401 - RNA, 19 nt, Homo sapiens
ucagaaugcuuauuuccaa

SEQ ID NO: 27402 - RNA, 19 nt, Homo sapiens
gacggagccuugaagauga

SEQ ID NO: 27403 - RNA, 19 nt, Homo sapiens
ugacacaucuggagacuac

SEQ ID NO: 27404 - RNA, 19 nt, Homo sapiens
cagaugaggugaaauuucu

SEQ ID NO: 27405 - RNA, 19 nt, Homo sapiens
cuacacugcuauuaucauu

SEQ ID NO: 27406 - RNA, 19 nt, Homo sapiens
ggugaaauuucuaacuguu

SEQ ID NO: 27407 - RNA, 19 nt, Homo sapiens
gaagggagccggcacugau

SEQ ID NO: 27408 - RNA, 19 nt, Homo sapiens
gcugaacauuccauauuau

SEQ ID NO: 27409 - RNA, 19 nt, Homo sapiens
gaaaagcucuauaaaucga

SEQ ID NO: 27410 - RNA, 19 nt, Homo sapiens
ggagggaugaaggaaauua

SEQ ID NO: 27411 - RNA, 19 nt, Homo sapiens
aaaccuaccagcagcaaua

SEQ ID NO: 27412 - RNA, 19 nt, Homo sapiens
acagcugccuccuagaaua

SEQ ID NO: 27413 - RNA, 19 nt, Homo sapiens
ugcugaacauuccauauua

SEQ ID NO: 27414 - RNA, 19 nt, Homo sapiens
caucaagggugacacaucu

SEQ ID NO: 27415 - RNA, 19 nt, Homo sapiens
uaagaaugcccauccaguu

SEQ ID NO: 27416 - RNA, 19 nt, Homo sapiens
uaaagugcaugaggaacaa

SEQ ID NO: 27417 - RNA, 19 nt, Homo sapiens
guaugaggcuggagagaag

SEQ ID NO: 27418 - RNA, 19 nt, Homo sapiens
ucuaagauguacuuggauu

SEQ ID NO: 27419 - RNA, 19 nt, Homo sapiens
guacuugcauuucaaagcu

SEQ ID NO: 27420 - RNA, 19 nt, Homo sapiens
ggaagacuguucuaaaauc

SEQ ID NO: 27421 - RNA, 19 nt, Homo sapiens
gaaggauauugaacagagu

SEQ ID NO: 27422 - RNA, 19 nt, Homo sapiens
gcauguguuugaugaauac

SEQ ID NO: 27423 - RNA, 19 nt, Homo sapiens
gaugaggugaaauuucuaa

SEQ ID NO: 27424 - RNA, 19 nt, Homo sapiens
cgaugaagacgccauuauu

SEQ ID NO: 27425 - RNA, 19 nt, Homo sapiens
uagaguggcuaguaguuuc

SEQ ID NO: 27426 - RNA, 19 nt, Homo sapiens
uuaaagcuguacuugcauu

SEQ ID NO: 27427 - RNA, 19 nt, Homo sapiens
uggcugaacucugaucuug

SEQ ID NO: 27428 - RNA, 19 nt, Homo sapiens
acucugaucuugaccuaga

SEQ ID NO: 27429 - RNA, 19 nt, Homo sapiens
cuaguaguuucuucauuug

SEQ ID NO: 27430 - RNA, 19 nt, Homo sapiens
cugaaaagcucuauaaauc

SEQ ID NO: 27431 - RNA, 19 nt, Homo sapiens
guaaagugcaugaggaaca

SEQ ID NO: 27432 - RNA, 19 nt, Homo sapiens
gaggaacaaaucugcauau

SEQ ID NO: 27433 - RNA, 19 nt, Homo sapiens
ucugguagcuuugaagaug

SEQ ID NO: 27434 - RNA, 19 nt, Homo sapiens
gaagacuguucuaaaauca

SEQ ID NO: 27435 - RNA, 19 nt, Homo sapiens
aagaugcucugcuggcuau

SEQ ID NO: 27436 - RNA, 19 nt, Homo sapiens
gcugaacucugaucuugac

SEQ ID NO: 27437 - RNA, 19 nt, Homo sapiens
gcucugcuggcuauaguaa

SEQ ID NO: 27438 - RNA, 19 nt, Homo sapiens
gacauucgcucugacacau

SEQ ID NO: 27439 - RNA, 19 nt, Homo sapiens
aagaugacauucgcucuga

SEQ ID NO: 27440 - RNA, 19 nt, Homo sapiens
gcuugcaagugaauggaaa

SEQ ID NO: 27441 - RNA, 19 nt, Homo sapiens
aagaaugcccauccaguuu

SEQ ID NO: 27442 - RNA, 19 nt, Homo sapiens
gaucaggacagccuacaag

SEQ ID NO: 27443 - RNA, 19 nt, Homo sapiens
gcucugaauuuaguaugau

SEQ ID NO: 27444 - RNA, 19 nt, Homo sapiens
cuuuaaagcuguacuugca

SEQ ID NO: 27445 - RNA, 19 nt, Homo sapiens
cuacagcugccuccuagaa

SEQ ID NO: 27446 - RNA, 19 nt, Homo sapiens
caacuucgagcaggugauu

SEQ ID NO: 27447 - RNA, 19 nt, Homo sapiens
uuggguggcugaacucuga

SEQ ID NO: 27448 - RNA, 19 nt, Homo sapiens
auucuaagauguacuugga

SEQ ID NO: 27449 - RNA, 19 nt, Homo sapiens
gagacuuccuucaucacau

SEQ ID NO: 27450 - RNA, 19 nt, Homo sapiens
gauagacgaccugaaguca

SEQ ID NO: 27451 - RNA, 19 nt, Homo sapiens
uugaaagcaucuacaaauc

SEQ ID NO: 27452 - RNA, 19 nt, Homo sapiens
aagcuguacuugcauuuca

SEQ ID NO: 27453 - RNA, 19 nt, Homo sapiens
ugggagggaugaaggaaau

SEQ ID NO: 27454 - RNA, 19 nt, Homo sapiens
guagucaaaguauaccaaa

SEQ ID NO: 27455 - RNA, 19 nt, Homo sapiens
cuuccuucaucacaucuua

SEQ ID NO: 27456 - RNA, 19 nt, Homo sapiens
gaaaguacugcuuguucuc

SEQ ID NO: 27457 - RNA, 19 nt, Homo sapiens
ugcauguguuugaugaaua

SEQ ID NO: 27458 - RNA, 19 nt, Homo sapiens
caucuuauguugaaaucac

SEQ ID NO: 27459 - RNA, 19 nt, Homo sapiens
cuugaaagcaucuacaaau

SEQ ID NO: 27460 - RNA, 19 nt, Homo sapiens
aauggaagacuguucuaaa

SEQ ID NO: 27461 - RNA, 19 nt, Homo sapiens
cagaaugcuuauuuccaau

SEQ ID NO: 27462 - RNA, 19 nt, Homo sapiens
gacaggaggauucucaaca

SEQ ID NO: 27463 - RNA, 19 nt, Homo sapiens
cagaaggacaggaggauuc

SEQ ID NO: 27464 - RNA, 19 nt, Homo sapiens
ggagacuuccuucaucaca

SEQ ID NO: 27465 - RNA, 19 nt, Homo sapiens
agaacugaguggcaacuuc

SEQ ID NO: 27466 - RNA, 19 nt, Homo sapiens
caucggcagggacuugaua

SEQ ID NO: 27467 - RNA, 19 nt, Homo sapiens
ggcuaguaguuucuucauu

SEQ ID NO: 27468 - RNA, 19 nt, Homo sapiens
aggaacaaaucugcauauu

SEQ ID NO: 27469 - RNA, 19 nt, Homo sapiens
ugaugagggcugccuaauu

SEQ ID NO: 27470 - RNA, 19 nt, Homo sapiens
ugaaagcaucuacaaaucu

SEQ ID NO: 27471 - RNA, 19 nt, Homo sapiens
cgcccacggugcuguauga

SEQ ID NO: 27472 - RNA, 19 nt, Homo sapiens
uaaauggaagacuguucua

SEQ ID NO: 27473 - RNA, 19 nt, Homo sapiens
uuucuacacugcuauuauc

SEQ ID NO: 27474 - RNA, 19 nt, Homo sapiens
ucucuguacucguucauca

SEQ ID NO: 27475 - RNA, 19 nt, Homo sapiens
gacagaugaggugaaauuu

SEQ ID NO: 27476 - RNA, 19 nt, Homo sapiens
ugggagacuuccuucauca

SEQ ID NO: 27477 - RNA, 19 nt, Homo sapiens
uggaggagaugauuaaaau

SEQ ID NO: 27478 - RNA, 19 nt, Homo sapiens
aaacaucugguagcuuuga

SEQ ID NO: 27479 - RNA, 19 nt, Homo sapiens
acagaaggauauugaacag

SEQ ID NO: 27480 - RNA, 19 nt, Homo sapiens
gaagggagcuggaacaaau

SEQ ID NO: 27481 - RNA, 19 nt, Homo sapiens
gaaagguguuugacaagua

SEQ ID NO: 27482 - RNA, 19 nt, Homo sapiens
gcagggaucuucuggauga

SEQ ID NO: 27483 - RNA, 19 nt, Homo sapiens
caacuaaacuaaaccugua

SEQ ID NO: 27484 - RNA, 19 nt, Homo sapiens
ggaaggaguuuaggaagaa

SEQ ID NO: 27485 - RNA, 19 nt, Homo sapiens
gcucaagccuggaagauga

SEQ ID NO: 27486 - RNA, 19 nt, Homo sapiens
gaagggagcugggacagau

SEQ ID NO: 27487 - RNA, 19 nt, Homo sapiens
cgagacuucuggcaauuua

SEQ ID NO: 27488 - RNA, 19 nt, Homo sapiens
ggaaaucucugcagcuuuu

SEQ ID NO: 27489 - RNA, 19 nt, Homo sapiens
ugagaaagguguuugacaa

SEQ ID NO: 27490 - RNA, 19 nt, Homo sapiens
acacauugccuuauucaua

SEQ ID NO: 27491 - RNA, 19 nt, Homo sapiens
cgaagugugucucauuuga

SEQ ID NO: 27492 - RNA, 19 nt, Homo sapiens
gaaauuauugcuucaagga

SEQ ID NO: 27493 - RNA, 19 nt, Homo sapiens
aaucagaacuaacuggaaa

SEQ ID NO: 27494 - RNA, 19 nt, Homo sapiens
gaaacccucucggcuuuau

SEQ ID NO: 27495 - RNA, 19 nt, Homo sapiens
acaagaugcucaggcuuua

SEQ ID NO: 27496 - RNA, 19 nt, Homo sapiens
acacauacacgucauagaa

SEQ ID NO: 27497 - RNA, 19 nt, Homo sapiens
guacugacagaaauuauug

SEQ ID NO: 27498 - RNA, 19 nt, Homo sapiens
guugugaaaucuauucgaa

SEQ ID NO: 27499 - RNA, 19 nt, Homo sapiens
acaaguacaugacuauauc

SEQ ID NO: 27500 - RNA, 19 nt, Homo sapiens
gaacugagagccaucaaac

SEQ ID NO: 27501 - RNA, 19 nt, Homo sapiens
cacgaagugugucucauuu

SEQ ID NO: 27502 - RNA, 19 nt, Homo sapiens
ugacuucccuggauuugau

SEQ ID NO: 27503 - RNA, 19 nt, Homo sapiens
gaacugaaacaugccuuga

SEQ ID NO: 27504 - RNA, 19 nt, Homo sapiens
ugacugacuucccuggauu

SEQ ID NO: 27505 - RNA, 19 nt, Homo sapiens
aagcuuagccuugaaauug

SEQ ID NO: 27506 - RNA, 19 nt, Homo sapiens
cuuaacacauugccuuauu

SEQ ID NO: 27507 - RNA, 19 nt, Homo sapiens
gagacccucuauuaugcua

SEQ ID NO: 27508 - RNA, 19 nt, Homo sapiens
gaagcuuagccuugaaauu

SEQ ID NO: 27509 - RNA, 19 nt, Homo sapiens
gaagagcucccugcugugu

SEQ ID NO: 27510 - RNA, 19 nt, Homo sapiens
gacaaguacaugacuauau

SEQ ID NO: 27511 - RNA, 19 nt, Homo sapiens
gaagaagaauauggcucaa

SEQ ID NO: 27512 - RNA, 19 nt, Homo sapiens
ugccagugcuuaacacauu

SEQ ID NO: 27513 - RNA, 19 nt, Homo sapiens
caggaaaucucugcagcuu

SEQ ID NO: 27514 - RNA, 19 nt, Homo sapiens
ugagcgggcugaugcagaa

SEQ ID NO: 27515 - RNA, 19 nt, Homo sapiens
ugacugcuguaguacuaaa

SEQ ID NO: 27516 - RNA, 19 nt, Homo sapiens
uuaagaggcuagagugcuu

SEQ ID NO: 27517 - RNA, 19 nt, Homo sapiens
ggagcuggaacaaaugaaa

SEQ ID NO: 27518 - RNA, 19 nt, Homo sapiens
cacauugccuuauucauac

SEQ ID NO: 27519 - RNA, 19 nt, Homo sapiens
accuuuagcugcauuugua

SEQ ID NO: 27520 - RNA, 19 nt, Homo sapiens
ccaccucucuuuauuccau

SEQ ID NO: 27521 - RNA, 19 nt, Homo sapiens
gacagaaauuauugcuuca

SEQ ID NO: 27522 - RNA, 19 nt, Homo sapiens
ugagagccaucaaacaagu

SEQ ID NO: 27523 - RNA, 19 nt, Homo sapiens
ggaaauguuauuagugaag

SEQ ID NO: 27524 - RNA, 19 nt, Homo sapiens
gaaauugugaacucuugga

SEQ ID NO: 27525 - RNA, 19 nt, Homo sapiens
ugugaaaucuauucgaagu

SEQ ID NO: 27526 - RNA, 19 nt, Homo sapiens
cagaaauuauugcuucaag

SEQ ID NO: 27527 - RNA, 19 nt, Homo sapiens
gcuuuaugaugcuuaugaa

SEQ ID NO: 27528 - RNA, 19 nt, Homo sapiens
gcacagaugaggagagcau

SEQ ID NO: 27529 - RNA, 19 nt, Homo sapiens
uaguggugcuucuuucuga

SEQ ID NO: 27530 - RNA, 19 nt, Homo sapiens
acauacacgucauagaaga

SEQ ID NO: 27531 - RNA, 19 nt, Homo sapiens
gaaggaguuuaggaagaau

SEQ ID NO: 27532 - RNA, 19 nt, Homo sapiens
aaguauaccugccuaccuu

SEQ ID NO: 27533 - RNA, 19 nt, Homo sapiens
caaauugaggaaaccauug

SEQ ID NO: 27534 - RNA, 19 nt, Homo sapiens
augaaacccucucggcuuu

SEQ ID NO: 27535 - RNA, 19 nt, Homo sapiens
uaacagagacccugaugcu

SEQ ID NO: 27536 - RNA, 19 nt, Homo sapiens
guucgcaacuaaacuaaac

SEQ ID NO: 27537 - RNA, 19 nt, Homo sapiens
gaacuaacuggaaaauuug

SEQ ID NO: 27538 - RNA, 19 nt, Homo sapiens
ugugaacucuuggaaaugu

SEQ ID NO: 27539 - RNA, 19 nt, Homo sapiens
auuagaagcuuagccuuga

SEQ ID NO: 27540 - RNA, 19 nt, Homo sapiens
aaauaguggugcuucuuuc

SEQ ID NO: 27541 - RNA, 19 nt, Homo sapiens
aggaaggaguuuaggaaga

SEQ ID NO: 27542 - RNA, 19 nt, Homo sapiens
gagcugggacagaugauca

SEQ ID NO: 27543 - RNA, 19 nt, Homo sapiens
gacccucuauuaugcuaug

SEQ ID NO: 27544 - RNA, 19 nt, Homo sapiens
aaggacaccugaagaacug

SEQ ID NO: 27545 - RNA, 19 nt, Homo sapiens
ugaacucuuggaaauguua

SEQ ID NO: 27546 - RNA, 19 nt, Homo sapiens
gcuguaguacuaaagugua

SEQ ID NO: 27547 - RNA, 19 nt, Homo sapiens
uaacacauugccuuauuca

SEQ ID NO: 27548 - RNA, 19 nt, Homo sapiens
uggagaagaugacuaacgu

SEQ ID NO: 27549 - RNA, 19 nt, Homo sapiens
ucaggaaggaguuuaggaa

SEQ ID NO: 27550 - RNA, 19 nt, Homo sapiens
gacuauaucaggauuucaa

SEQ ID NO: 27551 - RNA, 19 nt, Homo sapiens
gaagaacugagagccauca

SEQ ID NO: 27552 - RNA, 19 nt, Homo sapiens
cuguugacaucccgaagua

SEQ ID NO: 27553 - RNA, 19 nt, Homo sapiens
gagaaagguguuugacaag

SEQ ID NO: 27554 - RNA, 19 nt, Homo sapiens
uggcagggaucuucuggau

SEQ ID NO: 27555 - RNA, 19 nt, Homo sapiens
uuugacugcuguaguacua

SEQ ID NO: 27556 - RNA, 19 nt, Homo sapiens
uuaacacauugccuuauuc

SEQ ID NO: 27557 - RNA, 19 nt, Homo sapiens
aauuguggcucugaugaaa

SEQ ID NO: 27558 - RNA, 19 nt, Homo sapiens
gaggcacugugacugacuu

SEQ ID NO: 27559 - RNA, 19 nt, Homo sapiens
gcucaugaccaacacauac

SEQ ID NO: 27560 - RNA, 19 nt, Homo sapiens
uaacaucaggaaggaguuu

SEQ ID NO: 27561 - RNA, 19 nt, Homo sapiens
acuccuugcuguugugaaa

SEQ ID NO: 27562 - RNA, 19 nt, Homo sapiens
ccgcgagacuucuggcaau

SEQ ID NO: 27563 - RNA, 19 nt, Homo sapiens
ugacaaguacaugacuaua

SEQ ID NO: 27564 - RNA, 19 nt, Homo sapiens
agaaagguguuugacaagu

SEQ ID NO: 27565 - RNA, 19 nt, Homo sapiens
ggacagaugaagaaaaguu

SEQ ID NO: 27566 - RNA, 19 nt, Homo sapiens
auugugaacucuuggaaau

SEQ ID NO: 27567 - RNA, 19 nt, Homo sapiens
uugaaauugugaacucuug

SEQ ID NO: 27568 - RNA, 19 nt, Homo sapiens
ugaaaggcuugggcacaga

SEQ ID NO: 27569 - RNA, 19 nt, Homo sapiens
aacaagaugcucaggcuuu

SEQ ID NO: 27570 - RNA, 19 nt, Homo sapiens
gccagugcuuaacacauug

SEQ ID NO: 27571 - RNA, 19 nt, Homo sapiens
gcuuagccuugaaauugug

SEQ ID NO: 27572 - RNA, 19 nt, Homo sapiens
cucuuugacugcuguagua

SEQ ID NO: 27573 - RNA, 19 nt, Homo sapiens
gaaaggcuugggcacagau

SEQ ID NO: 27574 - RNA, 19 nt, Homo sapiens
gugacugacuucccuggau

SEQ ID NO: 27575 - RNA, 19 nt, Homo sapiens
caauuuagagcaacuacuc

SEQ ID NO: 27576 - RNA, 19 nt, Homo sapiens
gcgagacuucuggcaauuu

SEQ ID NO: 27577 - RNA, 19 nt, Homo sapiens
aaauugaggaaaccauuga

SEQ ID NO: 27578 - RNA, 19 nt, Homo sapiens
aaagguguuugacaaguac

SEQ ID NO: 27579 - RNA, 19 nt, Homo sapiens
gcuaacagagacccugaug

SEQ ID NO: 27580 - RNA, 19 nt, Homo sapiens
gaacaagccucucuucuuu

SEQ ID NO: 27581 - RNA, 19 nt, Homo sapiens
gggaauucauugagaaaua

SEQ ID NO: 27582 - RNA, 19 nt, Homo sapiens
ggaccucauugcugauuua

SEQ ID NO: 27583 - RNA, 19 nt, Homo sapiens
uaucagaugugggaacuua

SEQ ID NO: 27584 - RNA, 19 nt, Homo sapiens
ggagggaauucauugagaa

SEQ ID NO: 27585 - RNA, 19 nt, Homo sapiens
gaagacacaaucaucgaua

SEQ ID NO: 27586 - RNA, 19 nt, Homo sapiens
gcugagaucuuggaaauag

SEQ ID NO: 27587 - RNA, 19 nt, Homo sapiens
ggaggaggaugacguagug

SEQ ID NO: 27588 - RNA, 19 nt, Homo sapiens
ggacuagggccacagcuuu

SEQ ID NO: 27589 - RNA, 19 nt, Homo sapiens
ugacaagucucuccaccaa

SEQ ID NO: 27590 - RNA, 19 nt, Homo sapiens
gcgaggaccugguacaaca

SEQ ID NO: 27591 - RNA, 19 nt, Homo sapiens
agacacaucuggccacuuc

SEQ ID NO: 27592 - RNA, 19 nt, Homo sapiens
gaacagaugaagcccaguu

SEQ ID NO: 27593 - RNA, 19 nt, Homo sapiens
gcagguggccuaucagaug

SEQ ID NO: 27594 - RNA, 19 nt, Homo sapiens
ugagaaauaugacaagucu

SEQ ID NO: 27595 - RNA, 19 nt, Homo sapiens
ugaaaaggcucuuauugaa

SEQ ID NO: 27596 - RNA, 19 nt, Homo sapiens
cgacaccucuggccacuuc

SEQ ID NO: 27597 - RNA, 19 nt, Homo sapiens
ccucauugcugauuuaaag

SEQ ID NO: 27598 - RNA, 19 nt, Homo sapiens
ccgacaaacuuuacaaauc

SEQ ID NO: 27599 - RNA, 19 nt, Homo sapiens
ucaaugaggccuauaagga

SEQ ID NO: 27600 - RNA, 19 nt, Homo sapiens
ggguugggcucuuaucuuc

SEQ ID NO: 27601 - RNA, 19 nt, Homo sapiens
cgacaaacuuuacaaaucc

SEQ ID NO: 27602 - RNA, 19 nt, Homo sapiens
ccagguggcugcugagauc

SEQ ID NO: 27603 - RNA, 19 nt, Homo sapiens
ccaguucauuuacaucuug

SEQ ID NO: 27604 - RNA, 19 nt, Homo sapiens
gaaccagggaggaggauga

SEQ ID NO: 27605 - RNA, 19 nt, Homo sapiens
cagcgcagguggccuauca

SEQ ID NO: 27606 - RNA, 19 nt, Homo sapiens
caagaagacucugcugaag

SEQ ID NO: 27607 - RNA, 19 nt, Homo sapiens
ucauuuacaucuugggaaa

SEQ ID NO: 27608 - RNA, 19 nt, Homo sapiens
gcacagaugagaagacucu

SEQ ID NO: 27609 - RNA, 19 nt, Homo sapiens
gaaauagcagacacaccua

SEQ ID NO: 27610 - RNA, 19 nt, Homo sapiens
ugaauugacgggcaaguuu

SEQ ID NO: 27611 - RNA, 19 nt, Homo sapiens
ugaagggacucgggacuga

SEQ ID NO: 27612 - RNA, 19 nt, Homo sapiens
ucaagaugaccaacuauga

SEQ ID NO: 27613 - RNA, 19 nt, Homo sapiens
ggagagucuuccaggaguu

SEQ ID NO: 27614 - RNA, 19 nt, Homo sapiens
cugcugagaucuuggaaau

SEQ ID NO: 27615 - RNA, 19 nt, Homo sapiens
gaaaaggcucuuauugaaa

SEQ ID NO: 27616 - RNA, 19 nt, Homo sapiens
gaagcccaguucauuuaca

SEQ ID NO: 27617 - RNA, 19 nt, Homo sapiens
caauaaacauccugaaccu

SEQ ID NO: 27618 - RNA, 19 nt, Homo sapiens
agaagacucugaccaggau

SEQ ID NO: 27619 - RNA, 19 nt, Homo sapiens
ccaaagcgcugcggaaagc

SEQ ID NO: 27620 - RNA, 19 nt, Homo sapiens
ccaccugccuauugugaug

SEQ ID NO: 27621 - RNA, 19 nt, Homo sapiens
gaauugacgggcaaguuug

SEQ ID NO: 27622 - RNA, 19 nt, Homo sapiens
ugacaccucuggcgaguac

SEQ ID NO: 27623 - RNA, 19 nt, Homo sapiens
acagcaugaucaagaauga

SEQ ID NO: 27624 - RNA, 19 nt, Homo sapiens
ugucagggaugcauuugug

SEQ ID NO: 27625 - RNA, 19 nt, Homo sapiens
gccaagaaaugguuaucag

SEQ ID NO: 27626 - RNA, 19 nt, Homo sapiens
acaagaagacucugcugaa

SEQ ID NO: 27627 - RNA, 19 nt, Homo sapiens
ggguuggguugggcucuua

SEQ ID NO: 27628 - RNA, 19 nt, Homo sapiens
cggagggaauucauugaga

SEQ ID NO: 27629 - RNA, 19 nt, Homo sapiens
ggaugucagggaugcauuu

SEQ ID NO: 27630 - RNA, 19 nt, Homo sapiens
cuuaaugacugaccugaag

SEQ ID NO: 27631 - RNA, 19 nt, Homo sapiens
ggacugacgaagacacaau

SEQ ID NO: 27632 - RNA, 19 nt, Homo sapiens
ccacagggaagccgaugaa

SEQ ID NO: 27633 - RNA, 19 nt, Homo sapiens
uaugucagauccaauaaac

SEQ ID NO: 27634 - RNA, 19 nt, Homo sapiens
gagggaauucauugagaaa

SEQ ID NO: 27635 - RNA, 19 nt, Homo sapiens
ccuauaaggaggacuauca

SEQ ID NO: 27636 - RNA, 19 nt, Homo sapiens
agaagucccucuacagcau

SEQ ID NO: 27637 - RNA, 19 nt, Homo sapiens
uaugagaagucccucuaca

SEQ ID NO: 27638 - RNA, 19 nt, Homo sapiens
ccuggaggcugacaucauc

SEQ ID NO: 27639 - RNA, 19 nt, Homo sapiens
cuauugugaugccaaagaa

SEQ ID NO: 27640 - RNA, 19 nt, Homo sapiens
ggcuaugucagauccaaua

SEQ ID NO: 27641 - RNA, 19 nt, Homo sapiens
ggaccaaguaugagaaguc

SEQ ID NO: 27642 - RNA, 19 nt, Homo sapiens
guagugaguuggacaugcu

SEQ ID NO: 27643 - RNA, 19 nt, Homo sapiens
gaccugaagucugagaucu

SEQ ID NO: 27644 - RNA, 19 nt, Homo sapiens
aagacacaaucaucgauau

SEQ ID NO: 27645 - RNA, 19 nt, Homo sapiens
ugacgaagacacaaucauc

SEQ ID NO: 27646 - RNA, 19 nt, Homo sapiens
agaagacucugcugaagcu

SEQ ID NO: 27647 - RNA, 19 nt, Homo sapiens
gcauuggcacugaugagaa

SEQ ID NO: 27648 - RNA, 19 nt, Homo sapiens
ucuacagcaugaucaagaa

SEQ ID NO: 27649 - RNA, 19 nt, Homo sapiens
ggucucccguagugaguug

SEQ ID NO: 27650 - RNA, 19 nt, Homo sapiens
gguugguguucgaugagua

SEQ ID NO: 27651 - RNA, 19 nt, Homo sapiens
ugacaccuccggagacuuc

SEQ ID NO: 27652 - RNA, 19 nt, Homo sapiens
ccaucaaugaggccuauaa

SEQ ID NO: 27653 - RNA, 19 nt, Homo sapiens
gaugaaaaggcucuuauug

SEQ ID NO: 27654 - RNA, 19 nt, Homo sapiens
cuucaacccugacgcagau

SEQ ID NO: 27655 - RNA, 19 nt, Homo sapiens
cagguggccuaucagaugu

SEQ ID NO: 27656 - RNA, 19 nt, Homo sapiens
gguggcagcauacaaagau

SEQ ID NO: 27657 - RNA, 19 nt, Homo sapiens
uaaggaggacuaucacaag

SEQ ID NO: 27658 - RNA, 19 nt, Homo sapiens
gccaaagaaauuaaagaug

SEQ ID NO: 27659 - RNA, 19 nt, Homo sapiens
gccgggacuuaaugacuga

SEQ ID NO: 27660 - RNA, 19 nt, Homo sapiens
gacacaaucaucgauauca

SEQ ID NO: 27661 - RNA, 19 nt, Homo sapiens
ugaagggcuuuggcaguga

SEQ ID NO: 27662 - RNA, 19 nt, Homo sapiens
ggagcaccccggaauauuu

SEQ ID NO: 27663 - RNA, 19 nt, Homo sapiens
gagcgaggaccugguacaa

SEQ ID NO: 27664 - RNA, 19 nt, Homo sapiens
gcuaugucagauccaauaa

SEQ ID NO: 27665 - RNA, 19 nt, Homo sapiens
guugggcucuuaucuucau

SEQ ID NO: 27666 - RNA, 19 nt, Homo sapiens
agaaauaugacaagucucu

SEQ ID NO: 27667 - RNA, 19 nt, Homo sapiens
ggaugcauuuguggccauu

SEQ ID NO: 27668 - RNA, 19 nt, Homo sapiens
uccaggaguucaucaagau

SEQ ID NO: 27669 - RNA, 19 nt, Homo sapiens
ucaugacgauccuguguac

SEQ ID NO: 27670 - RNA, 19 nt, Homo sapiens
gguggcugcugagaucuug

SEQ ID NO: 27671 - RNA, 19 nt, Homo sapiens
acacaaucaucgauaucau

SEQ ID NO: 27672 - RNA, 19 nt, Homo sapiens
ugucagauccaauaaacau

SEQ ID NO: 27673 - RNA, 19 nt, Homo sapiens
uggccaagccugauuguuc

SEQ ID NO: 27674 - RNA, 19 nt, Homo sapiens
ugacaaggaggccauacug

SEQ ID NO: 27675 - RNA, 19 nt, Homo sapiens
ugugaugccaaagaaauua

SEQ ID NO: 27676 - RNA, 19 nt, Homo sapiens
cauuggcacugaugagaag

SEQ ID NO: 27677 - RNA, 19 nt, Homo sapiens
ucauggagcuuaggaaacg

SEQ ID NO: 27678 - RNA, 19 nt, Homo sapiens
gaacugaaauggggaacag

SEQ ID NO: 27679 - RNA, 19 nt, Homo sapiens
gcacggcugagcggugaaa

SEQ ID NO: 27680 - RNA, 19 nt, Homo sapiens
gaacaagccucucuucuuu

SEQ ID NO: 27681 - RNA, 19 nt, Homo sapiens
gggaauucauugagaaaua

SEQ ID NO: 27682 - RNA, 19 nt, Homo sapiens
ggaccucauugcugauuua

SEQ ID NO: 27683 - RNA, 19 nt, Homo sapiens
uaucagaugugggaacuua

SEQ ID NO: 27684 - RNA, 19 nt, Homo sapiens
ggaagaugcccaggaaaua

SEQ ID NO: 27685 - RNA, 19 nt, Homo sapiens
ggagggaauucauugagaa

SEQ ID NO: 27686 - RNA, 19 nt, Homo sapiens
gaagacacaaucaucgaua

SEQ ID NO: 27687 - RNA, 19 nt, Homo sapiens
ggaggaggaugacguagug

SEQ ID NO: 27688 - RNA, 19 nt, Homo sapiens
ggacuagggccacagcuuu

SEQ ID NO: 27689 - RNA, 19 nt, Homo sapiens
ugacaagucucuccaccaa

SEQ ID NO: 27690 - RNA, 19 nt, Homo sapiens
gcgaggaccugguacaaca

SEQ ID NO: 27691 - RNA, 19 nt, Homo sapiens
agacacaucuggccacuuc

SEQ ID NO: 27692 - RNA, 19 nt, Homo sapiens
gaacagaugaagcccaguu

SEQ ID NO: 27693 - RNA, 19 nt, Homo sapiens
gcagguggccuaucagaug

SEQ ID NO: 27694 - RNA, 19 nt, Homo sapiens
ugagaaauaugacaagucu

SEQ ID NO: 27695 - RNA, 19 nt, Homo sapiens
ugaaaaggcucuuauugaa

SEQ ID NO: 27696 - RNA, 19 nt, Homo sapiens
cgacaccucuggccacuuc

SEQ ID NO: 27697 - RNA, 19 nt, Homo sapiens
ccucauugcugauuuaaag

SEQ ID NO: 27698 - RNA, 19 nt, Homo sapiens
ccgacaaacuuuacaaauc

SEQ ID NO: 27699 - RNA, 19 nt, Homo sapiens
ucaaugaggccuauaagga

SEQ ID NO: 27700 - RNA, 19 nt, Homo sapiens
ggguugggcucuuaucuuc

SEQ ID NO: 27701 - RNA, 19 nt, Homo sapiens
cgacaaacuuuacaaaucc

SEQ ID NO: 27702 - RNA, 19 nt, Homo sapiens
ccaguucauuuacaucuug

SEQ ID NO: 27703 - RNA, 19 nt, Homo sapiens
gaaccagggaggaggauga

SEQ ID NO: 27704 - RNA, 19 nt, Homo sapiens
cagcgcagguggccuauca

SEQ ID NO: 27705 - RNA, 19 nt, Homo sapiens
caagaagacucugcugaag

SEQ ID NO: 27706 - RNA, 19 nt, Homo sapiens
ucauuuacaucuugggaaa

SEQ ID NO: 27707 - RNA, 19 nt, Homo sapiens
gaagaugcccaggaaauag

SEQ ID NO: 27708 - RNA, 19 nt, Homo sapiens
gcacagaugagaagacucu

SEQ ID NO: 27709 - RNA, 19 nt, Homo sapiens
gaaauagcagacacaccua

SEQ ID NO: 27710 - RNA, 19 nt, Homo sapiens
ugaauugacgggcaaguuu

SEQ ID NO: 27711 - RNA, 19 nt, Homo sapiens
ugaagggacucgggacuga

SEQ ID NO: 27712 - RNA, 19 nt, Homo sapiens
ucaagaugaccaacuauga

SEQ ID NO: 27713 - RNA, 19 nt, Homo sapiens
ggagagucuuccaggaguu

SEQ ID NO: 27714 - RNA, 19 nt, Homo sapiens
gggaagaugcccaggaaau

SEQ ID NO: 27715 - RNA, 19 nt, Homo sapiens
gaaaaggcucuuauugaaa

SEQ ID NO: 27716 - RNA, 19 nt, Homo sapiens
gaagcccaguucauuuaca

SEQ ID NO: 27717 - RNA, 19 nt, Homo sapiens
caauaaacauccugaaccu

SEQ ID NO: 27718 - RNA, 19 nt, Homo sapiens
agaagacucugaccaggau

SEQ ID NO: 27719 - RNA, 19 nt, Homo sapiens
ccaaagcgcugcggaaagc

SEQ ID NO: 27720 - RNA, 19 nt, Homo sapiens
ccaccugccuauugugaug

SEQ ID NO: 27721 - RNA, 19 nt, Homo sapiens
gaauugacgggcaaguuug

SEQ ID NO: 27722 - RNA, 19 nt, Homo sapiens
ugacaccucuggcgaguac

SEQ ID NO: 27723 - RNA, 19 nt, Homo sapiens
acagcaugaucaagaauga

SEQ ID NO: 27724 - RNA, 19 nt, Homo sapiens
ugucagggaugcauuugug

SEQ ID NO: 27725 - RNA, 19 nt, Homo sapiens
gccaagaaaugguuaucag

SEQ ID NO: 27726 - RNA, 19 nt, Homo sapiens
acaagaagacucugcugaa

SEQ ID NO: 27727 - RNA, 19 nt, Homo sapiens
ggguuggguugggcucuua

SEQ ID NO: 27728 - RNA, 19 nt, Homo sapiens
cggagggaauucauugaga

SEQ ID NO: 27729 - RNA, 19 nt, Homo sapiens
ggaugucagggaugcauuu

SEQ ID NO: 27730 - RNA, 19 nt, Homo sapiens
cuuaaugacugaccugaag

SEQ ID NO: 27731 - RNA, 19 nt, Homo sapiens
ggacugacgaagacacaau

SEQ ID NO: 27732 - RNA, 19 nt, Homo sapiens
ccacagggaagccgaugaa

SEQ ID NO: 27733 - RNA, 19 nt, Homo sapiens
uaugucagauccaauaaac

SEQ ID NO: 27734 - RNA, 19 nt, Homo sapiens
gagggaauucauugagaaa

SEQ ID NO: 27735 - RNA, 19 nt, Homo sapiens
ccuauaaggaggacuauca

SEQ ID NO: 27736 - RNA, 19 nt, Homo sapiens
agaagucccucuacagcau

SEQ ID NO: 27737 - RNA, 19 nt, Homo sapiens
uaugagaagucccucuaca

SEQ ID NO: 27738 - RNA, 19 nt, Homo sapiens
ccuggaggcugacaucauc

SEQ ID NO: 27739 - RNA, 19 nt, Homo sapiens
cuauugugaugccaaagaa

SEQ ID NO: 27740 - RNA, 19 nt, Homo sapiens
ggcuaugucagauccaaua

SEQ ID NO: 27741 - RNA, 19 nt, Homo sapiens
ggaccaaguaugagaaguc

SEQ ID NO: 27742 - RNA, 19 nt, Homo sapiens
guagugaguuggacaugcu

SEQ ID NO: 27743 - RNA, 19 nt, Homo sapiens
gaccugaagucugagaucu

SEQ ID NO: 27744 - RNA, 19 nt, Homo sapiens
aagacacaaucaucgauau

SEQ ID NO: 27745 - RNA, 19 nt, Homo sapiens
ugacgaagacacaaucauc

SEQ ID NO: 27746 - RNA, 19 nt, Homo sapiens
agaagacucugcugaagcu

SEQ ID NO: 27747 - RNA, 19 nt, Homo sapiens
gcauuggcacugaugagaa

SEQ ID NO: 27748 - RNA, 19 nt, Homo sapiens
ucuacagcaugaucaagaa

SEQ ID NO: 27749 - RNA, 19 nt, Homo sapiens
ggucucccguagugaguug

SEQ ID NO: 27750 - RNA, 19 nt, Homo sapiens
gguugguguucgaugagua

SEQ ID NO: 27751 - RNA, 19 nt, Homo sapiens
ugacaccuccggagacuuc

SEQ ID NO: 27752 - RNA, 19 nt, Homo sapiens
ccaucaaugaggccuauaa

SEQ ID NO: 27753 - RNA, 19 nt, Homo sapiens
gaugaaaaggcucuuauug

SEQ ID NO: 27754 - RNA, 19 nt, Homo sapiens
cuucaacccugacgcagau

SEQ ID NO: 27755 - RNA, 19 nt, Homo sapiens
cagguggccuaucagaugu

SEQ ID NO: 27756 - RNA, 19 nt, Homo sapiens
gguggcagcauacaaagau

SEQ ID NO: 27757 - RNA, 19 nt, Homo sapiens
uaaggaggacuaucacaag

SEQ ID NO: 27758 - RNA, 19 nt, Homo sapiens
gccaaagaaauuaaagaug

SEQ ID NO: 27759 - RNA, 19 nt, Homo sapiens
acgggaagaugcccaggaa

SEQ ID NO: 27760 - RNA, 19 nt, Homo sapiens
gccgggacuuaaugacuga

SEQ ID NO: 27761 - RNA, 19 nt, Homo sapiens
gacacaaucaucgauauca

SEQ ID NO: 27762 - RNA, 19 nt, Homo sapiens
ugaagggcuuuggcaguga

SEQ ID NO: 27763 - RNA, 19 nt, Homo sapiens
ggagcaccccggaauauuu

SEQ ID NO: 27764 - RNA, 19 nt, Homo sapiens
gagcgaggaccugguacaa

SEQ ID NO: 27765 - RNA, 19 nt, Homo sapiens
gcuaugucagauccaauaa

SEQ ID NO: 27766 - RNA, 19 nt, Homo sapiens
guugggcucuuaucuucau

SEQ ID NO: 27767 - RNA, 19 nt, Homo sapiens
agaaauaugacaagucucu

SEQ ID NO: 27768 - RNA, 19 nt, Homo sapiens
ggaugcauuuguggccauu

SEQ ID NO: 27769 - RNA, 19 nt, Homo sapiens
uccaggaguucaucaagau

SEQ ID NO: 27770 - RNA, 19 nt, Homo sapiens
ucaugacgauccuguguac

SEQ ID NO: 27771 - RNA, 19 nt, Homo sapiens
acacaaucaucgauaucau

SEQ ID NO: 27772 - RNA, 19 nt, Homo sapiens
ugucagauccaauaaacau

SEQ ID NO: 27773 - RNA, 19 nt, Homo sapiens
uggccaagccugauuguuc

SEQ ID NO: 27774 - RNA, 19 nt, Homo sapiens
ugacaaggaggccauacug

SEQ ID NO: 27775 - RNA, 19 nt, Homo sapiens
ugugaugccaaagaaauua

SEQ ID NO: 27776 - RNA, 19 nt, Homo sapiens
cauuggcacugaugagaag

SEQ ID NO: 27777 - RNA, 19 nt, Homo sapiens
ucauggagcuuaggaaacg

SEQ ID NO: 27778 - RNA, 19 nt, Homo sapiens
gaacugaaauggggaacag

SEQ ID NO: 27779 - RNA, 19 nt, Homo sapiens
gcacggcugagcggugaaa

SEQ ID NO: 27780 - RNA, 19 nt, Homo sapiens
cauaaacacuuuccacaua

SEQ ID NO: 27781 - RNA, 19 nt, Homo sapiens
ucaaagaucucaaaucaga

SEQ ID NO: 27782 - RNA, 19 nt, Homo sapiens
gaaccgcccugccuucuuu

SEQ ID NO: 27783 - RNA, 19 nt, Homo sapiens
gaacguguauugauugaga

SEQ ID NO: 27784 - RNA, 19 nt, Homo sapiens
caacuucgaugcuauaaga

SEQ ID NO: 27785 - RNA, 19 nt, Homo sapiens
gaagugagauugaccuugu

SEQ ID NO: 27786 - RNA, 19 nt, Homo sapiens
gaugagaaccagaguauaa

SEQ ID NO: 27787 - RNA, 19 nt, Homo sapiens
gagcuaccauggaggcuua

SEQ ID NO: 27788 - RNA, 19 nt, Homo sapiens
gaaucuugcuuuaacauga

SEQ ID NO: 27789 - RNA, 19 nt, Homo sapiens
gagaaauugucagauguua

SEQ ID NO: 27790 - RNA, 19 nt, Homo sapiens
aagaaagggucaaauguuu

SEQ ID NO: 27791 - RNA, 19 nt, Homo sapiens
uagaguggauaguauguua

SEQ ID NO: 27792 - RNA, 19 nt, Homo sapiens
guaaggcaaugaaggguuu

SEQ ID NO: 27793 - RNA, 19 nt, Homo sapiens
gcagcaauaucaaacauca

SEQ ID NO: 27794 - RNA, 19 nt, Homo sapiens
gauugaccuuguacaaaua

SEQ ID NO: 27795 - RNA, 19 nt, Homo sapiens
gcucuacuaugcuaugaaa

SEQ ID NO: 27796 - RNA, 19 nt, Homo sapiens
ccaaauggcucaggaagau

SEQ ID NO: 27797 - RNA, 19 nt, Homo sapiens
gaggacagaugccuucuca

SEQ ID NO: 27798 - RNA, 19 nt, Homo sapiens
cuaaauugguucuguauuc

SEQ ID NO: 27799 - RNA, 19 nt, Homo sapiens
gcucagauguaucagaaga

SEQ ID NO: 27800 - RNA, 19 nt, Homo sapiens
gauguucgcucagauguau

SEQ ID NO: 27801 - RNA, 19 nt, Homo sapiens
guaaagccauaucacaaug

SEQ ID NO: 27802 - RNA, 19 nt, Homo sapiens
gaaagggucaaauguuuau

SEQ ID NO: 27803 - RNA, 19 nt, Homo sapiens
gaguggagauuaccgaaga

SEQ ID NO: 27804 - RNA, 19 nt, Homo sapiens
gaaauugucagauguuauc

SEQ ID NO: 27805 - RNA, 19 nt, Homo sapiens
ucaggaacguguauugauu

SEQ ID NO: 27806 - RNA, 19 nt, Homo sapiens
gaucucaaaucagaguuaa

SEQ ID NO: 27807 - RNA, 19 nt, Homo sapiens
gauguuaucagucagaauu

SEQ ID NO: 27808 - RNA, 19 nt, Homo sapiens
acagaugccuucucaguau

SEQ ID NO: 27809 - RNA, 19 nt, Homo sapiens
uaagaaagggucaaauguu

SEQ ID NO: 27810 - RNA, 19 nt, Homo sapiens
ucagauacaucaggacauu

SEQ ID NO: 27811 - RNA, 19 nt, Homo sapiens
ggacagaugccuucucagu

SEQ ID NO: 27812 - RNA, 19 nt, Homo sapiens
caaucaauguaaagccaua

SEQ ID NO: 27813 - RNA, 19 nt, Homo sapiens
ggucaaauguuuauaugcu

SEQ ID NO: 27814 - RNA, 19 nt, Homo sapiens
gaguauaaaccaccaaaug

SEQ ID NO: 27815 - RNA, 19 nt, Homo sapiens
ugucagauguuaucaguca

SEQ ID NO: 27816 - RNA, 19 nt, Homo sapiens
auucauagcuuauccuuca

SEQ ID NO: 27817 - RNA, 19 nt, Homo sapiens
agaguuaaguggaaauaug

SEQ ID NO: 27818 - RNA, 19 nt, Homo sapiens
gagauugaccuuguacaaa

SEQ ID NO: 27819 - RNA, 19 nt, Homo sapiens
ggaaauauggaagaacuga

SEQ ID NO: 27820 - RNA, 19 nt, Homo sapiens
agauugaccuuguacaaau

SEQ ID NO: 27821 - RNA, 19 nt, Homo sapiens
gacauuaggucagauacau

SEQ ID NO: 27822 - RNA, 19 nt, Homo sapiens
gacagaugccuucucagua

SEQ ID NO: 27823 - RNA, 19 nt, Homo sapiens
guagaaagugguuugaaga

SEQ ID NO: 27824 - RNA, 19 nt, Homo sapiens
caggaaauccgagaaauug

SEQ ID NO: 27825 - RNA, 19 nt, Homo sapiens
ccucuaagucugcuugaua

SEQ ID NO: 27826 - RNA, 19 nt, Homo sapiens
ccuaguggcuuuccuccaa

SEQ ID NO: 27827 - RNA, 19 nt, Homo sapiens
agaaagggucaaauguuua

SEQ ID NO: 27828 - RNA, 19 nt, Homo sapiens
ggacagaugagcaggcaau

SEQ ID NO: 27829 - RNA, 19 nt, Homo sapiens
uaaacacuuuccacauaga

SEQ ID NO: 27830 - RNA, 19 nt, Homo sapiens
aaacaucagcuaaccgaaa

SEQ ID NO: 27831 - RNA, 19 nt, Homo sapiens
gaugaaucuugcuuuaaca

SEQ ID NO: 27832 - RNA, 19 nt, Homo sapiens
cgaugaaucuugcuuuaac

SEQ ID NO: 27833 - RNA, 19 nt, Homo sapiens
gcuaaucgagacuuguuaa

SEQ ID NO: 27834 - RNA, 19 nt, Homo sapiens
gaaauccgagaaauuguca

SEQ ID NO: 27835 - RNA, 19 nt, Homo sapiens
ucaugccuccuacguauua

SEQ ID NO: 27836 - RNA, 19 nt, Homo sapiens
gauccuggcccucuucaug

SEQ ID NO: 27837 - RNA, 19 nt, Homo sapiens
ucucugauucuguguaaua

SEQ ID NO: 27838 - RNA, 19 nt, Homo sapiens
ggaggugccuacccacaag

SEQ ID NO: 27839 - RNA, 19 nt, Homo sapiens
ucgcucagauguaucagaa

SEQ ID NO: 27840 - RNA, 19 nt, Homo sapiens
cagaugagcaggcaauugu

SEQ ID NO: 27841 - RNA, 19 nt, Homo sapiens
uaagucugcuugauagagu

SEQ ID NO: 27842 - RNA, 19 nt, Homo sapiens
ccaacaggcuacccaccuu

SEQ ID NO: 27843 - RNA, 19 nt, Homo sapiens
cuucaugccuccuacguau

SEQ ID NO: 27844 - RNA, 19 nt, Homo sapiens
guaaugugcuugguuugca

SEQ ID NO: 27845 - RNA, 19 nt, Homo sapiens
ccacaagugccaaguagug

SEQ ID NO: 27846 - RNA, 19 nt, Homo sapiens
aaucgagacuuguuaagca

SEQ ID NO: 27847 - RNA, 19 nt, Homo sapiens
gaguggauaguauguuaaa

SEQ ID NO: 27848 - RNA, 19 nt, Homo sapiens
ucaggaaauccgagaaauu

SEQ ID NO: 27849 - RNA, 19 nt, Homo sapiens
caagaacaaaucaggaaau

SEQ ID NO: 27850 - RNA, 19 nt, Homo sapiens
ggaaauccgagaaauuguc

SEQ ID NO: 27851 - RNA, 19 nt, Homo sapiens
caauaucaaacaucagcua

SEQ ID NO: 27852 - RNA, 19 nt, Homo sapiens
caacaggcuacccaccuuu

SEQ ID NO: 27853 - RNA, 19 nt, Homo sapiens
gugaugagaaccagaguau

SEQ ID NO: 27854 - RNA, 19 nt, Homo sapiens
ccgagaaauugucagaugu

SEQ ID NO: 27855 - RNA, 19 nt, Homo sapiens
gccuggagcuuacggaaag

SEQ ID NO: 27856 - RNA, 19 nt, Homo sapiens
guggaaauauggaagaacu

SEQ ID NO: 27857 - RNA, 19 nt, Homo sapiens
ccgaccagcugccaacuuc

SEQ ID NO: 27858 - RNA, 19 nt, Homo sapiens
uuuagaagguuacugaaag

SEQ ID NO: 27859 - RNA, 19 nt, Homo sapiens
guuugcacauguuguuauu

SEQ ID NO: 27860 - RNA, 19 nt, Homo sapiens
gauggcuaaucgagacuug

SEQ ID NO: 27861 - RNA, 19 nt, Homo sapiens
accgaugaaucuugcuuua

SEQ ID NO: 27862 - RNA, 19 nt, Homo sapiens
ccagggaaaucgugaugag

SEQ ID NO: 27863 - RNA, 19 nt, Homo sapiens
gaacucaggaacguguauu

SEQ ID NO: 27864 - RNA, 19 nt, Homo sapiens
caaccuacuuacccuaguc

SEQ ID NO: 27865 - RNA, 19 nt, Homo sapiens
auaaacacuuuccacauag

SEQ ID NO: 27866 - RNA, 19 nt, Homo sapiens
aggguaaugugcuugguuu

SEQ ID NO: 27867 - RNA, 19 nt, Homo sapiens
uguagaaagugguuugaag

SEQ ID NO: 27868 - RNA, 19 nt, Homo sapiens
aaucagaguuaaguggaaa

SEQ ID NO: 27869 - RNA, 19 nt, Homo sapiens
ggccaaccguuccaaugau

SEQ ID NO: 27870 - RNA, 19 nt, Homo sapiens
ugacacgaguggagauuac

SEQ ID NO: 27871 - RNA, 19 nt, Homo sapiens
agaagacucugggcacaau

SEQ ID NO: 27872 - RNA, 19 nt, Homo sapiens
aaaccuucauucuuacuag

SEQ ID NO: 27873 - RNA, 19 nt, Homo sapiens
ccauggaggcuuauucuag

SEQ ID NO: 27874 - RNA, 19 nt, Homo sapiens
cgagaaauugucagauguu

SEQ ID NO: 27875 - RNA, 19 nt, Homo sapiens
aagaacaaaucaggaaauc

SEQ ID NO: 27876 - RNA, 19 nt, Homo sapiens
ggacauuaggucagauaca

SEQ ID NO: 27877 - RNA, 19 nt, Homo sapiens
uccgagaaauugucagaug

SEQ ID NO: 27878 - RNA, 19 nt, Homo sapiens
cacaagaacaaaucaggaa

SEQ ID NO: 27879 - RNA, 19 nt, Homo sapiens
gcuauaagagaugcagaaa

SEQ ID NO: 27880 - RNA, 19 nt, Homo sapiens
cauaaacacuuuccacaua

SEQ ID NO: 27881 - RNA, 19 nt, Homo sapiens
ucaaagaucucaaaucaga

SEQ ID NO: 27882 - RNA, 19 nt, Homo sapiens
gaaccgcccugccuucuuu

SEQ ID NO: 27883 - RNA, 19 nt, Homo sapiens
gaacguguauugauugaga

SEQ ID NO: 27884 - RNA, 19 nt, Homo sapiens
caacuucgaugcuauaaga

SEQ ID NO: 27885 - RNA, 19 nt, Homo sapiens
gaagugagauugaccuugu

SEQ ID NO: 27886 - RNA, 19 nt, Homo sapiens
gaugagaaccagaguauaa

SEQ ID NO: 27887 - RNA, 19 nt, Homo sapiens
gagcuaccauggaggcuua

SEQ ID NO: 27888 - RNA, 19 nt, Homo sapiens
gaaucuugcuuuaacauga

SEQ ID NO: 27889 - RNA, 19 nt, Homo sapiens
gagaaauugucagauguua

SEQ ID NO: 27890 - RNA, 19 nt, Homo sapiens
aagaaagggucaaauguuu

SEQ ID NO: 27891 - RNA, 19 nt, Homo sapiens
uagaguggauaguauguua

SEQ ID NO: 27892 - RNA, 19 nt, Homo sapiens
guaaggcaaugaaggguuu

SEQ ID NO: 27893 - RNA, 19 nt, Homo sapiens
gcagcaauaucaaacauca

SEQ ID NO: 27894 - RNA, 19 nt, Homo sapiens
gauugaccuuguacaaaua

SEQ ID NO: 27895 - RNA, 19 nt, Homo sapiens
gcucuacuaugcuaugaaa

SEQ ID NO: 27896 - RNA, 19 nt, Homo sapiens
ccaaauggcucaggaagau

SEQ ID NO: 27897 - RNA, 19 nt, Homo sapiens
gaggacagaugccuucuca

SEQ ID NO: 27898 - RNA, 19 nt, Homo sapiens
cuaaauugguucuguauuc

SEQ ID NO: 27899 - RNA, 19 nt, Homo sapiens
gcucagauguaucagaaga

SEQ ID NO: 27900 - RNA, 19 nt, Homo sapiens
gauguucgcucagauguau

SEQ ID NO: 27901 - RNA, 19 nt, Homo sapiens
guaaagccauaucacaaug

SEQ ID NO: 27902 - RNA, 19 nt, Homo sapiens
gaaagggucaaauguuuau

SEQ ID NO: 27903 - RNA, 19 nt, Homo sapiens
gaguggagauuaccgaaga

SEQ ID NO: 27904 - RNA, 19 nt, Homo sapiens
gaaauugucagauguuauc

SEQ ID NO: 27905 - RNA, 19 nt, Homo sapiens
ucaggaacguguauugauu

SEQ ID NO: 27906 - RNA, 19 nt, Homo sapiens
gaucucaaaucagaguuaa

SEQ ID NO: 27907 - RNA, 19 nt, Homo sapiens
gauguuaucagucagaauu

SEQ ID NO: 27908 - RNA, 19 nt, Homo sapiens
acagaugccuucucaguau

SEQ ID NO: 27909 - RNA, 19 nt, Homo sapiens
uaagaaagggucaaauguu

SEQ ID NO: 27910 - RNA, 19 nt, Homo sapiens
ucagauacaucaggacauu

SEQ ID NO: 27911 - RNA, 19 nt, Homo sapiens
ggacagaugccuucucagu

SEQ ID NO: 27912 - RNA, 19 nt, Homo sapiens
caaucaauguaaagccaua

SEQ ID NO: 27913 - RNA, 19 nt, Homo sapiens
ggucaaauguuuauaugcu

SEQ ID NO: 27914 - RNA, 19 nt, Homo sapiens
gaguauaaaccaccaaaug

SEQ ID NO: 27915 - RNA, 19 nt, Homo sapiens
ugucagauguuaucaguca

SEQ ID NO: 27916 - RNA, 19 nt, Homo sapiens
auucauagcuuauccuuca

SEQ ID NO: 27917 - RNA, 19 nt, Homo sapiens
agaguuaaguggaaauaug

SEQ ID NO: 27918 - RNA, 19 nt, Homo sapiens
cuagucagaucaauacaga

SEQ ID NO: 27919 - RNA, 19 nt, Homo sapiens
gagauugaccuuguacaaa

SEQ ID NO: 27920 - RNA, 19 nt, Homo sapiens
ggaaauauggaagaacuga

SEQ ID NO: 27921 - RNA, 19 nt, Homo sapiens
agauugaccuuguacaaau

SEQ ID NO: 27922 - RNA, 19 nt, Homo sapiens
gacauuaggucagauacau

SEQ ID NO: 27923 - RNA, 19 nt, Homo sapiens
gacagaugccuucucagua

SEQ ID NO: 27924 - RNA, 19 nt, Homo sapiens
guagaaagugguuugaaga

SEQ ID NO: 27925 - RNA, 19 nt, Homo sapiens
caggaaauccgagaaauug

SEQ ID NO: 27926 - RNA, 19 nt, Homo sapiens
ccucuaagucugcuugaua

SEQ ID NO: 27927 - RNA, 19 nt, Homo sapiens
ccuaguggcuuuccuccaa

SEQ ID NO: 27928 - RNA, 19 nt, Homo sapiens
agaaagggucaaauguuua

SEQ ID NO: 27929 - RNA, 19 nt, Homo sapiens
ggacagaugagcaggcaau

SEQ ID NO: 27930 - RNA, 19 nt, Homo sapiens
uaaacacuuuccacauaga

SEQ ID NO: 27931 - RNA, 19 nt, Homo sapiens
aaacaucagcuaaccgaaa

SEQ ID NO: 27932 - RNA, 19 nt, Homo sapiens
gaugaaucuugcuuuaaca

SEQ ID NO: 27933 - RNA, 19 nt, Homo sapiens
cgaugaaucuugcuuuaac

SEQ ID NO: 27934 - RNA, 19 nt, Homo sapiens
gcuaaucgagacuuguuaa

SEQ ID NO: 27935 - RNA, 19 nt, Homo sapiens
gaaauccgagaaauuguca

SEQ ID NO: 27936 - RNA, 19 nt, Homo sapiens
ucaugccuccuacguauua

SEQ ID NO: 27937 - RNA, 19 nt, Homo sapiens
gauccuggcccucuucaug

SEQ ID NO: 27938 - RNA, 19 nt, Homo sapiens
ucucugauucuguguaaua

SEQ ID NO: 27939 - RNA, 19 nt, Homo sapiens
ggaggugccuacccacaag

SEQ ID NO: 27940 - RNA, 19 nt, Homo sapiens
ucgcucagauguaucagaa

SEQ ID NO: 27941 - RNA, 19 nt, Homo sapiens
cagaugagcaggcaauugu

SEQ ID NO: 27942 - RNA, 19 nt, Homo sapiens
uaagucugcuugauagagu

SEQ ID NO: 27943 - RNA, 19 nt, Homo sapiens
ccaacaggcuacccaccuu

SEQ ID NO: 27944 - RNA, 19 nt, Homo sapiens
cuucaugccuccuacguau

SEQ ID NO: 27945 - RNA, 19 nt, Homo sapiens
guaaugugcuugguuugca

SEQ ID NO: 27946 - RNA, 19 nt, Homo sapiens
aaucgagacuuguuaagca

SEQ ID NO: 27947 - RNA, 19 nt, Homo sapiens
ccacaagugccaaguagug

SEQ ID NO: 27948 - RNA, 19 nt, Homo sapiens
gaguggauaguauguuaaa

SEQ ID NO: 27949 - RNA, 19 nt, Homo sapiens
ucaggaaauccgagaaauu

SEQ ID NO: 27950 - RNA, 19 nt, Homo sapiens
caagaacaaaucaggaaau

SEQ ID NO: 27951 - RNA, 19 nt, Homo sapiens
ggaaauccgagaaauuguc

SEQ ID NO: 27952 - RNA, 19 nt, Homo sapiens
caauaucaaacaucagcua

SEQ ID NO: 27953 - RNA, 19 nt, Homo sapiens
caacaggcuacccaccuuu

SEQ ID NO: 27954 - RNA, 19 nt, Homo sapiens
gugaugagaaccagaguau

SEQ ID NO: 27955 - RNA, 19 nt, Homo sapiens
ccgagaaauugucagaugu

SEQ ID NO: 27956 - RNA, 19 nt, Homo sapiens
gccuggagcuuacggaaag

SEQ ID NO: 27957 - RNA, 19 nt, Homo sapiens
guggaaauauggaagaacu

SEQ ID NO: 27958 - RNA, 19 nt, Homo sapiens
ccgaccagcugccaacuuc

SEQ ID NO: 27959 - RNA, 19 nt, Homo sapiens
uuuagaagguuacugaaag

SEQ ID NO: 27960 - RNA, 19 nt, Homo sapiens
guuugcacauguuguuauu

SEQ ID NO: 27961 - RNA, 19 nt, Homo sapiens
gauggcuaaucgagacuug

SEQ ID NO: 27962 - RNA, 19 nt, Homo sapiens
accgaugaaucuugcuuua

SEQ ID NO: 27963 - RNA, 19 nt, Homo sapiens
ccagggaaaucgugaugag

SEQ ID NO: 27964 - RNA, 19 nt, Homo sapiens
gaacucaggaacguguauu

SEQ ID NO: 27965 - RNA, 19 nt, Homo sapiens
caaccuacuuacccuaguc

SEQ ID NO: 27966 - RNA, 19 nt, Homo sapiens
auaaacacuuuccacauag

SEQ ID NO: 27967 - RNA, 19 nt, Homo sapiens
aggguaaugugcuugguuu

SEQ ID NO: 27968 - RNA, 19 nt, Homo sapiens
uguagaaagugguuugaag

SEQ ID NO: 27969 - RNA, 19 nt, Homo sapiens
aaucagaguuaaguggaaa

SEQ ID NO: 27970 - RNA, 19 nt, Homo sapiens
ggccaaccguuccaaugau

SEQ ID NO: 27971 - RNA, 19 nt, Homo sapiens
ugacacgaguggagauuac

SEQ ID NO: 27972 - RNA, 19 nt, Homo sapiens
agaagacucugggcacaau

SEQ ID NO: 27973 - RNA, 19 nt, Homo sapiens
aaaccuucauucuuacuag

SEQ ID NO: 27974 - RNA, 19 nt, Homo sapiens
ccauggaggcuuauucuag

SEQ ID NO: 27975 - RNA, 19 nt, Homo sapiens
cgagaaauugucagauguu

SEQ ID NO: 27976 - RNA, 19 nt, Homo sapiens
aagaacaaaucaggaaauc

SEQ ID NO: 27977 - RNA, 19 nt, Homo sapiens
ucagaucaauacagauucu

SEQ ID NO: 27978 - RNA, 19 nt, Homo sapiens
ggacauuaggucagauaca

SEQ ID NO: 27979 - RNA, 19 nt, Homo sapiens
uccgagaaauugucagaug

SEQ ID NO: 27980 - RNA, 19 nt, Homo sapiens
gaugaagccugccugauug

SEQ ID NO: 27981 - RNA, 19 nt, Homo sapiens
gaacagacgaguccaaguu

SEQ ID NO: 27982 - RNA, 19 nt, Homo sapiens
ugaaaugucucaagaauac

SEQ ID NO: 27983 - RNA, 19 nt, Homo sapiens
gcacaaacguggacauguc

SEQ ID NO: 27984 - RNA, 19 nt, Homo sapiens
gcuaagacuuggcuucauu

SEQ ID NO: 27985 - RNA, 19 nt, Homo sapiens
cuacaaagcagaauucaaa

SEQ ID NO: 27986 - RNA, 19 nt, Homo sapiens
ugacagggcuucuuguaau

SEQ ID NO: 27987 - RNA, 19 nt, Homo sapiens
gaagaucugugguggcaau

SEQ ID NO: 27988 - RNA, 19 nt, Homo sapiens
ggaagauucugcugaagau

SEQ ID NO: 27989 - RNA, 19 nt, Homo sapiens
ggaauggucuggaaauguc

SEQ ID NO: 27990 - RNA, 19 nt, Homo sapiens
gaagguagccugugcaucu

SEQ ID NO: 27991 - RNA, 19 nt, Homo sapiens
ggugaaaugucucaagaau

SEQ ID NO: 27992 - RNA, 19 nt, Homo sapiens
aaacagagccuacaaagca

SEQ ID NO: 27993 - RNA, 19 nt, Homo sapiens
gcagaaaccacgagaacaa

SEQ ID NO: 27994 - RNA, 19 nt, Homo sapiens
gagcacauccgagaauuaa

SEQ ID NO: 27995 - RNA, 19 nt, Homo sapiens
gacaucagaucagaguaua

SEQ ID NO: 27996 - RNA, 19 nt, Homo sapiens
caacaccagugccaggaaa

SEQ ID NO: 27997 - RNA, 19 nt, Homo sapiens
gaucugaaaucugaacugu

SEQ ID NO: 27998 - RNA, 19 nt, Homo sapiens
gacagggcuucuuguaauu

SEQ ID NO: 27999 - RNA, 19 nt, Homo sapiens
ggacaucagaucagaguau

SEQ ID NO: 28000 - RNA, 19 nt, Homo sapiens
ucugaaaucugaacuguca

SEQ ID NO: 28001 - RNA, 19 nt, Homo sapiens
ucaggaaacuuugagaaga

SEQ ID NO: 28002 - RNA, 19 nt, Homo sapiens
gcucuggaauggucuggaa

SEQ ID NO: 28003 - RNA, 19 nt, Homo sapiens
ccaguccucuuugacauuu

SEQ ID NO: 28004 - RNA, 19 nt, Homo sapiens
cugaaugucuguagccaaa

SEQ ID NO: 28005 - RNA, 19 nt, Homo sapiens
caaagccaguucccuguca

SEQ ID NO: 28006 - RNA, 19 nt, Homo sapiens
caagucuguuugcugcaua

SEQ ID NO: 28007 - RNA, 19 nt, Homo sapiens
guggugaaaugucucaaga

SEQ ID NO: 28008 - RNA, 19 nt, Homo sapiens
ugaugaagccugccugauu

SEQ ID NO: 28009 - RNA, 19 nt, Homo sapiens
ccuccaggaugcccucaua

SEQ ID NO: 28010 - RNA, 19 nt, Homo sapiens
cugccaaacucacuccuuu

SEQ ID NO: 28011 - RNA, 19 nt, Homo sapiens
gugaaaugucucaagaaua

SEQ ID NO: 28012 - RNA, 19 nt, Homo sapiens
gauccuacuuuccuucaag

SEQ ID NO: 28013 - RNA, 19 nt, Homo sapiens
ggaaaaggccaaaagaaug

SEQ ID NO: 28014 - RNA, 19 nt, Homo sapiens
gcacauccgagaauuaaac

SEQ ID NO: 28015 - RNA, 19 nt, Homo sapiens
gauaaaggaagccaucaag

SEQ ID NO: 28016 - RNA, 19 nt, Homo sapiens
gaacugucaggaaacuuug

SEQ ID NO: 28017 - RNA, 19 nt, Homo sapiens
ggccagaucuaaccaugag

SEQ ID NO: 28018 - RNA, 19 nt, Homo sapiens
agacuuggcuucauuucgu

SEQ ID NO: 28019 - RNA, 19 nt, Homo sapiens
uaacaaauccacaaauagc

SEQ ID NO: 28020 - RNA, 19 nt, Homo sapiens
gagaugcccaggagcugua

SEQ ID NO: 28021 - RNA, 19 nt, Homo sapiens
uggauaacguggccaccua

SEQ ID NO: 28022 - RNA, 19 nt, Homo sapiens
ggcagcagauccuacuuuc

SEQ ID NO: 28023 - RNA, 19 nt, Homo sapiens
gggaaaccgugaugaaagc

SEQ ID NO: 28024 - RNA, 19 nt, Homo sapiens
ugaacugucaggaaacuuu

SEQ ID NO: 28025 - RNA, 19 nt, Homo sapiens
caacaugcccaaccuguac

SEQ ID NO: 28026 - RNA, 19 nt, Homo sapiens
gagauucaccguccuagag

SEQ ID NO: 28027 - RNA, 19 nt, Homo sapiens
gaaaaggccaaaagaaugu

SEQ ID NO: 28028 - RNA, 19 nt, Homo sapiens
ggaggcauauuuucuuuuc

SEQ ID NO: 28029 - RNA, 19 nt, Homo sapiens
gaagccugccugauugaga

SEQ ID NO: 28030 - RNA, 19 nt, Homo sapiens
cagggcuucuuguaauuug

SEQ ID NO: 28031 - RNA, 19 nt, Homo sapiens
gugacagggcuucuuguaa

SEQ ID NO: 28032 - RNA, 19 nt, Homo sapiens
ccaacaugcccaaccugua

SEQ ID NO: 28033 - RNA, 19 nt, Homo sapiens
ugagcacauccgagaauua

SEQ ID NO: 28034 - RNA, 19 nt, Homo sapiens
gaaacccacccuccaggau

SEQ ID NO: 28035 - RNA, 19 nt, Homo sapiens
agucauuccuuccaucuuc

SEQ ID NO: 28036 - RNA, 19 nt, Homo sapiens
caaaggaccggacccugau

SEQ ID NO: 28037 - RNA, 19 nt, Homo sapiens
agacagaggcauacaaguc

SEQ ID NO: 28038 - RNA, 19 nt, Homo sapiens
gggauuaccggaagauucu

SEQ ID NO: 28039 - RNA, 19 nt, Homo sapiens
cauccgagaauuaaacaga

SEQ ID NO: 28040 - RNA, 19 nt, Homo sapiens
gaaacuuugagaagacaau

SEQ ID NO: 28041 - RNA, 19 nt, Homo sapiens
gcaguucaaccaggacuau

SEQ ID NO: 28042 - RNA, 19 nt, Homo sapiens
ccaaaagaaugucuguuuc

SEQ ID NO: 28043 - RNA, 19 nt, Homo sapiens
gugccgagcuacccaggau

SEQ ID NO: 28044 - RNA, 19 nt, Homo sapiens
ggaagccgaggcaccauca

SEQ ID NO: 28045 - RNA, 19 nt, Homo sapiens
ucaaugaguaccagagaau

SEQ ID NO: 28046 - RNA, 19 nt, Homo sapiens
cagggaaaccgugaugaaa

SEQ ID NO: 28047 - RNA, 19 nt, Homo sapiens
caggaaacuuugagaagac

SEQ ID NO: 28048 - RNA, 19 nt, Homo sapiens
gacuaucucucgggaaugg

SEQ ID NO: 28049 - RNA, 19 nt, Homo sapiens
ucagggaaaccgugaugaa

SEQ ID NO: 28050 - RNA, 19 nt, Homo sapiens
gagccuacaaagcagaauu

SEQ ID NO: 28051 - RNA, 19 nt, Homo sapiens
aaucuuggcucugaugaag

SEQ ID NO: 28052 - RNA, 19 nt, Homo sapiens
cagaaaccacgagaacaaa

SEQ ID NO: 28053 - RNA, 19 nt, Homo sapiens
gucacgagcuuuguuacug

SEQ ID NO: 28054 - RNA, 19 nt, Homo sapiens
gacagaggcauacaagucu

SEQ ID NO: 28055 - RNA, 19 nt, Homo sapiens
gccaaaagaaugucuguuu

SEQ ID NO: 28056 - RNA, 19 nt, Homo sapiens
gaucugugguggcaaugac

SEQ ID NO: 28057 - RNA, 19 nt, Homo sapiens
agaccgaccuccuggacau

SEQ ID NO: 28058 - RNA, 19 nt, Homo sapiens
gaauuaaacagagccuaca

SEQ ID NO: 28059 - RNA, 19 nt, Homo sapiens
cggcuuacggcaaggauuu

SEQ ID NO: 28060 - RNA, 19 nt, Homo sapiens
gagcaggccaucauugacu

SEQ ID NO: 28061 - RNA, 19 nt, Homo sapiens
gagccaacaugcccaaccu

SEQ ID NO: 28062 - RNA, 19 nt, Homo sapiens
uuacagucauugccagaca

SEQ ID NO: 28063 - RNA, 19 nt, Homo sapiens
ggcuucauuucgucaugua

SEQ ID NO: 28064 - RNA, 19 nt, Homo sapiens
cuaacaaauccacaaauag

SEQ ID NO: 28065 - RNA, 19 nt, Homo sapiens
gcaacaccagugccaggaa

SEQ ID NO: 28066 - RNA, 19 nt, Homo sapiens
cggaagauucugcugaaga

SEQ ID NO: 28067 - RNA, 19 nt, Homo sapiens
gccgggacauugagaagag

SEQ ID NO: 28068 - RNA, 19 nt, Homo sapiens
ggauaacguggccaccuau

SEQ ID NO: 28069 - RNA, 19 nt, Homo sapiens
ucagugacagggcuucuug

SEQ ID NO: 28070 - RNA, 19 nt, Homo sapiens
agaaagucauuccuuccau

SEQ ID NO: 28071 - RNA, 19 nt, Homo sapiens
cuaagacuuggcuucauuu

SEQ ID NO: 28072 - RNA, 19 nt, Homo sapiens
cggcagcagauccuacuuu

SEQ ID NO: 28073 - RNA, 19 nt, Homo sapiens
ggagauacuucaggggauu

SEQ ID NO: 28074 - RNA, 19 nt, Homo sapiens
caucagaucagaguauaag

SEQ ID NO: 28075 - RNA, 19 nt, Homo sapiens
caaguucaaugcgguucug

SEQ ID NO: 28076 - RNA, 19 nt, Homo sapiens
ggccagaaagucauuccuu

SEQ ID NO: 28077 - RNA, 19 nt, Homo sapiens
cagaguauaagcggaugua

SEQ ID NO: 28078 - RNA, 19 nt, Homo sapiens
cacugaugcucccggcuuu

SEQ ID NO: 28079 - RNA, 19 nt, Homo sapiens
cgacacaucagggcacuuc

SEQ ID NO: 28080 - RNA, 19 nt, Homo sapiens
gaugaagccugccugauug

SEQ ID NO: 28081 - RNA, 19 nt, Homo sapiens
gaacagacgaguccaaguu

SEQ ID NO: 28082 - RNA, 19 nt, Homo sapiens
ugaaaugucucaagaauac

SEQ ID NO: 28083 - RNA, 19 nt, Homo sapiens
gcacaaacguggacauguc

SEQ ID NO: 28084 - RNA, 19 nt, Homo sapiens
gcuaagacuuggcuucauu

SEQ ID NO: 28085 - RNA, 19 nt, Homo sapiens
cuacaaagcagaauucaaa

SEQ ID NO: 28086 - RNA, 19 nt, Homo sapiens
ugacagggcuucuuguaau

SEQ ID NO: 28087 - RNA, 19 nt, Homo sapiens
gaagaucugugguggcaau

SEQ ID NO: 28088 - RNA, 19 nt, Homo sapiens
ggaagauucugcugaagau

SEQ ID NO: 28089 - RNA, 19 nt, Homo sapiens
ggaauggucuggaaauguc

SEQ ID NO: 28090 - RNA, 19 nt, Homo sapiens
gaagguagccugugcaucu

SEQ ID NO: 28091 - RNA, 19 nt, Homo sapiens
ggugaaaugucucaagaau

SEQ ID NO: 28092 - RNA, 19 nt, Homo sapiens
aaacagagccuacaaagca

SEQ ID NO: 28093 - RNA, 19 nt, Homo sapiens
gcagaaaccacgagaacaa

SEQ ID NO: 28094 - RNA, 19 nt, Homo sapiens
gagcacauccgagaauuaa

SEQ ID NO: 28095 - RNA, 19 nt, Homo sapiens
gacaucagaucagaguaua

SEQ ID NO: 28096 - RNA, 19 nt, Homo sapiens
caacaccagugccaggaaa

SEQ ID NO: 28097 - RNA, 19 nt, Homo sapiens
gaucugaaaucugaacugu

SEQ ID NO: 28098 - RNA, 19 nt, Homo sapiens
gacagggcuucuuguaauu

SEQ ID NO: 28099 - RNA, 19 nt, Homo sapiens
ggacaucagaucagaguau

SEQ ID NO: 28100 - RNA, 19 nt, Homo sapiens
ucugaaaucugaacuguca

SEQ ID NO: 28101 - RNA, 19 nt, Homo sapiens
ucaaagaucuaaccaugag

SEQ ID NO: 28102 - RNA, 19 nt, Homo sapiens
ucaggaaacuuugagaaga

SEQ ID NO: 28103 - RNA, 19 nt, Homo sapiens
gggaagagacuuacagaag

SEQ ID NO: 28104 - RNA, 19 nt, Homo sapiens
gcucuggaauggucuggaa

SEQ ID NO: 28105 - RNA, 19 nt, Homo sapiens
ccaguccucuuugacauuu

SEQ ID NO: 28106 - RNA, 19 nt, Homo sapiens
cugaaugucuguagccaaa

SEQ ID NO: 28107 - RNA, 19 nt, Homo sapiens
caaagccaguucccuguca

SEQ ID NO: 28108 - RNA, 19 nt, Homo sapiens
caagucuguuugcugcaua

SEQ ID NO: 28109 - RNA, 19 nt, Homo sapiens
guggugaaaugucucaaga

SEQ ID NO: 28110 - RNA, 19 nt, Homo sapiens
ugaugaagccugccugauu

SEQ ID NO: 28111 - RNA, 19 nt, Homo sapiens
ccuccaggaugcccucaua

SEQ ID NO: 28112 - RNA, 19 nt, Homo sapiens
cugccaaacucacuccuuu

SEQ ID NO: 28113 - RNA, 19 nt, Homo sapiens
gugaaaugucucaagaaua

SEQ ID NO: 28114 - RNA, 19 nt, Homo sapiens
gauccuacuuuccuucaag

SEQ ID NO: 28115 - RNA, 19 nt, Homo sapiens
ggaaaaggccaaaagaaug

SEQ ID NO: 28116 - RNA, 19 nt, Homo sapiens
gcacauccgagaauuaaac

SEQ ID NO: 28117 - RNA, 19 nt, Homo sapiens
gauaaaggaagccaucaag

SEQ ID NO: 28118 - RNA, 19 nt, Homo sapiens
gaacugucaggaaacuuug

SEQ ID NO: 28119 - RNA, 19 nt, Homo sapiens
agacuuggcuucauuucgu

SEQ ID NO: 28120 - RNA, 19 nt, Homo sapiens
uaacaaauccacaaauagc

SEQ ID NO: 28121 - RNA, 19 nt, Homo sapiens
uggauaacguggccaccua

SEQ ID NO: 28122 - RNA, 19 nt, Homo sapiens
gagaugcccaggagcugua

SEQ ID NO: 28123 - RNA, 19 nt, Homo sapiens
ggcagcagauccuacuuuc

SEQ ID NO: 28124 - RNA, 19 nt, Homo sapiens
gggaaaccgugaugaaagc

SEQ ID NO: 28125 - RNA, 19 nt, Homo sapiens
ugaacugucaggaaacuuu

SEQ ID NO: 28126 - RNA, 19 nt, Homo sapiens
caacaugcccaaccuguac

SEQ ID NO: 28127 - RNA, 19 nt, Homo sapiens
gagauucaccguccuagag

SEQ ID NO: 28128 - RNA, 19 nt, Homo sapiens
gaaaaggccaaaagaaugu

SEQ ID NO: 28129 - RNA, 19 nt, Homo sapiens
ggaggcauauuuucuuuuc

SEQ ID NO: 28130 - RNA, 19 nt, Homo sapiens
gaagccugccugauugaga

SEQ ID NO: 28131 - RNA, 19 nt, Homo sapiens
cagggcuucuuguaauuug

SEQ ID NO: 28132 - RNA, 19 nt, Homo sapiens
gugacagggcuucuuguaa

SEQ ID NO: 28133 - RNA, 19 nt, Homo sapiens
ccaacaugcccaaccugua

SEQ ID NO: 28134 - RNA, 19 nt, Homo sapiens
ugagcacauccgagaauua

SEQ ID NO: 28135 - RNA, 19 nt, Homo sapiens
agucauuccuuccaucuuc

SEQ ID NO: 28136 - RNA, 19 nt, Homo sapiens
gaaacccacccuccaggau

SEQ ID NO: 28137 - RNA, 19 nt, Homo sapiens
caaaggaccggacccugau

SEQ ID NO: 28138 - RNA, 19 nt, Homo sapiens
agacagaggcauacaaguc

SEQ ID NO: 28139 - RNA, 19 nt, Homo sapiens
gggauuaccggaagauucu

SEQ ID NO: 28140 - RNA, 19 nt, Homo sapiens
cauccgagaauuaaacaga

SEQ ID NO: 28141 - RNA, 19 nt, Homo sapiens
gaaacuuugagaagacaau

SEQ ID NO: 28142 - RNA, 19 nt, Homo sapiens
uuacagaaguggaguugcu

SEQ ID NO: 28143 - RNA, 19 nt, Homo sapiens
gcaguucaaccaggacuau

SEQ ID NO: 28144 - RNA, 19 nt, Homo sapiens
ccaaaagaaugucuguuuc

SEQ ID NO: 28145 - RNA, 19 nt, Homo sapiens
ucaaugaguaccagagaau

SEQ ID NO: 28146 - RNA, 19 nt, Homo sapiens
gugccgagcuacccaggau

SEQ ID NO: 28147 - RNA, 19 nt, Homo sapiens
cagggaaaccgugaugaaa

SEQ ID NO: 28148 - RNA, 19 nt, Homo sapiens
caggaaacuuugagaagac

SEQ ID NO: 28149 - RNA, 19 nt, Homo sapiens
ggaagccgaggcaccauca

SEQ ID NO: 28150 - RNA, 19 nt, Homo sapiens
gacuaucucucgggaaugg

SEQ ID NO: 28151 - RNA, 19 nt, Homo sapiens
ucagggaaaccgugaugaa

SEQ ID NO: 28152 - RNA, 19 nt, Homo sapiens
gagccuacaaagcagaauu

SEQ ID NO: 28153 - RNA, 19 nt, Homo sapiens
aaucuuggcucugaugaag

SEQ ID NO: 28154 - RNA, 19 nt, Homo sapiens
cagaaaccacgagaacaaa

SEQ ID NO: 28155 - RNA, 19 nt, Homo sapiens
gucacgagcuuuguuacug

SEQ ID NO: 28156 - RNA, 19 nt, Homo sapiens
gacagaggcauacaagucu

SEQ ID NO: 28157 - RNA, 19 nt, Homo sapiens
gccaaaagaaugucuguuu

SEQ ID NO: 28158 - RNA, 19 nt, Homo sapiens
gaucugugguggcaaugac

SEQ ID NO: 28159 - RNA, 19 nt, Homo sapiens
agaccgaccuccuggacau

SEQ ID NO: 28160 - RNA, 19 nt, Homo sapiens
gaauuaaacagagccuaca

SEQ ID NO: 28161 - RNA, 19 nt, Homo sapiens
cggcuuacggcaaggauuu

SEQ ID NO: 28162 - RNA, 19 nt, Homo sapiens
gagcaggccaucauugacu

SEQ ID NO: 28163 - RNA, 19 nt, Homo sapiens
uuacagucauugccagaca

SEQ ID NO: 28164 - RNA, 19 nt, Homo sapiens
ggcuucauuucgucaugua

SEQ ID NO: 28165 - RNA, 19 nt, Homo sapiens
cuaacaaauccacaaauag

SEQ ID NO: 28166 - RNA, 19 nt, Homo sapiens
gagccaacaugcccaaccu

SEQ ID NO: 28167 - RNA, 19 nt, Homo sapiens
gcaacaccagugccaggaa

SEQ ID NO: 28168 - RNA, 19 nt, Homo sapiens
cggaagauucugcugaaga

SEQ ID NO: 28169 - RNA, 19 nt, Homo sapiens
gccgggacauugagaagag

SEQ ID NO: 28170 - RNA, 19 nt, Homo sapiens
ucagugacagggcuucuug

SEQ ID NO: 28171 - RNA, 19 nt, Homo sapiens
agaaagucauuccuuccau

SEQ ID NO: 28172 - RNA, 19 nt, Homo sapiens
cuaagacuuggcuucauuu

SEQ ID NO: 28173 - RNA, 19 nt, Homo sapiens
ggagauacuucaggggauu

SEQ ID NO: 28174 - RNA, 19 nt, Homo sapiens
cggcagcagauccuacuuu

SEQ ID NO: 28175 - RNA, 19 nt, Homo sapiens
caucagaucagaguauaag

SEQ ID NO: 28176 - RNA, 19 nt, Homo sapiens
caaguucaaugcgguucug

SEQ ID NO: 28177 - RNA, 19 nt, Homo sapiens
ggauaacguggccaccuau

SEQ ID NO: 28178 - RNA, 19 nt, Homo sapiens
cacugaugcucccggcuuu

SEQ ID NO: 28179 - RNA, 19 nt, Homo sapiens
ggccagaaagucauuccuu

SEQ ID NO: 28180 - RNA, 19 nt, Homo sapiens
gaugaagccugccugauug

SEQ ID NO: 28181 - RNA, 19 nt, Homo sapiens
gaacagacgaguccaaguu

SEQ ID NO: 28182 - RNA, 19 nt, Homo sapiens
ugaaaugucucaagaauac

SEQ ID NO: 28183 - RNA, 19 nt, Homo sapiens
gcacaaacguggacauguc

SEQ ID NO: 28184 - RNA, 19 nt, Homo sapiens
gcuaagacuuggcuucauu

SEQ ID NO: 28185 - RNA, 19 nt, Homo sapiens
cuacaaagcagaauucaaa

SEQ ID NO: 28186 - RNA, 19 nt, Homo sapiens
ugacagggcuucuuguaau

SEQ ID NO: 28187 - RNA, 19 nt, Homo sapiens
gaagaucugugguggcaau

SEQ ID NO: 28188 - RNA, 19 nt, Homo sapiens
ggaagauucugcugaagau

SEQ ID NO: 28189 - RNA, 19 nt, Homo sapiens
ggaauggucuggaaauguc

SEQ ID NO: 28190 - RNA, 19 nt, Homo sapiens
gaagguagccugugcaucu

SEQ ID NO: 28191 - RNA, 19 nt, Homo sapiens
ggugaaaugucucaagaau

SEQ ID NO: 28192 - RNA, 19 nt, Homo sapiens
aaacagagccuacaaagca

SEQ ID NO: 28193 - RNA, 19 nt, Homo sapiens
gcagaaaccacgagaacaa

SEQ ID NO: 28194 - RNA, 19 nt, Homo sapiens
gagcacauccgagaauuaa

SEQ ID NO: 28195 - RNA, 19 nt, Homo sapiens
gacaucagaucagaguaua

SEQ ID NO: 28196 - RNA, 19 nt, Homo sapiens
caacaccagugccaggaaa

SEQ ID NO: 28197 - RNA, 19 nt, Homo sapiens
gaucugaaaucugaacugu

SEQ ID NO: 28198 - RNA, 19 nt, Homo sapiens
ggaccugccugguuuaaac

SEQ ID NO: 28199 - RNA, 19 nt, Homo sapiens
uaucacagacugaguaauu

SEQ ID NO: 28200 - RNA, 19 nt, Homo sapiens
gacagggcuucuuguaauu

SEQ ID NO: 28201 - RNA, 19 nt, Homo sapiens
ggacaucagaucagaguau

SEQ ID NO: 28202 - RNA, 19 nt, Homo sapiens
ucugaaaucugaacuguca

SEQ ID NO: 28203 - RNA, 19 nt, Homo sapiens
ucaaagaucuaaccaugag

SEQ ID NO: 28204 - RNA, 19 nt, Homo sapiens
ucaggaaacuuugagaaga

SEQ ID NO: 28205 - RNA, 19 nt, Homo sapiens
uaacauggcagaagacauc

SEQ ID NO: 28206 - RNA, 19 nt, Homo sapiens
ucacagacugaguaauuua

SEQ ID NO: 28207 - RNA, 19 nt, Homo sapiens
gcucuggaauggucuggaa

SEQ ID NO: 28208 - RNA, 19 nt, Homo sapiens
ccaguccucuuugacauuu

SEQ ID NO: 28209 - RNA, 19 nt, Homo sapiens
gggaagagacuuacagaag

SEQ ID NO: 28210 - RNA, 19 nt, Homo sapiens
cugaaugucuguagccaaa

SEQ ID NO: 28211 - RNA, 19 nt, Homo sapiens
caaagccaguucccuguca

SEQ ID NO: 28212 - RNA, 19 nt, Homo sapiens
uauuggaccugccugguuu

SEQ ID NO: 28213 - RNA, 19 nt, Homo sapiens
caagucuguuugcugcaua

SEQ ID NO: 28214 - RNA, 19 nt, Homo sapiens
guggugaaaugucucaaga

SEQ ID NO: 28215 - RNA, 19 nt, Homo sapiens
ugaugaagccugccugauu

SEQ ID NO: 28216 - RNA, 19 nt, Homo sapiens
ccuccaggaugcccucaua

SEQ ID NO: 28217 - RNA, 19 nt, Homo sapiens
cugccaaacucacuccuuu

SEQ ID NO: 28218 - RNA, 19 nt, Homo sapiens
gugaaaugucucaagaaua

SEQ ID NO: 28219 - RNA, 19 nt, Homo sapiens
gauccuacuuuccuucaag

SEQ ID NO: 28220 - RNA, 19 nt, Homo sapiens
aaauaucacagacugagua

SEQ ID NO: 28221 - RNA, 19 nt, Homo sapiens
ggaaaaggccaaaagaaug

SEQ ID NO: 28222 - RNA, 19 nt, Homo sapiens
gcacauccgagaauuaaac

SEQ ID NO: 28223 - RNA, 19 nt, Homo sapiens
gauaaaggaagccaucaag

SEQ ID NO: 28224 - RNA, 19 nt, Homo sapiens
gaacugucaggaaacuuug

SEQ ID NO: 28225 - RNA, 19 nt, Homo sapiens
agacuuggcuucauuucgu

SEQ ID NO: 28226 - RNA, 19 nt, Homo sapiens
uaacaaauccacaaauagc

SEQ ID NO: 28227 - RNA, 19 nt, Homo sapiens
gagaugcccaggagcugua

SEQ ID NO: 28228 - RNA, 19 nt, Homo sapiens
ggcagcagauccuacuuuc

SEQ ID NO: 28229 - RNA, 19 nt, Homo sapiens
uggauaacguggccaccua

SEQ ID NO: 28230 - RNA, 19 nt, Homo sapiens
gugcugcucuaacaaaaua

SEQ ID NO: 28231 - RNA, 19 nt, Homo sapiens
gggaaaccgugaugaaagc

SEQ ID NO: 28232 - RNA, 19 nt, Homo sapiens
ugaacugucaggaaacuuu

SEQ ID NO: 28233 - RNA, 19 nt, Homo sapiens
caacaugcccaaccuguac

SEQ ID NO: 28234 - RNA, 19 nt, Homo sapiens
gagauucaccguccuagag

SEQ ID NO: 28235 - RNA, 19 nt, Homo sapiens
gaaaaggccaaaagaaugu

SEQ ID NO: 28236 - RNA, 19 nt, Homo sapiens
ggaggcauauuuucuuuuc

SEQ ID NO: 28237 - RNA, 19 nt, Homo sapiens
gaagccugccugauugaga

SEQ ID NO: 28238 - RNA, 19 nt, Homo sapiens
cagggcuucuuguaauuug

SEQ ID NO: 28239 - RNA, 19 nt, Homo sapiens
gugacagggcuucuuguaa

SEQ ID NO: 28240 - RNA, 19 nt, Homo sapiens
ugagcacauccgagaauua

SEQ ID NO: 28241 - RNA, 19 nt, Homo sapiens
ccaacaugcccaaccugua

SEQ ID NO: 28242 - RNA, 19 nt, Homo sapiens
agucauuccuuccaucuuc

SEQ ID NO: 28243 - RNA, 19 nt, Homo sapiens
ccuucuugcugcuucauaa

SEQ ID NO: 28244 - RNA, 19 nt, Homo sapiens
caaaggaccggacccugau

SEQ ID NO: 28245 - RNA, 19 nt, Homo sapiens
gaaacccacccuccaggau

SEQ ID NO: 28246 - RNA, 19 nt, Homo sapiens
agacagaggcauacaaguc

SEQ ID NO: 28247 - RNA, 19 nt, Homo sapiens
gggauuaccggaagauucu

SEQ ID NO: 28248 - RNA, 19 nt, Homo sapiens
cauccgagaauuaaacaga

SEQ ID NO: 28249 - RNA, 19 nt, Homo sapiens
gaaacuuugagaagacaau

SEQ ID NO: 28250 - RNA, 19 nt, Homo sapiens
ccaaaagaaugucuguuuc

SEQ ID NO: 28251 - RNA, 19 nt, Homo sapiens
ucaaugaguaccagagaau

SEQ ID NO: 28252 - RNA, 19 nt, Homo sapiens
cagggaaaccgugaugaaa

SEQ ID NO: 28253 - RNA, 19 nt, Homo sapiens
caggaaacuuugagaagac

SEQ ID NO: 28254 - RNA, 19 nt, Homo sapiens
ggaagccgaggcaccauca

SEQ ID NO: 28255 - RNA, 19 nt, Homo sapiens
gugccgagcuacccaggau

SEQ ID NO: 28256 - RNA, 19 nt, Homo sapiens
gcaguucaaccaggacuau

SEQ ID NO: 28257 - RNA, 19 nt, Homo sapiens
uuacagaaguggaguugcu

SEQ ID NO: 28258 - RNA, 19 nt, Homo sapiens
ucagggaaaccgugaugaa

SEQ ID NO: 28259 - RNA, 19 nt, Homo sapiens
gagccuacaaagcagaauu

SEQ ID NO: 28260 - RNA, 19 nt, Homo sapiens
aaucuuggcucugaugaag

SEQ ID NO: 28261 - RNA, 19 nt, Homo sapiens
gacuaucucucgggaaugg

SEQ ID NO: 28262 - RNA, 19 nt, Homo sapiens
cagaaaccacgagaacaaa

SEQ ID NO: 28263 - RNA, 19 nt, Homo sapiens
gucacgagcuuuguuacug

SEQ ID NO: 28264 - RNA, 19 nt, Homo sapiens
gacagaggcauacaagucu

SEQ ID NO: 28265 - RNA, 19 nt, Homo sapiens
gccaaaagaaugucuguuu

SEQ ID NO: 28266 - RNA, 19 nt, Homo sapiens
gaucugugguggcaaugac

SEQ ID NO: 28267 - RNA, 19 nt, Homo sapiens
agaccgaccuccuggacau

SEQ ID NO: 28268 - RNA, 19 nt, Homo sapiens
gaauuaaacagagccuaca

SEQ ID NO: 28269 - RNA, 19 nt, Homo sapiens
cggcuuacggcaaggauuu

SEQ ID NO: 28270 - RNA, 19 nt, Homo sapiens
gagcaggccaucauugacu

SEQ ID NO: 28271 - RNA, 19 nt, Homo sapiens
uuacagucauugccagaca

SEQ ID NO: 28272 - RNA, 19 nt, Homo sapiens
ggcuucauuucgucaugua

SEQ ID NO: 28273 - RNA, 19 nt, Homo sapiens
cuaacaaauccacaaauag

SEQ ID NO: 28274 - RNA, 19 nt, Homo sapiens
gcaacaccagugccaggaa

SEQ ID NO: 28275 - RNA, 19 nt, Homo sapiens
cggaagauucugcugaaga

SEQ ID NO: 28276 - RNA, 19 nt, Homo sapiens
gccgggacauugagaagag

SEQ ID NO: 28277 - RNA, 19 nt, Homo sapiens
gagccaacaugcccaaccu

SEQ ID NO: 28278 - RNA, 19 nt, Homo sapiens
ucagugacagggcuucuug

SEQ ID NO: 28279 - RNA, 19 nt, Homo sapiens
agaaagucauuccuuccau

SEQ ID NO: 28280 - RNA, 19 nt, Homo sapiens
gaacaaagccugcaaagga

SEQ ID NO: 28281 - RNA, 19 nt, Homo sapiens
ggacugaucucuuaaugaa

SEQ ID NO: 28282 - RNA, 19 nt, Homo sapiens
gcaaggagcuggaggaagu

SEQ ID NO: 28283 - RNA, 19 nt, Homo sapiens
gagaugacguggacaaaga

SEQ ID NO: 28284 - RNA, 19 nt, Homo sapiens
uaggaggacugaucucuua

SEQ ID NO: 28285 - RNA, 19 nt, Homo sapiens
gaaaucaucgccauuaaag

SEQ ID NO: 28286 - RNA, 19 nt, Homo sapiens
uuugaaagccucauuguua

SEQ ID NO: 28287 - RNA, 19 nt, Homo sapiens
ggaaaucaucgccauuaaa

SEQ ID NO: 28288 - RNA, 19 nt, Homo sapiens
gcagaaggccuauuuaacu

SEQ ID NO: 28289 - RNA, 19 nt, Homo sapiens
gccaagcuguguaaguuaa

SEQ ID NO: 28290 - RNA, 19 nt, Homo sapiens
caagagaaguaucagaagu

SEQ ID NO: 28291 - RNA, 19 nt, Homo sapiens
gaaagccucauuguuaauu

SEQ ID NO: 28292 - RNA, 19 nt, Homo sapiens
ggaaccaccuuugucaaga

SEQ ID NO: 28293 - RNA, 19 nt, Homo sapiens
gcacgaggaccaauaagga

SEQ ID NO: 28294 - RNA, 19 nt, Homo sapiens
gaugagaggcaacaaauca

SEQ ID NO: 28295 - RNA, 19 nt, Homo sapiens
caaguaagguacaggaaag

SEQ ID NO: 28296 - RNA, 19 nt, Homo sapiens
aagcaaaguuccaagagaa

SEQ ID NO: 28297 - RNA, 19 nt, Homo sapiens
cgaaucagaugucaaaggu

SEQ ID NO: 28298 - RNA, 19 nt, Homo sapiens
gaggacugaucucuuaaug

SEQ ID NO: 28299 - RNA, 19 nt, Homo sapiens
agaagaagccauugaagaa

SEQ ID NO: 28300 - RNA, 19 nt, Homo sapiens
uugaaagccucauuguuaa

SEQ ID NO: 28301 - RNA, 19 nt, Homo sapiens
ggauaugcaucacacaagu

SEQ ID NO: 28302 - RNA, 19 nt, Homo sapiens
cuaaugaaaucagcaguug

SEQ ID NO: 28303 - RNA, 19 nt, Homo sapiens
gagcacauuccaaaucaaa

SEQ ID NO: 28304 - RNA, 19 nt, Homo sapiens
ugucaaaggugauacaagu

SEQ ID NO: 28305 - RNA, 19 nt, Homo sapiens
gaagcagccaucauugaaa

SEQ ID NO: 28306 - RNA, 19 nt, Homo sapiens
guaacuggauguuuucuaa

SEQ ID NO: 28307 - RNA, 19 nt, Homo sapiens
ccuuaagagucccggauua

SEQ ID NO: 28308 - RNA, 19 nt, Homo sapiens
agagugagcugaguggaaa

SEQ ID NO: 28309 - RNA, 19 nt, Homo sapiens
gaaccaccuuugucaagag

SEQ ID NO: 28310 - RNA, 19 nt, Homo sapiens
aaagcaaaguuccaagaga

SEQ ID NO: 28311 - RNA, 19 nt, Homo sapiens
cugaugagcuugcguucaa

SEQ ID NO: 28312 - RNA, 19 nt, Homo sapiens
gggcaaucgucaugcuaaa

SEQ ID NO: 28313 - RNA, 19 nt, Homo sapiens
caagagcacauuccaaauc

SEQ ID NO: 28314 - RNA, 19 nt, Homo sapiens
gagccaagccagggcaaua

SEQ ID NO: 28315 - RNA, 19 nt, Homo sapiens
gcaguuacgagccaccuuu

SEQ ID NO: 28316 - RNA, 19 nt, Homo sapiens
ugauacaaguggaaaccua

SEQ ID NO: 28317 - RNA, 19 nt, Homo sapiens
caaaguuccaagagaagua

SEQ ID NO: 28318 - RNA, 19 nt, Homo sapiens
aagaagccauugaagaaga

SEQ ID NO: 28319 - RNA, 19 nt, Homo sapiens
agacauagaagaagccauu

SEQ ID NO: 28320 - RNA, 19 nt, Homo sapiens
gauacaaguggaaaccuaa

SEQ ID NO: 28321 - RNA, 19 nt, Homo sapiens
uaaagaggccuaccaaagg

SEQ ID NO: 28322 - RNA, 19 nt, Homo sapiens
ugacaugguucgcucagau

SEQ ID NO: 28323 - RNA, 19 nt, Homo sapiens
gaucaaagcaaaguuccaa

SEQ ID NO: 28324 - RNA, 19 nt, Homo sapiens
agccaucauugaaaucuua

SEQ ID NO: 28325 - RNA, 19 nt, Homo sapiens
gauaugcaucacacaagua

SEQ ID NO: 28326 - RNA, 19 nt, Homo sapiens
caaaucaaacuugcaaaug

SEQ ID NO: 28327 - RNA, 19 nt, Homo sapiens
gucaagagcacauuccaaa

SEQ ID NO: 28328 - RNA, 19 nt, Homo sapiens
aacaaagccugcaaaggaa

SEQ ID NO: 28329 - RNA, 19 nt, Homo sapiens
uagaagaagccauugaaga

SEQ ID NO: 28330 - RNA, 19 nt, Homo sapiens
aagagcacauuccaaauca

SEQ ID NO: 28331 - RNA, 19 nt, Homo sapiens
cagaaggccuauuuaacuc

SEQ ID NO: 28332 - RNA, 19 nt, Homo sapiens
uuucaagccuaucaaauuc

SEQ ID NO: 28333 - RNA, 19 nt, Homo sapiens
cauagaagaagccauugaa

SEQ ID NO: 28334 - RNA, 19 nt, Homo sapiens
aagcagccaucauugaaau

SEQ ID NO: 28335 - RNA, 19 nt, Homo sapiens
ugaagcagccaucauugaa

SEQ ID NO: 28336 - RNA, 19 nt, Homo sapiens
uggcaaagacauagaagaa

SEQ ID NO: 28337 - RNA, 19 nt, Homo sapiens
gaggagcuacaagcaguua

SEQ ID NO: 28338 - RNA, 19 nt, Homo sapiens
aaggaaaucaucgccauua

SEQ ID NO: 28339 - RNA, 19 nt, Homo sapiens
caugguaacuggauguuuu

SEQ ID NO: 28340 - RNA, 19 nt, Homo sapiens
uuacuuucuuggcagcuua

SEQ ID NO: 28341 - RNA, 19 nt, Homo sapiens
ccaaaucaaacuugcaaau

SEQ ID NO: 28342 - RNA, 19 nt, Homo sapiens
gaugugcccaggauuguga

SEQ ID NO: 28343 - RNA, 19 nt, Homo sapiens
agaaacaucaggcgacuug

SEQ ID NO: 28344 - RNA, 19 nt, Homo sapiens
gaagaagccauugaagaag

SEQ ID NO: 28345 - RNA, 19 nt, Homo sapiens
gcaggcuaaucgcaaugaa

SEQ ID NO: 28346 - RNA, 19 nt, Homo sapiens
ccucgaaucagaugucaaa

SEQ ID NO: 28347 - RNA, 19 nt, Homo sapiens
gacaugguucgcucagaua

SEQ ID NO: 28348 - RNA, 19 nt, Homo sapiens
agaagucucucucugacau

SEQ ID NO: 28349 - RNA, 19 nt, Homo sapiens
aggaaaucaucgccauuaa

SEQ ID NO: 28350 - RNA, 19 nt, Homo sapiens
ggccaagcuguguaaguua

SEQ ID NO: 28351 - RNA, 19 nt, Homo sapiens
uaagagucccggauuacuu

SEQ ID NO: 28352 - RNA, 19 nt, Homo sapiens
uuaaagaggccuaccaaag

SEQ ID NO: 28353 - RNA, 19 nt, Homo sapiens
uggcacauuuagaaggaua

SEQ ID NO: 28354 - RNA, 19 nt, Homo sapiens
aggccaagcuguguaaguu

SEQ ID NO: 28355 - RNA, 19 nt, Homo sapiens
ggaccgaugaggagacguu

SEQ ID NO: 28356 - RNA, 19 nt, Homo sapiens
agaagccauugaagaagaa

SEQ ID NO: 28357 - RNA, 19 nt, Homo sapiens
ucgguaaacuuugccugua

SEQ ID NO: 28358 - RNA, 19 nt, Homo sapiens
cagaugagaggcaacaaau

SEQ ID NO: 28359 - RNA, 19 nt, Homo sapiens
ucaaagcaaaguuccaaga

SEQ ID NO: 28360 - RNA, 19 nt, Homo sapiens
auaggagccucgaaucaga

SEQ ID NO: 28361 - RNA, 19 nt, Homo sapiens
ccuucuguguguucaauuu

SEQ ID NO: 28362 - RNA, 19 nt, Homo sapiens
caccuugaacucuggcuua

SEQ ID NO: 28363 - RNA, 19 nt, Homo sapiens
ggacuuccggaaacugcua

SEQ ID NO: 28364 - RNA, 19 nt, Homo sapiens
agaucuagcuggucaggau

SEQ ID NO: 28365 - RNA, 19 nt, Homo sapiens
ugacguggacaaagaucua

SEQ ID NO: 28366 - RNA, 19 nt, Homo sapiens
aaucaaacuugcaaaugag

SEQ ID NO: 28367 - RNA, 19 nt, Homo sapiens
ugagaugugcccaggauug

SEQ ID NO: 28368 - RNA, 19 nt, Homo sapiens
ggcaacaaaucaagcaaaa

SEQ ID NO: 28369 - RNA, 19 nt, Homo sapiens
ccuaucaaauucucauugg

SEQ ID NO: 28370 - RNA, 19 nt, Homo sapiens
uuaaaguuguggauuaugc

SEQ ID NO: 28371 - RNA, 19 nt, Homo sapiens
ggaggacugaucucuuaau

SEQ ID NO: 28372 - RNA, 19 nt, Homo sapiens
acaaguaagguacaggaaa

SEQ ID NO: 28373 - RNA, 19 nt, Homo sapiens
aagagucccggauuacuuu

SEQ ID NO: 28374 - RNA, 19 nt, Homo sapiens
gcacauuccaaaucaaacu

SEQ ID NO: 28375 - RNA, 19 nt, Homo sapiens
gaugaggagacguugauuc

SEQ ID NO: 28376 - RNA, 19 nt, Homo sapiens
uaagguacaggaaagacaa

SEQ ID NO: 28377 - RNA, 19 nt, Homo sapiens
cgugagaugugcccaggau

SEQ ID NO: 28378 - RNA, 19 nt, Homo sapiens
gcugcaggcuaaucgcaau

SEQ ID NO: 28379 - RNA, 19 nt, Homo sapiens
guacaggaaagacaaaauu

SEQ ID NO: 28380 - RNA, 19 nt, Homo sapiens
aaggagacauggaaauuua

SEQ ID NO: 28381 - RNA, 19 nt, Homo sapiens
caacagcccuuaccaacga

SEQ ID NO: 28382 - RNA, 19 nt, Homo sapiens
ucaaagauguggauucaga

SEQ ID NO: 28383 - RNA, 19 nt, Homo sapiens
gaaccuuucucugggauaa

SEQ ID NO: 28384 - RNA, 19 nt, Homo sapiens
gaaaaccaccugcuauuua

SEQ ID NO: 28385 - RNA, 19 nt, Homo sapiens
gaaaggagaauccguucaa

SEQ ID NO: 28386 - RNA, 19 nt, Homo sapiens
gguggugucuguaauagaa

SEQ ID NO: 28387 - RNA, 19 nt, Homo sapiens
ucacaucucuccugaaugg

SEQ ID NO: 28388 - RNA, 19 nt, Homo sapiens
cccgaaaccugaagaaauu

SEQ ID NO: 28389 - RNA, 19 nt, Homo sapiens
uaugaaugcugauguggua

SEQ ID NO: 28390 - RNA, 19 nt, Homo sapiens
ggagagagagaucaauuga

SEQ ID NO: 28391 - RNA, 19 nt, Homo sapiens
gaaagcuugucuagaaaca

SEQ ID NO: 28392 - RNA, 19 nt, Homo sapiens
gcagaugucuuugaacucu

SEQ ID NO: 28393 - RNA, 19 nt, Homo sapiens
gaacacuggccaaccauug

SEQ ID NO: 28394 - RNA, 19 nt, Homo sapiens
gguaaacucauuccacaaa

SEQ ID NO: 28395 - RNA, 19 nt, Homo sapiens
gggagagacuguaaugaca

SEQ ID NO: 28396 - RNA, 19 nt, Homo sapiens
cgagguggcuuugcuguug

SEQ ID NO: 28397 - RNA, 19 nt, Homo sapiens
caucaggauucaaacugua

SEQ ID NO: 28398 - RNA, 19 nt, Homo sapiens
uaaauuagcuauggaacag

SEQ ID NO: 28399 - RNA, 19 nt, Homo sapiens
caugaccacuccugagaaa

SEQ ID NO: 28400 - RNA, 19 nt, Homo sapiens
cacagggacuaccagaaua

SEQ ID NO: 28401 - RNA, 19 nt, Homo sapiens
cguuauauaugccaugauu

SEQ ID NO: 28402 - RNA, 19 nt, Homo sapiens
gaagagaaggagagagaga

SEQ ID NO: 28403 - RNA, 19 nt, Homo sapiens
ucaaagagagugaggaaga

SEQ ID NO: 28404 - RNA, 19 nt, Homo sapiens
ucagacaaauacagcguuu

SEQ ID NO: 28405 - RNA, 19 nt, Homo sapiens
gaagugguucugacauuug

SEQ ID NO: 28406 - RNA, 19 nt, Homo sapiens
ccaaaggacucuucuucag

SEQ ID NO: 28407 - RNA, 19 nt, Homo sapiens
guagaaggccgaacaacug

SEQ ID NO: 28408 - RNA, 19 nt, Homo sapiens
agaaaccacuguaaucaca

SEQ ID NO: 28409 - RNA, 19 nt, Homo sapiens
caaggagacauggaaauuu

SEQ ID NO: 28410 - RNA, 19 nt, Homo sapiens
caaaaugucuuucucucaa

SEQ ID NO: 28411 - RNA, 19 nt, Homo sapiens
uauaugccaugauuggaaa

SEQ ID NO: 28412 - RNA, 19 nt, Homo sapiens
gaaauuuacacuacagaag

SEQ ID NO: 28413 - RNA, 19 nt, Homo sapiens
cgaaaccugaagaaauuua

SEQ ID NO: 28414 - RNA, 19 nt, Homo sapiens
cagcgucgcagaugucuuu

SEQ ID NO: 28415 - RNA, 19 nt, Homo sapiens
ggaaauuuacacuacagaa

SEQ ID NO: 28416 - RNA, 19 nt, Homo sapiens
caccugcuauuuagucauu

SEQ ID NO: 28417 - RNA, 19 nt, Homo sapiens
cgucgcagaugucuuugaa

SEQ ID NO: 28418 - RNA, 19 nt, Homo sapiens
agauguggauucagacaaa

SEQ ID NO: 28419 - RNA, 19 nt, Homo sapiens
ccaaggagacauggaaauu

SEQ ID NO: 28420 - RNA, 19 nt, Homo sapiens
gguggcgccucuauucuug

SEQ ID NO: 28421 - RNA, 19 nt, Homo sapiens
auaaagacaugaccuaugc

SEQ ID NO: 28422 - RNA, 19 nt, Homo sapiens
gaaaagaaaccacuguaau

SEQ ID NO: 28423 - RNA, 19 nt, Homo sapiens
cuacagaaggcaagacaaa

SEQ ID NO: 28424 - RNA, 19 nt, Homo sapiens
ccagugagaaauuuacaaa

SEQ ID NO: 28425 - RNA, 19 nt, Homo sapiens
cugagaaacucuacuccaa

SEQ ID NO: 28426 - RNA, 19 nt, Homo sapiens
ggacuaucccgccaucguu

SEQ ID NO: 28427 - RNA, 19 nt, Homo sapiens
gaucagacaucauaaaacu

SEQ ID NO: 28428 - RNA, 19 nt, Homo sapiens
ccagcuaaauaaagacaug

SEQ ID NO: 28429 - RNA, 19 nt, Homo sapiens
aaagaaaccacuguaauca

SEQ ID NO: 28430 - RNA, 19 nt, Homo sapiens
ucacagggacuaccagaau

SEQ ID NO: 28431 - RNA, 19 nt, Homo sapiens
ggaguuccauaugagaaga

SEQ ID NO: 28432 - RNA, 19 nt, Homo sapiens
gaacaacugggauguccau

SEQ ID NO: 28433 - RNA, 19 nt, Homo sapiens
acagaaggcaagacaaauu

SEQ ID NO: 28434 - RNA, 19 nt, Homo sapiens
gcagccagugagaaauuua

SEQ ID NO: 28435 - RNA, 19 nt, Homo sapiens
gaucacagcgucgcagaug

SEQ ID NO: 28436 - RNA, 19 nt, Homo sapiens
cagaaggcaagacaaauug

SEQ ID NO: 28437 - RNA, 19 nt, Homo sapiens
auacaggaguggcagaaga

SEQ ID NO: 28438 - RNA, 19 nt, Homo sapiens
ggaaaagaaaccacuguaa

SEQ ID NO: 28439 - RNA, 19 nt, Homo sapiens
ggccaaccauugugucauc

SEQ ID NO: 28440 - RNA, 19 nt, Homo sapiens
gcugguggugucuguaaua

SEQ ID NO: 28441 - RNA, 19 nt, Homo sapiens
ugaccuaugcgcaguugua

SEQ ID NO: 28442 - RNA, 19 nt, Homo sapiens
caaagagagugaggaagag

SEQ ID NO: 28443 - RNA, 19 nt, Homo sapiens
gggauaauuugcacaacag

SEQ ID NO: 28444 - RNA, 19 nt, Homo sapiens
gacuaucccgccaucguua

SEQ ID NO: 28445 - RNA, 19 nt, Homo sapiens
ugucaucucuacccucuuc

SEQ ID NO: 28446 - RNA, 19 nt, Homo sapiens
gaaugcugaugugguaugu

SEQ ID NO: 28447 - RNA, 19 nt, Homo sapiens
guuuggaucagacaucaua

SEQ ID NO: 28448 - RNA, 19 nt, Homo sapiens
gcccaaaggacucuucuuc

SEQ ID NO: 28449 - RNA, 19 nt, Homo sapiens
ccucucggccagcuaaaua

SEQ ID NO: 28450 - RNA, 19 nt, Homo sapiens
gcagccauguuauuuugua

SEQ ID NO: 28451 - RNA, 19 nt, Homo sapiens
cuauuuaccuucgcuuaug

SEQ ID NO: 28452 - RNA, 19 nt, Homo sapiens
ccaacucucuggugcuaca

SEQ ID NO: 28453 - RNA, 19 nt, Homo sapiens
ggacuaccagaauauuuca

SEQ ID NO: 28454 - RNA, 19 nt, Homo sapiens
gggacuaccagaauauuuc

SEQ ID NO: 28455 - RNA, 19 nt, Homo sapiens
agaugucuuugaacucuuu

SEQ ID NO: 28456 - RNA, 19 nt, Homo sapiens
caguaacccuuccgcuguu

SEQ ID NO: 28457 - RNA, 19 nt, Homo sapiens
gauuuugccuuccaugaaa

SEQ ID NO: 28458 - RNA, 19 nt, Homo sapiens
ccaucaggauucaaacugu

SEQ ID NO: 28459 - RNA, 19 nt, Homo sapiens
gugggucugugaguguuua

SEQ ID NO: 28460 - RNA, 19 nt, Homo sapiens
gcuccagcaucccucaguu

SEQ ID NO: 28461 - RNA, 19 nt, Homo sapiens
cuuaccagauggaaccuuu

SEQ ID NO: 28462 - RNA, 19 nt, Homo sapiens
gacauggaaauuuacacua

SEQ ID NO: 28463 - RNA, 19 nt, Homo sapiens
acagaacacuggccaacca

SEQ ID NO: 28464 - RNA, 19 nt, Homo sapiens
aaagccgggugaucacuug

SEQ ID NO: 28465 - RNA, 19 nt, Homo sapiens
ucagcagcaucuuugcaaa

SEQ ID NO: 28466 - RNA, 19 nt, Homo sapiens
guaaacucauuccacaaac

SEQ ID NO: 28467 - RNA, 19 nt, Homo sapiens
cuaccagaauauuucaaga

SEQ ID NO: 28468 - RNA, 19 nt, Homo sapiens
auucaaagauguggauuca

SEQ ID NO: 28469 - RNA, 19 nt, Homo sapiens
acauggaaauuuacacuac

SEQ ID NO: 28470 - RNA, 19 nt, Homo sapiens
gcuuagcgcagauaugaau

SEQ ID NO: 28471 - RNA, 19 nt, Homo sapiens
aaaugucuuucucucaaug

SEQ ID NO: 28472 - RNA, 19 nt, Homo sapiens
aggcuuggguaaacucauu

SEQ ID NO: 28473 - RNA, 19 nt, Homo sapiens
ggaaaggagaauccguuca

SEQ ID NO: 28474 - RNA, 19 nt, Homo sapiens
ccaacgagguggcuuugcu

SEQ ID NO: 28475 - RNA, 19 nt, Homo sapiens
ucggccagcuaaauaaaga

SEQ ID NO: 28476 - RNA, 19 nt, Homo sapiens
uuguauggcuuaccagaug

SEQ ID NO: 28477 - RNA, 19 nt, Homo sapiens
ucgcagaugucuuugaacu

SEQ ID NO: 28478 - RNA, 19 nt, Homo sapiens
cauggaaauuuacacuaca

SEQ ID NO: 28479 - RNA, 19 nt, Homo sapiens
caaccauugugucaucucu

SEQ ID NO: 28480 - RNA, 19 nt, Homo sapiens
gaacagaguuggcuucuug

SEQ ID NO: 28481 - RNA, 19 nt, Homo sapiens
guucaucucuaaaguguua

SEQ ID NO: 28482 - RNA, 19 nt, Homo sapiens
gaaauagguggucacauua

SEQ ID NO: 28483 - RNA, 19 nt, Homo sapiens
agaaauagguggucacauu

SEQ ID NO: 28484 - RNA, 19 nt, Homo sapiens
gcacuacuaugcagacuug

SEQ ID NO: 28485 - RNA, 19 nt, Homo sapiens
ggauuggccucuaccauaa

SEQ ID NO: 28486 - RNA, 19 nt, Homo sapiens
ggacauccauauauuagug

SEQ ID NO: 28487 - RNA, 19 nt, Homo sapiens
ggaacgaacuaccuggauu

SEQ ID NO: 28488 - RNA, 19 nt, Homo sapiens
gggcaacuaugacuacauu

SEQ ID NO: 28489 - RNA, 19 nt, Homo sapiens
caucagacaucucuuuaug

SEQ ID NO: 28490 - RNA, 19 nt, Homo sapiens
ucacaaauccuacuacuca

SEQ ID NO: 28491 - RNA, 19 nt, Homo sapiens
gagcugaguuuacacagau

SEQ ID NO: 28492 - RNA, 19 nt, Homo sapiens
ggaagaguagauagaauuu

SEQ ID NO: 28493 - RNA, 19 nt, Homo sapiens
caacaaugaaacccucuua

SEQ ID NO: 28494 - RNA, 19 nt, Homo sapiens
cugaagacgugguguuuaa

SEQ ID NO: 28495 - RNA, 19 nt, Homo sapiens
gaugcugacucgcuauuug

SEQ ID NO: 28496 - RNA, 19 nt, Homo sapiens
gcugagagcugaguuuaca

SEQ ID NO: 28497 - RNA, 19 nt, Homo sapiens
gaaaggaggaggagucaca

SEQ ID NO: 28498 - RNA, 19 nt, Homo sapiens
gaacgaacuaccuggauug

SEQ ID NO: 28499 - RNA, 19 nt, Homo sapiens
gcaccacaauuaccuucaa

SEQ ID NO: 28500 - RNA, 19 nt, Homo sapiens
ccuauaacuucuuugauga

SEQ ID NO: 28501 - RNA, 19 nt, Homo sapiens
gcaaggaaaccugguggua

SEQ ID NO: 28502 - RNA, 19 nt, Homo sapiens
gcaacuaugacuacauuug

SEQ ID NO: 28503 - RNA, 19 nt, Homo sapiens
acacaugccuuccacuuca

SEQ ID NO: 28504 - RNA, 19 nt, Homo sapiens
gcaucuaucaccagaauga

SEQ ID NO: 28505 - RNA, 19 nt, Homo sapiens
caaugaaacccucuuagga

SEQ ID NO: 28506 - RNA, 19 nt, Homo sapiens
ucagacaucucuuuaugca

SEQ ID NO: 28507 - RNA, 19 nt, Homo sapiens
ucccuuugguuaauucuua

SEQ ID NO: 28508 - RNA, 19 nt, Homo sapiens
aggaggaccugacagcuuu

SEQ ID NO: 28509 - RNA, 19 nt, Homo sapiens
uagcaucuaucaccagaau

SEQ ID NO: 28510 - RNA, 19 nt, Homo sapiens
ggacaacugcaucuucuca

SEQ ID NO: 28511 - RNA, 19 nt, Homo sapiens
ucacagagcaguagcaucu

SEQ ID NO: 28512 - RNA, 19 nt, Homo sapiens
cccuauaacuucuuugaug

SEQ ID NO: 28513 - RNA, 19 nt, Homo sapiens
ugacuacauuugggacuuu

SEQ ID NO: 28514 - RNA, 19 nt, Homo sapiens
caucagucccuuugguuaa

SEQ ID NO: 28515 - RNA, 19 nt, Homo sapiens
ggucaggucugugucaucu

SEQ ID NO: 28516 - RNA, 19 nt, Homo sapiens
uggauuggccucuaccaua

SEQ ID NO: 28517 - RNA, 19 nt, Homo sapiens
ggccagagccagcuguuug

SEQ ID NO: 28518 - RNA, 19 nt, Homo sapiens
ucugaaagauguggagcua

SEQ ID NO: 28519 - RNA, 19 nt, Homo sapiens
ggaguugacagcugugaug

SEQ ID NO: 28520 - RNA, 19 nt, Homo sapiens
caaauccuacuacucagaa

SEQ ID NO: 28521 - RNA, 19 nt, Homo sapiens
gcuccgacccuauaacuuc

SEQ ID NO: 28522 - RNA, 19 nt, Homo sapiens
gaguguguaucuaucuaug

SEQ ID NO: 28523 - RNA, 19 nt, Homo sapiens
gcuagcaaccagacuaaug

SEQ ID NO: 28524 - RNA, 19 nt, Homo sapiens
cugacucgcuauuuggaua

SEQ ID NO: 28525 - RNA, 19 nt, Homo sapiens
guuccagggugagcgaaua

SEQ ID NO: 28526 - RNA, 19 nt, Homo sapiens
caaggaaaccuggugguau

SEQ ID NO: 28527 - RNA, 19 nt, Homo sapiens
gcugugaugcgcuuucuga

SEQ ID NO: 28528 - RNA, 19 nt, Homo sapiens
uuacaucagacaucucuuu

SEQ ID NO: 28529 - RNA, 19 nt, Homo sapiens
gcugaagacgugguguuua

SEQ ID NO: 28530 - RNA, 19 nt, Homo sapiens
aaggaaaccuggugguauc

SEQ ID NO: 28531 - RNA, 19 nt, Homo sapiens
ggaacagaguuggcuucuu

SEQ ID NO: 28532 - RNA, 19 nt, Homo sapiens
acagagcaguagcaucuau

SEQ ID NO: 28533 - RNA, 19 nt, Homo sapiens
guggucacauuacaucaga

SEQ ID NO: 28534 - RNA, 19 nt, Homo sapiens
ccaucagucccuuugguua

SEQ ID NO: 28535 - RNA, 19 nt, Homo sapiens
caacuaugacuacauuugg

SEQ ID NO: 28536 - RNA, 19 nt, Homo sapiens
ucaggucugugucaucugu

SEQ ID NO: 28537 - RNA, 19 nt, Homo sapiens
caccacaauuaccuucaaa

SEQ ID NO: 28538 - RNA, 19 nt, Homo sapiens
aaaggaagaguagauagaa

SEQ ID NO: 28539 - RNA, 19 nt, Homo sapiens
ucauuucuauggugguuug

SEQ ID NO: 28540 - RNA, 19 nt, Homo sapiens
uaucuauggugccgauuca

SEQ ID NO: 28541 - RNA, 19 nt, Homo sapiens
gugcugagagcugaguuua

SEQ ID NO: 28542 - RNA, 19 nt, Homo sapiens
gacccuauaacuucuuuga

SEQ ID NO: 28543 - RNA, 19 nt, Homo sapiens
uacaucagacaucucuuua

SEQ ID NO: 28544 - RNA, 19 nt, Homo sapiens
ugucaucugugggcaacua

SEQ ID NO: 28545 - RNA, 19 nt, Homo sapiens
uucgaaggcaccacaauua

SEQ ID NO: 28546 - RNA, 19 nt, Homo sapiens
gguuggaagugguuagagu

SEQ ID NO: 28547 - RNA, 19 nt, Homo sapiens
ggcaguguguacuuugaga

SEQ ID NO: 28548 - RNA, 19 nt, Homo sapiens
gaagacgugguguuuaaac

SEQ ID NO: 28549 - RNA, 19 nt, Homo sapiens
gcuuuggacucggccguaa

SEQ ID NO: 28550 - RNA, 19 nt, Homo sapiens
ccaggaguguguaucuauc

SEQ ID NO: 28551 - RNA, 19 nt, Homo sapiens
gcacugucccucauuacca

SEQ ID NO: 28552 - RNA, 19 nt, Homo sapiens
uaccuuugcugacuucauc

SEQ ID NO: 28553 - RNA, 19 nt, Homo sapiens
gagaaaggaggaggaguca

SEQ ID NO: 28554 - RNA, 19 nt, Homo sapiens
ggauguggcagggcugaaa

SEQ ID NO: 28555 - RNA, 19 nt, Homo sapiens
ggaguguguaucuaucuau

SEQ ID NO: 28556 - RNA, 19 nt, Homo sapiens
uauccucccucuggucauu

SEQ ID NO: 28557 - RNA, 19 nt, Homo sapiens
ccaguacagugugcaagga

SEQ ID NO: 28558 - RNA, 19 nt, Homo sapiens
ccucuggucauuuaccuuu

SEQ ID NO: 28559 - RNA, 19 nt, Homo sapiens
ggaacgggaguuuaagucu

SEQ ID NO: 28560 - RNA, 19 nt, Homo sapiens
aggaagaguagauagaauu

SEQ ID NO: 28561 - RNA, 19 nt, Homo sapiens
cuggcacugucccucauua

SEQ ID NO: 28562 - RNA, 19 nt, Homo sapiens
uaucacaaauccuacuacu

SEQ ID NO: 28563 - RNA, 19 nt, Homo sapiens
ggacacccacaguuaccuu

SEQ ID NO: 28564 - RNA, 19 nt, Homo sapiens
gcucagcccucggacaacu

SEQ ID NO: 28565 - RNA, 19 nt, Homo sapiens
caucugugggcaacuauga

SEQ ID NO: 28566 - RNA, 19 nt, Homo sapiens
ccucuaccauaacaucuca

SEQ ID NO: 28567 - RNA, 19 nt, Homo sapiens
agagcugaguuuacacaga

SEQ ID NO: 28568 - RNA, 19 nt, Homo sapiens
gggaaaggaggaccugaca

SEQ ID NO: 28569 - RNA, 19 nt, Homo sapiens
uuugggacuuuguguugua

SEQ ID NO: 28570 - RNA, 19 nt, Homo sapiens
guccaggaguguguaucua

SEQ ID NO: 28571 - RNA, 19 nt, Homo sapiens
aaggaagaguagauagaau

SEQ ID NO: 28572 - RNA, 19 nt, Homo sapiens
gaggagucacagagcagua

SEQ ID NO: 28573 - RNA, 19 nt, Homo sapiens
cauuugggacuuuguguug

SEQ ID NO: 28574 - RNA, 19 nt, Homo sapiens
gaaggcaccacaauuaccu

SEQ ID NO: 28575 - RNA, 19 nt, Homo sapiens
gcaugugcauucaaaagga

SEQ ID NO: 28576 - RNA, 19 nt, Homo sapiens
ucacauuacaucagacauc

SEQ ID NO: 28577 - RNA, 19 nt, Homo sapiens
aauagguggucacauuaca

SEQ ID NO: 28578 - RNA, 19 nt, Homo sapiens
gcaguguguacuuugagaa

SEQ ID NO: 28579 - RNA, 19 nt, Homo sapiens
uugcugacuucaucaacaa

SEQ ID NO: 28580 - RNA, 19 nt, Homo sapiens
gaacagaguuggcuucuug

SEQ ID NO: 28581 - RNA, 19 nt, Homo sapiens
guucaucucuaaaguguua

SEQ ID NO: 28582 - RNA, 19 nt, Homo sapiens
gaaauagguggucacauua

SEQ ID NO: 28583 - RNA, 19 nt, Homo sapiens
agaaauagguggucacauu

SEQ ID NO: 28584 - RNA, 19 nt, Homo sapiens
gcacuacuaugcagacuug

SEQ ID NO: 28585 - RNA, 19 nt, Homo sapiens
ggacauccauauauuagug

SEQ ID NO: 28586 - RNA, 19 nt, Homo sapiens
gggcaacuaugacuacauu

SEQ ID NO: 28587 - RNA, 19 nt, Homo sapiens
caucagacaucucuuuaug

SEQ ID NO: 28588 - RNA, 19 nt, Homo sapiens
ucacaaauccuacuacuca

SEQ ID NO: 28589 - RNA, 19 nt, Homo sapiens
gagcugaguuuacacagau

SEQ ID NO: 28590 - RNA, 19 nt, Homo sapiens
ggaagaguagauagaauuu

SEQ ID NO: 28591 - RNA, 19 nt, Homo sapiens
caacaaugaaacccucuua

SEQ ID NO: 28592 - RNA, 19 nt, Homo sapiens
cugaagacgugguguuuaa

SEQ ID NO: 28593 - RNA, 19 nt, Homo sapiens
gaugcugacucgcuauuug

SEQ ID NO: 28594 - RNA, 19 nt, Homo sapiens
gcugagagcugaguuuaca

SEQ ID NO: 28595 - RNA, 19 nt, Homo sapiens
gaaaggaggaggagucaca

SEQ ID NO: 28596 - RNA, 19 nt, Homo sapiens
gcaccacaauuaccuucaa

SEQ ID NO: 28597 - RNA, 19 nt, Homo sapiens
ccuauaacuucuuugauga

SEQ ID NO: 28598 - RNA, 19 nt, Homo sapiens
gcaaggaaaccugguggua

SEQ ID NO: 28599 - RNA, 19 nt, Homo sapiens
gcaacuaugacuacauuug

SEQ ID NO: 28600 - RNA, 19 nt, Homo sapiens
acacaugccuuccacuuca

SEQ ID NO: 28601 - RNA, 19 nt, Homo sapiens
gcaucuaucaccagaauga

SEQ ID NO: 28602 - RNA, 19 nt, Homo sapiens
caaugaaacccucuuagga

SEQ ID NO: 28603 - RNA, 19 nt, Homo sapiens
ucagacaucucuuuaugca

SEQ ID NO: 28604 - RNA, 19 nt, Homo sapiens
ucccuuugguuaauucuua

SEQ ID NO: 28605 - RNA, 19 nt, Homo sapiens
aggaggaccugacagcuuu

SEQ ID NO: 28606 - RNA, 19 nt, Homo sapiens
uagcaucuaucaccagaau

SEQ ID NO: 28607 - RNA, 19 nt, Homo sapiens
ggacaacugcaucuucuca

SEQ ID NO: 28608 - RNA, 19 nt, Homo sapiens
ucacagagcaguagcaucu

SEQ ID NO: 28609 - RNA, 19 nt, Homo sapiens
cccuauaacuucuuugaug

SEQ ID NO: 28610 - RNA, 19 nt, Homo sapiens
ugacuacauuugggacuuu

SEQ ID NO: 28611 - RNA, 19 nt, Homo sapiens
caucagucccuuugguuaa

SEQ ID NO: 28612 - RNA, 19 nt, Homo sapiens
ggucaggucugugucaucu

SEQ ID NO: 28613 - RNA, 19 nt, Homo sapiens
ucugaaagauguggagcua

SEQ ID NO: 28614 - RNA, 19 nt, Homo sapiens
ggaguugacagcugugaug

SEQ ID NO: 28615 - RNA, 19 nt, Homo sapiens
ggccagagccagcuguuug

SEQ ID NO: 28616 - RNA, 19 nt, Homo sapiens
caaauccuacuacucagaa

SEQ ID NO: 28617 - RNA, 19 nt, Homo sapiens
gcuccgacccuauaacuuc

SEQ ID NO: 28618 - RNA, 19 nt, Homo sapiens
gaguguguaucuaucuaug

SEQ ID NO: 28619 - RNA, 19 nt, Homo sapiens
gcuagcaaccagacuaaug

SEQ ID NO: 28620 - RNA, 19 nt, Homo sapiens
cugacucgcuauuuggaua

SEQ ID NO: 28621 - RNA, 19 nt, Homo sapiens
guuccagggugagcgaaua

SEQ ID NO: 28622 - RNA, 19 nt, Homo sapiens
caaggaaaccuggugguau

SEQ ID NO: 28623 - RNA, 19 nt, Homo sapiens
gcugugaugcgcuuucuga

SEQ ID NO: 28624 - RNA, 19 nt, Homo sapiens
uuacaucagacaucucuuu

SEQ ID NO: 28625 - RNA, 19 nt, Homo sapiens
gcugaagacgugguguuua

SEQ ID NO: 28626 - RNA, 19 nt, Homo sapiens
aaggaaaccuggugguauc

SEQ ID NO: 28627 - RNA, 19 nt, Homo sapiens
ggaacagaguuggcuucuu

SEQ ID NO: 28628 - RNA, 19 nt, Homo sapiens
acagagcaguagcaucuau

SEQ ID NO: 28629 - RNA, 19 nt, Homo sapiens
guggucacauuacaucaga

SEQ ID NO: 28630 - RNA, 19 nt, Homo sapiens
ccaucagucccuuugguua

SEQ ID NO: 28631 - RNA, 19 nt, Homo sapiens
caacuaugacuacauuugg

SEQ ID NO: 28632 - RNA, 19 nt, Homo sapiens
ucaggucugugucaucugu

SEQ ID NO: 28633 - RNA, 19 nt, Homo sapiens
caccacaauuaccuucaaa

SEQ ID NO: 28634 - RNA, 19 nt, Homo sapiens
aaaggaagaguagauagaa

SEQ ID NO: 28635 - RNA, 19 nt, Homo sapiens
ucauuucuauggugguuug

SEQ ID NO: 28636 - RNA, 19 nt, Homo sapiens
uaucuauggugccgauuca

SEQ ID NO: 28637 - RNA, 19 nt, Homo sapiens
gugcugagagcugaguuua

SEQ ID NO: 28638 - RNA, 19 nt, Homo sapiens
gacccuauaacuucuuuga

SEQ ID NO: 28639 - RNA, 19 nt, Homo sapiens
uacaucagacaucucuuua

SEQ ID NO: 28640 - RNA, 19 nt, Homo sapiens
ugucaucugugggcaacua

SEQ ID NO: 28641 - RNA, 19 nt, Homo sapiens
uucgaaggcaccacaauua

SEQ ID NO: 28642 - RNA, 19 nt, Homo sapiens
gguuggaagugguuagagu

SEQ ID NO: 28643 - RNA, 19 nt, Homo sapiens
cuaccuggauggcccucua

SEQ ID NO: 28644 - RNA, 19 nt, Homo sapiens
ggcaguguguacuuugaga

SEQ ID NO: 28645 - RNA, 19 nt, Homo sapiens
gaagacgugguguuuaaac

SEQ ID NO: 28646 - RNA, 19 nt, Homo sapiens
gcuuuggacucggccguaa

SEQ ID NO: 28647 - RNA, 19 nt, Homo sapiens
ccaggaguguguaucuauc

SEQ ID NO: 28648 - RNA, 19 nt, Homo sapiens
uaccuuugcugacuucauc

SEQ ID NO: 28649 - RNA, 19 nt, Homo sapiens
gagaaaggaggaggaguca

SEQ ID NO: 28650 - RNA, 19 nt, Homo sapiens
gcacugucccucauuacca

SEQ ID NO: 28651 - RNA, 19 nt, Homo sapiens
ggauguggcagggcugaaa

SEQ ID NO: 28652 - RNA, 19 nt, Homo sapiens
ggaguguguaucuaucuau

SEQ ID NO: 28653 - RNA, 19 nt, Homo sapiens
uauccucccucuggucauu

SEQ ID NO: 28654 - RNA, 19 nt, Homo sapiens
ccaguacagugugcaagga

SEQ ID NO: 28655 - RNA, 19 nt, Homo sapiens
ccucuggucauuuaccuuu

SEQ ID NO: 28656 - RNA, 19 nt, Homo sapiens
ggaacgggaguuuaagucu

SEQ ID NO: 28657 - RNA, 19 nt, Homo sapiens
cuggcacugucccucauua

SEQ ID NO: 28658 - RNA, 19 nt, Homo sapiens
aggaagaguagauagaauu

SEQ ID NO: 28659 - RNA, 19 nt, Homo sapiens
uaucacaaauccuacuacu

SEQ ID NO: 28660 - RNA, 19 nt, Homo sapiens
ggacacccacaguuaccuu

SEQ ID NO: 28661 - RNA, 19 nt, Homo sapiens
caucugugggcaacuauga

SEQ ID NO: 28662 - RNA, 19 nt, Homo sapiens
gcucagcccucggacaacu

SEQ ID NO: 28663 - RNA, 19 nt, Homo sapiens
ccucuaccauaacaucuca

SEQ ID NO: 28664 - RNA, 19 nt, Homo sapiens
gggaaaggaggaccugaca

SEQ ID NO: 28665 - RNA, 19 nt, Homo sapiens
agagcugaguuuacacaga

SEQ ID NO: 28666 - RNA, 19 nt, Homo sapiens
uuugggacuuuguguugua

SEQ ID NO: 28667 - RNA, 19 nt, Homo sapiens
guccaggaguguguaucua

SEQ ID NO: 28668 - RNA, 19 nt, Homo sapiens
aaggaagaguagauagaau

SEQ ID NO: 28669 - RNA, 19 nt, Homo sapiens
gaggagucacagagcagua

SEQ ID NO: 28670 - RNA, 19 nt, Homo sapiens
cauuugggacuuuguguug

SEQ ID NO: 28671 - RNA, 19 nt, Homo sapiens
gaaggcaccacaauuaccu

SEQ ID NO: 28672 - RNA, 19 nt, Homo sapiens
gcaugugcauucaaaagga

SEQ ID NO: 28673 - RNA, 19 nt, Homo sapiens
ucacauuacaucagacauc

SEQ ID NO: 28674 - RNA, 19 nt, Homo sapiens
aauagguggucacauuaca

SEQ ID NO: 28675 - RNA, 19 nt, Homo sapiens
gcaguguguacuuugagaa

SEQ ID NO: 28676 - RNA, 19 nt, Homo sapiens
uugcugacuucaucaacaa

SEQ ID NO: 28677 - RNA, 19 nt, Homo sapiens
cacauuacaucagacaucu

SEQ ID NO: 28678 - RNA, 19 nt, Homo sapiens
ucagucccuuugguuaauu

SEQ ID NO: 28679 - RNA, 19 nt, Homo sapiens
ccucaauguuccucucaca

SEQ ID NO: 28680 - RNA, 19 nt, Homo sapiens
ggacaaugcuuacaaguuu

SEQ ID NO: 28681 - RNA, 19 nt, Homo sapiens
guacaaagcuggauucaug

SEQ ID NO: 28682 - RNA, 19 nt, Homo sapiens
gauguuggcugcaguauaa

SEQ ID NO: 28683 - RNA, 19 nt, Homo sapiens
ccacacaguuucccaaaua

SEQ ID NO: 28684 - RNA, 19 nt, Homo sapiens
gcaaauaucucuggagguu

SEQ ID NO: 28685 - RNA, 19 nt, Homo sapiens
gaaccaaccuuccauccaa

SEQ ID NO: 28686 - RNA, 19 nt, Homo sapiens
ggagaagacauguuaauaa

SEQ ID NO: 28687 - RNA, 19 nt, Homo sapiens
ugaaggaacugcuggaauu

SEQ ID NO: 28688 - RNA, 19 nt, Homo sapiens
gauaauggcugauaaacag

SEQ ID NO: 28689 - RNA, 19 nt, Homo sapiens
gaucuuaauucaaggcuuu

SEQ ID NO: 28690 - RNA, 19 nt, Homo sapiens
gauugaaggugcauuuauu

SEQ ID NO: 28691 - RNA, 19 nt, Homo sapiens
caacacaacuccuccuuca

SEQ ID NO: 28692 - RNA, 19 nt, Homo sapiens
caauagaggaacugaauua

SEQ ID NO: 28693 - RNA, 19 nt, Homo sapiens
gagugaagauugucuauca

SEQ ID NO: 28694 - RNA, 19 nt, Homo sapiens
gauaaacagucgcaaagga

SEQ ID NO: 28695 - RNA, 19 nt, Homo sapiens
gcaaagagcucagguaacg

SEQ ID NO: 28696 - RNA, 19 nt, Homo sapiens
gaggaaaguugcuguggaa

SEQ ID NO: 28697 - RNA, 19 nt, Homo sapiens
ggccugaagugaaauuuaa

SEQ ID NO: 28698 - RNA, 19 nt, Homo sapiens
gaaugaauauagacacaug

SEQ ID NO: 28699 - RNA, 19 nt, Homo sapiens
gaacagaugcuggauauag

SEQ ID NO: 28700 - RNA, 19 nt, Homo sapiens
gguuauaauucuccugaua

SEQ ID NO: 28701 - RNA, 19 nt, Homo sapiens
gaaaggaaacccacagaau

SEQ ID NO: 28702 - RNA, 19 nt, Homo sapiens
gcagagaauuauuggaaga

SEQ ID NO: 28703 - RNA, 19 nt, Homo sapiens
aaaggaaacccacagaaua

SEQ ID NO: 28704 - RNA, 19 nt, Homo sapiens
uggaauaggugaugacuug

SEQ ID NO: 28705 - RNA, 19 nt, Homo sapiens
ggucagccgugaauuaaga

SEQ ID NO: 28706 - RNA, 19 nt, Homo sapiens
gggagaggaucaagaaaug

SEQ ID NO: 28707 - RNA, 19 nt, Homo sapiens
uaacuacucugacuugauc

SEQ ID NO: 28708 - RNA, 19 nt, Homo sapiens
gagcugauuuaaaguauuc

SEQ ID NO: 28709 - RNA, 19 nt, Homo sapiens
gaaaucaucccacaguguu

SEQ ID NO: 28710 - RNA, 19 nt, Homo sapiens
gaaggugcauuuauucaag

SEQ ID NO: 28711 - RNA, 19 nt, Homo sapiens
uggcagaucucaacgguuu

SEQ ID NO: 28712 - RNA, 19 nt, Homo sapiens
gagaaggugcgaaucauaa

SEQ ID NO: 28713 - RNA, 19 nt, Homo sapiens
aaaggaaacuggaauaugg

SEQ ID NO: 28714 - RNA, 19 nt, Homo sapiens
ucaggaacauggcuucuuu

SEQ ID NO: 28715 - RNA, 19 nt, Homo sapiens
gauauuuccuccugagcua

SEQ ID NO: 28716 - RNA, 19 nt, Homo sapiens
gcaugggacuuuauacaau

SEQ ID NO: 28717 - RNA, 19 nt, Homo sapiens
guaaccagauacauaaaga

SEQ ID NO: 28718 - RNA, 19 nt, Homo sapiens
caugggacuuuauacaaua

SEQ ID NO: 28719 - RNA, 19 nt, Homo sapiens
aaacaucacugcaguacau

SEQ ID NO: 28720 - RNA, 19 nt, Homo sapiens
agacagaguuuccacaguu

SEQ ID NO: 28721 - RNA, 19 nt, Homo sapiens
cauggacccuugacccuua

SEQ ID NO: 28722 - RNA, 19 nt, Homo sapiens
gaauuaagaaugccaaugu

SEQ ID NO: 28723 - RNA, 19 nt, Homo sapiens
caaggaaauugaucaaaca

SEQ ID NO: 28724 - RNA, 19 nt, Homo sapiens
ggauacaggcccauaauug

SEQ ID NO: 28725 - RNA, 19 nt, Homo sapiens
guacccaucugaaucaaau

SEQ ID NO: 28726 - RNA, 19 nt, Homo sapiens
gaacuuuucuugacuuuug

SEQ ID NO: 28727 - RNA, 19 nt, Homo sapiens
gauacaggcccauaauuga

SEQ ID NO: 28728 - RNA, 19 nt, Homo sapiens
gaacaucagaacagacauu

SEQ ID NO: 28729 - RNA, 19 nt, Homo sapiens
cagguaacguuggaucuua

SEQ ID NO: 28730 - RNA, 19 nt, Homo sapiens
gaaaggaaacuggaauaug

SEQ ID NO: 28731 - RNA, 19 nt, Homo sapiens
gaaccugaguguuguaaac

SEQ ID NO: 28732 - RNA, 19 nt, Homo sapiens
ggagaaugcgcuagcgaua

SEQ ID NO: 28733 - RNA, 19 nt, Homo sapiens
ucauaaacauguacaagga

SEQ ID NO: 28734 - RNA, 19 nt, Homo sapiens
gccaaugccugucugauuc

SEQ ID NO: 28735 - RNA, 19 nt, Homo sapiens
acucugacuugaucauuua

SEQ ID NO: 28736 - RNA, 19 nt, Homo sapiens
ggugaugacuuggauguga

SEQ ID NO: 28737 - RNA, 19 nt, Homo sapiens
ugaaucaaaugcaaacuuc

SEQ ID NO: 28738 - RNA, 19 nt, Homo sapiens
gaaacugucccuaaugcaa

SEQ ID NO: 28739 - RNA, 19 nt, Homo sapiens
gagaauuauuggaagaaga

SEQ ID NO: 28740 - RNA, 19 nt, Homo sapiens
gaugauuuccgcccacaua

SEQ ID NO: 28741 - RNA, 19 nt, Homo sapiens
cagcagaacaucuuaguga

SEQ ID NO: 28742 - RNA, 19 nt, Homo sapiens
cgacagauuccuuuaaaug

SEQ ID NO: 28743 - RNA, 19 nt, Homo sapiens
gaaugccaaugucgaaugu

SEQ ID NO: 28744 - RNA, 19 nt, Homo sapiens
gaaaguacaaagcuggauu

SEQ ID NO: 28745 - RNA, 19 nt, Homo sapiens
ugacgaagcauuuaaagug

SEQ ID NO: 28746 - RNA, 19 nt, Homo sapiens
caaagcagcauccugaaga

SEQ ID NO: 28747 - RNA, 19 nt, Homo sapiens
gggauggcauuauuagaga

SEQ ID NO: 28748 - RNA, 19 nt, Homo sapiens
gcaaaggaccaggguguuu

SEQ ID NO: 28749 - RNA, 19 nt, Homo sapiens
cuucagagguuaugaguca

SEQ ID NO: 28750 - RNA, 19 nt, Homo sapiens
ccaaauauauacaggacau

SEQ ID NO: 28751 - RNA, 19 nt, Homo sapiens
cuaagauugugucuaauga

SEQ ID NO: 28752 - RNA, 19 nt, Homo sapiens
augcuaagauugugucuaa

SEQ ID NO: 28753 - RNA, 19 nt, Homo sapiens
ggagaggauugccaagugu

SEQ ID NO: 28754 - RNA, 19 nt, Homo sapiens
guauaaauccagccauuga

SEQ ID NO: 28755 - RNA, 19 nt, Homo sapiens
gagaauguauggccauguc

SEQ ID NO: 28756 - RNA, 19 nt, Homo sapiens
ucaaacacccuacaaacaa

SEQ ID NO: 28757 - RNA, 19 nt, Homo sapiens
caagggagaggaucaagaa

SEQ ID NO: 28758 - RNA, 19 nt, Homo sapiens
gaaacuggaauauggaaau

SEQ ID NO: 28759 - RNA, 19 nt, Homo sapiens
uacugaagcugagaaauuu

SEQ ID NO: 28760 - RNA, 19 nt, Homo sapiens
gggaggccaucuacuguga

SEQ ID NO: 28761 - RNA, 19 nt, Homo sapiens
gaauauagacacauguauc

SEQ ID NO: 28762 - RNA, 19 nt, Homo sapiens
gcuaucaccuuccucuugu

SEQ ID NO: 28763 - RNA, 19 nt, Homo sapiens
guuccgagguugaaauaga

SEQ ID NO: 28764 - RNA, 19 nt, Homo sapiens
gcucugugcuggucacuca

SEQ ID NO: 28765 - RNA, 19 nt, Homo sapiens
ggaaguugcagccaaaugu

SEQ ID NO: 28766 - RNA, 19 nt, Homo sapiens
gaacgauggcagaaucuug

SEQ ID NO: 28767 - RNA, 19 nt, Homo sapiens
caagaauuccugccagaaa

SEQ ID NO: 28768 - RNA, 19 nt, Homo sapiens
gaagugggaauuuguguca

SEQ ID NO: 28769 - RNA, 19 nt, Homo sapiens
ucaaggaagugggaauuug

SEQ ID NO: 28770 - RNA, 19 nt, Homo sapiens
gacagauuccuuuaaauga

SEQ ID NO: 28771 - RNA, 19 nt, Homo sapiens
acaaugcuguugccuuauu

SEQ ID NO: 28772 - RNA, 19 nt, Homo sapiens
gaaguaagacaaguccaaa

SEQ ID NO: 28773 - RNA, 19 nt, Homo sapiens
gagaugaaccuggauccua

SEQ ID NO: 28774 - RNA, 19 nt, Homo sapiens
uaaaggaacuuggaaagac

SEQ ID NO: 28775 - RNA, 19 nt, Homo sapiens
gaacccaucaucagcaaga

SEQ ID NO: 28776 - RNA, 19 nt, Homo sapiens
gguggucagccgugaauua

SEQ ID NO: 28777 - RNA, 19 nt, Homo sapiens
ggaggaggcuguggugcuu

SEQ ID NO: 28778 - RNA, 19 nt, Homo sapiens
gaacugcuggaauuuaaau

SEQ ID NO: 28779 - RNA, 19 nt, Homo sapiens
gaaggaacugcuggaauuu

SEQ ID NO: 28780 - RNA, 19 nt, Homo sapiens
gaacauaccuuuaaucuug

SEQ ID NO: 28781 - RNA, 19 nt, Homo sapiens
gagaagacaucaaagauua

SEQ ID NO: 28782 - RNA, 19 nt, Homo sapiens
gaacucugcuguaauguua

SEQ ID NO: 28783 - RNA, 19 nt, Homo sapiens
ucaaacagcuucagaauaa

SEQ ID NO: 28784 - RNA, 19 nt, Homo sapiens
gaacaggucagauugauua

SEQ ID NO: 28785 - RNA, 19 nt, Homo sapiens
ggacaaauguaucuuucua

SEQ ID NO: 28786 - RNA, 19 nt, Homo sapiens
cgacagccauuuccuaaua

SEQ ID NO: 28787 - RNA, 19 nt, Homo sapiens
gugaagguauggaauauua

SEQ ID NO: 28788 - RNA, 19 nt, Homo sapiens
gaacaagcucauaguauua

SEQ ID NO: 28789 - RNA, 19 nt, Homo sapiens
ggaagaagcuggugaaugc

SEQ ID NO: 28790 - RNA, 19 nt, Homo sapiens
gauggaaccuuaaagcuuu

SEQ ID NO: 28791 - RNA, 19 nt, Homo sapiens
ugaagaaguugaagacaua

SEQ ID NO: 28792 - RNA, 19 nt, Homo sapiens
uaaaugguaugucuccuua

SEQ ID NO: 28793 - RNA, 19 nt, Homo sapiens
agaaguagauguuguguuu

SEQ ID NO: 28794 - RNA, 19 nt, Homo sapiens
gaauggcccuugucuuaaa

SEQ ID NO: 28795 - RNA, 19 nt, Homo sapiens
gcacaugccaggcuaauuu

SEQ ID NO: 28796 - RNA, 19 nt, Homo sapiens
gagcauuucuaaagcauuu

SEQ ID NO: 28797 - RNA, 19 nt, Homo sapiens
uaagaacucugcuguaaug

SEQ ID NO: 28798 - RNA, 19 nt, Homo sapiens
caaggaacuuugugcuuua

SEQ ID NO: 28799 - RNA, 19 nt, Homo sapiens
guucaaagguggcugauug

SEQ ID NO: 28800 - RNA, 19 nt, Homo sapiens
ucacagaccuucuacacaa

SEQ ID NO: 28801 - RNA, 19 nt, Homo sapiens
cagaagcucuccaaauuga

SEQ ID NO: 28802 - RNA, 19 nt, Homo sapiens
gggaauagaucacucagau

SEQ ID NO: 28803 - RNA, 19 nt, Homo sapiens
gaugacagauuuauagcaa

SEQ ID NO: 28804 - RNA, 19 nt, Homo sapiens
gaagauaaucacucaguuu

SEQ ID NO: 28805 - RNA, 19 nt, Homo sapiens
gagggaagauggaugcaaa

SEQ ID NO: 28806 - RNA, 19 nt, Homo sapiens
ggcagaguauaaaguauua

SEQ ID NO: 28807 - RNA, 19 nt, Homo sapiens
gagaagaauuuggaagaaa

SEQ ID NO: 28808 - RNA, 19 nt, Homo sapiens
gcauuaaugugaaacaguu

SEQ ID NO: 28809 - RNA, 19 nt, Homo sapiens
ucacucaguuucagagaua

SEQ ID NO: 28810 - RNA, 19 nt, Homo sapiens
ggaaaucuucgucuuauga

SEQ ID NO: 28811 - RNA, 19 nt, Homo sapiens
agaacaagcucauaguauu

SEQ ID NO: 28812 - RNA, 19 nt, Homo sapiens
gaugaagccaugucuauaa

SEQ ID NO: 28813 - RNA, 19 nt, Homo sapiens
gaaagacaagguaacauga

SEQ ID NO: 28814 - RNA, 19 nt, Homo sapiens
gggcaauggagauaaauua

SEQ ID NO: 28815 - RNA, 19 nt, Homo sapiens
gaaaucaggauauggaaug

SEQ ID NO: 28816 - RNA, 19 nt, Homo sapiens
uguaagaacucugcuguaa

SEQ ID NO: 28817 - RNA, 19 nt, Homo sapiens
ugaaacaguucuuccuaaa

SEQ ID NO: 28818 - RNA, 19 nt, Homo sapiens
acaaagguguuauguauuc

SEQ ID NO: 28819 - RNA, 19 nt, Homo sapiens
gauaaugauuccuacguau

SEQ ID NO: 28820 - RNA, 19 nt, Homo sapiens
gaauagaucacucagaugu

SEQ ID NO: 28821 - RNA, 19 nt, Homo sapiens
acaaauggaaccaaucuua

SEQ ID NO: 28822 - RNA, 19 nt, Homo sapiens
gaucucggcucaccacaau

SEQ ID NO: 28823 - RNA, 19 nt, Homo sapiens
gacagagucuugcuuuguu

SEQ ID NO: 28824 - RNA, 19 nt, Homo sapiens
ugacaagacugcaaagauc

SEQ ID NO: 28825 - RNA, 19 nt, Homo sapiens
gcagaggacauuuaaguug

SEQ ID NO: 28826 - RNA, 19 nt, Homo sapiens
gugaaacaguucuuccuaa

SEQ ID NO: 28827 - RNA, 19 nt, Homo sapiens
gaagccaugucuauaagug

SEQ ID NO: 28828 - RNA, 19 nt, Homo sapiens
ugauggagcugcaaauuuc

SEQ ID NO: 28829 - RNA, 19 nt, Homo sapiens
gagcuaguuuacaggcuua

SEQ ID NO: 28830 - RNA, 19 nt, Homo sapiens
gugaauacauaccuuguug

SEQ ID NO: 28831 - RNA, 19 nt, Homo sapiens
acggugagcuucuucauuu

SEQ ID NO: 28832 - RNA, 19 nt, Homo sapiens
ucacgaugcuaccaaguuu

SEQ ID NO: 28833 - RNA, 19 nt, Homo sapiens
gugaagauuuggaauucua

SEQ ID NO: 28834 - RNA, 19 nt, Homo sapiens
gaucuuggaugauguuugg

SEQ ID NO: 28835 - RNA, 19 nt, Homo sapiens
agaaagaucugagggaaga

SEQ ID NO: 28836 - RNA, 19 nt, Homo sapiens
gaagaacaggucagauuga

SEQ ID NO: 28837 - RNA, 19 nt, Homo sapiens
gaaaguauguaagaacucu

SEQ ID NO: 28838 - RNA, 19 nt, Homo sapiens
ggaggucgauaauggaaug

SEQ ID NO: 28839 - RNA, 19 nt, Homo sapiens
ggaauacagacauauacua

SEQ ID NO: 28840 - RNA, 19 nt, Homo sapiens
caggaagacuguauguauu

SEQ ID NO: 28841 - RNA, 19 nt, Homo sapiens
gcucagagaagacaucaaa

SEQ ID NO: 28842 - RNA, 19 nt, Homo sapiens
uaagggcaauggagauaaa

SEQ ID NO: 28843 - RNA, 19 nt, Homo sapiens
gcguaaaucuaaagaaaca

SEQ ID NO: 28844 - RNA, 19 nt, Homo sapiens
gacagggucucacuauguu

SEQ ID NO: 28845 - RNA, 19 nt, Homo sapiens
ccaaaugaacauaccuuua

SEQ ID NO: 28846 - RNA, 19 nt, Homo sapiens
gugguuggaugaauaauau

SEQ ID NO: 28847 - RNA, 19 nt, Homo sapiens
caaauggaaccaaucuuaa

SEQ ID NO: 28848 - RNA, 19 nt, Homo sapiens
ggagaaaucaggauaugga

SEQ ID NO: 28849 - RNA, 19 nt, Homo sapiens
ggaagaacaggucagauug

SEQ ID NO: 28850 - RNA, 19 nt, Homo sapiens
ggaacuuugugcuuuaaug

SEQ ID NO: 28851 - RNA, 19 nt, Homo sapiens
gaacagugaagguauggaa

SEQ ID NO: 28852 - RNA, 19 nt, Homo sapiens
caaguuagcugcuguugcu

SEQ ID NO: 28853 - RNA, 19 nt, Homo sapiens
ugcaggaguuuguaaauaa

SEQ ID NO: 28854 - RNA, 19 nt, Homo sapiens
ggacauggaaacugaagaa

SEQ ID NO: 28855 - RNA, 19 nt, Homo sapiens
aguaauggguccuaaauau

SEQ ID NO: 28856 - RNA, 19 nt, Homo sapiens
agcagaagcucuccaaauu

SEQ ID NO: 28857 - RNA, 19 nt, Homo sapiens
ccacagaggccaguuguuu

SEQ ID NO: 28858 - RNA, 19 nt, Homo sapiens
gaagaaagacaagguaaca

SEQ ID NO: 28859 - RNA, 19 nt, Homo sapiens
ggagugcaguggcauaauc

SEQ ID NO: 28860 - RNA, 19 nt, Homo sapiens
gaucaucauuaacaguuug

SEQ ID NO: 28861 - RNA, 19 nt, Homo sapiens
ggauaaugguggcagcaaa

SEQ ID NO: 28862 - RNA, 19 nt, Homo sapiens
caagacauccuacaucaug

SEQ ID NO: 28863 - RNA, 19 nt, Homo sapiens
uaucagacuucuuacuuga

SEQ ID NO: 28864 - RNA, 19 nt, Homo sapiens
uaucugaguuggacacuau

SEQ ID NO: 28865 - RNA, 19 nt, Homo sapiens
uaagugagucuuggauuua

SEQ ID NO: 28866 - RNA, 19 nt, Homo sapiens
caacaguagucaucaucuu

SEQ ID NO: 28867 - RNA, 19 nt, Homo sapiens
acaaugcucuacuacauga

SEQ ID NO: 28868 - RNA, 19 nt, Homo sapiens
caacacacaucagguuuua

SEQ ID NO: 28869 - RNA, 19 nt, Homo sapiens
guaggcagaguauaaagua

SEQ ID NO: 28870 - RNA, 19 nt, Homo sapiens
ggacgugacugcucuaucc

SEQ ID NO: 28871 - RNA, 19 nt, Homo sapiens
uugaauggcccuugucuua

SEQ ID NO: 28872 - RNA, 19 nt, Homo sapiens
cugcaaagaucuggaguuu

SEQ ID NO: 28873 - RNA, 19 nt, Homo sapiens
aaucugggcuucugaugaa

SEQ ID NO: 28874 - RNA, 19 nt, Homo sapiens
gaagcucuccaaauugaaa

SEQ ID NO: 28875 - RNA, 19 nt, Homo sapiens
gcagaagcucuccaaauug

SEQ ID NO: 28876 - RNA, 19 nt, Homo sapiens
cuacaaugcucuacuacau

SEQ ID NO: 28877 - RNA, 19 nt, Homo sapiens
caugauuagugauggauuu

SEQ ID NO: 28878 - RNA, 19 nt, Homo sapiens
ucaaggagcuaguuuacag

SEQ ID NO: 28879 - RNA, 19 nt, Homo sapiens
ggacucuaguugucaguau

SEQ ID NO: 28880 - RNA, 19 nt, Homo sapiens
gaacauaccuuuaaucuug

SEQ ID NO: 28881 - RNA, 19 nt, Homo sapiens
gagaagacaucaaagauua

SEQ ID NO: 28882 - RNA, 19 nt, Homo sapiens
gaacucugcuguaauguua

SEQ ID NO: 28883 - RNA, 19 nt, Homo sapiens
ucaaacagcuucagaauaa

SEQ ID NO: 28884 - RNA, 19 nt, Homo sapiens
gaacaggucagauugauua

SEQ ID NO: 28885 - RNA, 19 nt, Homo sapiens
ggacaaauguaucuuucua

SEQ ID NO: 28886 - RNA, 19 nt, Homo sapiens
cgacagccauuuccuaaua

SEQ ID NO: 28887 - RNA, 19 nt, Homo sapiens
gugaagguauggaauauua

SEQ ID NO: 28888 - RNA, 19 nt, Homo sapiens
gaacaagcucauaguauua

SEQ ID NO: 28889 - RNA, 19 nt, Homo sapiens
ggaagaagcuggugaaugc

SEQ ID NO: 28890 - RNA, 19 nt, Homo sapiens
gauggaaccuuaaagcuuu

SEQ ID NO: 28891 - RNA, 19 nt, Homo sapiens
ugaagaaguugaagacaua

SEQ ID NO: 28892 - RNA, 19 nt, Homo sapiens
uaaaugguaugucuccuua

SEQ ID NO: 28893 - RNA, 19 nt, Homo sapiens
agaaguagauguuguguuu

SEQ ID NO: 28894 - RNA, 19 nt, Homo sapiens
gaauggcccuugucuuaaa

SEQ ID NO: 28895 - RNA, 19 nt, Homo sapiens
gcacaugccaggcuaauuu

SEQ ID NO: 28896 - RNA, 19 nt, Homo sapiens
gagcauuucuaaagcauuu

SEQ ID NO: 28897 - RNA, 19 nt, Homo sapiens
uaagaacucugcuguaaug

SEQ ID NO: 28898 - RNA, 19 nt, Homo sapiens
caaggaacuuugugcuuua

SEQ ID NO: 28899 - RNA, 19 nt, Homo sapiens
guucaaagguggcugauug

SEQ ID NO: 28900 - RNA, 19 nt, Homo sapiens
ucacagaccuucuacacaa

SEQ ID NO: 28901 - RNA, 19 nt, Homo sapiens
cagaagcucuccaaauuga

SEQ ID NO: 28902 - RNA, 19 nt, Homo sapiens
gggaauagaucacucagau

SEQ ID NO: 28903 - RNA, 19 nt, Homo sapiens
gaugacagauuuauagcaa

SEQ ID NO: 28904 - RNA, 19 nt, Homo sapiens
gaagauaaucacucaguuu

SEQ ID NO: 28905 - RNA, 19 nt, Homo sapiens
gagggaagauggaugcaaa

SEQ ID NO: 28906 - RNA, 19 nt, Homo sapiens
ggcagaguauaaaguauua

SEQ ID NO: 28907 - RNA, 19 nt, Homo sapiens
gagaagaauuuggaagaaa

SEQ ID NO: 28908 - RNA, 19 nt, Homo sapiens
gcauuaaugugaaacaguu

SEQ ID NO: 28909 - RNA, 19 nt, Homo sapiens
ucacucaguuucagagaua

SEQ ID NO: 28910 - RNA, 19 nt, Homo sapiens
ggaaaucuucgucuuauga

SEQ ID NO: 28911 - RNA, 19 nt, Homo sapiens
agaacaagcucauaguauu

SEQ ID NO: 28912 - RNA, 19 nt, Homo sapiens
gaugaagccaugucuauaa

SEQ ID NO: 28913 - RNA, 19 nt, Homo sapiens
gaaagacaagguaacauga

SEQ ID NO: 28914 - RNA, 19 nt, Homo sapiens
gggcaauggagauaaauua

SEQ ID NO: 28915 - RNA, 19 nt, Homo sapiens
gaaaucaggauauggaaug

SEQ ID NO: 28916 - RNA, 19 nt, Homo sapiens
uguaagaacucugcuguaa

SEQ ID NO: 28917 - RNA, 19 nt, Homo sapiens
ugaaacaguucuuccuaaa

SEQ ID NO: 28918 - RNA, 19 nt, Homo sapiens
acaaagguguuauguauuc

SEQ ID NO: 28919 - RNA, 19 nt, Homo sapiens
gauaaugauuccuacguau

SEQ ID NO: 28920 - RNA, 19 nt, Homo sapiens
gaauagaucacucagaugu

SEQ ID NO: 28921 - RNA, 19 nt, Homo sapiens
acaaauggaaccaaucuua

SEQ ID NO: 28922 - RNA, 19 nt, Homo sapiens
gaucucggcucaccacaau

SEQ ID NO: 28923 - RNA, 19 nt, Homo sapiens
gacagagucuugcuuuguu

SEQ ID NO: 28924 - RNA, 19 nt, Homo sapiens
ugacaagacugcaaagauc

SEQ ID NO: 28925 - RNA, 19 nt, Homo sapiens
gcagaggacauuuaaguug

SEQ ID NO: 28926 - RNA, 19 nt, Homo sapiens
gugaaacaguucuuccuaa

SEQ ID NO: 28927 - RNA, 19 nt, Homo sapiens
gaagccaugucuauaagug

SEQ ID NO: 28928 - RNA, 19 nt, Homo sapiens
ugauggagcugcaaauuuc

SEQ ID NO: 28929 - RNA, 19 nt, Homo sapiens
gagcuaguuuacaggcuua

SEQ ID NO: 28930 - RNA, 19 nt, Homo sapiens
gugaauacauaccuuguug

SEQ ID NO: 28931 - RNA, 19 nt, Homo sapiens
acggugagcuucuucauuu

SEQ ID NO: 28932 - RNA, 19 nt, Homo sapiens
ucacgaugcuaccaaguuu

SEQ ID NO: 28933 - RNA, 19 nt, Homo sapiens
gugaagauuuggaauucua

SEQ ID NO: 28934 - RNA, 19 nt, Homo sapiens
gaucuuggaugauguuugg

SEQ ID NO: 28935 - RNA, 19 nt, Homo sapiens
agaaagaucugagggaaga

SEQ ID NO: 28936 - RNA, 19 nt, Homo sapiens
gaagaacaggucagauuga

SEQ ID NO: 28937 - RNA, 19 nt, Homo sapiens
gaaaguauguaagaacucu

SEQ ID NO: 28938 - RNA, 19 nt, Homo sapiens
ggaggucgauaauggaaug

SEQ ID NO: 28939 - RNA, 19 nt, Homo sapiens
ggaauacagacauauacua

SEQ ID NO: 28940 - RNA, 19 nt, Homo sapiens
caggaagacuguauguauu

SEQ ID NO: 28941 - RNA, 19 nt, Homo sapiens
gcucagagaagacaucaaa

SEQ ID NO: 28942 - RNA, 19 nt, Homo sapiens
uaagggcaauggagauaaa

SEQ ID NO: 28943 - RNA, 19 nt, Homo sapiens
gcguaaaucuaaagaaaca

SEQ ID NO: 28944 - RNA, 19 nt, Homo sapiens
gacagggucucacuauguu

SEQ ID NO: 28945 - RNA, 19 nt, Homo sapiens
ccaaaugaacauaccuuua

SEQ ID NO: 28946 - RNA, 19 nt, Homo sapiens
gugguuggaugaauaauau

SEQ ID NO: 28947 - RNA, 19 nt, Homo sapiens
caaauggaaccaaucuuaa

SEQ ID NO: 28948 - RNA, 19 nt, Homo sapiens
ggagaaaucaggauaugga

SEQ ID NO: 28949 - RNA, 19 nt, Homo sapiens
ggaagaacaggucagauug

SEQ ID NO: 28950 - RNA, 19 nt, Homo sapiens
ggaacuuugugcuuuaaug

SEQ ID NO: 28951 - RNA, 19 nt, Homo sapiens
gaacagugaagguauggaa

SEQ ID NO: 28952 - RNA, 19 nt, Homo sapiens
caaguuagcugcuguugcu

SEQ ID NO: 28953 - RNA, 19 nt, Homo sapiens
ugcaggaguuuguaaauaa

SEQ ID NO: 28954 - RNA, 19 nt, Homo sapiens
ggacauggaaacugaagaa

SEQ ID NO: 28955 - RNA, 19 nt, Homo sapiens
aguaauggguccuaaauau

SEQ ID NO: 28956 - RNA, 19 nt, Homo sapiens
agcagaagcucuccaaauu

SEQ ID NO: 28957 - RNA, 19 nt, Homo sapiens
ccacagaggccaguuguuu

SEQ ID NO: 28958 - RNA, 19 nt, Homo sapiens
gaagaaagacaagguaaca

SEQ ID NO: 28959 - RNA, 19 nt, Homo sapiens
ggagugcaguggcauaauc

SEQ ID NO: 28960 - RNA, 19 nt, Homo sapiens
gaucaucauuaacaguuug

SEQ ID NO: 28961 - RNA, 19 nt, Homo sapiens
ggauaaugguggcagcaaa

SEQ ID NO: 28962 - RNA, 19 nt, Homo sapiens
caagacauccuacaucaug

SEQ ID NO: 28963 - RNA, 19 nt, Homo sapiens
uaucagacuucuuacuuga

SEQ ID NO: 28964 - RNA, 19 nt, Homo sapiens
uaucugaguuggacacuau

SEQ ID NO: 28965 - RNA, 19 nt, Homo sapiens
uaagugagucuuggauuua

SEQ ID NO: 28966 - RNA, 19 nt, Homo sapiens
caacaguagucaucaucuu

SEQ ID NO: 28967 - RNA, 19 nt, Homo sapiens
acaaugcucuacuacauga

SEQ ID NO: 28968 - RNA, 19 nt, Homo sapiens
caacacacaucagguuuua

SEQ ID NO: 28969 - RNA, 19 nt, Homo sapiens
guaggcagaguauaaagua

SEQ ID NO: 28970 - RNA, 19 nt, Homo sapiens
ggacgugacugcucuaucc

SEQ ID NO: 28971 - RNA, 19 nt, Homo sapiens
uugaauggcccuugucuua

SEQ ID NO: 28972 - RNA, 19 nt, Homo sapiens
cugcaaagaucuggaguuu

SEQ ID NO: 28973 - RNA, 19 nt, Homo sapiens
aaucugggcuucugaugaa

SEQ ID NO: 28974 - RNA, 19 nt, Homo sapiens
gaagcucuccaaauugaaa

SEQ ID NO: 28975 - RNA, 19 nt, Homo sapiens
gcagaagcucuccaaauug

SEQ ID NO: 28976 - RNA, 19 nt, Homo sapiens
cuacaaugcucuacuacau

SEQ ID NO: 28977 - RNA, 19 nt, Homo sapiens
caugauuagugauggauuu

SEQ ID NO: 28978 - RNA, 19 nt, Homo sapiens
ucaaggagcuaguuuacag

SEQ ID NO: 28979 - RNA, 19 nt, Homo sapiens
ggacucuaguugucaguau

SEQ ID NO: 28980 - RNA, 19 nt, Homo sapiens
aaagggaacucaauuaugu

SEQ ID NO: 28981 - RNA, 19 nt, Homo sapiens
uaaccaggcucuucugauu

SEQ ID NO: 28982 - RNA, 19 nt, Homo sapiens
gaaggacaccaguuucuuu

SEQ ID NO: 28983 - RNA, 19 nt, Homo sapiens
gaaggcagcgcuccaagaa

SEQ ID NO: 28984 - RNA, 19 nt, Homo sapiens
ucaauuauguggccaggaa

SEQ ID NO: 28985 - RNA, 19 nt, Homo sapiens
gccaagagcagauuuguga

SEQ ID NO: 28986 - RNA, 19 nt, Homo sapiens
gcauguggcuugaucaucu

SEQ ID NO: 28987 - RNA, 19 nt, Homo sapiens
caaccacggaccaauaaua

SEQ ID NO: 28988 - RNA, 19 nt, Homo sapiens
ccaagaaggacaccaguuu

SEQ ID NO: 28989 - RNA, 19 nt, Homo sapiens
ggaagguugugcugguauu

SEQ ID NO: 28990 - RNA, 19 nt, Homo sapiens
ucacuggacuccucccaaa

SEQ ID NO: 28991 - RNA, 19 nt, Homo sapiens
ccacggaccaauaauauga

SEQ ID NO: 28992 - RNA, 19 nt, Homo sapiens
gcugguauuuggcucauga

SEQ ID NO: 28993 - RNA, 19 nt, Homo sapiens
gggaucagcuaccuguuuc

SEQ ID NO: 28994 - RNA, 19 nt, Homo sapiens
gcaggccagcugaccauua

SEQ ID NO: 28995 - RNA, 19 nt, Homo sapiens
gaucuuuguucaccaguuc

SEQ ID NO: 28996 - RNA, 19 nt, Homo sapiens
gagagcauguggcuugauc

SEQ ID NO: 28997 - RNA, 19 nt, Homo sapiens
caagagcagauuugugaaa

SEQ ID NO: 28998 - RNA, 19 nt, Homo sapiens
gauaagaccauggccuuga

SEQ ID NO: 28999 - RNA, 19 nt, Homo sapiens
uggcggaggugaaggacua

SEQ ID NO: 29000 - RNA, 19 nt, Homo sapiens
caggccagcugaccauuau

SEQ ID NO: 29001 - RNA, 19 nt, Homo sapiens
ccaagaggaagcaggcaua

SEQ ID NO: 29002 - RNA, 19 nt, Homo sapiens
ccaguaaguguaccuugua

SEQ ID NO: 29003 - RNA, 19 nt, Homo sapiens
agaggaagcaggcauagaa

SEQ ID NO: 29004 - RNA, 19 nt, Homo sapiens
acacaugccagcccuguuu

SEQ ID NO: 29005 - RNA, 19 nt, Homo sapiens
cugaggaucuccaguguca

SEQ ID NO: 29006 - RNA, 19 nt, Homo sapiens
ggacaccaguuucuuugcu

SEQ ID NO: 29007 - RNA, 19 nt, Homo sapiens
gaucuccagugucacaaca

SEQ ID NO: 29008 - RNA, 19 nt, Homo sapiens
ggaccaauaauaugagauc

SEQ ID NO: 29009 - RNA, 19 nt, Homo sapiens
ccaguuucuuugcuccaua

SEQ ID NO: 29010 - RNA, 19 nt, Homo sapiens
ccaguuggcucaguucaag

SEQ ID NO: 29011 - RNA, 19 nt, Homo sapiens
gaggaugacuuggaaacag

SEQ ID NO: 29012 - RNA, 19 nt, Homo sapiens
ccucaaccacggaccaaua

SEQ ID NO: 29013 - RNA, 19 nt, Homo sapiens
aaucuuggcuggguggaaa

SEQ ID NO: 29014 - RNA, 19 nt, Homo sapiens
gaagguugugcugguauuu

SEQ ID NO: 29015 - RNA, 19 nt, Homo sapiens
ggaagcaggcauagaagca

SEQ ID NO: 29016 - RNA, 19 nt, Homo sapiens
gagggagacccaagaggaa

SEQ ID NO: 29017 - RNA, 19 nt, Homo sapiens
caagaaggacaccaguuuc

SEQ ID NO: 29018 - RNA, 19 nt, Homo sapiens
ucaaaagggaacucaauua

SEQ ID NO: 29019 - RNA, 19 nt, Homo sapiens
ggaacaagccuaaaacagu

SEQ ID NO: 29020 - RNA, 19 nt, Homo sapiens
aggagaggaugacuuggaa

SEQ ID NO: 29021 - RNA, 19 nt, Homo sapiens
caaaagggaacucaauuau

SEQ ID NO: 29022 - RNA, 19 nt, Homo sapiens
ggauagaggccacauugac

SEQ ID NO: 29023 - RNA, 19 nt, Homo sapiens
ggaaugggugcguuugcuu

SEQ ID NO: 29024 - RNA, 19 nt, Homo sapiens
ggccagcugaccauuauug

SEQ ID NO: 29025 - RNA, 19 nt, Homo sapiens
gauagaggccacauugacu

SEQ ID NO: 29026 - RNA, 19 nt, Homo sapiens
caccaguucuacagugaug

SEQ ID NO: 29027 - RNA, 19 nt, Homo sapiens
caaaggccauguggaacca

SEQ ID NO: 29028 - RNA, 19 nt, Homo sapiens
caaaguggacaacaaugca

SEQ ID NO: 29029 - RNA, 19 nt, Homo sapiens
gaggaucuccagugucaca

SEQ ID NO: 29030 - RNA, 19 nt, Homo sapiens
ucuccagugucacaacaaa

SEQ ID NO: 29031 - RNA, 19 nt, Homo sapiens
gggauagaggccacauuga

SEQ ID NO: 29032 - RNA, 19 nt, Homo sapiens
uuccgaagaugccucauuc

SEQ ID NO: 29033 - RNA, 19 nt, Homo sapiens
guccugcaguuauacacaa

SEQ ID NO: 29034 - RNA, 19 nt, Homo sapiens
cccaguaaguguaccuugu

SEQ ID NO: 29035 - RNA, 19 nt, Homo sapiens
caggagaggaugacuugga

SEQ ID NO: 29036 - RNA, 19 nt, Homo sapiens
guuauacacaaaguccuua

SEQ ID NO: 29037 - RNA, 19 nt, Homo sapiens
ugggugcguuugcuucuga

SEQ ID NO: 29038 - RNA, 19 nt, Homo sapiens
gaugaaggcagcgcuccaa

SEQ ID NO: 29039 - RNA, 19 nt, Homo sapiens
ucccaaaggccauguggaa

SEQ ID NO: 29040 - RNA, 19 nt, Homo sapiens
ugggauagaggccacauug

SEQ ID NO: 29041 - RNA, 19 nt, Homo sapiens
uugaugggcccaagcguaa

SEQ ID NO: 29042 - RNA, 19 nt, Homo sapiens
gagaggaugacuuggaaac

SEQ ID NO: 29043 - RNA, 19 nt, Homo sapiens
ggagaggaugacuuggaaa

SEQ ID NO: 29044 - RNA, 19 nt, Homo sapiens
aaccacggaccaauaauau

SEQ ID NO: 29045 - RNA, 19 nt, Homo sapiens
gaaaggaaggcaaaagagu

SEQ ID NO: 29046 - RNA, 19 nt, Homo sapiens
ugaaggcagcgcuccaaga

SEQ ID NO: 29047 - RNA, 19 nt, Homo sapiens
ggacuaugacguggagauc

SEQ ID NO: 29048 - RNA, 19 nt, Homo sapiens
ugggaucagcuaccuguuu

SEQ ID NO: 29049 - RNA, 19 nt, Homo sapiens
gugauggggugcuuccuuu

SEQ ID NO: 29050 - RNA, 19 nt, Homo sapiens
gccaggcccaguaagugua

SEQ ID NO: 29051 - RNA, 19 nt, Homo sapiens
gagggcaugggaucagcua

SEQ ID NO: 29052 - RNA, 19 nt, Homo sapiens
cauguggcuugaucaucuu

SEQ ID NO: 29053 - RNA, 19 nt, Homo sapiens
gagcauguggcuugaucau

SEQ ID NO: 29054 - RNA, 19 nt, Homo sapiens
cugauuggccgguguacuu

SEQ ID NO: 29055 - RNA, 19 nt, Homo sapiens
guaaccaggcucuucugau

SEQ ID NO: 29056 - RNA, 19 nt, Homo sapiens
ccaaaguggacaacaaugc

SEQ ID NO: 29057 - RNA, 19 nt, Homo sapiens
ggaaggcaaaagaguaaaa

SEQ ID NO: 29058 - RNA, 19 nt, Homo sapiens
ugugggccuucuaagauga

SEQ ID NO: 29059 - RNA, 19 nt, Homo sapiens
gaucagcuaccuguuucug

SEQ ID NO: 29060 - RNA, 19 nt, Homo sapiens
ugacagccaagagcagauu

SEQ ID NO: 29061 - RNA, 19 nt, Homo sapiens
gcagagucauuugcuucag

SEQ ID NO: 29062 - RNA, 19 nt, Homo sapiens
uggcucaguucaaggagau

SEQ ID NO: 29063 - RNA, 19 nt, Homo sapiens
gaggaagcaggcauagaag

SEQ ID NO: 29064 - RNA, 19 nt, Homo sapiens
aaaggaaggcaaaagagua

SEQ ID NO: 29065 - RNA, 19 nt, Homo sapiens
gaccaauaauaugagaucu

SEQ ID NO: 29066 - RNA, 19 nt, Homo sapiens
aaagggaacucaauuaugu

SEQ ID NO: 29067 - RNA, 19 nt, Homo sapiens
uaaccaggcucuucugauu

SEQ ID NO: 29068 - RNA, 19 nt, Homo sapiens
gaaggacaccaguuucuuu

SEQ ID NO: 29069 - RNA, 19 nt, Homo sapiens
gaaggcagcgcuccaagaa

SEQ ID NO: 29070 - RNA, 19 nt, Homo sapiens
ucaauuauguggccaggaa

SEQ ID NO: 29071 - RNA, 19 nt, Homo sapiens
gccaagagcagauuuguga

SEQ ID NO: 29072 - RNA, 19 nt, Homo sapiens
gcauguggcuugaucaucu

SEQ ID NO: 29073 - RNA, 19 nt, Homo sapiens
ccaagaaggacaccaguuu

SEQ ID NO: 29074 - RNA, 19 nt, Homo sapiens
ggaagguugugcugguauu

SEQ ID NO: 29075 - RNA, 19 nt, Homo sapiens
ucacuggacuccucccaaa

SEQ ID NO: 29076 - RNA, 19 nt, Homo sapiens
gcugguauuuggcucauga

SEQ ID NO: 29077 - RNA, 19 nt, Homo sapiens
gcaggccagcugaccauua

SEQ ID NO: 29078 - RNA, 19 nt, Homo sapiens
gagagcauguggcuugauc

SEQ ID NO: 29079 - RNA, 19 nt, Homo sapiens
caagagcagauuugugaaa

SEQ ID NO: 29080 - RNA, 19 nt, Homo sapiens
gauaagaccauggccuuga

SEQ ID NO: 29081 - RNA, 19 nt, Homo sapiens
uggcggaggugaaggacua

SEQ ID NO: 29082 - RNA, 19 nt, Homo sapiens
caggccagcugaccauuau

SEQ ID NO: 29083 - RNA, 19 nt, Homo sapiens
ccaagaggaagcaggcaua

SEQ ID NO: 29084 - RNA, 19 nt, Homo sapiens
ccaguaaguguaccuugua

SEQ ID NO: 29085 - RNA, 19 nt, Homo sapiens
agaggaagcaggcauagaa

SEQ ID NO: 29086 - RNA, 19 nt, Homo sapiens
acacaugccagcccuguuu

SEQ ID NO: 29087 - RNA, 19 nt, Homo sapiens
cugaggaucuccaguguca

SEQ ID NO: 29088 - RNA, 19 nt, Homo sapiens
ggacaccaguuucuuugcu

SEQ ID NO: 29089 - RNA, 19 nt, Homo sapiens
gaucuccagugucacaaca

SEQ ID NO: 29090 - RNA, 19 nt, Homo sapiens
ccaguuucuuugcuccaua

SEQ ID NO: 29091 - RNA, 19 nt, Homo sapiens
ccaguuggcucaguucaag

SEQ ID NO: 29092 - RNA, 19 nt, Homo sapiens
gaggaugacuuggaaacag

SEQ ID NO: 29093 - RNA, 19 nt, Homo sapiens
aaucuuggcuggguggaaa

SEQ ID NO: 29094 - RNA, 19 nt, Homo sapiens
gaagguugugcugguauuu

SEQ ID NO: 29095 - RNA, 19 nt, Homo sapiens
ggaagcaggcauagaagca

SEQ ID NO: 29096 - RNA, 19 nt, Homo sapiens
gagggagacccaagaggaa

SEQ ID NO: 29097 - RNA, 19 nt, Homo sapiens
caagaaggacaccaguuuc

SEQ ID NO: 29098 - RNA, 19 nt, Homo sapiens
ucaaaagggaacucaauua

SEQ ID NO: 29099 - RNA, 19 nt, Homo sapiens
ggaacaagccuaaaacagu

SEQ ID NO: 29100 - RNA, 19 nt, Homo sapiens
aggagaggaugacuuggaa

SEQ ID NO: 29101 - RNA, 19 nt, Homo sapiens
caaaagggaacucaauuau

SEQ ID NO: 29102 - RNA, 19 nt, Homo sapiens
ggauagaggccacauugac

SEQ ID NO: 29103 - RNA, 19 nt, Homo sapiens
ggaaugggugcguuugcuu

SEQ ID NO: 29104 - RNA, 19 nt, Homo sapiens
ggccagcugaccauuauug

SEQ ID NO: 29105 - RNA, 19 nt, Homo sapiens
gauagaggccacauugacu

SEQ ID NO: 29106 - RNA, 19 nt, Homo sapiens
caaaggccauguggaacca

SEQ ID NO: 29107 - RNA, 19 nt, Homo sapiens
caaaguggacaacaaugca

SEQ ID NO: 29108 - RNA, 19 nt, Homo sapiens
gaggaucuccagugucaca

SEQ ID NO: 29109 - RNA, 19 nt, Homo sapiens
ucuccagugucacaacaaa

SEQ ID NO: 29110 - RNA, 19 nt, Homo sapiens
gggauagaggccacauuga

SEQ ID NO: 29111 - RNA, 19 nt, Homo sapiens
uuccgaagaugccucauuc

SEQ ID NO: 29112 - RNA, 19 nt, Homo sapiens
guccugcaguuauacacaa

SEQ ID NO: 29113 - RNA, 19 nt, Homo sapiens
cccaguaaguguaccuugu

SEQ ID NO: 29114 - RNA, 19 nt, Homo sapiens
caggagaggaugacuugga

SEQ ID NO: 29115 - RNA, 19 nt, Homo sapiens
guuauacacaaaguccuua

SEQ ID NO: 29116 - RNA, 19 nt, Homo sapiens
ugggugcguuugcuucuga

SEQ ID NO: 29117 - RNA, 19 nt, Homo sapiens
gaugaaggcagcgcuccaa

SEQ ID NO: 29118 - RNA, 19 nt, Homo sapiens
ucccaaaggccauguggaa

SEQ ID NO: 29119 - RNA, 19 nt, Homo sapiens
ugggauagaggccacauug

SEQ ID NO: 29120 - RNA, 19 nt, Homo sapiens
uugaugggcccaagcguaa

SEQ ID NO: 29121 - RNA, 19 nt, Homo sapiens
gagaggaugacuuggaaac

SEQ ID NO: 29122 - RNA, 19 nt, Homo sapiens
ggagaggaugacuuggaaa

SEQ ID NO: 29123 - RNA, 19 nt, Homo sapiens
gaaaggaaggcaaaagagu

SEQ ID NO: 29124 - RNA, 19 nt, Homo sapiens
ugaaggcagcgcuccaaga

SEQ ID NO: 29125 - RNA, 19 nt, Homo sapiens
ggacuaugacguggagauc

SEQ ID NO: 29126 - RNA, 19 nt, Homo sapiens
gugauggggugcuuccuuu

SEQ ID NO: 29127 - RNA, 19 nt, Homo sapiens
gccaggcccaguaagugua

SEQ ID NO: 29128 - RNA, 19 nt, Homo sapiens
cugauuggccgguguacuu

SEQ ID NO: 29129 - RNA, 19 nt, Homo sapiens
cauguggcuugaucaucuu

SEQ ID NO: 29130 - RNA, 19 nt, Homo sapiens
gagcauguggcuugaucau

SEQ ID NO: 29131 - RNA, 19 nt, Homo sapiens
guaaccaggcucuucugau

SEQ ID NO: 29132 - RNA, 19 nt, Homo sapiens
ccaaaguggacaacaaugc

SEQ ID NO: 29133 - RNA, 19 nt, Homo sapiens
ggaaggcaaaagaguaaaa

SEQ ID NO: 29134 - RNA, 19 nt, Homo sapiens
ugugggccuucuaagauga

SEQ ID NO: 29135 - RNA, 19 nt, Homo sapiens
ugacagccaagagcagauu

SEQ ID NO: 29136 - RNA, 19 nt, Homo sapiens
gcagagucauuugcuucag

SEQ ID NO: 29137 - RNA, 19 nt, Homo sapiens
uggcucaguucaaggagau

SEQ ID NO: 29138 - RNA, 19 nt, Homo sapiens
gaggaagcaggcauagaag

SEQ ID NO: 29139 - RNA, 19 nt, Homo sapiens
aaaggaaggcaaaagagua

SEQ ID NO: 29140 - RNA, 19 nt, Homo sapiens
aaagggaacucaauuaugu

SEQ ID NO: 29141 - RNA, 19 nt, Homo sapiens
uaaccaggcucuucugauu

SEQ ID NO: 29142 - RNA, 19 nt, Homo sapiens
gaaggacaccaguuucuuu

SEQ ID NO: 29143 - RNA, 19 nt, Homo sapiens
gaaggcagcgcuccaagaa

SEQ ID NO: 29144 - RNA, 19 nt, Homo sapiens
ucaauuauguggccaggaa

SEQ ID NO: 29145 - RNA, 19 nt, Homo sapiens
gccaagagcagauuuguga

SEQ ID NO: 29146 - RNA, 19 nt, Homo sapiens
gcauguggcuugaucaucu

SEQ ID NO: 29147 - RNA, 19 nt, Homo sapiens
ccaagaaggacaccaguuu

SEQ ID NO: 29148 - RNA, 19 nt, Homo sapiens
ggaagguugugcugguauu

SEQ ID NO: 29149 - RNA, 19 nt, Homo sapiens
ucacuggacuccucccaaa

SEQ ID NO: 29150 - RNA, 19 nt, Homo sapiens
gcugguauuuggcucauga

SEQ ID NO: 29151 - RNA, 19 nt, Homo sapiens
gcaggccagcugaccauua

SEQ ID NO: 29152 - RNA, 19 nt, Homo sapiens
gagagcauguggcuugauc

SEQ ID NO: 29153 - RNA, 19 nt, Homo sapiens
caagagcagauuugugaaa

SEQ ID NO: 29154 - RNA, 19 nt, Homo sapiens
gauaagaccauggccuuga

SEQ ID NO: 29155 - RNA, 19 nt, Homo sapiens
uggcggaggugaaggacua

SEQ ID NO: 29156 - RNA, 19 nt, Homo sapiens
caggccagcugaccauuau

SEQ ID NO: 29157 - RNA, 19 nt, Homo sapiens
ccaagaggaagcaggcaua

SEQ ID NO: 29158 - RNA, 19 nt, Homo sapiens
ccaguaaguguaccuugua

SEQ ID NO: 29159 - RNA, 19 nt, Homo sapiens
agaggaagcaggcauagaa

SEQ ID NO: 29160 - RNA, 19 nt, Homo sapiens
acacaugccagcccuguuu

SEQ ID NO: 29161 - RNA, 19 nt, Homo sapiens
cugaggaucuccaguguca

SEQ ID NO: 29162 - RNA, 19 nt, Homo sapiens
ggacaccaguuucuuugcu

SEQ ID NO: 29163 - RNA, 19 nt, Homo sapiens
gaucuccagugucacaaca

SEQ ID NO: 29164 - RNA, 19 nt, Homo sapiens
ccaguuucuuugcuccaua

SEQ ID NO: 29165 - RNA, 19 nt, Homo sapiens
ccaguuggcucaguucaag

SEQ ID NO: 29166 - RNA, 19 nt, Homo sapiens
gaggaugacuuggaaacag

SEQ ID NO: 29167 - RNA, 19 nt, Homo sapiens
aaucuuggcuggguggaaa

SEQ ID NO: 29168 - RNA, 19 nt, Homo sapiens
gaagguugugcugguauuu

SEQ ID NO: 29169 - RNA, 19 nt, Homo sapiens
ggaagcaggcauagaagca

SEQ ID NO: 29170 - RNA, 19 nt, Homo sapiens
gagggagacccaagaggaa

SEQ ID NO: 29171 - RNA, 19 nt, Homo sapiens
caagaaggacaccaguuuc

SEQ ID NO: 29172 - RNA, 19 nt, Homo sapiens
ucaaaagggaacucaauua

SEQ ID NO: 29173 - RNA, 19 nt, Homo sapiens
ggaacaagccuaaaacagu

SEQ ID NO: 29174 - RNA, 19 nt, Homo sapiens
aggagaggaugacuuggaa

SEQ ID NO: 29175 - RNA, 19 nt, Homo sapiens
caaaagggaacucaauuau

SEQ ID NO: 29176 - RNA, 19 nt, Homo sapiens
ggauagaggccacauugac

SEQ ID NO: 29177 - RNA, 19 nt, Homo sapiens
ggccagcugaccauuauug

SEQ ID NO: 29178 - RNA, 19 nt, Homo sapiens
gauagaggccacauugacu

SEQ ID NO: 29179 - RNA, 19 nt, Homo sapiens
caaaggccauguggaacca

SEQ ID NO: 29180 - RNA, 19 nt, Homo sapiens
caaaguggacaacaaugca

SEQ ID NO: 29181 - RNA, 19 nt, Homo sapiens
gaggaucuccagugucaca

SEQ ID NO: 29182 - RNA, 19 nt, Homo sapiens
ucuccagugucacaacaaa

SEQ ID NO: 29183 - RNA, 19 nt, Homo sapiens
gggauagaggccacauuga

SEQ ID NO: 29184 - RNA, 19 nt, Homo sapiens
uuccgaagaugccucauuc

SEQ ID NO: 29185 - RNA, 19 nt, Homo sapiens
guccugcaguuauacacaa

SEQ ID NO: 29186 - RNA, 19 nt, Homo sapiens
cccaguaaguguaccuugu

SEQ ID NO: 29187 - RNA, 19 nt, Homo sapiens
caggagaggaugacuugga

SEQ ID NO: 29188 - RNA, 19 nt, Homo sapiens
ucggugcguuugcuucuga

SEQ ID NO: 29189 - RNA, 19 nt, Homo sapiens
guuauacacaaaguccuua

SEQ ID NO: 29190 - RNA, 19 nt, Homo sapiens
gaugaaggcagcgcuccaa

SEQ ID NO: 29191 - RNA, 19 nt, Homo sapiens
ucccaaaggccauguggaa

SEQ ID NO: 29192 - RNA, 19 nt, Homo sapiens
ugggauagaggccacauug

SEQ ID NO: 29193 - RNA, 19 nt, Homo sapiens
uugaugggcccaagcguaa

SEQ ID NO: 29194 - RNA, 19 nt, Homo sapiens
gagaggaugacuuggaaac

SEQ ID NO: 29195 - RNA, 19 nt, Homo sapiens
ggagaggaugacuuggaaa

SEQ ID NO: 29196 - RNA, 19 nt, Homo sapiens
gaaaggaaggcaaaagagu

SEQ ID NO: 29197 - RNA, 19 nt, Homo sapiens
ugaaggcagcgcuccaaga

SEQ ID NO: 29198 - RNA, 19 nt, Homo sapiens
ggacuaugacguggagauc

SEQ ID NO: 29199 - RNA, 19 nt, Homo sapiens
gccaggcccaguaagugua

SEQ ID NO: 29200 - RNA, 19 nt, Homo sapiens
cugauuggccgguguacuu

SEQ ID NO: 29201 - RNA, 19 nt, Homo sapiens
cauguggcuugaucaucuu

SEQ ID NO: 29202 - RNA, 19 nt, Homo sapiens
gagcauguggcuugaucau

SEQ ID NO: 29203 - RNA, 19 nt, Homo sapiens
guaaccaggcucuucugau

SEQ ID NO: 29204 - RNA, 19 nt, Homo sapiens
ccaaaguggacaacaaugc

SEQ ID NO: 29205 - RNA, 19 nt, Homo sapiens
ggaaggcaaaagaguaaaa

SEQ ID NO: 29206 - RNA, 19 nt, Homo sapiens
ugugggccuucuaagauga

SEQ ID NO: 29207 - RNA, 19 nt, Homo sapiens
ugacagccaagagcagauu

SEQ ID NO: 29208 - RNA, 19 nt, Homo sapiens
gcagagucauuugcuucag

SEQ ID NO: 29209 - RNA, 19 nt, Homo sapiens
uggcucaguucaaggagau

SEQ ID NO: 29210 - RNA, 19 nt, Homo sapiens
gaggaagcaggcauagaag

SEQ ID NO: 29211 - RNA, 19 nt, Homo sapiens
aaaggaaggcaaaagagua

SEQ ID NO: 29212 - RNA, 19 nt, Homo sapiens
gaggaaggcuguacaguaa

SEQ ID NO: 29213 - RNA, 19 nt, Homo sapiens
caacuacucuggcuucuuu

SEQ ID NO: 29214 - RNA, 19 nt, Homo sapiens
ggugaucacugaauaguaa

SEQ ID NO: 29215 - RNA, 19 nt, Homo sapiens
gaguugcccuguaaauuua

SEQ ID NO: 29216 - RNA, 19 nt, Homo sapiens
caaagucacugccugguuu

SEQ ID NO: 29217 - RNA, 19 nt, Homo sapiens
ucaaugaguugcccuguaa

SEQ ID NO: 29218 - RNA, 19 nt, Homo sapiens
gggcacagcuuuguauuau

SEQ ID NO: 29219 - RNA, 19 nt, Homo sapiens
ggaggaaggcuguacagua

SEQ ID NO: 29220 - RNA, 19 nt, Homo sapiens
guaagaacguaaauguuug

SEQ ID NO: 29221 - RNA, 19 nt, Homo sapiens
gguaaccacagaauuaaua

SEQ ID NO: 29222 - RNA, 19 nt, Homo sapiens
caagagcuaugacuuagau

SEQ ID NO: 29223 - RNA, 19 nt, Homo sapiens
ggauaugaccuucugauga

SEQ ID NO: 29224 - RNA, 19 nt, Homo sapiens
gcacagcuuuguauuaugc

SEQ ID NO: 29225 - RNA, 19 nt, Homo sapiens
gagccucggugaucacuga

SEQ ID NO: 29226 - RNA, 19 nt, Homo sapiens
cguaagaacguaaauguuu

SEQ ID NO: 29227 - RNA, 19 nt, Homo sapiens
ggagcaagcugugcacaau

SEQ ID NO: 29228 - RNA, 19 nt, Homo sapiens
gauaugaccuucugaugac

SEQ ID NO: 29229 - RNA, 19 nt, Homo sapiens
ggucaggaguucaagauca

SEQ ID NO: 29230 - RNA, 19 nt, Homo sapiens
ggccauagaucugggauau

SEQ ID NO: 29231 - RNA, 19 nt, Homo sapiens
ugaguugcccuguaaauuu

SEQ ID NO: 29232 - RNA, 19 nt, Homo sapiens
gaccauggcugggauguca

SEQ ID NO: 29233 - RNA, 19 nt, Homo sapiens
caguugagcugcuacuuug

SEQ ID NO: 29234 - RNA, 19 nt, Homo sapiens
uaucagaaguaguaaguuc

SEQ ID NO: 29235 - RNA, 19 nt, Homo sapiens
aaucuaggcuccacuuguu

SEQ ID NO: 29236 - RNA, 19 nt, Homo sapiens
aaucaagagcuaugacuua

SEQ ID NO: 29237 - RNA, 19 nt, Homo sapiens
gauccaguauuaccaagau

SEQ ID NO: 29238 - RNA, 19 nt, Homo sapiens
ccucggugaucacugaaua

SEQ ID NO: 29239 - RNA, 19 nt, Homo sapiens
guaaauguuuggguguuga

SEQ ID NO: 29240 - RNA, 19 nt, Homo sapiens
gaaagacgcaaacaucucu

SEQ ID NO: 29241 - RNA, 19 nt, Homo sapiens
gccaauuucugcacccaaa

SEQ ID NO: 29242 - RNA, 19 nt, Homo sapiens
cugggagucuugagauaua

SEQ ID NO: 29243 - RNA, 19 nt, Homo sapiens
gugagugacuuggaagaaa

SEQ ID NO: 29244 - RNA, 19 nt, Homo sapiens
agcaguugauccaguauua

SEQ ID NO: 29245 - RNA, 19 nt, Homo sapiens
ggaugccacuucauaugga

SEQ ID NO: 29246 - RNA, 19 nt, Homo sapiens
ggaaggcuguacaguaaaa

SEQ ID NO: 29247 - RNA, 19 nt, Homo sapiens
agacaugcguggccucaga

SEQ ID NO: 29248 - RNA, 19 nt, Homo sapiens
cagucucacuucucaauga

SEQ ID NO: 29249 - RNA, 19 nt, Homo sapiens
ucagaaagacgcaaacauc

SEQ ID NO: 29250 - RNA, 19 nt, Homo sapiens
ugacagagcgagaccaugu

SEQ ID NO: 29251 - RNA, 19 nt, Homo sapiens
gaagucacaggguuugguu

SEQ ID NO: 29252 - RNA, 19 nt, Homo sapiens
uacucuggcuucuuucaua

SEQ ID NO: 29253 - RNA, 19 nt, Homo sapiens
cugacaagcuauauacaug

SEQ ID NO: 29254 - RNA, 19 nt, Homo sapiens
ccaguugagcugcuacuuu

SEQ ID NO: 29255 - RNA, 19 nt, Homo sapiens
caaaugucuugaugcacuu

SEQ ID NO: 29256 - RNA, 19 nt, Homo sapiens
gaaucuaggcuccacuugu

SEQ ID NO: 29257 - RNA, 19 nt, Homo sapiens
caagcuauauacaugucuu

SEQ ID NO: 29258 - RNA, 19 nt, Homo sapiens
gauaccaguugagcugcua

SEQ ID NO: 29259 - RNA, 19 nt, Homo sapiens
ggaguuaugcacgcuugua

SEQ ID NO: 29260 - RNA, 19 nt, Homo sapiens
gcagaagcacagagaggaa

SEQ ID NO: 29261 - RNA, 19 nt, Homo sapiens
ggcugggagucuugagaua

SEQ ID NO: 29262 - RNA, 19 nt, Homo sapiens
gagcagcaaagcacaggaa

SEQ ID NO: 29263 - RNA, 19 nt, Homo sapiens
gaugccacuucauauggaa

SEQ ID NO: 29264 - RNA, 19 nt, Homo sapiens
ugaaguuucuaaaggagau

SEQ ID NO: 29265 - RNA, 19 nt, Homo sapiens
cuacacagguccucaucca

SEQ ID NO: 29266 - RNA, 19 nt, Homo sapiens
uguuugggcucuacagcua

SEQ ID NO: 29267 - RNA, 19 nt, Homo sapiens
aaauuauccuggcggaguu

SEQ ID NO: 29268 - RNA, 19 nt, Homo sapiens
guuagagccucggugauca

SEQ ID NO: 29269 - RNA, 19 nt, Homo sapiens
gggccauaaucaagagcua

SEQ ID NO: 29270 - RNA, 19 nt, Homo sapiens
ccaaggcagucucacuucu

SEQ ID NO: 29271 - RNA, 19 nt, Homo sapiens
cagaggacugugagaauga

SEQ ID NO: 29272 - RNA, 19 nt, Homo sapiens
cucaaugacuggacugugu

SEQ ID NO: 29273 - RNA, 19 nt, Homo sapiens
cauaucagaaguaguaagu

SEQ ID NO: 29274 - RNA, 19 nt, Homo sapiens
gcaagcugugcacaaugua

SEQ ID NO: 29275 - RNA, 19 nt, Homo sapiens
gaggaacgugucaguggaa

SEQ ID NO: 29276 - RNA, 19 nt, Homo sapiens
cauauggaaagcagacaaa

SEQ ID NO: 29277 - RNA, 19 nt, Homo sapiens
gggauaugaccuucugaug

SEQ ID NO: 29278 - RNA, 19 nt, Homo sapiens
gaggucaggaguucaagau

SEQ ID NO: 29279 - RNA, 19 nt, Homo sapiens
uguaaucccagcacuguga

SEQ ID NO: 29280 - RNA, 19 nt, Homo sapiens
gcuuaucacaguacuuuca

SEQ ID NO: 29281 - RNA, 19 nt, Homo sapiens
cuaaaaugcuuaucacagu

SEQ ID NO: 29282 - RNA, 19 nt, Homo sapiens
ucacaggguuugguuucga

SEQ ID NO: 29283 - RNA, 19 nt, Homo sapiens
cguaaauguuuggguguug

SEQ ID NO: 29284 - RNA, 19 nt, Homo sapiens
guauuaccaagaucagaaa

SEQ ID NO: 29285 - RNA, 19 nt, Homo sapiens
gagcaagcugugcacaaug

SEQ ID NO: 29286 - RNA, 19 nt, Homo sapiens
ccaaagucacugccugguu

SEQ ID NO: 29287 - RNA, 19 nt, Homo sapiens
gaagcgaucaaaccuacca

SEQ ID NO: 29288 - RNA, 19 nt, Homo sapiens
uggcuucuuucauaucaga

SEQ ID NO: 29289 - RNA, 19 nt, Homo sapiens
agaugugagugacuuggaa

SEQ ID NO: 29290 - RNA, 19 nt, Homo sapiens
cagaaagacgcaaacaucu

SEQ ID NO: 29291 - RNA, 19 nt, Homo sapiens
gaucagaaagacgcaaaca

SEQ ID NO: 29292 - RNA, 19 nt, Homo sapiens
cacaggguuugguuucgaa

SEQ ID NO: 29293 - RNA, 19 nt, Homo sapiens
ugagugacuuggaagaaac

SEQ ID NO: 29294 - RNA, 19 nt, Homo sapiens
caaccugggcacagcuuug

SEQ ID NO: 29295 - RNA, 19 nt, Homo sapiens
gaucagccugcgcaacaug

SEQ ID NO: 29296 - RNA, 19 nt, Homo sapiens
ggguuugguuucgaaucua

SEQ ID NO: 29297 - RNA, 19 nt, Homo sapiens
ugggcacagcuuuguauua

SEQ ID NO: 29298 - RNA, 19 nt, Homo sapiens
gguuugguuucgaaucuag

SEQ ID NO: 29299 - RNA, 19 nt, Homo sapiens
gcuauauacaugucuucaa

SEQ ID NO: 29300 - RNA, 19 nt, Homo sapiens
ugacaagcuauauacaugu

SEQ ID NO: 29301 - RNA, 19 nt, Homo sapiens
ggucugggguucagcaguu

SEQ ID NO: 29302 - RNA, 19 nt, Homo sapiens
ggcacagcuuuguauuaug

SEQ ID NO: 29303 - RNA, 19 nt, Homo sapiens
ggagugggaaccuucuaca

SEQ ID NO: 29304 - RNA, 19 nt, Homo sapiens
agcaagcugugcacaaugu

SEQ ID NO: 29305 - RNA, 19 nt, Homo sapiens
gaaaccccgucucuacaau

SEQ ID NO: 29306 - RNA, 19 nt, Homo sapiens
gcugggagucuugagauau

SEQ ID NO: 29307 - RNA, 19 nt, Homo sapiens
acucuggcuucuuucauau

SEQ ID NO: 29308 - RNA, 19 nt, Homo sapiens
aaggcagucucacuucuca

SEQ ID NO: 29309 - RNA, 19 nt, Homo sapiens
auggaaagcagacaaaugu

SEQ ID NO: 29310 - RNA, 19 nt, Homo sapiens
aaaggcagaagcacagaga

SEQ ID NO: 29311 - RNA, 19 nt, Homo sapiens
gaaguuucuaaaggagaua

SEQ ID NO: 29312 - RNA, 19 nt, Homo sapiens
caagauggcccagaaauua

SEQ ID NO: 29313 - RNA, 19 nt, Homo sapiens
gagacaagcugaagauuag

SEQ ID NO: 29314 - RNA, 19 nt, Homo sapiens
gaccagaucauguccauua

SEQ ID NO: 29315 - RNA, 19 nt, Homo sapiens
gaauaucggugaccagauc

SEQ ID NO: 29316 - RNA, 19 nt, Homo sapiens
ccacucagcugcucucaga

SEQ ID NO: 29317 - RNA, 19 nt, Homo sapiens
guacaacgaugaccugauc

SEQ ID NO: 29318 - RNA, 19 nt, Homo sapiens
ccuuaaaccucuucuauug

SEQ ID NO: 29319 - RNA, 19 nt, Homo sapiens
gcugaucccugcucucuga

SEQ ID NO: 29320 - RNA, 19 nt, Homo sapiens
acagagagcuuggcaauuc

SEQ ID NO: 29321 - RNA, 19 nt, Homo sapiens
caccauacauuauuucuuc

SEQ ID NO: 29322 - RNA, 19 nt, Homo sapiens
gagaagaucguccacauuc

SEQ ID NO: 29323 - RNA, 19 nt, Homo sapiens
guggaucucuucauuucua

SEQ ID NO: 29324 - RNA, 19 nt, Homo sapiens
ugagacaagcugaagauua

SEQ ID NO: 29325 - RNA, 19 nt, Homo sapiens
ggaucaagauggcccagaa

SEQ ID NO: 29326 - RNA, 19 nt, Homo sapiens
cagaucauguccauuaaug

SEQ ID NO: 29327 - RNA, 19 nt, Homo sapiens
gggcccagcuucucuccua

SEQ ID NO: 29328 - RNA, 19 nt, Homo sapiens
acaaggaccucuuuacucu

SEQ ID NO: 29329 - RNA, 19 nt, Homo sapiens
ggagcagccuguuuacauc

SEQ ID NO: 29330 - RNA, 19 nt, Homo sapiens
uauagugaccugcucaaua

SEQ ID NO: 29331 - RNA, 19 nt, Homo sapiens
gcacacagauccccuggaa

SEQ ID NO: 29332 - RNA, 19 nt, Homo sapiens
gaguuuaucugugggaaug

SEQ ID NO: 29333 - RNA, 19 nt, Homo sapiens
gccaaugacugaaguggau

SEQ ID NO: 29334 - RNA, 19 nt, Homo sapiens
ggaagcguccacuaauaaa

SEQ ID NO: 29335 - RNA, 19 nt, Homo sapiens
ggacaucgaccagauagug

SEQ ID NO: 29336 - RNA, 19 nt, Homo sapiens
gcacguguacgaggagaua

SEQ ID NO: 29337 - RNA, 19 nt, Homo sapiens
ccgaagaucucagccagaa

SEQ ID NO: 29338 - RNA, 19 nt, Homo sapiens
gaaacccaccucucuggaa

SEQ ID NO: 29339 - RNA, 19 nt, Homo sapiens
agacaaaacuccuuccaaa

SEQ ID NO: 29340 - RNA, 19 nt, Homo sapiens
ggaggacaucgaccagaua

SEQ ID NO: 29341 - RNA, 19 nt, Homo sapiens
cagcaccacuuuggcuuaa

SEQ ID NO: 29342 - RNA, 19 nt, Homo sapiens
caaguuaucaaccauuaga

SEQ ID NO: 29343 - RNA, 19 nt, Homo sapiens
ugacugaaguggaucucuu

SEQ ID NO: 29344 - RNA, 19 nt, Homo sapiens
agagaagaauccacaagga

SEQ ID NO: 29345 - RNA, 19 nt, Homo sapiens
ggaaaacuguaaagauguu

SEQ ID NO: 29346 - RNA, 19 nt, Homo sapiens
cucaaguuaucaaccauua

SEQ ID NO: 29347 - RNA, 19 nt, Homo sapiens
gaucccugcucucugaguu

SEQ ID NO: 29348 - RNA, 19 nt, Homo sapiens
guucuaauuucaacguaug

SEQ ID NO: 29349 - RNA, 19 nt, Homo sapiens
ccagggaaguuucguaugc

SEQ ID NO: 29350 - RNA, 19 nt, Homo sapiens
gaccagaccuucgcuacca

SEQ ID NO: 29351 - RNA, 19 nt, Homo sapiens
ucaauacccaggacaugua

SEQ ID NO: 29352 - RNA, 19 nt, Homo sapiens
ggaccauccguucgccuua

SEQ ID NO: 29353 - RNA, 19 nt, Homo sapiens
gcacgaggaagccaugaau

SEQ ID NO: 29354 - RNA, 19 nt, Homo sapiens
gaagagaagaauccacaag

SEQ ID NO: 29355 - RNA, 19 nt, Homo sapiens
auagugaccugcucaauac

SEQ ID NO: 29356 - RNA, 19 nt, Homo sapiens
ucuuuacucucuccgauuu

SEQ ID NO: 29357 - RNA, 19 nt, Homo sapiens
gcccacgucauuaagguua

SEQ ID NO: 29358 - RNA, 19 nt, Homo sapiens
gagucaagcugaauaucgu

SEQ ID NO: 29359 - RNA, 19 nt, Homo sapiens
gccagaaggaguauaguga

SEQ ID NO: 29360 - RNA, 19 nt, Homo sapiens
ucaagauggcccagaaauu

SEQ ID NO: 29361 - RNA, 19 nt, Homo sapiens
gcagagucaucaagcacau

SEQ ID NO: 29362 - RNA, 19 nt, Homo sapiens
ccagguuguccucaaguua

SEQ ID NO: 29363 - RNA, 19 nt, Homo sapiens
ccucuucuauugcuaguuc

SEQ ID NO: 29364 - RNA, 19 nt, Homo sapiens
ucucugagccaaccuuaaa

SEQ ID NO: 29365 - RNA, 19 nt, Homo sapiens
ggccagcccacgucauuaa

SEQ ID NO: 29366 - RNA, 19 nt, Homo sapiens
aaguggaucucuucauuuc

SEQ ID NO: 29367 - RNA, 19 nt, Homo sapiens
caagcugaauaucgugaga

SEQ ID NO: 29368 - RNA, 19 nt, Homo sapiens
aagaaucagucccgaguca

SEQ ID NO: 29369 - RNA, 19 nt, Homo sapiens
ggaaaaggcaguacaagau

SEQ ID NO: 29370 - RNA, 19 nt, Homo sapiens
gaucaagauggcccagaaa

SEQ ID NO: 29371 - RNA, 19 nt, Homo sapiens
ucacagagagcuuggcaau

SEQ ID NO: 29372 - RNA, 19 nt, Homo sapiens
gcagccuguuuacaucuga

SEQ ID NO: 29373 - RNA, 19 nt, Homo sapiens
gaagaucguccacauucuc

SEQ ID NO: 29374 - RNA, 19 nt, Homo sapiens
acgaugaccugauccacuu

SEQ ID NO: 29375 - RNA, 19 nt, Homo sapiens
gcgccuaugcugugcagua

SEQ ID NO: 29376 - RNA, 19 nt, Homo sapiens
gaugaucugccacgucuuc

SEQ ID NO: 29377 - RNA, 19 nt, Homo sapiens
ggacauugggaacaucguu

SEQ ID NO: 29378 - RNA, 19 nt, Homo sapiens
gaggugaagcagagcauga

SEQ ID NO: 29379 - RNA, 19 nt, Homo sapiens
cccaggaggugcagacuuc

SEQ ID NO: 29380 - RNA, 19 nt, Homo sapiens
gggcaccggaucauugaaa

SEQ ID NO: 29381 - RNA, 19 nt, Homo sapiens
acacagucccauuugcaua

SEQ ID NO: 29382 - RNA, 19 nt, Homo sapiens
cagagagcuuggcaauuca

SEQ ID NO: 29383 - RNA, 19 nt, Homo sapiens
gggcaaggacaccauagug

SEQ ID NO: 29384 - RNA, 19 nt, Homo sapiens
ucccugcucucugaguuua

SEQ ID NO: 29385 - RNA, 19 nt, Homo sapiens
ggagagcggcuuccacaac

SEQ ID NO: 29386 - RNA, 19 nt, Homo sapiens
gcaucccuguguccacuga

SEQ ID NO: 29387 - RNA, 19 nt, Homo sapiens
gaagcagaaaggagaaauc

SEQ ID NO: 29388 - RNA, 19 nt, Homo sapiens
gccguaagcaggaucaaga

SEQ ID NO: 29389 - RNA, 19 nt, Homo sapiens
ccaucucgcuggccaucaa

SEQ ID NO: 29390 - RNA, 19 nt, Homo sapiens
ccagcaccacuuuggcuua

SEQ ID NO: 29391 - RNA, 19 nt, Homo sapiens
gaggugcagacuucuuaaa

SEQ ID NO: 29392 - RNA, 19 nt, Homo sapiens
ccacaaggaccucuuuacu

SEQ ID NO: 29393 - RNA, 19 nt, Homo sapiens
cgagaagaucguccacauu

SEQ ID NO: 29394 - RNA, 19 nt, Homo sapiens
caaggcagccgaggacaug

SEQ ID NO: 29395 - RNA, 19 nt, Homo sapiens
gaagauuaggcacacagau

SEQ ID NO: 29396 - RNA, 19 nt, Homo sapiens
gcaccauacauuauuucuu

SEQ ID NO: 29397 - RNA, 19 nt, Homo sapiens
ggaggugcagacuucuuaa

SEQ ID NO: 29398 - RNA, 19 nt, Homo sapiens
gaaaaggcaguacaagaug

SEQ ID NO: 29399 - RNA, 19 nt, Homo sapiens
ggaacaucguugugcugau

SEQ ID NO: 29400 - RNA, 19 nt, Homo sapiens
gauaguggccgaggugaag

SEQ ID NO: 29401 - RNA, 19 nt, Homo sapiens
ggaagagaagaauccacaa

SEQ ID NO: 29402 - RNA, 19 nt, Homo sapiens
ccucagggccaaugggauu

SEQ ID NO: 29403 - RNA, 19 nt, Homo sapiens
gaagcguccacuaauaaag

SEQ ID NO: 29404 - RNA, 19 nt, Homo sapiens
acacacacagucccauuug

SEQ ID NO: 29405 - RNA, 19 nt, Homo sapiens
gcaccagcgcugucacuag

SEQ ID NO: 29406 - RNA, 19 nt, Homo sapiens
uuaaaccucuucuauugcu

SEQ ID NO: 29407 - RNA, 19 nt, Homo sapiens
uuacacaggaagagaagaa

SEQ ID NO: 29408 - RNA, 19 nt, Homo sapiens
gaaucagucccgagucaag

SEQ ID NO: 29409 - RNA, 19 nt, Homo sapiens
gucaugcgccaggacauua

SEQ ID NO: 29410 - RNA, 19 nt, Homo sapiens
cgagaaggaggccgaguuc

SEQ ID NO: 29411 - RNA, 19 nt, Homo sapiens
cagguuguccucaaguuau

SEQ ID NO: 29412 - RNA, 19 nt, Homo sapiens
caaagaagguggcaucauu

SEQ ID NO: 29413 - RNA, 19 nt, Homo sapiens
ggacacgacuuguaaugaa

SEQ ID NO: 29414 - RNA, 19 nt, Homo sapiens
ggaagaagauggucacuac

SEQ ID NO: 29415 - RNA, 19 nt, Homo sapiens
gcccaggccuugaagaaua

SEQ ID NO: 29416 - RNA, 19 nt, Homo sapiens
gcaagaagcaguauaagau

SEQ ID NO: 29417 - RNA, 19 nt, Homo sapiens
guaaagcguuccaaguauu

SEQ ID NO: 29418 - RNA, 19 nt, Homo sapiens
caauggaccuguugacaau

SEQ ID NO: 29419 - RNA, 19 nt, Homo sapiens
aagaauacacugugacuua

SEQ ID NO: 29420 - RNA, 19 nt, Homo sapiens
ggagagauccacaugaaga

SEQ ID NO: 29421 - RNA, 19 nt, Homo sapiens
gacaugugauugauugauu

SEQ ID NO: 29422 - RNA, 19 nt, Homo sapiens
gcaaaaggcugcuaagauc

SEQ ID NO: 29423 - RNA, 19 nt, Homo sapiens
ccacccagcugcuaucaga

SEQ ID NO: 29424 - RNA, 19 nt, Homo sapiens
gaugauggccacaacauga

SEQ ID NO: 29425 - RNA, 19 nt, Homo sapiens
ucgcgcauaucacuaauaa

SEQ ID NO: 29426 - RNA, 19 nt, Homo sapiens
gcaguggcccugagcagua

SEQ ID NO: 29427 - RNA, 19 nt, Homo sapiens
gaaacgaaacccacucuag

SEQ ID NO: 29428 - RNA, 19 nt, Homo sapiens
gcagcgcucugaucucaau

SEQ ID NO: 29429 - RNA, 19 nt, Homo sapiens
agaauacacugugacuuaa

SEQ ID NO: 29430 - RNA, 19 nt, Homo sapiens
gacgucaucuugucucgaa

SEQ ID NO: 29431 - RNA, 19 nt, Homo sapiens
cauguaaucugacgucauc

SEQ ID NO: 29432 - RNA, 19 nt, Homo sapiens
gacacgacuuguaaugaaa

SEQ ID NO: 29433 - RNA, 19 nt, Homo sapiens
gaauacagcgacaucauca

SEQ ID NO: 29434 - RNA, 19 nt, Homo sapiens
uaacaacauuccagagaca

SEQ ID NO: 29435 - RNA, 19 nt, Homo sapiens
gagagucacagaacaaaug

SEQ ID NO: 29436 - RNA, 19 nt, Homo sapiens
gaucaucuuugcugccaau

SEQ ID NO: 29437 - RNA, 19 nt, Homo sapiens
cagcagcgcucugaucuca

SEQ ID NO: 29438 - RNA, 19 nt, Homo sapiens
gagcaguaguggcaugugu

SEQ ID NO: 29439 - RNA, 19 nt, Homo sapiens
ggccagaccucaaguacca

SEQ ID NO: 29440 - RNA, 19 nt, Homo sapiens
gaccagaucauguccauca

SEQ ID NO: 29441 - RNA, 19 nt, Homo sapiens
aaacgaaacccacucuaga

SEQ ID NO: 29442 - RNA, 19 nt, Homo sapiens
ucggagagauccacaugaa

SEQ ID NO: 29443 - RNA, 19 nt, Homo sapiens
ucacuacugugccagcaaa

SEQ ID NO: 29444 - RNA, 19 nt, Homo sapiens
gcgcauaucacuaauaaac

SEQ ID NO: 29445 - RNA, 19 nt, Homo sapiens
gcuuuaggaugacuguauu

SEQ ID NO: 29446 - RNA, 19 nt, Homo sapiens
gugauugauugauugauug

SEQ ID NO: 29447 - RNA, 19 nt, Homo sapiens
cagaucauguccaucaaug

SEQ ID NO: 29448 - RNA, 19 nt, Homo sapiens
uggcaucauuuccaaguuu

SEQ ID NO: 29449 - RNA, 19 nt, Homo sapiens
uguaaagcguuccaaguau

SEQ ID NO: 29450 - RNA, 19 nt, Homo sapiens
guacaacgacgaccucauc

SEQ ID NO: 29451 - RNA, 19 nt, Homo sapiens
aagaagcaguauaagauga

SEQ ID NO: 29452 - RNA, 19 nt, Homo sapiens
ggaagcagcagcgcucuga

SEQ ID NO: 29453 - RNA, 19 nt, Homo sapiens
uaaagcguuccaaguauuu

SEQ ID NO: 29454 - RNA, 19 nt, Homo sapiens
agacacaggugaagcucaa

SEQ ID NO: 29455 - RNA, 19 nt, Homo sapiens
gaccuuggccgcaccuaaa

SEQ ID NO: 29456 - RNA, 19 nt, Homo sapiens
gaaggcaagaagcaguaua

SEQ ID NO: 29457 - RNA, 19 nt, Homo sapiens
caucuuugcugccaauuac

SEQ ID NO: 29458 - RNA, 19 nt, Homo sapiens
gcauaucacuaauaaaccu

SEQ ID NO: 29459 - RNA, 19 nt, Homo sapiens
uaaaaucgaucuacacaca

SEQ ID NO: 29460 - RNA, 19 nt, Homo sapiens
ggaauacagcgacaucauc

SEQ ID NO: 29461 - RNA, 19 nt, Homo sapiens
gaaggaauacagcgacauc

SEQ ID NO: 29462 - RNA, 19 nt, Homo sapiens
gagaucaagaugagucuga

SEQ ID NO: 29463 - RNA, 19 nt, Homo sapiens
ggaggacauugaccagauc

SEQ ID NO: 29464 - RNA, 19 nt, Homo sapiens
uuuccaaugugacuaauga

SEQ ID NO: 29465 - RNA, 19 nt, Homo sapiens
caagaagcaguauaagaug

SEQ ID NO: 29466 - RNA, 19 nt, Homo sapiens
aaagaagguggcaucauuu

SEQ ID NO: 29467 - RNA, 19 nt, Homo sapiens
cagaagagaggcugaagug

SEQ ID NO: 29468 - RNA, 19 nt, Homo sapiens
gggcaucaccuacuacauc

SEQ ID NO: 29469 - RNA, 19 nt, Homo sapiens
acauggagcugcccuugga

SEQ ID NO: 29470 - RNA, 19 nt, Homo sapiens
ucaagggccugaagaacca

SEQ ID NO: 29471 - RNA, 19 nt, Homo sapiens
gaugaucugccauguguuc

SEQ ID NO: 29472 - RNA, 19 nt, Homo sapiens
ggcaagaagcaguauaaga

SEQ ID NO: 29473 - RNA, 19 nt, Homo sapiens
ugacggaaguggaccucuu

SEQ ID NO: 29474 - RNA, 19 nt, Homo sapiens
ccacaauggucccaaacag

SEQ ID NO: 29475 - RNA, 19 nt, Homo sapiens
ucaccacgguccuuaucaa

SEQ ID NO: 29476 - RNA, 19 nt, Homo sapiens
gaagguggcaucauuucca

SEQ ID NO: 29477 - RNA, 19 nt, Homo sapiens
uggcagagaucaagaugag

SEQ ID NO: 29478 - RNA, 19 nt, Homo sapiens
agaagauggucacuacugu

SEQ ID NO: 29479 - RNA, 19 nt, Homo sapiens
aauacacugugacuuaaga

SEQ ID NO: 29480 - RNA, 19 nt, Homo sapiens
caaaggagagucacagaac

SEQ ID NO: 29481 - RNA, 19 nt, Homo sapiens
gauccuggccaacaugaug

SEQ ID NO: 29482 - RNA, 19 nt, Homo sapiens
guaaucugacgucaucuug

SEQ ID NO: 29483 - RNA, 19 nt, Homo sapiens
ggaaacgaaacccacucua

SEQ ID NO: 29484 - RNA, 19 nt, Homo sapiens
aaaggagagucacagaaca

SEQ ID NO: 29485 - RNA, 19 nt, Homo sapiens
cccaggagauguacaacga

SEQ ID NO: 29486 - RNA, 19 nt, Homo sapiens
aaguggaccucuucauuuc

SEQ ID NO: 29487 - RNA, 19 nt, Homo sapiens
ccacagcccacgagaagau

SEQ ID NO: 29488 - RNA, 19 nt, Homo sapiens
cgacauugggaacauugua

SEQ ID NO: 29489 - RNA, 19 nt, Homo sapiens
gcauguguguagaucaagu

SEQ ID NO: 29490 - RNA, 19 nt, Homo sapiens
gacauuaccaaaccacuca

SEQ ID NO: 29491 - RNA, 19 nt, Homo sapiens
uuguaaagcguuccaagua

SEQ ID NO: 29492 - RNA, 19 nt, Homo sapiens
aggugaagcucaacauugu

SEQ ID NO: 29493 - RNA, 19 nt, Homo sapiens
caggugaagcucaacauug

SEQ ID NO: 29494 - RNA, 19 nt, Homo sapiens
gaagcaguauaagaugauc

SEQ ID NO: 29495 - RNA, 19 nt, Homo sapiens
gaacauuguagugcugaug

SEQ ID NO: 29496 - RNA, 19 nt, Homo sapiens
ggacgacagcuaccuagag

SEQ ID NO: 29497 - RNA, 19 nt, Homo sapiens
gaagaauacacugugacuu

SEQ ID NO: 29498 - RNA, 19 nt, Homo sapiens
uggcauguguguagaucaa

SEQ ID NO: 29499 - RNA, 19 nt, Homo sapiens
aagaugagucugagcauga

SEQ ID NO: 29500 - RNA, 19 nt, Homo sapiens
aauaacaacauuccagaga

SEQ ID NO: 29501 - RNA, 19 nt, Homo sapiens
gaccagaucguggcagaga

SEQ ID NO: 29502 - RNA, 19 nt, Homo sapiens
ugaaucuccuguggacaaa

SEQ ID NO: 29503 - RNA, 19 nt, Homo sapiens
gggugagccucuucuugug

SEQ ID NO: 29504 - RNA, 19 nt, Homo sapiens
aaaucgaucuacacacauc

SEQ ID NO: 29505 - RNA, 19 nt, Homo sapiens
ucaaaggagagucacagaa

SEQ ID NO: 29506 - RNA, 19 nt, Homo sapiens
gaucaagguuuuaaaugca

SEQ ID NO: 29507 - RNA, 19 nt, Homo sapiens
uaccaaaccacucauuuua

SEQ ID NO: 29508 - RNA, 19 nt, Homo sapiens
aaucugacgucaucuuguc

SEQ ID NO: 29509 - RNA, 19 nt, Homo sapiens
guaguggcauguguguaga

SEQ ID NO: 29510 - RNA, 19 nt, Homo sapiens
gaaacccacucuagaaaac

SEQ ID NO: 29511 - RNA, 19 nt, Homo sapiens
aggagggcaucaccuacua

SEQ ID NO: 29512 - RNA, 19 nt, Homo sapiens
gaauguaccuguugcuaaa

SEQ ID NO: 29513 - RNA, 19 nt, Homo sapiens
gcagagauguccacacguu

SEQ ID NO: 29514 - RNA, 19 nt, Homo sapiens
caugagaucugcucuaaga

SEQ ID NO: 29515 - RNA, 19 nt, Homo sapiens
gggcaccucugcuguauug

SEQ ID NO: 29516 - RNA, 19 nt, Homo sapiens
cuacguagcucgugauaag

SEQ ID NO: 29517 - RNA, 19 nt, Homo sapiens
ccucaggccucccaaauau

SEQ ID NO: 29518 - RNA, 19 nt, Homo sapiens
ggaggaugaugaugaugaa

SEQ ID NO: 29519 - RNA, 19 nt, Homo sapiens
ggaauguaccuguugcuaa

SEQ ID NO: 29520 - RNA, 19 nt, Homo sapiens
gugauaagcugacccagau

SEQ ID NO: 29521 - RNA, 19 nt, Homo sapiens
ggaugucccuuuccaagug

SEQ ID NO: 29522 - RNA, 19 nt, Homo sapiens
ggaggaggaugaugaugau

SEQ ID NO: 29523 - RNA, 19 nt, Homo sapiens
ggaaggaaaggaucugcua

SEQ ID NO: 29524 - RNA, 19 nt, Homo sapiens
ggccaugucuguuccauca

SEQ ID NO: 29525 - RNA, 19 nt, Homo sapiens
agaaugaguugguccagaa

SEQ ID NO: 29526 - RNA, 19 nt, Homo sapiens
ggaccacucuaaacuugug

SEQ ID NO: 29527 - RNA, 19 nt, Homo sapiens
caccucugcuguauugaua

SEQ ID NO: 29528 - RNA, 19 nt, Homo sapiens
ggguagaugugauuaaugg

SEQ ID NO: 29529 - RNA, 19 nt, Homo sapiens
caauggagcugggacugaa

SEQ ID NO: 29530 - RNA, 19 nt, Homo sapiens
gcucaagugccacguguuu

SEQ ID NO: 29531 - RNA, 19 nt, Homo sapiens
gagggacuuugccuacgua

SEQ ID NO: 29532 - RNA, 19 nt, Homo sapiens
ucagcucucuuaccacaaa

SEQ ID NO: 29533 - RNA, 19 nt, Homo sapiens
gaagagagagggacuuugc

SEQ ID NO: 29534 - RNA, 19 nt, Homo sapiens
gaggaggacuuaucuucuc

SEQ ID NO: 29535 - RNA, 19 nt, Homo sapiens
acucuaaacuuguggaugu

SEQ ID NO: 29536 - RNA, 19 nt, Homo sapiens
gaccagaaucgcaauguga

SEQ ID NO: 29537 - RNA, 19 nt, Homo sapiens
ggaaggaugaacccaguga

SEQ ID NO: 29538 - RNA, 19 nt, Homo sapiens
gaacagugcagccagugau

SEQ ID NO: 29539 - RNA, 19 nt, Homo sapiens
gagagugucgggugcguuu

SEQ ID NO: 29540 - RNA, 19 nt, Homo sapiens
cagcagccgugaacaaugg

SEQ ID NO: 29541 - RNA, 19 nt, Homo sapiens
ugacccagaugcucaagug

SEQ ID NO: 29542 - RNA, 19 nt, Homo sapiens
acccagggaucaaguguuu

SEQ ID NO: 29543 - RNA, 19 nt, Homo sapiens
agaaguuccaagucuauua

SEQ ID NO: 29544 - RNA, 19 nt, Homo sapiens
ugcaugagaucugcucuaa

SEQ ID NO: 29545 - RNA, 19 nt, Homo sapiens
ggaugagacacuaaagcua

SEQ ID NO: 29546 - RNA, 19 nt, Homo sapiens
cuuugaggauggagaauuu

SEQ ID NO: 29547 - RNA, 19 nt, Homo sapiens
ggaugaugaugaugaagag

SEQ ID NO: 29548 - RNA, 19 nt, Homo sapiens
gcaaugugaccuugaccuu

SEQ ID NO: 29549 - RNA, 19 nt, Homo sapiens
ucccagcgccuaagaauga

SEQ ID NO: 29550 - RNA, 19 nt, Homo sapiens
ccaccagccugcaugagau

SEQ ID NO: 29551 - RNA, 19 nt, Homo sapiens
gcuggaggaugagacacua

SEQ ID NO: 29552 - RNA, 19 nt, Homo sapiens
ccacacguuugcauucauc

SEQ ID NO: 29553 - RNA, 19 nt, Homo sapiens
gaaguuccaagucuauuac

SEQ ID NO: 29554 - RNA, 19 nt, Homo sapiens
guccagaaguuccaagucu

SEQ ID NO: 29555 - RNA, 19 nt, Homo sapiens
ggacuuugccuacguagcu

SEQ ID NO: 29556 - RNA, 19 nt, Homo sapiens
gcauccgucagcucucuua

SEQ ID NO: 29557 - RNA, 19 nt, Homo sapiens
guguggcagucaacaauug

SEQ ID NO: 29558 - RNA, 19 nt, Homo sapiens
uacugcagcuggaggauga

SEQ ID NO: 29559 - RNA, 19 nt, Homo sapiens
acaccucagggaccuauua

SEQ ID NO: 29560 - RNA, 19 nt, Homo sapiens
ggaggaggaggacuuaucu

SEQ ID NO: 29561 - RNA, 19 nt, Homo sapiens
cuggaccacucuaaacuug

SEQ ID NO: 29562 - RNA, 19 nt, Homo sapiens
ccagaaguuccaagucuau

SEQ ID NO: 29563 - RNA, 19 nt, Homo sapiens
ucuguuccaucaucacuga

SEQ ID NO: 29564 - RNA, 19 nt, Homo sapiens
gcagcaguguggcagucaa

SEQ ID NO: 29565 - RNA, 19 nt, Homo sapiens
ggaacagugcagccaguga

SEQ ID NO: 29566 - RNA, 19 nt, Homo sapiens
ggaggaggacuuaucuucu

SEQ ID NO: 29567 - RNA, 19 nt, Homo sapiens
gagaucuaaucccuucaag

SEQ ID NO: 29568 - RNA, 19 nt, Homo sapiens
gggaauguaccuguugcua

SEQ ID NO: 29569 - RNA, 19 nt, Homo sapiens
ugaccagaaucgcaaugug

SEQ ID NO: 29570 - RNA, 19 nt, Homo sapiens
gcaccucugcuguauugau

SEQ ID NO: 29571 - RNA, 19 nt, Homo sapiens
uccagaaguuccaagucua

SEQ ID NO: 29572 - RNA, 19 nt, Homo sapiens
ccaugucuguuccaucauc

SEQ ID NO: 29573 - RNA, 19 nt, Homo sapiens
ggaggaggaggaugaugau

SEQ ID NO: 29574 - RNA, 19 nt, Homo sapiens
ggucuagaggcuauuccua

SEQ ID NO: 29575 - RNA, 19 nt, Homo sapiens
gaucaucagcacucaagag

SEQ ID NO: 29576 - RNA, 19 nt, Homo sapiens
aaugcccgcugcuugguaa

SEQ ID NO: 29577 - RNA, 19 nt, Homo sapiens
acgaggaccuggccugauc

SEQ ID NO: 29578 - RNA, 19 nt, Homo sapiens
guaacaagaggagcaggaa

SEQ ID NO: 29579 - RNA, 19 nt, Homo sapiens
ggacaccucagggaccuau

SEQ ID NO: 29580 - RNA, 19 nt, Homo sapiens
gcuguauugauaucacuaa

SEQ ID NO: 29581 - RNA, 19 nt, Homo sapiens
caugggcaccucugcugua

SEQ ID NO: 29582 - RNA, 19 nt, Homo sapiens
gaauucccagcgccuaaga

SEQ ID NO: 29583 - RNA, 19 nt, Homo sapiens
gccaaggccaugucuguuc

SEQ ID NO: 29584 - RNA, 19 nt, Homo sapiens
gcaguguggcagucaacaa

SEQ ID NO: 29585 - RNA, 19 nt, Homo sapiens
gcccauaccccaugaagaa

SEQ ID NO: 29586 - RNA, 19 nt, Homo sapiens
cugcuacccucaccaucuu

SEQ ID NO: 29587 - RNA, 19 nt, Homo sapiens
gcccgcugcuugguaaaug

SEQ ID NO: 29588 - RNA, 19 nt, Homo sapiens
gagccagucggccauuaau

SEQ ID NO: 29589 - RNA, 19 nt, Homo sapiens
cagaugagggagaggagaa

SEQ ID NO: 29590 - RNA, 19 nt, Homo sapiens
gccaccagccugcaugaga

SEQ ID NO: 29591 - RNA, 19 nt, Homo sapiens
ggaagagagagggacuuug

SEQ ID NO: 29592 - RNA, 19 nt, Homo sapiens
ccucagggaccuauuacug

SEQ ID NO: 29593 - RNA, 19 nt, Homo sapiens
ggaggggucuagaggcuau

SEQ ID NO: 29594 - RNA, 19 nt, Homo sapiens
agagauguccacacguuug

SEQ ID NO: 29595 - RNA, 19 nt, Homo sapiens
ccaauggagcugggacuga

SEQ ID NO: 29596 - RNA, 19 nt, Homo sapiens
ggaugaacccagugaugag

SEQ ID NO: 29597 - RNA, 19 nt, Homo sapiens
caagcugggcuaccuuauc

SEQ ID NO: 29598 - RNA, 19 nt, Homo sapiens
guccacacguuugcauuca

SEQ ID NO: 29599 - RNA, 19 nt, Homo sapiens
aggaggaggaugaugauga

SEQ ID NO: 29600 - RNA, 19 nt, Homo sapiens
agaggaggaggaggacuua

SEQ ID NO: 29601 - RNA, 19 nt, Homo sapiens
gugccagccuccuguuugg

SEQ ID NO: 29602 - RNA, 19 nt, Homo sapiens
ccucugcuguauugauauc

SEQ ID NO: 29603 - RNA, 19 nt, Homo sapiens
ggagggagagaucuaaucc

SEQ ID NO: 29604 - RNA, 19 nt, Homo sapiens
gaaggaugaacccagugau

SEQ ID NO: 29605 - RNA, 19 nt, Homo sapiens
cagagauguccacacguuu

SEQ ID NO: 29606 - RNA, 19 nt, Homo sapiens
ugagccagucggccauuaa

SEQ ID NO: 29607 - RNA, 19 nt, Homo sapiens
ucccuaggcuggguagaga

SEQ ID NO: 29608 - RNA, 19 nt, Homo sapiens
gggagggagagaucuaauc

SEQ ID NO: 29609 - RNA, 19 nt, Homo sapiens
gagugccagccuccuguuu

SEQ ID NO: 29610 - RNA, 19 nt, Homo sapiens
cugagccagucggccauua

SEQ ID NO: 29611 - RNA, 19 nt, Homo sapiens
gcagcuggaggaugagaca

SEQ ID NO: 29612 - RNA, 19 nt, Homo sapiens
gaauguaccuguugcuaaa

SEQ ID NO: 29613 - RNA, 19 nt, Homo sapiens
gcagagauguccacacguu

SEQ ID NO: 29614 - RNA, 19 nt, Homo sapiens
caugagaucugcucuaaga

SEQ ID NO: 29615 - RNA, 19 nt, Homo sapiens
gggcaccucugcuguauug

SEQ ID NO: 29616 - RNA, 19 nt, Homo sapiens
cuacguagcucgugauaag

SEQ ID NO: 29617 - RNA, 19 nt, Homo sapiens
ccucaggccucccaaauau

SEQ ID NO: 29618 - RNA, 19 nt, Homo sapiens
ggaggaugaugaugaugaa

SEQ ID NO: 29619 - RNA, 19 nt, Homo sapiens
ggaauguaccuguugcuaa

SEQ ID NO: 29620 - RNA, 19 nt, Homo sapiens
gugauaagcugacccagau

SEQ ID NO: 29621 - RNA, 19 nt, Homo sapiens
ggaugucccuuuccaagug

SEQ ID NO: 29622 - RNA, 19 nt, Homo sapiens
ggaggaggaugaugaugau

SEQ ID NO: 29623 - RNA, 19 nt, Homo sapiens
ggccaugucuguuccauca

SEQ ID NO: 29624 - RNA, 19 nt, Homo sapiens
ggaaggaaaggaucugcua

SEQ ID NO: 29625 - RNA, 19 nt, Homo sapiens
agaaugaguugguccagaa

SEQ ID NO: 29626 - RNA, 19 nt, Homo sapiens
ggaccacucuaaacuugug

SEQ ID NO: 29627 - RNA, 19 nt, Homo sapiens
caccucugcuguauugaua

SEQ ID NO: 29628 - RNA, 19 nt, Homo sapiens
ggguagaugugauuaaugg

SEQ ID NO: 29629 - RNA, 19 nt, Homo sapiens
caauggagcugggacugaa

SEQ ID NO: 29630 - RNA, 19 nt, Homo sapiens
gcucaagugccacguguuu

SEQ ID NO: 29631 - RNA, 19 nt, Homo sapiens
gaagggacuuugccuacgu

SEQ ID NO: 29632 - RNA, 19 nt, Homo sapiens
ucagcucucuuaccacaaa

SEQ ID NO: 29633 - RNA, 19 nt, Homo sapiens
gaggaggacuuaucuucuc

SEQ ID NO: 29634 - RNA, 19 nt, Homo sapiens
acucuaaacuuguggaugu

SEQ ID NO: 29635 - RNA, 19 nt, Homo sapiens
gaccagaaucgcaauguga

SEQ ID NO: 29636 - RNA, 19 nt, Homo sapiens
ggaaggaugaacccaguga

SEQ ID NO: 29637 - RNA, 19 nt, Homo sapiens
gaacagugcagccagugau

SEQ ID NO: 29638 - RNA, 19 nt, Homo sapiens
gagagugucgggugcguuu

SEQ ID NO: 29639 - RNA, 19 nt, Homo sapiens
cagcagccgugaacaaugg

SEQ ID NO: 29640 - RNA, 19 nt, Homo sapiens
ugacccagaugcucaagug

SEQ ID NO: 29641 - RNA, 19 nt, Homo sapiens
acccagggaucaaguguuu

SEQ ID NO: 29642 - RNA, 19 nt, Homo sapiens
agaaguuccaagucuauua

SEQ ID NO: 29643 - RNA, 19 nt, Homo sapiens
ugcaugagaucugcucuaa

SEQ ID NO: 29644 - RNA, 19 nt, Homo sapiens
ggaugagacacuaaagcua

SEQ ID NO: 29645 - RNA, 19 nt, Homo sapiens
cuuugaggauggagaauuu

SEQ ID NO: 29646 - RNA, 19 nt, Homo sapiens
ggaugaugaugaugaagag

SEQ ID NO: 29647 - RNA, 19 nt, Homo sapiens
gcaaugugaccuugaccuu

SEQ ID NO: 29648 - RNA, 19 nt, Homo sapiens
ucccagcgccuaagaauga

SEQ ID NO: 29649 - RNA, 19 nt, Homo sapiens
ccaccagccugcaugagau

SEQ ID NO: 29650 - RNA, 19 nt, Homo sapiens
gcuggaggaugagacacua

SEQ ID NO: 29651 - RNA, 19 nt, Homo sapiens
ccacacguuugcauucauc

SEQ ID NO: 29652 - RNA, 19 nt, Homo sapiens
gaaguuccaagucuauuac

SEQ ID NO: 29653 - RNA, 19 nt, Homo sapiens
guccagaaguuccaagucu

SEQ ID NO: 29654 - RNA, 19 nt, Homo sapiens
ggacuuugccuacguagcu

SEQ ID NO: 29655 - RNA, 19 nt, Homo sapiens
gcauccgucagcucucuua

SEQ ID NO: 29656 - RNA, 19 nt, Homo sapiens
guguggcagucaacaauug

SEQ ID NO: 29657 - RNA, 19 nt, Homo sapiens
uacugcagcuggaggauga

SEQ ID NO: 29658 - RNA, 19 nt, Homo sapiens
acaccucagggaccuauua

SEQ ID NO: 29659 - RNA, 19 nt, Homo sapiens
ggaggaggaggacuuaucu

SEQ ID NO: 29660 - RNA, 19 nt, Homo sapiens
cuggaccacucuaaacuug

SEQ ID NO: 29661 - RNA, 19 nt, Homo sapiens
ccagaaguuccaagucuau

SEQ ID NO: 29662 - RNA, 19 nt, Homo sapiens
ucuguuccaucaucacuga

SEQ ID NO: 29663 - RNA, 19 nt, Homo sapiens
ggacaguggaagggacuuu

SEQ ID NO: 29664 - RNA, 19 nt, Homo sapiens
gcagcaguguggcagucaa

SEQ ID NO: 29665 - RNA, 19 nt, Homo sapiens
ggaacagugcagccaguga

SEQ ID NO: 29666 - RNA, 19 nt, Homo sapiens
ggaggaggacuuaucuucu

SEQ ID NO: 29667 - RNA, 19 nt, Homo sapiens
gagaucuaaucccuucaag

SEQ ID NO: 29668 - RNA, 19 nt, Homo sapiens
gggaauguaccuguugcua

SEQ ID NO: 29669 - RNA, 19 nt, Homo sapiens
ugaccagaaucgcaaugug

SEQ ID NO: 29670 - RNA, 19 nt, Homo sapiens
gcaccucugcuguauugau

SEQ ID NO: 29671 - RNA, 19 nt, Homo sapiens
uccagaaguuccaagucua

SEQ ID NO: 29672 - RNA, 19 nt, Homo sapiens
ccaugucuguuccaucauc

SEQ ID NO: 29673 - RNA, 19 nt, Homo sapiens
ggaggaggaggaugaugau

SEQ ID NO: 29674 - RNA, 19 nt, Homo sapiens
ggucuagaggcuauuccua

SEQ ID NO: 29675 - RNA, 19 nt, Homo sapiens
acgaggaccuggccugauc

SEQ ID NO: 29676 - RNA, 19 nt, Homo sapiens
aaugcccgcugcuugguaa

SEQ ID NO: 29677 - RNA, 19 nt, Homo sapiens
gaucaucagcacucaagag

SEQ ID NO: 29678 - RNA, 19 nt, Homo sapiens
guaacaagaggagcaggaa

SEQ ID NO: 29679 - RNA, 19 nt, Homo sapiens
ggacaccucagggaccuau

SEQ ID NO: 29680 - RNA, 19 nt, Homo sapiens
gcuguauugauaucacuaa

SEQ ID NO: 29681 - RNA, 19 nt, Homo sapiens
caugggcaccucugcugua

SEQ ID NO: 29682 - RNA, 19 nt, Homo sapiens
gccaaggccaugucuguuc

SEQ ID NO: 29683 - RNA, 19 nt, Homo sapiens
gaauucccagcgccuaaga

SEQ ID NO: 29684 - RNA, 19 nt, Homo sapiens
gcaguguggcagucaacaa

SEQ ID NO: 29685 - RNA, 19 nt, Homo sapiens
gcccauaccccaugaagaa

SEQ ID NO: 29686 - RNA, 19 nt, Homo sapiens
cugcuacccucaccaucuu

SEQ ID NO: 29687 - RNA, 19 nt, Homo sapiens
gcccgcugcuugguaaaug

SEQ ID NO: 29688 - RNA, 19 nt, Homo sapiens
aagggacuuugccuacgua

SEQ ID NO: 29689 - RNA, 19 nt, Homo sapiens
gagccagucggccauuaau

SEQ ID NO: 29690 - RNA, 19 nt, Homo sapiens
gccaccagccugcaugaga

SEQ ID NO: 29691 - RNA, 19 nt, Homo sapiens
cagaugagggagaggagaa

SEQ ID NO: 29692 - RNA, 19 nt, Homo sapiens
ccucagggaccuauuacug

SEQ ID NO: 29693 - RNA, 19 nt, Homo sapiens
ggaggggucuagaggcuau

SEQ ID NO: 29694 - RNA, 19 nt, Homo sapiens
agagauguccacacguuug

SEQ ID NO: 29695 - RNA, 19 nt, Homo sapiens
ccaauggagcugggacuga

SEQ ID NO: 29696 - RNA, 19 nt, Homo sapiens
ggaugaacccagugaugag

SEQ ID NO: 29697 - RNA, 19 nt, Homo sapiens
caagcugggcuaccuuauc

SEQ ID NO: 29698 - RNA, 19 nt, Homo sapiens
aggaggaggaugaugauga

SEQ ID NO: 29699 - RNA, 19 nt, Homo sapiens
guccacacguuugcauuca

SEQ ID NO: 29700 - RNA, 19 nt, Homo sapiens
agaggaggaggaggacuua

SEQ ID NO: 29701 - RNA, 19 nt, Homo sapiens
gugccagccuccuguuugg

SEQ ID NO: 29702 - RNA, 19 nt, Homo sapiens
ccucugcuguauugauauc

SEQ ID NO: 29703 - RNA, 19 nt, Homo sapiens
ggagggagagaucuaaucc

SEQ ID NO: 29704 - RNA, 19 nt, Homo sapiens
gaaggaugaacccagugau

SEQ ID NO: 29705 - RNA, 19 nt, Homo sapiens
cagagauguccacacguuu

SEQ ID NO: 29706 - RNA, 19 nt, Homo sapiens
ugagccagucggccauuaa

SEQ ID NO: 29707 - RNA, 19 nt, Homo sapiens
ucccuaggcuggguagaga

SEQ ID NO: 29708 - RNA, 19 nt, Homo sapiens
cugagccagucggccauua

SEQ ID NO: 29709 - RNA, 19 nt, Homo sapiens
gggagggagagaucuaauc

SEQ ID NO: 29710 - RNA, 19 nt, Homo sapiens
aggaggaggaggaugauga

SEQ ID NO: 29711 - RNA, 19 nt, Homo sapiens
gcagcuggaggaugagaca

SEQ ID NO: 29712 - RNA, 19 nt, Homo sapiens
aaagaaagcuccugugaaa

SEQ ID NO: 29713 - RNA, 19 nt, Homo sapiens
gaaaccaacuggcagcuuu

SEQ ID NO: 29714 - RNA, 19 nt, Homo sapiens
ggacucaacuagauauauu

SEQ ID NO: 29715 - RNA, 19 nt, Homo sapiens
ggaaggacguccacacauu

SEQ ID NO: 29716 - RNA, 19 nt, Homo sapiens
acuaagagcuuccuaaauu

SEQ ID NO: 29717 - RNA, 19 nt, Homo sapiens
aaacuuagcuggaaagaca

SEQ ID NO: 29718 - RNA, 19 nt, Homo sapiens
gaugaugauucuuguagua

SEQ ID NO: 29719 - RNA, 19 nt, Homo sapiens
gaacuaagagcuuccuaaa

SEQ ID NO: 29720 - RNA, 19 nt, Homo sapiens
agaauuagcugauaugcaa

SEQ ID NO: 29721 - RNA, 19 nt, Homo sapiens
gaaccucgaugucccuuug

SEQ ID NO: 29722 - RNA, 19 nt, Homo sapiens
ggaaagacauguaccugau

SEQ ID NO: 29723 - RNA, 19 nt, Homo sapiens
cuaagagcuuccuaaauua

SEQ ID NO: 29724 - RNA, 19 nt, Homo sapiens
cauguuaccuguagacaaa

SEQ ID NO: 29725 - RNA, 19 nt, Homo sapiens
ggacauauuucaaacuucu

SEQ ID NO: 29726 - RNA, 19 nt, Homo sapiens
ccagagaacuagagcagaa

SEQ ID NO: 29727 - RNA, 19 nt, Homo sapiens
gaacagcacaccucccaaa

SEQ ID NO: 29728 - RNA, 19 nt, Homo sapiens
caucagccuuucauccuua

SEQ ID NO: 29729 - RNA, 19 nt, Homo sapiens
ucagagaauuuacccuuaa

SEQ ID NO: 29730 - RNA, 19 nt, Homo sapiens
ccaggcagcucauauuuca

SEQ ID NO: 29731 - RNA, 19 nt, Homo sapiens
uagcugauaugcaauuuga

SEQ ID NO: 29732 - RNA, 19 nt, Homo sapiens
gaaggacguccacacauuu

SEQ ID NO: 29733 - RNA, 19 nt, Homo sapiens
gcgaucaaucucaauauua

SEQ ID NO: 29734 - RNA, 19 nt, Homo sapiens
ucaaacuucugccuuauau

SEQ ID NO: 29735 - RNA, 19 nt, Homo sapiens
gaacauuacuuaacuucac

SEQ ID NO: 29736 - RNA, 19 nt, Homo sapiens
cuauuuaccugaagauuga

SEQ ID NO: 29737 - RNA, 19 nt, Homo sapiens
gauaugcaauuugaaguug

SEQ ID NO: 29738 - RNA, 19 nt, Homo sapiens
aaacagauauauggaguga

SEQ ID NO: 29739 - RNA, 19 nt, Homo sapiens
caaaaggacucggcuauuu

SEQ ID NO: 29740 - RNA, 19 nt, Homo sapiens
gaacuacagacgucacaaa

SEQ ID NO: 29741 - RNA, 19 nt, Homo sapiens
cggugcagcuagagaauua

SEQ ID NO: 29742 - RNA, 19 nt, Homo sapiens
uuacuuaacuucacacaca

SEQ ID NO: 29743 - RNA, 19 nt, Homo sapiens
ggguagagauggcagaaga

SEQ ID NO: 29744 - RNA, 19 nt, Homo sapiens
gcuaugggcucacuguugu

SEQ ID NO: 29745 - RNA, 19 nt, Homo sapiens
gaacgaggauuugcaugca

SEQ ID NO: 29746 - RNA, 19 nt, Homo sapiens
uaaacguucugcuggaauu

SEQ ID NO: 29747 - RNA, 19 nt, Homo sapiens
gcaaguagauuuuccaaca

SEQ ID NO: 29748 - RNA, 19 nt, Homo sapiens
guucauaccugagcaaagu

SEQ ID NO: 29749 - RNA, 19 nt, Homo sapiens
aagcugaggcugacaauaa

SEQ ID NO: 29750 - RNA, 19 nt, Homo sapiens
gaaguuagaggguaaagag

SEQ ID NO: 29751 - RNA, 19 nt, Homo sapiens
ggaguaauggacuguuuaa

SEQ ID NO: 29752 - RNA, 19 nt, Homo sapiens
cacgagaucugcuccaaga

SEQ ID NO: 29753 - RNA, 19 nt, Homo sapiens
ggugcuugcuauuaauuaa

SEQ ID NO: 29754 - RNA, 19 nt, Homo sapiens
cgaucaaucucaauauuag

SEQ ID NO: 29755 - RNA, 19 nt, Homo sapiens
ggcgaucaaucucaauauu

SEQ ID NO: 29756 - RNA, 19 nt, Homo sapiens
gcuagagaauuauaguuca

SEQ ID NO: 29757 - RNA, 19 nt, Homo sapiens
aaacuucugccuuauauug

SEQ ID NO: 29758 - RNA, 19 nt, Homo sapiens
guugaacgcugaaauaaaa

SEQ ID NO: 29759 - RNA, 19 nt, Homo sapiens
gugagaaacuuagcuggaa

SEQ ID NO: 29760 - RNA, 19 nt, Homo sapiens
uagcagauaccauugaauu

SEQ ID NO: 29761 - RNA, 19 nt, Homo sapiens
ccaaguagccacaguguca

SEQ ID NO: 29762 - RNA, 19 nt, Homo sapiens
guauguaggugagaaacuu

SEQ ID NO: 29763 - RNA, 19 nt, Homo sapiens
gagcugcuguggucuguag

SEQ ID NO: 29764 - RNA, 19 nt, Homo sapiens
cgaugucccuuugcaagua

SEQ ID NO: 29765 - RNA, 19 nt, Homo sapiens
acagauauauggagugauc

SEQ ID NO: 29766 - RNA, 19 nt, Homo sapiens
gcaacaaauuacauuaggu

SEQ ID NO: 29767 - RNA, 19 nt, Homo sapiens
cauagcagauaccauugaa

SEQ ID NO: 29768 - RNA, 19 nt, Homo sapiens
gaggaagucuuaguggaau

SEQ ID NO: 29769 - RNA, 19 nt, Homo sapiens
gcaguacuugggcauguua

SEQ ID NO: 29770 - RNA, 19 nt, Homo sapiens
uaucaacagugacccagaa

SEQ ID NO: 29771 - RNA, 19 nt, Homo sapiens
aggaaagggucacuuaguu

SEQ ID NO: 29772 - RNA, 19 nt, Homo sapiens
cuacagacgucacaaaucg

SEQ ID NO: 29773 - RNA, 19 nt, Homo sapiens
caggaguaauggacuguuu

SEQ ID NO: 29774 - RNA, 19 nt, Homo sapiens
ccagaagagucacaaccaa

SEQ ID NO: 29775 - RNA, 19 nt, Homo sapiens
ggaaagggccaaugugaac

SEQ ID NO: 29776 - RNA, 19 nt, Homo sapiens
guagcaagagauaaagaua

SEQ ID NO: 29777 - RNA, 19 nt, Homo sapiens
ggaaagggucacuuaguuc

SEQ ID NO: 29778 - RNA, 19 nt, Homo sapiens
ggaaaccucagccagagaa

SEQ ID NO: 29779 - RNA, 19 nt, Homo sapiens
caaagucuacacaggagua

SEQ ID NO: 29780 - RNA, 19 nt, Homo sapiens
aaaauaggauggcgaguuu

SEQ ID NO: 29781 - RNA, 19 nt, Homo sapiens
ggaugaaacagauauaugg

SEQ ID NO: 29782 - RNA, 19 nt, Homo sapiens
cagcacaccucccaaaugc

SEQ ID NO: 29783 - RNA, 19 nt, Homo sapiens
gguaaacguucugcuggaa

SEQ ID NO: 29784 - RNA, 19 nt, Homo sapiens
gccauucucuacauaaaca

SEQ ID NO: 29785 - RNA, 19 nt, Homo sapiens
aaacauagccuuucuuuuc

SEQ ID NO: 29786 - RNA, 19 nt, Homo sapiens
ggauggcgaguuuguguuu

SEQ ID NO: 29787 - RNA, 19 nt, Homo sapiens
ccacacauuugccuucauc

SEQ ID NO: 29788 - RNA, 19 nt, Homo sapiens
ugagaaacuuagcuggaaa

SEQ ID NO: 29789 - RNA, 19 nt, Homo sapiens
gcaauuugaaguugaggaa

SEQ ID NO: 29790 - RNA, 19 nt, Homo sapiens
gcuauuuaccugaagauug

SEQ ID NO: 29791 - RNA, 19 nt, Homo sapiens
gaaagggucacuuaguucu

SEQ ID NO: 29792 - RNA, 19 nt, Homo sapiens
guugaaccuuuccuugauu

SEQ ID NO: 29793 - RNA, 19 nt, Homo sapiens
uaguuucacugucuucuug

SEQ ID NO: 29794 - RNA, 19 nt, Homo sapiens
ugaguuaguuucacugucu

SEQ ID NO: 29795 - RNA, 19 nt, Homo sapiens
gcaacuuuccuacugcaaa

SEQ ID NO: 29796 - RNA, 19 nt, Homo sapiens
ucaggcaacuuuccuacug

SEQ ID NO: 29797 - RNA, 19 nt, Homo sapiens
ccacugcagucaucaacau

SEQ ID NO: 29798 - RNA, 19 nt, Homo sapiens
cuaaggcgaucaaucucaa

SEQ ID NO: 29799 - RNA, 19 nt, Homo sapiens
gaagagucacaaccaaugu

SEQ ID NO: 29800 - RNA, 19 nt, Homo sapiens
gaacagugccauagaaaau

SEQ ID NO: 29801 - RNA, 19 nt, Homo sapiens
agacaaaccagucggaaug

SEQ ID NO: 29802 - RNA, 19 nt, Homo sapiens
gagcagaaccgaggcaauc

SEQ ID NO: 29803 - RNA, 19 nt, Homo sapiens
ccuauuuccugcaccauug

SEQ ID NO: 29804 - RNA, 19 nt, Homo sapiens
aaauuuagacucucguuga

SEQ ID NO: 29805 - RNA, 19 nt, Homo sapiens
cuugggugcuugcuauuaa

SEQ ID NO: 29806 - RNA, 19 nt, Homo sapiens
gcauagcagauaccauuga

SEQ ID NO: 29807 - RNA, 19 nt, Homo sapiens
caggaaagggccaauguga

SEQ ID NO: 29808 - RNA, 19 nt, Homo sapiens
gcccagccguggaacagaa

SEQ ID NO: 29809 - RNA, 19 nt, Homo sapiens
ggugauccaugucagaagu

SEQ ID NO: 29810 - RNA, 19 nt, Homo sapiens
gacaagcucuuugacacau

SEQ ID NO: 29811 - RNA, 19 nt, Homo sapiens
aagcaaccuuuaaguccua

SEQ ID NO: 29812 - RNA, 19 nt, Homo sapiens
gcacaaagcuguugaauuu

SEQ ID NO: 29813 - RNA, 19 nt, Homo sapiens
cgaaauagcuccucaagua

SEQ ID NO: 29814 - RNA, 19 nt, Homo sapiens
ggaggaaucugcuucauuu

SEQ ID NO: 29815 - RNA, 19 nt, Homo sapiens
gacaagagcuagaagauaa

SEQ ID NO: 29816 - RNA, 19 nt, Homo sapiens
agaaagaccuguauuagua

SEQ ID NO: 29817 - RNA, 19 nt, Homo sapiens
gaaauaggauguaaucaga

SEQ ID NO: 29818 - RNA, 19 nt, Homo sapiens
gaugauacaugcauacaua

SEQ ID NO: 29819 - RNA, 19 nt, Homo sapiens
gaagagagaccaacaaauu

SEQ ID NO: 29820 - RNA, 19 nt, Homo sapiens
gaacauaugucuucaagca

SEQ ID NO: 29821 - RNA, 19 nt, Homo sapiens
gaaaccaacuucaccagua

SEQ ID NO: 29822 - RNA, 19 nt, Homo sapiens
gagaacaacugucuacaaa

SEQ ID NO: 29823 - RNA, 19 nt, Homo sapiens
gagcagauguaaauaguaa

SEQ ID NO: 29824 - RNA, 19 nt, Homo sapiens
ggaaugugcuuuagaaguu

SEQ ID NO: 29825 - RNA, 19 nt, Homo sapiens
caaaucacauggaacuuua

SEQ ID NO: 29826 - RNA, 19 nt, Homo sapiens
gauaauaggucagacaauu

SEQ ID NO: 29827 - RNA, 19 nt, Homo sapiens
guacaaggaugccaauauu

SEQ ID NO: 29828 - RNA, 19 nt, Homo sapiens
caaagacucuguauuguug

SEQ ID NO: 29829 - RNA, 19 nt, Homo sapiens
acagaaagauguggaauua

SEQ ID NO: 29830 - RNA, 19 nt, Homo sapiens
caacaugacuguccuuuca

SEQ ID NO: 29831 - RNA, 19 nt, Homo sapiens
uagaagaacuugagaaaga

SEQ ID NO: 29832 - RNA, 19 nt, Homo sapiens
gggaagugcugcagcuuua

SEQ ID NO: 29833 - RNA, 19 nt, Homo sapiens
gcacuuaucuauuccugaa

SEQ ID NO: 29834 - RNA, 19 nt, Homo sapiens
aaacauagucccagaaaua

SEQ ID NO: 29835 - RNA, 19 nt, Homo sapiens
ggaaaaggcugaauuaaga

SEQ ID NO: 29836 - RNA, 19 nt, Homo sapiens
gcucagcacuuaucagaaa

SEQ ID NO: 29837 - RNA, 19 nt, Homo sapiens
caaauaggccugcgaagua

SEQ ID NO: 29838 - RNA, 19 nt, Homo sapiens
gaaggcaauuggaauauga

SEQ ID NO: 29839 - RNA, 19 nt, Homo sapiens
gaagauaauuccaaucauc

SEQ ID NO: 29840 - RNA, 19 nt, Homo sapiens
ggaaguacuuaaacaacua

SEQ ID NO: 29841 - RNA, 19 nt, Homo sapiens
guacaaguccuguuucuaa

SEQ ID NO: 29842 - RNA, 19 nt, Homo sapiens
gaauauaggacacguguaa

SEQ ID NO: 29843 - RNA, 19 nt, Homo sapiens
gaacaacugucuacaaacu

SEQ ID NO: 29844 - RNA, 19 nt, Homo sapiens
ggucugacaugaacacuuu

SEQ ID NO: 29845 - RNA, 19 nt, Homo sapiens
gaagaucucccacagguaa

SEQ ID NO: 29846 - RNA, 19 nt, Homo sapiens
gaagaggguuuguaaaugg

SEQ ID NO: 29847 - RNA, 19 nt, Homo sapiens
gaacucaaaucuucgacaa

SEQ ID NO: 29848 - RNA, 19 nt, Homo sapiens
ccaaggacuucaaugauaa

SEQ ID NO: 29849 - RNA, 19 nt, Homo sapiens
caagucagcugccugugua

SEQ ID NO: 29850 - RNA, 19 nt, Homo sapiens
uaagcaagcugcaguaaau

SEQ ID NO: 29851 - RNA, 19 nt, Homo sapiens
ucaagaagaugacuaugaa

SEQ ID NO: 29852 - RNA, 19 nt, Homo sapiens
gcaaaguccuucacagaau

SEQ ID NO: 29853 - RNA, 19 nt, Homo sapiens
uaaggaaucucauggcaaa

SEQ ID NO: 29854 - RNA, 19 nt, Homo sapiens
ucaguuagaugguaagaaa

SEQ ID NO: 29855 - RNA, 19 nt, Homo sapiens
ucaagaaccucauucauuc

SEQ ID NO: 29856 - RNA, 19 nt, Homo sapiens
gacaaacacuuuagccauu

SEQ ID NO: 29857 - RNA, 19 nt, Homo sapiens
gauggaaugugcuuuagaa

SEQ ID NO: 29858 - RNA, 19 nt, Homo sapiens
ugacaaagacucuguauug

SEQ ID NO: 29859 - RNA, 19 nt, Homo sapiens
gaaaccggcucacaugaug

SEQ ID NO: 29860 - RNA, 19 nt, Homo sapiens
gugaagaucugacacuuga

SEQ ID NO: 29861 - RNA, 19 nt, Homo sapiens
gaagauagagucagaggaa

SEQ ID NO: 29862 - RNA, 19 nt, Homo sapiens
gcaggaagcucaugaacca

SEQ ID NO: 29863 - RNA, 19 nt, Homo sapiens
guacaaacuucuaccauca

SEQ ID NO: 29864 - RNA, 19 nt, Homo sapiens
ucaguucacuugauaguuu

SEQ ID NO: 29865 - RNA, 19 nt, Homo sapiens
gaagccauauuugauagua

SEQ ID NO: 29866 - RNA, 19 nt, Homo sapiens
uaaagcaccuucuagauca

SEQ ID NO: 29867 - RNA, 19 nt, Homo sapiens
ggaucaccauuucaucuua

SEQ ID NO: 29868 - RNA, 19 nt, Homo sapiens
gauaagcucccaaauaaug

SEQ ID NO: 29869 - RNA, 19 nt, Homo sapiens
augauaagcucccaaauaa

SEQ ID NO: 29870 - RNA, 19 nt, Homo sapiens
gaugauaugucgcgaacuu

SEQ ID NO: 29871 - RNA, 19 nt, Homo sapiens
uaucuucccugauuuguuu

SEQ ID NO: 29872 - RNA, 19 nt, Homo sapiens
gaggcacucuugaugguua

SEQ ID NO: 29873 - RNA, 19 nt, Homo sapiens
ccagucaacuuucaucaaa

SEQ ID NO: 29874 - RNA, 19 nt, Homo sapiens
caaauuaucucaacuucca

SEQ ID NO: 29875 - RNA, 19 nt, Homo sapiens
ugaguuagcugcuggagaa

SEQ ID NO: 29876 - RNA, 19 nt, Homo sapiens
gagaauacguccacaccuu

SEQ ID NO: 29877 - RNA, 19 nt, Homo sapiens
gaagaugacuaugaagaug

SEQ ID NO: 29878 - RNA, 19 nt, Homo sapiens
ugagagcacugaugauaaa

SEQ ID NO: 29879 - RNA, 19 nt, Homo sapiens
ggacauguucuaugccuua

SEQ ID NO: 29880 - RNA, 19 nt, Homo sapiens
gaaaugcacuuagaagaag

SEQ ID NO: 29881 - RNA, 19 nt, Homo sapiens
caacuuauccuguuuauac

SEQ ID NO: 29882 - RNA, 19 nt, Homo sapiens
gaacuagauacaccaauaa

SEQ ID NO: 29883 - RNA, 19 nt, Homo sapiens
gaaugugcuuuagaaguua

SEQ ID NO: 29884 - RNA, 19 nt, Homo sapiens
gaaacugaggcaucuaaua

SEQ ID NO: 29885 - RNA, 19 nt, Homo sapiens
agaagacuguugccacuua

SEQ ID NO: 29886 - RNA, 19 nt, Homo sapiens
gaaaugauucuuugaguuc

SEQ ID NO: 29887 - RNA, 19 nt, Homo sapiens
ccaacaaagucaucacgua

SEQ ID NO: 29888 - RNA, 19 nt, Homo sapiens
ccacagauauuccuucauc

SEQ ID NO: 29889 - RNA, 19 nt, Homo sapiens
caacugcuauauagacauu

SEQ ID NO: 29890 - RNA, 19 nt, Homo sapiens
gcaaagcgccaugauauug

SEQ ID NO: 29891 - RNA, 19 nt, Homo sapiens
ggacuaaaucagaugaaua

SEQ ID NO: 29892 - RNA, 19 nt, Homo sapiens
gcuaauacccugcaaauag

SEQ ID NO: 29893 - RNA, 19 nt, Homo sapiens
gaagauacuccaauauguu

SEQ ID NO: 29894 - RNA, 19 nt, Homo sapiens
uagaaucccugccuguuaa

SEQ ID NO: 29895 - RNA, 19 nt, Homo sapiens
guaauaugguucccgauga

SEQ ID NO: 29896 - RNA, 19 nt, Homo sapiens
gaaauucacaguaauaugg

SEQ ID NO: 29897 - RNA, 19 nt, Homo sapiens
gaugagccauuuauacaga

SEQ ID NO: 29898 - RNA, 19 nt, Homo sapiens
agaacuagauacaccaaua

SEQ ID NO: 29899 - RNA, 19 nt, Homo sapiens
gaaaguaaguuuugcaguu

SEQ ID NO: 29900 - RNA, 19 nt, Homo sapiens
gaauagauagucuuccuuu

SEQ ID NO: 29901 - RNA, 19 nt, Homo sapiens
gcagagaaaguacuggaua

SEQ ID NO: 29902 - RNA, 19 nt, Homo sapiens
gugauuagcucaucuugau

SEQ ID NO: 29903 - RNA, 19 nt, Homo sapiens
gaagacuguugccacuuaa

SEQ ID NO: 29904 - RNA, 19 nt, Homo sapiens
ggucuuaccuugugacauc

SEQ ID NO: 29905 - RNA, 19 nt, Homo sapiens
gaauaaguccuccuaacaa

SEQ ID NO: 29906 - RNA, 19 nt, Homo sapiens
caacaaagucaucacguaa

SEQ ID NO: 29907 - RNA, 19 nt, Homo sapiens
gcaaguggacugugaaaug

SEQ ID NO: 29908 - RNA, 19 nt, Homo sapiens
ucauauacaucuccaggua

SEQ ID NO: 29909 - RNA, 19 nt, Homo sapiens
uguagaagauacuccaaua

SEQ ID NO: 29910 - RNA, 19 nt, Homo sapiens
ccaauuauagugaacguua

SEQ ID NO: 29911 - RNA, 19 nt, Homo sapiens
gcaguuagcaugcucaaga

SEQ ID NO: 29912 - RNA, 19 nt, Homo sapiens
caaagcaacuggauacuag

SEQ ID NO: 29913 - RNA, 19 nt, Homo sapiens
gagaaucuguuacugauca

SEQ ID NO: 29914 - RNA, 19 nt, Homo sapiens
gauaaugagcuacuaguuu

SEQ ID NO: 29915 - RNA, 19 nt, Homo sapiens
gaggauaugucaucaucaa

SEQ ID NO: 29916 - RNA, 19 nt, Homo sapiens
agaaagaguuggagaguau

SEQ ID NO: 29917 - RNA, 19 nt, Homo sapiens
cuacagaacuuuaccuugu

SEQ ID NO: 29918 - RNA, 19 nt, Homo sapiens
ggucacugcuucugcuaua

SEQ ID NO: 29919 - RNA, 19 nt, Homo sapiens
gaaaucagaggauauguca

SEQ ID NO: 29920 - RNA, 19 nt, Homo sapiens
ggcaggcucugaacuauga

SEQ ID NO: 29921 - RNA, 19 nt, Homo sapiens
cuguaugucugccuaauua

SEQ ID NO: 29922 - RNA, 19 nt, Homo sapiens
uaagagaucuggucaaagc

SEQ ID NO: 29923 - RNA, 19 nt, Homo sapiens
ugaaaugacugucuaagag

SEQ ID NO: 29924 - RNA, 19 nt, Homo sapiens
ggagaagccucuacagaac

SEQ ID NO: 29925 - RNA, 19 nt, Homo sapiens
gcucugaacuaugaaauca

SEQ ID NO: 29926 - RNA, 19 nt, Homo sapiens
acacaaaguuacauccaaa

SEQ ID NO: 29927 - RNA, 19 nt, Homo sapiens
gaaaugacugucuaagaga

SEQ ID NO: 29928 - RNA, 19 nt, Homo sapiens
ucuaagagaucuggucaaa

SEQ ID NO: 29929 - RNA, 19 nt, Homo sapiens
gugggaagguguuuguauu

SEQ ID NO: 29930 - RNA, 19 nt, Homo sapiens
cgagagcacuugaaaauga

SEQ ID NO: 29931 - RNA, 19 nt, Homo sapiens
cagaggauaugucaucauc

SEQ ID NO: 29932 - RNA, 19 nt, Homo sapiens
uagagaaucuguuacugau

SEQ ID NO: 29933 - RNA, 19 nt, Homo sapiens
ucuuacaucugcagucuuu

SEQ ID NO: 29934 - RNA, 19 nt, Homo sapiens
gcaacuggauacuagaucu

SEQ ID NO: 29935 - RNA, 19 nt, Homo sapiens
gacacaaaguuacauccaa

SEQ ID NO: 29936 - RNA, 19 nt, Homo sapiens
caaaguuacauccaaaguu

SEQ ID NO: 29937 - RNA, 19 nt, Homo sapiens
gggaagguguuuguauuuc

SEQ ID NO: 29938 - RNA, 19 nt, Homo sapiens
gaucuuacaucugcagucu

SEQ ID NO: 29939 - RNA, 19 nt, Homo sapiens
guauuaugcuaccugcaaa

SEQ ID NO: 29940 - RNA, 19 nt, Homo sapiens
gaagcucagcccaagauug

SEQ ID NO: 29941 - RNA, 19 nt, Homo sapiens
gaaagaguuggagaguaua

SEQ ID NO: 29942 - RNA, 19 nt, Homo sapiens
aagaaagaguuggagagua

SEQ ID NO: 29943 - RNA, 19 nt, Homo sapiens
ucugcagucuuucuucuuu

SEQ ID NO: 29944 - RNA, 19 nt, Homo sapiens
ggucaaagcaacuggauac

SEQ ID NO: 29945 - RNA, 19 nt, Homo sapiens
ggauaaugagcuacuaguu

SEQ ID NO: 29946 - RNA, 19 nt, Homo sapiens
uggagaagccucuacagaa

SEQ ID NO: 29947 - RNA, 19 nt, Homo sapiens
gcgacaggguuacuuugug

SEQ ID NO: 29948 - RNA, 19 nt, Homo sapiens
acuaugaaaucagaggaua

SEQ ID NO: 29949 - RNA, 19 nt, Homo sapiens
ggaagccuuugcucacaca

SEQ ID NO: 29950 - RNA, 19 nt, Homo sapiens
cuagagaaucuguuacuga

SEQ ID NO: 29951 - RNA, 19 nt, Homo sapiens
ugaauuuccuaucuguaug

SEQ ID NO: 29952 - RNA, 19 nt, Homo sapiens
ucaaagcaacuggauacua

SEQ ID NO: 29953 - RNA, 19 nt, Homo sapiens
gaagacacaaaguuacauc

SEQ ID NO: 29954 - RNA, 19 nt, Homo sapiens
ccuacagccucuucuccua

SEQ ID NO: 29955 - RNA, 19 nt, Homo sapiens
gagcuacuaguuuauaaag

SEQ ID NO: 29956 - RNA, 19 nt, Homo sapiens
guaugucugccuaauuaaa

SEQ ID NO: 29957 - RNA, 19 nt, Homo sapiens
ugggaguccucaucaggua

SEQ ID NO: 29958 - RNA, 19 nt, Homo sapiens
ccaaaguuaucgaaaaguu

SEQ ID NO: 29959 - RNA, 19 nt, Homo sapiens
gaauuuccuaucuguaugu

SEQ ID NO: 29960 - RNA, 19 nt, Homo sapiens
gagcugggaguccucauca

SEQ ID NO: 29961 - RNA, 19 nt, Homo sapiens
aggcagggauaaugagcua

SEQ ID NO: 29962 - RNA, 19 nt, Homo sapiens
agaagccucuacagaacuu

SEQ ID NO: 29963 - RNA, 19 nt, Homo sapiens
ggaguccucaucagguauu

SEQ ID NO: 29964 - RNA, 19 nt, Homo sapiens
gaagguguuuguauuuccu

SEQ ID NO: 29965 - RNA, 19 nt, Homo sapiens
guuuguauuuccuagagaa

SEQ ID NO: 29966 - RNA, 19 nt, Homo sapiens
gccacuguguugucugcua

SEQ ID NO: 29967 - RNA, 19 nt, Homo sapiens
ggauaugucaucaucaaac

SEQ ID NO: 29968 - RNA, 19 nt, Homo sapiens
ggaucaaugggacaccuuu

SEQ ID NO: 29969 - RNA, 19 nt, Homo sapiens
aaaugacugucuaagagau

SEQ ID NO: 29970 - RNA, 19 nt, Homo sapiens
cauccaaaguuaucgaaaa

SEQ ID NO: 29971 - RNA, 19 nt, Homo sapiens
aaucagaggauaugucauc

SEQ ID NO: 29972 - RNA, 19 nt, Homo sapiens
caucugcagucuuucuucu

SEQ ID NO: 29973 - RNA, 19 nt, Homo sapiens
aagcucagcccaagauugu

SEQ ID NO: 29974 - RNA, 19 nt, Homo sapiens
gaacuuuaccuuguguuuu

SEQ ID NO: 29975 - RNA, 19 nt, Homo sapiens
gauaugucaucaucaaacc

SEQ ID NO: 29976 - RNA, 19 nt, Homo sapiens
gaucaaugggacaccuuug

SEQ ID NO: 29977 - RNA, 19 nt, Homo sapiens
auuggaagacacaaaguua

SEQ ID NO: 29978 - RNA, 19 nt, Homo sapiens
ugggaagguguuuguauuu

SEQ ID NO: 29979 - RNA, 19 nt, Homo sapiens
uacagaacuuuaccuugug

SEQ ID NO: 29980 - RNA, 19 nt, Homo sapiens
gagagcacuugaaaaugaa

SEQ ID NO: 29981 - RNA, 19 nt, Homo sapiens
acagaacuuuaccuugugu

SEQ ID NO: 29982 - RNA, 19 nt, Homo sapiens
gaaaaugaaaugacugucu

SEQ ID NO: 29983 - RNA, 19 nt, Homo sapiens
uaugaaaucagaggauaug

SEQ ID NO: 29984 - RNA, 19 nt, Homo sapiens
ugcagucuuucuucuuuga

SEQ ID NO: 29985 - RNA, 19 nt, Homo sapiens
caacuggauacuagaucuu

SEQ ID NO: 29986 - RNA, 19 nt, Homo sapiens
ggaagcucagcccaagauu

SEQ ID NO: 29987 - RNA, 19 nt, Homo sapiens
uuuccuagagaaucuguua

SEQ ID NO: 29988 - RNA, 19 nt, Homo sapiens
ggaagacacaaaguuacau

SEQ ID NO: 29989 - RNA, 19 nt, Homo sapiens
aaagaaagaguuggagagu

SEQ ID NO: 29990 - RNA, 19 nt, Homo sapiens
cagggauaaugagcuacua

SEQ ID NO: 29991 - RNA, 19 nt, Homo sapiens
agccucuucuccuacaaua

SEQ ID NO: 29992 - RNA, 19 nt, Homo sapiens
agaacuuuaccuuguguuu

SEQ ID NO: 29993 - RNA, 19 nt, Homo sapiens
gaucacaccgcuggagaag

SEQ ID NO: 29994 - RNA, 19 nt, Homo sapiens
uguauuuccuagagaaucu

SEQ ID NO: 29995 - RNA, 19 nt, Homo sapiens
uguauuaugcuaccugcaa

SEQ ID NO: 29996 - RNA, 19 nt, Homo sapiens
cagucuuucuucuuugaau

SEQ ID NO: 29997 - RNA, 19 nt, Homo sapiens
gucacugcuucugcuauaa

SEQ ID NO: 29998 - RNA, 19 nt, Homo sapiens
gugugggucugaggucuug

SEQ ID NO: 29999 - RNA, 19 nt, Homo sapiens
cauuggaagacacaaaguu

SEQ ID NO: 30000 - RNA, 19 nt, Homo sapiens
gagaagccucuacagaacu

SEQ ID NO: 30001 - RNA, 19 nt, Homo sapiens
ugaaaucagaggauauguc

SEQ ID NO: 30002 - RNA, 19 nt, Homo sapiens
gggauaaugagcuacuagu

SEQ ID NO: 30003 - RNA, 19 nt, Homo sapiens
ccuagagaaucuguuacug

SEQ ID NO: 30004 - RNA, 19 nt, Homo sapiens
guguuuguauuuccuagag

SEQ ID NO: 30005 - RNA, 19 nt, Homo sapiens
cccaaggcagggauaauga

SEQ ID NO: 30006 - RNA, 19 nt, Homo sapiens
ggagggugcuguucaagga

SEQ ID NO: 30007 - RNA, 19 nt, Homo sapiens
ucaugugccuggaaauuaa

SEQ ID NO: 30008 - RNA, 19 nt, Homo sapiens
ggacgagugugccgugugu

SEQ ID NO: 30009 - RNA, 19 nt, Homo sapiens
ccacuucucuacucuggaa

SEQ ID NO: 30010 - RNA, 19 nt, Homo sapiens
ggacaugcagcucugauga

SEQ ID NO: 30011 - RNA, 19 nt, Homo sapiens
gaugagagagugcugagaa

SEQ ID NO: 30012 - RNA, 19 nt, Homo sapiens
gaccuggagucccuucuga

SEQ ID NO: 30013 - RNA, 19 nt, Homo sapiens
ggacagcgccaccucuugu

SEQ ID NO: 30014 - RNA, 19 nt, Homo sapiens
ccacagccauccuggacuu

SEQ ID NO: 30015 - RNA, 19 nt, Homo sapiens
ggaacgggauucagaccau

SEQ ID NO: 30016 - RNA, 19 nt, Homo sapiens
gaagaaugaggacgagugu

SEQ ID NO: 30017 - RNA, 19 nt, Homo sapiens
ggacaccuccuuccucagu

SEQ ID NO: 30018 - RNA, 19 nt, Homo sapiens
ugucagugcucggcuguaa

SEQ ID NO: 30019 - RNA, 19 nt, Homo sapiens
caggagacgcuucaucuga

SEQ ID NO: 30020 - RNA, 19 nt, Homo sapiens
gccaucaugugccuggaaa

SEQ ID NO: 30021 - RNA, 19 nt, Homo sapiens
gagagagugcugagaagga

SEQ ID NO: 30022 - RNA, 19 nt, Homo sapiens
gcaugagaaucacuugaac

SEQ ID NO: 30023 - RNA, 19 nt, Homo sapiens
ggcaugagaaucacuugaa

SEQ ID NO: 30024 - RNA, 19 nt, Homo sapiens
gguggugggugccuguaau

SEQ ID NO: 30025 - RNA, 19 nt, Homo sapiens
ggacaccagccaucaugug

SEQ ID NO: 30026 - RNA, 19 nt, Homo sapiens
caucaugugccuggaaauu

SEQ ID NO: 30027 - RNA, 19 nt, Homo sapiens
caagaagugcauccagguu

SEQ ID NO: 30028 - RNA, 19 nt, Homo sapiens
ucaggcggcuccaagaagu

SEQ ID NO: 30029 - RNA, 19 nt, Homo sapiens
acaugcagcucugaugaga

SEQ ID NO: 30030 - RNA, 19 nt, Homo sapiens
gcauggacacgacucuugu

SEQ ID NO: 30031 - RNA, 19 nt, Homo sapiens
uuuaucaucucgaccacuu

SEQ ID NO: 30032 - RNA, 19 nt, Homo sapiens
ggcauggacacgacucuug

SEQ ID NO: 30033 - RNA, 19 nt, Homo sapiens
cuccuugccuggugaccua

SEQ ID NO: 30034 - RNA, 19 nt, Homo sapiens
gugcugcgguguacucacu

SEQ ID NO: 30035 - RNA, 19 nt, Homo sapiens
agagagcuguggccauguc

SEQ ID NO: 30036 - RNA, 19 nt, Homo sapiens
cccaggcucucaacugaag

SEQ ID NO: 30037 - RNA, 19 nt, Homo sapiens
ucuggagggugcuguucaa

SEQ ID NO: 30038 - RNA, 19 nt, Homo sapiens
ucaguggcauucacaucuc

SEQ ID NO: 30039 - RNA, 19 nt, Homo sapiens
ucauccagcagguguuuga

SEQ ID NO: 30040 - RNA, 19 nt, Homo sapiens
ggaaugccaugcucaucuu

SEQ ID NO: 30041 - RNA, 19 nt, Homo sapiens
ucaugugccuggaaauuaa

SEQ ID NO: 30042 - RNA, 19 nt, Homo sapiens
ggacgagugugccgugugu

SEQ ID NO: 30043 - RNA, 19 nt, Homo sapiens
ccacuucucuacucuggaa

SEQ ID NO: 30044 - RNA, 19 nt, Homo sapiens
ggacaugcagcucugauga

SEQ ID NO: 30045 - RNA, 19 nt, Homo sapiens
gaugagagagugcugagaa

SEQ ID NO: 30046 - RNA, 19 nt, Homo sapiens
cagcaugguuucuuaaugg

SEQ ID NO: 30047 - RNA, 19 nt, Homo sapiens
gaccuggagucccuucuga

SEQ ID NO: 30048 - RNA, 19 nt, Homo sapiens
ggacagcgccaccucuugu

SEQ ID NO: 30049 - RNA, 19 nt, Homo sapiens
gaagaaugaggacgagugu

SEQ ID NO: 30050 - RNA, 19 nt, Homo sapiens
ggacaccuccuuccucagu

SEQ ID NO: 30051 - RNA, 19 nt, Homo sapiens
ugucagugcucggcuguaa

SEQ ID NO: 30052 - RNA, 19 nt, Homo sapiens
ccagcaugguuucuuaaug

SEQ ID NO: 30053 - RNA, 19 nt, Homo sapiens
ggucuucucaggcucuuaa

SEQ ID NO: 30054 - RNA, 19 nt, Homo sapiens
gccaucaugugccuggaaa

SEQ ID NO: 30055 - RNA, 19 nt, Homo sapiens
gagagagugcugagaagga

SEQ ID NO: 30056 - RNA, 19 nt, Homo sapiens
gaguucagguacccagaga

SEQ ID NO: 30057 - RNA, 19 nt, Homo sapiens
ggacaccagccaucaugug

SEQ ID NO: 30058 - RNA, 19 nt, Homo sapiens
caucaugugccuggaaauu

SEQ ID NO: 30059 - RNA, 19 nt, Homo sapiens
gguggucagggcagaauuu

SEQ ID NO: 30060 - RNA, 19 nt, Homo sapiens
aggaaggguucaugugguu

SEQ ID NO: 30061 - RNA, 19 nt, Homo sapiens
agaagcaggucgggagaga

SEQ ID NO: 30062 - RNA, 19 nt, Homo sapiens
acaugcagcucugaugaga

SEQ ID NO: 30063 - RNA, 19 nt, Homo sapiens
gcauggacacgacucuugu

SEQ ID NO: 30064 - RNA, 19 nt, Homo sapiens
ucaaggauccacugggaau

SEQ ID NO: 30065 - RNA, 19 nt, Homo sapiens
gaaugccaugcucaucuuu

SEQ ID NO: 30066 - RNA, 19 nt, Homo sapiens
gggaaugccaugcucaucu

SEQ ID NO: 30067 - RNA, 19 nt, Homo sapiens
guucagguacccagagaug

SEQ ID NO: 30068 - RNA, 19 nt, Homo sapiens
uuaagagcauggcguuugg

SEQ ID NO: 30069 - RNA, 19 nt, Homo sapiens
ggcauggacacgacucuug

SEQ ID NO: 30070 - RNA, 19 nt, Homo sapiens
cuccuugccuggugaccua

SEQ ID NO: 30071 - RNA, 19 nt, Homo sapiens
gugcugcgguguacucacu

SEQ ID NO: 30072 - RNA, 19 nt, Homo sapiens
ucucuugccugugccagaa

SEQ ID NO: 30073 - RNA, 19 nt, Homo sapiens
ggucagggcagaauuucag

SEQ ID NO: 30074 - RNA, 19 nt, Homo sapiens
cuuaagagcauggcguuug

SEQ ID NO: 30075 - RNA, 19 nt, Homo sapiens
gcuauagccaggaggucaa

SEQ ID NO: 30076 - RNA, 19 nt, Homo sapiens
ugugguugguguacaguuc

SEQ ID NO: 30077 - RNA, 19 nt, Homo sapiens
ggaaugccaugcucaucuu

SEQ ID NO: 30078 - RNA, 19 nt, Homo sapiens
ucaugugccuggaaauuaa

SEQ ID NO: 30079 - RNA, 19 nt, Homo sapiens
ggacgagugugccgugugu

SEQ ID NO: 30080 - RNA, 19 nt, Homo sapiens
ccacuucucuacucuggaa

SEQ ID NO: 30081 - RNA, 19 nt, Homo sapiens
ggacaugcagcucugauga

SEQ ID NO: 30082 - RNA, 19 nt, Homo sapiens
gaugagagagugcugagaa

SEQ ID NO: 30083 - RNA, 19 nt, Homo sapiens
cagcaugguuucuuaaugg

SEQ ID NO: 30084 - RNA, 19 nt, Homo sapiens
gaccuggagucccuucuga

SEQ ID NO: 30085 - RNA, 19 nt, Homo sapiens
ggacagcgccaccucuugu

SEQ ID NO: 30086 - RNA, 19 nt, Homo sapiens
gaagaaugaggacgagugu

SEQ ID NO: 30087 - RNA, 19 nt, Homo sapiens
ggacaccuccuuccucagu

SEQ ID NO: 30088 - RNA, 19 nt, Homo sapiens
ugucagugcucggcuguaa

SEQ ID NO: 30089 - RNA, 19 nt, Homo sapiens
ccagcaugguuucuuaaug

SEQ ID NO: 30090 - RNA, 19 nt, Homo sapiens
ggucuucucaggcucuuaa

SEQ ID NO: 30091 - RNA, 19 nt, Homo sapiens
gccaucaugugccuggaaa

SEQ ID NO: 30092 - RNA, 19 nt, Homo sapiens
gagagagugcugagaagga

SEQ ID NO: 30093 - RNA, 19 nt, Homo sapiens
gaguucagguacccagaga

SEQ ID NO: 30094 - RNA, 19 nt, Homo sapiens
ggacaccagccaucaugug

SEQ ID NO: 30095 - RNA, 19 nt, Homo sapiens
caucaugugccuggaaauu

SEQ ID NO: 30096 - RNA, 19 nt, Homo sapiens
gguggucagggcagaauuu

SEQ ID NO: 30097 - RNA, 19 nt, Homo sapiens
aggaaggguucaugugguu

SEQ ID NO: 30098 - RNA, 19 nt, Homo sapiens
agaagcaggucgggagaga

SEQ ID NO: 30099 - RNA, 19 nt, Homo sapiens
acaugcagcucugaugaga

SEQ ID NO: 30100 - RNA, 19 nt, Homo sapiens
ucaaggauccacugggaau

SEQ ID NO: 30101 - RNA, 19 nt, Homo sapiens
gaaugccaugcucaucuuu

SEQ ID NO: 30102 - RNA, 19 nt, Homo sapiens
gggaaugccaugcucaucu

SEQ ID NO: 30103 - RNA, 19 nt, Homo sapiens
guucagguacccagagaug

SEQ ID NO: 30104 - RNA, 19 nt, Homo sapiens
uuaagagcauggcguuugg

SEQ ID NO: 30105 - RNA, 19 nt, Homo sapiens
cuccuugccuggugaccua

SEQ ID NO: 30106 - RNA, 19 nt, Homo sapiens
gugcugcgguguacucacu

SEQ ID NO: 30107 - RNA, 19 nt, Homo sapiens
ucucuugccugugccagaa

SEQ ID NO: 30108 - RNA, 19 nt, Homo sapiens
ggucagggcagaauuucag

SEQ ID NO: 30109 - RNA, 19 nt, Homo sapiens
cuuaagagcauggcguuug

SEQ ID NO: 30110 - RNA, 19 nt, Homo sapiens
gcuauagccaggaggucaa

SEQ ID NO: 30111 - RNA, 19 nt, Homo sapiens
ugugguugguguacaguuc

SEQ ID NO: 30112 - RNA, 19 nt, Homo sapiens
ggaaguugcucacaauuga

SEQ ID NO: 30113 - RNA, 19 nt, Homo sapiens
caacgguccucacccauua

SEQ ID NO: 30114 - RNA, 19 nt, Homo sapiens
ggucagcccuguauuaugu

SEQ ID NO: 30115 - RNA, 19 nt, Homo sapiens
ucagacagcuucaugaaug

SEQ ID NO: 30116 - RNA, 19 nt, Homo sapiens
acaaaucgcccaucagaua

SEQ ID NO: 30117 - RNA, 19 nt, Homo sapiens
ggacaaaucgcccaucaga

SEQ ID NO: 30118 - RNA, 19 nt, Homo sapiens
gaacuucucugggaucuac

SEQ ID NO: 30119 - RNA, 19 nt, Homo sapiens
gcaagagaaugugcaguau

SEQ ID NO: 30120 - RNA, 19 nt, Homo sapiens
ggaaggagcagucaguguu

SEQ ID NO: 30121 - RNA, 19 nt, Homo sapiens
gggcugagaugcuggacaa

SEQ ID NO: 30122 - RNA, 19 nt, Homo sapiens
caaaagcacccacgcauua

SEQ ID NO: 30123 - RNA, 19 nt, Homo sapiens
gaggcuggcuuuccuuuca

SEQ ID NO: 30124 - RNA, 19 nt, Homo sapiens
gagacacacuuguuguaug

SEQ ID NO: 30125 - RNA, 19 nt, Homo sapiens
ugugaaggauguccaguuu

SEQ ID NO: 30126 - RNA, 19 nt, Homo sapiens
gaggaacacuuugaugcaa

SEQ ID NO: 30127 - RNA, 19 nt, Homo sapiens
ugccagcgaugaugagaua

SEQ ID NO: 30128 - RNA, 19 nt, Homo sapiens
ugucagcgcuggagaaaca

SEQ ID NO: 30129 - RNA, 19 nt, Homo sapiens
gcagagaggagacuaugga

SEQ ID NO: 30130 - RNA, 19 nt, Homo sapiens
caacaucucugugcuugag

SEQ ID NO: 30131 - RNA, 19 nt, Homo sapiens
gggaucaguuuguguuuua

SEQ ID NO: 30132 - RNA, 19 nt, Homo sapiens
gcagaggaaugugggcuau

SEQ ID NO: 30133 - RNA, 19 nt, Homo sapiens
gcuggaaguugcucacaau

SEQ ID NO: 30134 - RNA, 19 nt, Homo sapiens
agacacacuuguuguaugu

SEQ ID NO: 30135 - RNA, 19 nt, Homo sapiens
gaaggagcagucaguguug

SEQ ID NO: 30136 - RNA, 19 nt, Homo sapiens
gccagagaguggucuuuga

SEQ ID NO: 30137 - RNA, 19 nt, Homo sapiens
gccaauaccugguguucca

SEQ ID NO: 30138 - RNA, 19 nt, Homo sapiens
gcauggagaacauucgauu

SEQ ID NO: 30139 - RNA, 19 nt, Homo sapiens
gcccugccauucugcauga

SEQ ID NO: 30140 - RNA, 19 nt, Homo sapiens
agcagggcauggaguauua

SEQ ID NO: 30141 - RNA, 19 nt, Homo sapiens
gaaugugggcuauguaguc

SEQ ID NO: 30142 - RNA, 19 nt, Homo sapiens
ggagacacacuuguuguau

SEQ ID NO: 30143 - RNA, 19 nt, Homo sapiens
gaacgcauggagaacauuc

SEQ ID NO: 30144 - RNA, 19 nt, Homo sapiens
ugaaggauguccaguuugc

SEQ ID NO: 30145 - RNA, 19 nt, Homo sapiens
uuaugaggaugacugcuuu

SEQ ID NO: 30146 - RNA, 19 nt, Homo sapiens
gaagacaccacuguuacug

SEQ ID NO: 30147 - RNA, 19 nt, Homo sapiens
gggcuuugcgguacuacua

SEQ ID NO: 30148 - RNA, 19 nt, Homo sapiens
gcaguaugcuggccuugac

SEQ ID NO: 30149 - RNA, 19 nt, Homo sapiens
ggagucagacagcuucaug

SEQ ID NO: 30150 - RNA, 19 nt, Homo sapiens
guaagaggcccaggacuca

SEQ ID NO: 30151 - RNA, 19 nt, Homo sapiens
gccgaguccuucuuucaga

SEQ ID NO: 30152 - RNA, 19 nt, Homo sapiens
ucaagcagggcauggagua

SEQ ID NO: 30153 - RNA, 19 nt, Homo sapiens
ggaggaacacuuugaugca

SEQ ID NO: 30154 - RNA, 19 nt, Homo sapiens
agacaccacuguuacugau

SEQ ID NO: 30155 - RNA, 19 nt, Homo sapiens
ccacuugauuggucaguac

SEQ ID NO: 30156 - RNA, 19 nt, Homo sapiens
gaugggcuuugcgguacua

SEQ ID NO: 30157 - RNA, 19 nt, Homo sapiens
ccucaguggugguagaugu

SEQ ID NO: 30158 - RNA, 19 nt, Homo sapiens
aagagaaugugcaguaugc

SEQ ID NO: 30159 - RNA, 19 nt, Homo sapiens
gcaguacccaucucugauc

SEQ ID NO: 30160 - RNA, 19 nt, Homo sapiens
agaggaaugugggcuaugu

SEQ ID NO: 30161 - RNA, 19 nt, Homo sapiens
cugagaugcuggacaaauc

SEQ ID NO: 30162 - RNA, 19 nt, Homo sapiens
ggccuugacuuugaagcaa

SEQ ID NO: 30163 - RNA, 19 nt, Homo sapiens
caagagaaugugcaguaug

SEQ ID NO: 30164 - RNA, 19 nt, Homo sapiens
gcacucggagacacacuug

SEQ ID NO: 30165 - RNA, 19 nt, Homo sapiens
acaccacuguuacugaugu

SEQ ID NO: 30166 - RNA, 19 nt, Homo sapiens
uggcagcccuccagauaag

SEQ ID NO: 30167 - RNA, 19 nt, Homo sapiens
gcugagcccagaccaaugu

SEQ ID NO: 30168 - RNA, 19 nt, Homo sapiens
gugagcuccucucggauga

SEQ ID NO: 30169 - RNA, 19 nt, Homo sapiens
gaggaaugugggcuaugua

SEQ ID NO: 30170 - RNA, 19 nt, Homo sapiens
ccaacgguccucacccauu

SEQ ID NO: 30171 - RNA, 19 nt, Homo sapiens
augcuggccuugacuuuga

SEQ ID NO: 30172 - RNA, 19 nt, Homo sapiens
cagcugaagcccugccauu

SEQ ID NO: 30173 - RNA, 19 nt, Homo sapiens
cggagacacacuuguugua

SEQ ID NO: 30174 - RNA, 19 nt, Homo sapiens
gugccacacuucgcucuug

SEQ ID NO: 30175 - RNA, 19 nt, Homo sapiens
gcacccacgcauuaucaga

SEQ ID NO: 30176 - RNA, 19 nt, Homo sapiens
guauuaccgugcccucaag

SEQ ID NO: 30177 - RNA, 19 nt, Homo sapiens
ccucaugguggcacaguuu

SEQ ID NO: 30178 - RNA, 19 nt, Homo sapiens
gugccuguaugacugguau

SEQ ID NO: 30179 - RNA, 19 nt, Homo sapiens
cagggcagcaggaggcuuu

SEQ ID NO: 30180 - RNA, 19 nt, Homo sapiens
ccaccaggaugugaaggau

SEQ ID NO: 30181 - RNA, 19 nt, Homo sapiens
agcaagagaaugugcagua

SEQ ID NO: 30182 - RNA, 19 nt, Homo sapiens
auacaucccucaggugaag

SEQ ID NO: 30183 - RNA, 19 nt, Homo sapiens
gccacuugauuggucagua

SEQ ID NO: 30184 - RNA, 19 nt, Homo sapiens
uguuguauguggcagagaa

SEQ ID NO: 30185 - RNA, 19 nt, Homo sapiens
cugaagcccugccauucug

SEQ ID NO: 30186 - RNA, 19 nt, Homo sapiens
gcugaagcccugccauucu

SEQ ID NO: 30187 - RNA, 19 nt, Homo sapiens
caaaucgcccaucagauac

SEQ ID NO: 30188 - RNA, 19 nt, Homo sapiens
gcugagaugcuggacaaau

SEQ ID NO: 30189 - RNA, 19 nt, Homo sapiens
cagccaugcuuugcaagau

SEQ ID NO: 30190 - RNA, 19 nt, Homo sapiens
caagagcuucaaccuguca

SEQ ID NO: 30191 - RNA, 19 nt, Homo sapiens
gauacaucccucaggugaa

SEQ ID NO: 30192 - RNA, 19 nt, Homo sapiens
gucaguacccagagaccua

SEQ ID NO: 30193 - RNA, 19 nt, Homo sapiens
caugguggcuucauuuccu

SEQ ID NO: 30194 - RNA, 19 nt, Homo sapiens
ggaaugugggcuauguagu

SEQ ID NO: 30195 - RNA, 19 nt, Homo sapiens
gagucagacagcuucauga

SEQ ID NO: 30196 - RNA, 19 nt, Homo sapiens
gugaagacaccacuguuac

SEQ ID NO: 30197 - RNA, 19 nt, Homo sapiens
uggaaguugcucacaauug

SEQ ID NO: 30198 - RNA, 19 nt, Homo sapiens
agaagaaccggaagcucaa

SEQ ID NO: 30199 - RNA, 19 nt, Homo sapiens
gagaugcuggugugguguu

SEQ ID NO: 30200 - RNA, 19 nt, Homo sapiens
aaugugggcuauguaguca

SEQ ID NO: 30201 - RNA, 19 nt, Homo sapiens
cuggacaaaucgcccauca

SEQ ID NO: 30202 - RNA, 19 nt, Homo sapiens
gguggaggcuggcuuuccu

SEQ ID NO: 30203 - RNA, 19 nt, Homo sapiens
guaugcuggccuugacuuu

SEQ ID NO: 30204 - RNA, 19 nt, Homo sapiens
gggaaggagcagucagugu

SEQ ID NO: 30205 - RNA, 19 nt, Homo sapiens
gagcuccucucggaugacu

SEQ ID NO: 30206 - RNA, 19 nt, Homo sapiens
uguauuauguggaccucau

SEQ ID NO: 30207 - RNA, 19 nt, Homo sapiens
cuucauuuccugccacuug

SEQ ID NO: 30208 - RNA, 19 nt, Homo sapiens
accaggaugugaaggaugu

SEQ ID NO: 30209 - RNA, 19 nt, Homo sapiens
acacccagccuaccuccaa

SEQ ID NO: 30210 - RNA, 19 nt, Homo sapiens
gcaacaucucugugcuuga

SEQ ID NO: 30211 - RNA, 19 nt, Homo sapiens
agguggagguggagucaga

SEQ ID NO: 30212 - RNA, 19 nt, Homo sapiens
gaacaaagacuacuaauga

SEQ ID NO: 30213 - RNA, 19 nt, Homo sapiens
caacuaccauuccuucuuu

SEQ ID NO: 30214 - RNA, 19 nt, Homo sapiens
caaaguuucuuacggcaua

SEQ ID NO: 30215 - RNA, 19 nt, Homo sapiens
ggacuuauaugaugaaugc

SEQ ID NO: 30216 - RNA, 19 nt, Homo sapiens
gagccuggauuaagaagaa

SEQ ID NO: 30217 - RNA, 19 nt, Homo sapiens
gggcagaucucgcgaguag

SEQ ID NO: 30218 - RNA, 19 nt, Homo sapiens
ggaagaagccccagauaua

SEQ ID NO: 30219 - RNA, 19 nt, Homo sapiens
gaagaaaggauuagauugg

SEQ ID NO: 30220 - RNA, 19 nt, Homo sapiens
gggaugagcucaggacaga

SEQ ID NO: 30221 - RNA, 19 nt, Homo sapiens
gcgcugggaugaagccuuu

SEQ ID NO: 30222 - RNA, 19 nt, Homo sapiens
gaugaagccuuucgcaagu

SEQ ID NO: 30223 - RNA, 19 nt, Homo sapiens
aaagagccauaguuucaaa

SEQ ID NO: 30224 - RNA, 19 nt, Homo sapiens
gaacaaacuaccagcugaa

SEQ ID NO: 30225 - RNA, 19 nt, Homo sapiens
gagucaggacccuuaauua

SEQ ID NO: 30226 - RNA, 19 nt, Homo sapiens
gagaccaaauguucagaga

SEQ ID NO: 30227 - RNA, 19 nt, Homo sapiens
gauauacugugccuucaag

SEQ ID NO: 30228 - RNA, 19 nt, Homo sapiens
ggauuaagaagaaaggauu

SEQ ID NO: 30229 - RNA, 19 nt, Homo sapiens
gaucugcucuuggaaugug

SEQ ID NO: 30230 - RNA, 19 nt, Homo sapiens
caaacuaccagcugaacuu

SEQ ID NO: 30231 - RNA, 19 nt, Homo sapiens
auaaagagccauaguuuca

SEQ ID NO: 30232 - RNA, 19 nt, Homo sapiens
gaacggcaagcuugaguca

SEQ ID NO: 30233 - RNA, 19 nt, Homo sapiens
caaagacuacuaaugacuu

SEQ ID NO: 30234 - RNA, 19 nt, Homo sapiens
uaacagcauauguaccuaa

SEQ ID NO: 30235 - RNA, 19 nt, Homo sapiens
uagauuggguaaaggaaga

SEQ ID NO: 30236 - RNA, 19 nt, Homo sapiens
cuucgagccuggauuaaga

SEQ ID NO: 30237 - RNA, 19 nt, Homo sapiens
ucuguuaccugcauugugu

SEQ ID NO: 30238 - RNA, 19 nt, Homo sapiens
agucaggacccuuaauuaa

SEQ ID NO: 30239 - RNA, 19 nt, Homo sapiens
ggagcugccuggacucucu

SEQ ID NO: 30240 - RNA, 19 nt, Homo sapiens
gauuguggcugaauuugac

SEQ ID NO: 30241 - RNA, 19 nt, Homo sapiens
ugaggagcaugaucaggaa

SEQ ID NO: 30242 - RNA, 19 nt, Homo sapiens
gcauucuauuucucaugua

SEQ ID NO: 30243 - RNA, 19 nt, Homo sapiens
ggucagcuccuucggacaa

SEQ ID NO: 30244 - RNA, 19 nt, Homo sapiens
gcgaugaggagcaugauca

SEQ ID NO: 30245 - RNA, 19 nt, Homo sapiens
gaauguggaugggcuucga

SEQ ID NO: 30246 - RNA, 19 nt, Homo sapiens
ccuggacucucucaucaau

SEQ ID NO: 30247 - RNA, 19 nt, Homo sapiens
ccagaggccaagaagagua

SEQ ID NO: 30248 - RNA, 19 nt, Homo sapiens
ugagucaggacccuuaauu

SEQ ID NO: 30249 - RNA, 19 nt, Homo sapiens
cuacuaaugacuuuguuug

SEQ ID NO: 30250 - RNA, 19 nt, Homo sapiens
gauacgggguugcucuuuu

SEQ ID NO: 30251 - RNA, 19 nt, Homo sapiens
ugaacaaagacuacuaaug

SEQ ID NO: 30252 - RNA, 19 nt, Homo sapiens
guaacagcauauguaccua

SEQ ID NO: 30253 - RNA, 19 nt, Homo sapiens
ggcugaauuugacucguuu

SEQ ID NO: 30254 - RNA, 19 nt, Homo sapiens
ggugauuguggcugaauuu

SEQ ID NO: 30255 - RNA, 19 nt, Homo sapiens
uggcugaauuugacucguu

SEQ ID NO: 30256 - RNA, 19 nt, Homo sapiens
uaccauuccuucuuuaaac

SEQ ID NO: 30257 - RNA, 19 nt, Homo sapiens
guuggcgccuugauuacuu

SEQ ID NO: 30258 - RNA, 19 nt, Homo sapiens
ccaaucacgcgcauucuuc

SEQ ID NO: 30259 - RNA, 19 nt, Homo sapiens
gcaaaccugccacacucaa

SEQ ID NO: 30260 - RNA, 19 nt, Homo sapiens
gcuugagucaggacccuua

SEQ ID NO: 30261 - RNA, 19 nt, Homo sapiens
ugaaugcucgauccaagaa

SEQ ID NO: 30262 - RNA, 19 nt, Homo sapiens
ggacaaggaaggguacagu

SEQ ID NO: 30263 - RNA, 19 nt, Homo sapiens
gauuagauuggguaaagga

SEQ ID NO: 30264 - RNA, 19 nt, Homo sapiens
aggauuagauuggguaaag

SEQ ID NO: 30265 - RNA, 19 nt, Homo sapiens
agaagaaaggauuagauug

SEQ ID NO: 30266 - RNA, 19 nt, Homo sapiens
cagaggccaagaagaguaa

SEQ ID NO: 30267 - RNA, 19 nt, Homo sapiens
uggacucucucaucaauac

SEQ ID NO: 30268 - RNA, 19 nt, Homo sapiens
cuaccauuccuucuuuaaa

SEQ ID NO: 30269 - RNA, 19 nt, Homo sapiens
ucaacuaccauuccuucuu

SEQ ID NO: 30270 - RNA, 19 nt, Homo sapiens
acuuugagccugggaaaua

SEQ ID NO: 30271 - RNA, 19 nt, Homo sapiens
ugaagccuuucgcaaguuc

SEQ ID NO: 30272 - RNA, 19 nt, Homo sapiens
cuuugagccugggaaauaa

SEQ ID NO: 30273 - RNA, 19 nt, Homo sapiens
guugucccacucucuguua

SEQ ID NO: 30274 - RNA, 19 nt, Homo sapiens
uugguuggcgccuugauua

SEQ ID NO: 30275 - RNA, 19 nt, Homo sapiens
gggugauuguggcugaauu

SEQ ID NO: 30276 - RNA, 19 nt, Homo sapiens
ucaagagaccaaauguuca

SEQ ID NO: 30277 - RNA, 19 nt, Homo sapiens
uaaagagccauaguuucaa

SEQ ID NO: 30278 - RNA, 19 nt, Homo sapiens
gaaaauaaagagccauagu

SEQ ID NO: 30279 - RNA, 19 nt, Homo sapiens
ugccuggacucucucauca

SEQ ID NO: 30280 - RNA, 19 nt, Homo sapiens
gacuacuaaugacuuuguu

SEQ ID NO: 30281 - RNA, 19 nt, Homo sapiens
ugcauucuauuucucaugu

SEQ ID NO: 30282 - RNA, 19 nt, Homo sapiens
aaugcucgauccaagaaug

SEQ ID NO: 30283 - RNA, 19 nt, Homo sapiens
ugacucguuugugcuggua

SEQ ID NO: 30284 - RNA, 19 nt, Homo sapiens
caagagaccaaauguucag

SEQ ID NO: 30285 - RNA, 19 nt, Homo sapiens
cagauauacugugccuuca

SEQ ID NO: 30286 - RNA, 19 nt, Homo sapiens
auacugugccuucaagaga

SEQ ID NO: 30287 - RNA, 19 nt, Homo sapiens
aaaccugccacacucaaga

SEQ ID NO: 30288 - RNA, 19 nt, Homo sapiens
aauaaagagccauaguuuc

SEQ ID NO: 30289 - RNA, 19 nt, Homo sapiens
acagcaagauccguuccaa

SEQ ID NO: 30290 - RNA, 19 nt, Homo sapiens
uucaagagaccaaauguuc

SEQ ID NO: 30291 - RNA, 19 nt, Homo sapiens
agaccaaucacgcgcauuc

SEQ ID NO: 30292 - RNA, 19 nt, Homo sapiens
uuaccugcauugugugaca

SEQ ID NO: 30293 - RNA, 19 nt, Homo sapiens
gaagaagccccagauauac

SEQ ID NO: 30294 - RNA, 19 nt, Homo sapiens
ggauuagauuggguaaagg

SEQ ID NO: 30295 - RNA, 19 nt, Homo sapiens
ugauuguggcugaauuuga

SEQ ID NO: 30296 - RNA, 19 nt, Homo sapiens
gcucgauccaagaauguug

SEQ ID NO: 30297 - RNA, 19 nt, Homo sapiens
cagcgugcacccuucuuug

SEQ ID NO: 30298 - RNA, 19 nt, Homo sapiens
ucagcgugcacccuucuuu

SEQ ID NO: 30299 - RNA, 19 nt, Homo sapiens
aacagcauauguaccuaau

SEQ ID NO: 30300 - RNA, 19 nt, Homo sapiens
cauaggcgaugaggagcau

SEQ ID NO: 30301 - RNA, 19 nt, Homo sapiens
gaguagggcaacgcgguaa

SEQ ID NO: 30302 - RNA, 19 nt, Homo sapiens
agacuacuaaugacuuugu

SEQ ID NO: 30303 - RNA, 19 nt, Homo sapiens
aacuaccauuccuucuuua

SEQ ID NO: 30304 - RNA, 19 nt, Homo sapiens
ucacuuugagccugggaaa

SEQ ID NO: 30305 - RNA, 19 nt, Homo sapiens
acuguccuaucacccuaua

SEQ ID NO: 30306 - RNA, 19 nt, Homo sapiens
caauacuggucagcuccuu

SEQ ID NO: 30307 - RNA, 19 nt, Homo sapiens
gaacaaagacuacuaauga

SEQ ID NO: 30308 - RNA, 19 nt, Homo sapiens
caacuaccauuccuucuuu

SEQ ID NO: 30309 - RNA, 19 nt, Homo sapiens
caaaguuucuuacggcaua

SEQ ID NO: 30310 - RNA, 19 nt, Homo sapiens
ggacuuauaugaugaaugc

SEQ ID NO: 30311 - RNA, 19 nt, Homo sapiens
gagccuggauuaagaagaa

SEQ ID NO: 30312 - RNA, 19 nt, Homo sapiens
ggaagaagccccagauaua

SEQ ID NO: 30313 - RNA, 19 nt, Homo sapiens
gaagaaaggauuagauugg

SEQ ID NO: 30314 - RNA, 19 nt, Homo sapiens
gggaugagcucaggacaga

SEQ ID NO: 30315 - RNA, 19 nt, Homo sapiens
gcgcugggaugaagccuuu

SEQ ID NO: 30316 - RNA, 19 nt, Homo sapiens
gaugaagccuuucgcaagu

SEQ ID NO: 30317 - RNA, 19 nt, Homo sapiens
aaagagccauaguuucaaa

SEQ ID NO: 30318 - RNA, 19 nt, Homo sapiens
gaacaaacuaccagcugaa

SEQ ID NO: 30319 - RNA, 19 nt, Homo sapiens
gagaccaaauguucagaga

SEQ ID NO: 30320 - RNA, 19 nt, Homo sapiens
gauauacugugccuucaag

SEQ ID NO: 30321 - RNA, 19 nt, Homo sapiens
ggauuaagaagaaaggauu

SEQ ID NO: 30322 - RNA, 19 nt, Homo sapiens
gaucugcucuuggaaugug

SEQ ID NO: 30323 - RNA, 19 nt, Homo sapiens
caaacuaccagcugaacuu

SEQ ID NO: 30324 - RNA, 19 nt, Homo sapiens
auaaagagccauaguuuca

SEQ ID NO: 30325 - RNA, 19 nt, Homo sapiens
caaagacuacuaaugacuu

SEQ ID NO: 30326 - RNA, 19 nt, Homo sapiens
uaacagcauauguaccuaa

SEQ ID NO: 30327 - RNA, 19 nt, Homo sapiens
uagauuggguaaaggaaga

SEQ ID NO: 30328 - RNA, 19 nt, Homo sapiens
cuucgagccuggauuaaga

SEQ ID NO: 30329 - RNA, 19 nt, Homo sapiens
ucuguuaccugcauugugu

SEQ ID NO: 30330 - RNA, 19 nt, Homo sapiens
ggagcugccuggacucucu

SEQ ID NO: 30331 - RNA, 19 nt, Homo sapiens
gauuguggcugaauuugac

SEQ ID NO: 30332 - RNA, 19 nt, Homo sapiens
ugaggagcaugaucaggaa

SEQ ID NO: 30333 - RNA, 19 nt, Homo sapiens
gcauucuauuucucaugua

SEQ ID NO: 30334 - RNA, 19 nt, Homo sapiens
ggucagcuccuucggacaa

SEQ ID NO: 30335 - RNA, 19 nt, Homo sapiens
gcgaugaggagcaugauca

SEQ ID NO: 30336 - RNA, 19 nt, Homo sapiens
gaauguggaugggcuucga

SEQ ID NO: 30337 - RNA, 19 nt, Homo sapiens
ccuggacucucucaucaau

SEQ ID NO: 30338 - RNA, 19 nt, Homo sapiens
ccagaggccaagaagagua

SEQ ID NO: 30339 - RNA, 19 nt, Homo sapiens
cuacuaaugacuuuguuug

SEQ ID NO: 30340 - RNA, 19 nt, Homo sapiens
ugaacaaagacuacuaaug

SEQ ID NO: 30341 - RNA, 19 nt, Homo sapiens
guaacagcauauguaccua

SEQ ID NO: 30342 - RNA, 19 nt, Homo sapiens
ggcugaauuugacucguuu

SEQ ID NO: 30343 - RNA, 19 nt, Homo sapiens
ggugauuguggcugaauuu

SEQ ID NO: 30344 - RNA, 19 nt, Homo sapiens
gauacgggguugcucuuuu

SEQ ID NO: 30345 - RNA, 19 nt, Homo sapiens
uggcugaauuugacucguu

SEQ ID NO: 30346 - RNA, 19 nt, Homo sapiens
uaccauuccuucuuuaaac

SEQ ID NO: 30347 - RNA, 19 nt, Homo sapiens
guuggcgccuugauuacuu

SEQ ID NO: 30348 - RNA, 19 nt, Homo sapiens
ccaaucacgcgcauucuuc

SEQ ID NO: 30349 - RNA, 19 nt, Homo sapiens
gcaaaccugccacacucaa

SEQ ID NO: 30350 - RNA, 19 nt, Homo sapiens
ugaaugcucgauccaagaa

SEQ ID NO: 30351 - RNA, 19 nt, Homo sapiens
ggacaaggaaggguacagu

SEQ ID NO: 30352 - RNA, 19 nt, Homo sapiens
gauuagauuggguaaagga

SEQ ID NO: 30353 - RNA, 19 nt, Homo sapiens
aggauuagauuggguaaag

SEQ ID NO: 30354 - RNA, 19 nt, Homo sapiens
cagaggccaagaagaguaa

SEQ ID NO: 30355 - RNA, 19 nt, Homo sapiens
agaagaaaggauuagauug

SEQ ID NO: 30356 - RNA, 19 nt, Homo sapiens
uggacucucucaucaauac

SEQ ID NO: 30357 - RNA, 19 nt, Homo sapiens
cuaccauuccuucuuuaaa

SEQ ID NO: 30358 - RNA, 19 nt, Homo sapiens
ucaacuaccauuccuucuu

SEQ ID NO: 30359 - RNA, 19 nt, Homo sapiens
acuuugagccugggaaaua

SEQ ID NO: 30360 - RNA, 19 nt, Homo sapiens
ugaagccuuucgcaaguuc

SEQ ID NO: 30361 - RNA, 19 nt, Homo sapiens
cuuugagccugggaaauaa

SEQ ID NO: 30362 - RNA, 19 nt, Homo sapiens
guugucccacucucuguua

SEQ ID NO: 30363 - RNA, 19 nt, Homo sapiens
uugguuggcgccuugauua

SEQ ID NO: 30364 - RNA, 19 nt, Homo sapiens
gggugauuguggcugaauu

SEQ ID NO: 30365 - RNA, 19 nt, Homo sapiens
ucaagagaccaaauguuca

SEQ ID NO: 30366 - RNA, 19 nt, Homo sapiens
uaaagagccauaguuucaa

SEQ ID NO: 30367 - RNA, 19 nt, Homo sapiens
gaaaauaaagagccauagu

SEQ ID NO: 30368 - RNA, 19 nt, Homo sapiens
ugccuggacucucucauca

SEQ ID NO: 30369 - RNA, 19 nt, Homo sapiens
gacuacuaaugacuuuguu

SEQ ID NO: 30370 - RNA, 19 nt, Homo sapiens
ugcauucuauuucucaugu

SEQ ID NO: 30371 - RNA, 19 nt, Homo sapiens
aaugcucgauccaagaaug

SEQ ID NO: 30372 - RNA, 19 nt, Homo sapiens
ugacucguuugugcuggua

SEQ ID NO: 30373 - RNA, 19 nt, Homo sapiens
gaacggcaacgcgguaaaa

SEQ ID NO: 30374 - RNA, 19 nt, Homo sapiens
caagagaccaaauguucag

SEQ ID NO: 30375 - RNA, 19 nt, Homo sapiens
cagauauacugugccuuca

SEQ ID NO: 30376 - RNA, 19 nt, Homo sapiens
aaaccugccacacucaaga

SEQ ID NO: 30377 - RNA, 19 nt, Homo sapiens
auacugugccuucaagaga

SEQ ID NO: 30378 - RNA, 19 nt, Homo sapiens
aauaaagagccauaguuuc

SEQ ID NO: 30379 - RNA, 19 nt, Homo sapiens
acagcaagauccguuccaa

SEQ ID NO: 30380 - RNA, 19 nt, Homo sapiens
uucaagagaccaaauguuc

SEQ ID NO: 30381 - RNA, 19 nt, Homo sapiens
agaccaaucacgcgcauuc

SEQ ID NO: 30382 - RNA, 19 nt, Homo sapiens
uuaccugcauugugugaca

SEQ ID NO: 30383 - RNA, 19 nt, Homo sapiens
gaagaagccccagauauac

SEQ ID NO: 30384 - RNA, 19 nt, Homo sapiens
ggauuagauuggguaaagg

SEQ ID NO: 30385 - RNA, 19 nt, Homo sapiens
ugauuguggcugaauuuga

SEQ ID NO: 30386 - RNA, 19 nt, Homo sapiens
cagcgugcacccuucuuug

SEQ ID NO: 30387 - RNA, 19 nt, Homo sapiens
gcucgauccaagaauguug

SEQ ID NO: 30388 - RNA, 19 nt, Homo sapiens
ucagcgugcacccuucuuu

SEQ ID NO: 30389 - RNA, 19 nt, Homo sapiens
aacagcauauguaccuaau

SEQ ID NO: 30390 - RNA, 19 nt, Homo sapiens
cauaggcgaugaggagcau

SEQ ID NO: 30391 - RNA, 19 nt, Homo sapiens
agacuacuaaugacuuugu

SEQ ID NO: 30392 - RNA, 19 nt, Homo sapiens
aacuaccauuccuucuuua

SEQ ID NO: 30393 - RNA, 19 nt, Homo sapiens
ucacuuugagccugggaaa

SEQ ID NO: 30394 - RNA, 19 nt, Homo sapiens
acuguccuaucacccuaua

SEQ ID NO: 30395 - RNA, 19 nt, Homo sapiens
caauacuggucagcuccuu

SEQ ID NO: 30396 - RNA, 19 nt, Homo sapiens
gaacaaagacuacuaauga

SEQ ID NO: 30397 - RNA, 19 nt, Homo sapiens
caacuaccauuccuucuuu

SEQ ID NO: 30398 - RNA, 19 nt, Homo sapiens
caaaguuucuuacggcaua

SEQ ID NO: 30399 - RNA, 19 nt, Homo sapiens
ggacuuauaugaugaaugc

SEQ ID NO: 30400 - RNA, 19 nt, Homo sapiens
gagccuggauuaagaagaa

SEQ ID NO: 30401 - RNA, 19 nt, Homo sapiens
ggaagaagccccagauaua

SEQ ID NO: 30402 - RNA, 19 nt, Homo sapiens
gaagaaaggauuagauugg

SEQ ID NO: 30403 - RNA, 19 nt, Homo sapiens
gggaugagcucaggacaga

SEQ ID NO: 30404 - RNA, 19 nt, Homo sapiens
gcgcugggaugaagccuuu

SEQ ID NO: 30405 - RNA, 19 nt, Homo sapiens
gaugaagccuuucgcaagu

SEQ ID NO: 30406 - RNA, 19 nt, Homo sapiens
aaagagccauaguuucaaa

SEQ ID NO: 30407 - RNA, 19 nt, Homo sapiens
gaacaaacuaccagcugaa

SEQ ID NO: 30408 - RNA, 19 nt, Homo sapiens
gagaccaaauguucagaga

SEQ ID NO: 30409 - RNA, 19 nt, Homo sapiens
gauauacugugccuucaag

SEQ ID NO: 30410 - RNA, 19 nt, Homo sapiens
ggauuaagaagaaaggauu

SEQ ID NO: 30411 - RNA, 19 nt, Homo sapiens
gaucugcucuuggaaugug

SEQ ID NO: 30412 - RNA, 19 nt, Homo sapiens
caaacuaccagcugaacuu

SEQ ID NO: 30413 - RNA, 19 nt, Homo sapiens
auaaagagccauaguuuca

SEQ ID NO: 30414 - RNA, 19 nt, Homo sapiens
caaagacuacuaaugacuu

SEQ ID NO: 30415 - RNA, 19 nt, Homo sapiens
uaacagcauauguaccuaa

SEQ ID NO: 30416 - RNA, 19 nt, Homo sapiens
uagauuggguaaaggaaga

SEQ ID NO: 30417 - RNA, 19 nt, Homo sapiens
cuucgagccuggauuaaga

SEQ ID NO: 30418 - RNA, 19 nt, Homo sapiens
ucuguuaccugcauugugu

SEQ ID NO: 30419 - RNA, 19 nt, Homo sapiens
ggagcugccuggacucucu

SEQ ID NO: 30420 - RNA, 19 nt, Homo sapiens
gaacggcaagcuugagcaa

SEQ ID NO: 30421 - RNA, 19 nt, Homo sapiens
gauuguggcugaauuugac

SEQ ID NO: 30422 - RNA, 19 nt, Homo sapiens
ugaggagcaugaucaggaa

SEQ ID NO: 30423 - RNA, 19 nt, Homo sapiens
gcauucuauuucucaugua

SEQ ID NO: 30424 - RNA, 19 nt, Homo sapiens
ggucagcuccuucggacaa

SEQ ID NO: 30425 - RNA, 19 nt, Homo sapiens
gcgaugaggagcaugauca

SEQ ID NO: 30426 - RNA, 19 nt, Homo sapiens
gaauguggaugggcuucga

SEQ ID NO: 30427 - RNA, 19 nt, Homo sapiens
ccuggacucucucaucaau

SEQ ID NO: 30428 - RNA, 19 nt, Homo sapiens
ccagaggccaagaagagua

SEQ ID NO: 30429 - RNA, 19 nt, Homo sapiens
cuacuaaugacuuuguuug

SEQ ID NO: 30430 - RNA, 19 nt, Homo sapiens
ugaacaaagacuacuaaug

SEQ ID NO: 30431 - RNA, 19 nt, Homo sapiens
guaacagcauauguaccua

SEQ ID NO: 30432 - RNA, 19 nt, Homo sapiens
ggcugaauuugacucguuu

SEQ ID NO: 30433 - RNA, 19 nt, Homo sapiens
ggugauuguggcugaauuu

SEQ ID NO: 30434 - RNA, 19 nt, Homo sapiens
gauacgggguugcucuuuu

SEQ ID NO: 30435 - RNA, 19 nt, Homo sapiens
uggcugaauuugacucguu

SEQ ID NO: 30436 - RNA, 19 nt, Homo sapiens
uaccauuccuucuuuaaac

SEQ ID NO: 30437 - RNA, 19 nt, Homo sapiens
guuggcgccuugauuacuu

SEQ ID NO: 30438 - RNA, 19 nt, Homo sapiens
ccaaucacgcgcauucuuc

SEQ ID NO: 30439 - RNA, 19 nt, Homo sapiens
gcaaaccugccacacucaa

SEQ ID NO: 30440 - RNA, 19 nt, Homo sapiens
ugaaugcucgauccaagaa

SEQ ID NO: 30441 - RNA, 19 nt, Homo sapiens
ggacaaggaaggguacagu

SEQ ID NO: 30442 - RNA, 19 nt, Homo sapiens
gauuagauuggguaaagga

SEQ ID NO: 30443 - RNA, 19 nt, Homo sapiens
aggauuagauuggguaaag

SEQ ID NO: 30444 - RNA, 19 nt, Homo sapiens
agaagaaaggauuagauug

SEQ ID NO: 30445 - RNA, 19 nt, Homo sapiens
cagaggccaagaagaguaa

SEQ ID NO: 30446 - RNA, 19 nt, Homo sapiens
uggacucucucaucaauac

SEQ ID NO: 30447 - RNA, 19 nt, Homo sapiens
cuaccauuccuucuuuaaa

SEQ ID NO: 30448 - RNA, 19 nt, Homo sapiens
ucaacuaccauuccuucuu

SEQ ID NO: 30449 - RNA, 19 nt, Homo sapiens
acuuugagccugggaaaua

SEQ ID NO: 30450 - RNA, 19 nt, Homo sapiens
ugaagccuuucgcaaguuc

SEQ ID NO: 30451 - RNA, 19 nt, Homo sapiens
cuuugagccugggaaauaa

SEQ ID NO: 30452 - RNA, 19 nt, Homo sapiens
guugucccacucucuguua

SEQ ID NO: 30453 - RNA, 19 nt, Homo sapiens
uugguuggcgccuugauua

SEQ ID NO: 30454 - RNA, 19 nt, Homo sapiens
gggugauuguggcugaauu

SEQ ID NO: 30455 - RNA, 19 nt, Homo sapiens
ucaagagaccaaauguuca

SEQ ID NO: 30456 - RNA, 19 nt, Homo sapiens
uaaagagccauaguuucaa

SEQ ID NO: 30457 - RNA, 19 nt, Homo sapiens
gaaaauaaagagccauagu

SEQ ID NO: 30458 - RNA, 19 nt, Homo sapiens
ugccuggacucucucauca

SEQ ID NO: 30459 - RNA, 19 nt, Homo sapiens
gacuacuaaugacuuuguu

SEQ ID NO: 30460 - RNA, 19 nt, Homo sapiens
ugcauucuauuucucaugu

SEQ ID NO: 30461 - RNA, 19 nt, Homo sapiens
aaugcucgauccaagaaug

SEQ ID NO: 30462 - RNA, 19 nt, Homo sapiens
ugacucguuugugcuggua

SEQ ID NO: 30463 - RNA, 19 nt, Homo sapiens
caagagaccaaauguucag

SEQ ID NO: 30464 - RNA, 19 nt, Homo sapiens
cagauauacugugccuuca

SEQ ID NO: 30465 - RNA, 19 nt, Homo sapiens
aaaccugccacacucaaga

SEQ ID NO: 30466 - RNA, 19 nt, Homo sapiens
auacugugccuucaagaga

SEQ ID NO: 30467 - RNA, 19 nt, Homo sapiens
aauaaagagccauaguuuc

SEQ ID NO: 30468 - RNA, 19 nt, Homo sapiens
acagcaagauccguuccaa

SEQ ID NO: 30469 - RNA, 19 nt, Homo sapiens
uucaagagaccaaauguuc

SEQ ID NO: 30470 - RNA, 19 nt, Homo sapiens
agaccaaucacgcgcauuc

SEQ ID NO: 30471 - RNA, 19 nt, Homo sapiens
uuaccugcauugugugaca

SEQ ID NO: 30472 - RNA, 19 nt, Homo sapiens
gaagaagccccagauauac

SEQ ID NO: 30473 - RNA, 19 nt, Homo sapiens
ggauuagauuggguaaagg

SEQ ID NO: 30474 - RNA, 19 nt, Homo sapiens
ugauuguggcugaauuuga

SEQ ID NO: 30475 - RNA, 19 nt, Homo sapiens
cagcgugcacccuucuuug

SEQ ID NO: 30476 - RNA, 19 nt, Homo sapiens
gcucgauccaagaauguug

SEQ ID NO: 30477 - RNA, 19 nt, Homo sapiens
ucagcgugcacccuucuuu

SEQ ID NO: 30478 - RNA, 19 nt, Homo sapiens
aacagcauauguaccuaau

SEQ ID NO: 30479 - RNA, 19 nt, Homo sapiens
cauaggcgaugaggagcau

SEQ ID NO: 30480 - RNA, 19 nt, Homo sapiens
agacuacuaaugacuuugu

SEQ ID NO: 30481 - RNA, 19 nt, Homo sapiens
aacuaccauuccuucuuua

SEQ ID NO: 30482 - RNA, 19 nt, Homo sapiens
ucacuuugagccugggaaa

SEQ ID NO: 30483 - RNA, 19 nt, Homo sapiens
acuguccuaucacccuaua

SEQ ID NO: 30484 - RNA, 19 nt, Homo sapiens
caauacuggucagcuccuu

SEQ ID NO: 30485 - RNA, 19 nt, Homo sapiens
gaaagaagccugcauauaa

SEQ ID NO: 30486 - RNA, 19 nt, Homo sapiens
gaaauugacucuacauugu

SEQ ID NO: 30487 - RNA, 19 nt, Homo sapiens
gaaaugggcuuuaauagag

SEQ ID NO: 30488 - RNA, 19 nt, Homo sapiens
ccaaagaguuguguucuaa

SEQ ID NO: 30489 - RNA, 19 nt, Homo sapiens
acaaauagcacuuagguua

SEQ ID NO: 30490 - RNA, 19 nt, Homo sapiens
gaauacaccugugguuaaa

SEQ ID NO: 30491 - RNA, 19 nt, Homo sapiens
gaacagaauggcucucuuu

SEQ ID NO: 30492 - RNA, 19 nt, Homo sapiens
gaauaguccuuaaaugaug

SEQ ID NO: 30493 - RNA, 19 nt, Homo sapiens
ggaagaaagucaacaugau

SEQ ID NO: 30494 - RNA, 19 nt, Homo sapiens
gaaaauaccuucaguugau

SEQ ID NO: 30495 - RNA, 19 nt, Homo sapiens
ggaaaugggcuuuaauaga

SEQ ID NO: 30496 - RNA, 19 nt, Homo sapiens
ggaaagaagccugcauaua

SEQ ID NO: 30497 - RNA, 19 nt, Homo sapiens
ggauccaccucuaagaaua

SEQ ID NO: 30498 - RNA, 19 nt, Homo sapiens
guacauuucucucuuaaag

SEQ ID NO: 30499 - RNA, 19 nt, Homo sapiens
gccaagaguuuguugauga

SEQ ID NO: 30500 - RNA, 19 nt, Homo sapiens
cauccuaccugaauauaaa

SEQ ID NO: 30501 - RNA, 19 nt, Homo sapiens
guugucagcugaaguaauu

SEQ ID NO: 30502 - RNA, 19 nt, Homo sapiens
aagaauacgucuccaauga

SEQ ID NO: 30503 - RNA, 19 nt, Homo sapiens
cgagagaacugauugauac

SEQ ID NO: 30504 - RNA, 19 nt, Homo sapiens
cagaauggcucucuuucaa

SEQ ID NO: 30505 - RNA, 19 nt, Homo sapiens
gguauucuauaguugcuua

SEQ ID NO: 30506 - RNA, 19 nt, Homo sapiens
ugaaguauauuccaacaga

SEQ ID NO: 30507 - RNA, 19 nt, Homo sapiens
gguuaaaucugccuuggaa

SEQ ID NO: 30508 - RNA, 19 nt, Homo sapiens
guucuagucugcuuuggua

SEQ ID NO: 30509 - RNA, 19 nt, Homo sapiens
gaauggcucucuuucaaca

SEQ ID NO: 30510 - RNA, 19 nt, Homo sapiens
gaaacaaacaguucaaagu

SEQ ID NO: 30511 - RNA, 19 nt, Homo sapiens
aaagaaggcuaguagaguu

SEQ ID NO: 30512 - RNA, 19 nt, Homo sapiens
uaccauauguggccauuaa

SEQ ID NO: 30513 - RNA, 19 nt, Homo sapiens
gaacaaauagcacuuaggu

SEQ ID NO: 30514 - RNA, 19 nt, Homo sapiens
aaagaagccugcauauaau

SEQ ID NO: 30515 - RNA, 19 nt, Homo sapiens
gaagaaagucaacaugaug

SEQ ID NO: 30516 - RNA, 19 nt, Homo sapiens
gaacugauugauaccauuu

SEQ ID NO: 30517 - RNA, 19 nt, Homo sapiens
gcaaugaugaugucaaaug

SEQ ID NO: 30518 - RNA, 19 nt, Homo sapiens
cuucauagcuuguaaccaa

SEQ ID NO: 30519 - RNA, 19 nt, Homo sapiens
uaaauagugugaccauaug

SEQ ID NO: 30520 - RNA, 19 nt, Homo sapiens
cagaaagcuuugaauacua

SEQ ID NO: 30521 - RNA, 19 nt, Homo sapiens
ugagauaaauccaguaaag

SEQ ID NO: 30522 - RNA, 19 nt, Homo sapiens
gaugguggcuugagguguu

SEQ ID NO: 30523 - RNA, 19 nt, Homo sapiens
acucugagguuuagcauuu

SEQ ID NO: 30524 - RNA, 19 nt, Homo sapiens
ggacaaacagcaacaaaca

SEQ ID NO: 30525 - RNA, 19 nt, Homo sapiens
ccaggucccucguaucaaa

SEQ ID NO: 30526 - RNA, 19 nt, Homo sapiens
gaagaacgaacuuguaaag

SEQ ID NO: 30527 - RNA, 19 nt, Homo sapiens
caacuggagagaacuauaa

SEQ ID NO: 30528 - RNA, 19 nt, Homo sapiens
ggagacaguccuauucaaa

SEQ ID NO: 30529 - RNA, 19 nt, Homo sapiens
caagguagauauccucauc

SEQ ID NO: 30530 - RNA, 19 nt, Homo sapiens
cauaagagucuaucauuga

SEQ ID NO: 30531 - RNA, 19 nt, Homo sapiens
caagggaagauuuauguuu

SEQ ID NO: 30532 - RNA, 19 nt, Homo sapiens
gaaguauauuccaacagaa

SEQ ID NO: 30533 - RNA, 19 nt, Homo sapiens
aaacacagauaccuuuaca

SEQ ID NO: 30534 - RNA, 19 nt, Homo sapiens
caaacccucuuaauucuag

SEQ ID NO: 30535 - RNA, 19 nt, Homo sapiens
gaaagaaggcuaguagagu

SEQ ID NO: 30536 - RNA, 19 nt, Homo sapiens
ugacaugugugcuuccuau

SEQ ID NO: 30537 - RNA, 19 nt, Homo sapiens
gaagauguuucaggucugu

SEQ ID NO: 30538 - RNA, 19 nt, Homo sapiens
aaaacaagcugaagaaaug

SEQ ID NO: 30539 - RNA, 19 nt, Homo sapiens
ucuaaaugcugaagaugaa

SEQ ID NO: 30540 - RNA, 19 nt, Homo sapiens
uaauuuagcccacuuaagu

SEQ ID NO: 30541 - RNA, 19 nt, Homo sapiens
aaagugugcuguggaaauu

SEQ ID NO: 30542 - RNA, 19 nt, Homo sapiens
ucagaaagcuuugaauacu

SEQ ID NO: 30543 - RNA, 19 nt, Homo sapiens
gaagccaucuaaaguaaaa

SEQ ID NO: 30544 - RNA, 19 nt, Homo sapiens
gcgagagaacugauugaua

SEQ ID NO: 30545 - RNA, 19 nt, Homo sapiens
auagagaccuggugaaaca

SEQ ID NO: 30546 - RNA, 19 nt, Homo sapiens
ugaauacaccugugguuaa

SEQ ID NO: 30547 - RNA, 19 nt, Homo sapiens
agaagaugcugucaugaug

SEQ ID NO: 30548 - RNA, 19 nt, Homo sapiens
gaguuauggugccgaauug

SEQ ID NO: 30549 - RNA, 19 nt, Homo sapiens
gcugaauaguccuuaaaug

SEQ ID NO: 30550 - RNA, 19 nt, Homo sapiens
aagggaagauuuauguuug

SEQ ID NO: 30551 - RNA, 19 nt, Homo sapiens
gaacaugccaagugguuuc

SEQ ID NO: 30552 - RNA, 19 nt, Homo sapiens
gggcuuuaaguuaguauua

SEQ ID NO: 30553 - RNA, 19 nt, Homo sapiens
aaugaaaggccaagaguuu

SEQ ID NO: 30554 - RNA, 19 nt, Homo sapiens
uugaagccaucuaaaguaa

SEQ ID NO: 30555 - RNA, 19 nt, Homo sapiens
caggaaauggaaacaaaua

SEQ ID NO: 30556 - RNA, 19 nt, Homo sapiens
cugaaaagaugguaucaua

SEQ ID NO: 30557 - RNA, 19 nt, Homo sapiens
gauauugugucagcacuuc

SEQ ID NO: 30558 - RNA, 19 nt, Homo sapiens
gagauaggguagccugcuu

SEQ ID NO: 30559 - RNA, 19 nt, Homo sapiens
ggaaauggaaacaaauaca

SEQ ID NO: 30560 - RNA, 19 nt, Homo sapiens
cgaauugucuuuggugcuu

SEQ ID NO: 30561 - RNA, 19 nt, Homo sapiens
cugaauaguccuuaaauga

SEQ ID NO: 30562 - RNA, 19 nt, Homo sapiens
uaaaguguguauggacaaa

SEQ ID NO: 30563 - RNA, 19 nt, Homo sapiens
ucgcaaugaugaugucaaa

SEQ ID NO: 30564 - RNA, 19 nt, Homo sapiens
acaaacagcaacaaacaaa

SEQ ID NO: 30565 - RNA, 19 nt, Homo sapiens
acauaagagucuaucauug

SEQ ID NO: 30566 - RNA, 19 nt, Homo sapiens
aaaguugucagcugaagua

SEQ ID NO: 30567 - RNA, 19 nt, Homo sapiens
gcuuuucacuuguguuuua

SEQ ID NO: 30568 - RNA, 19 nt, Homo sapiens
aagaagaacgaacuuguaa

SEQ ID NO: 30569 - RNA, 19 nt, Homo sapiens
cauaaacagcuauauccua

SEQ ID NO: 30570 - RNA, 19 nt, Homo sapiens
cuggauaacuggaaacuag

SEQ ID NO: 30571 - RNA, 19 nt, Homo sapiens
guaauuggucuguuauuca

SEQ ID NO: 30572 - RNA, 19 nt, Homo sapiens
uaaagugcuuauagggaaa

SEQ ID NO: 30573 - RNA, 19 nt, Homo sapiens
ggaguuacuggauuuguug

SEQ ID NO: 30574 - RNA, 19 nt, Homo sapiens
gaaugaaaggccaagaguu

SEQ ID NO: 30575 - RNA, 19 nt, Homo sapiens
gaagccagauuucuuaccu

SEQ ID NO: 30576 - RNA, 19 nt, Homo sapiens
aguaguaucuuggaaauuc

SEQ ID NO: 30577 - RNA, 19 nt, Homo sapiens
gaacuuuaagccaaauuca

SEQ ID NO: 30578 - RNA, 19 nt, Homo sapiens
gaaaugcugcggccaacau

SEQ ID NO: 30579 - RNA, 19 nt, Homo sapiens
guagaguugauuacugaua

SEQ ID NO: 30580 - RNA, 19 nt, Homo sapiens
uaauagagaccuggugaaa

SEQ ID NO: 30581 - RNA, 19 nt, Homo sapiens
acaugcagcucgaaugaga

SEQ ID NO: 30582 - RNA, 19 nt, Homo sapiens
gaugcuggauaacuggaaa

SEQ ID NO: 30583 - RNA, 19 nt, Homo sapiens
cauagcuuguaaccaaaua

SEQ ID NO: 30584 - RNA, 19 nt, Homo sapiens
agaaauugacucuacauug

SEQ ID NO: 30585 - RNA, 19 nt, Homo sapiens
gaaaugggcuuuaguagaa

SEQ ID NO: 30586 - RNA, 19 nt, Homo sapiens
gaaagaacauguaaagugu

SEQ ID NO: 30587 - RNA, 19 nt, Homo sapiens
ggagaugccugccauuaaa

SEQ ID NO: 30588 - RNA, 19 nt, Homo sapiens
gugcauauauguugaauga

SEQ ID NO: 30589 - RNA, 19 nt, Homo sapiens
caagagaacugauugauac

SEQ ID NO: 30590 - RNA, 19 nt, Homo sapiens
ucaaugaucuuguguuaga

SEQ ID NO: 30591 - RNA, 19 nt, Homo sapiens
uaacagugaugaugucaaa

SEQ ID NO: 30592 - RNA, 19 nt, Homo sapiens
gaagaaagaacauguaaag

SEQ ID NO: 30593 - RNA, 19 nt, Homo sapiens
gcaagagaacugauugaua

SEQ ID NO: 30594 - RNA, 19 nt, Homo sapiens
gaaaguguccuauuuguag

SEQ ID NO: 30595 - RNA, 19 nt, Homo sapiens
gaaaaugccagauuacuua

SEQ ID NO: 30596 - RNA, 19 nt, Homo sapiens
gcauauauguugaaugaca

SEQ ID NO: 30597 - RNA, 19 nt, Homo sapiens
gaugaauacuccugugauu

SEQ ID NO: 30598 - RNA, 19 nt, Homo sapiens
caaaaugucuucaguugua

SEQ ID NO: 30599 - RNA, 19 nt, Homo sapiens
caucgaaggugugcauaua

SEQ ID NO: 30600 - RNA, 19 nt, Homo sapiens
uaacgaaaaugccagauua

SEQ ID NO: 30601 - RNA, 19 nt, Homo sapiens
caagauacacaguuucuaa

SEQ ID NO: 30602 - RNA, 19 nt, Homo sapiens
ggacucagguguugggaau

SEQ ID NO: 30603 - RNA, 19 nt, Homo sapiens
cagaacaccugagacauuu

SEQ ID NO: 30604 - RNA, 19 nt, Homo sapiens
gcagagcuuuccaccauga

SEQ ID NO: 30605 - RNA, 19 nt, Homo sapiens
guacauuucuuucaugaag

SEQ ID NO: 30606 - RNA, 19 nt, Homo sapiens
ggaaaugggcuuuaguaga

SEQ ID NO: 30607 - RNA, 19 nt, Homo sapiens
gagaagaccauucagaaga

SEQ ID NO: 30608 - RNA, 19 nt, Homo sapiens
caacacguuugaacugaaa

SEQ ID NO: 30609 - RNA, 19 nt, Homo sapiens
gaacugauugauacgauuu

SEQ ID NO: 30610 - RNA, 19 nt, Homo sapiens
ggagagaauuauagacuag

SEQ ID NO: 30611 - RNA, 19 nt, Homo sapiens
cauaggaccuggagacaga

SEQ ID NO: 30612 - RNA, 19 nt, Homo sapiens
cuucaugagucacacauua

SEQ ID NO: 30613 - RNA, 19 nt, Homo sapiens
uuacguaccucuaagaaau

SEQ ID NO: 30614 - RNA, 19 nt, Homo sapiens
gaaggauaaugcuauguca

SEQ ID NO: 30615 - RNA, 19 nt, Homo sapiens
cagcagagcuuuccaccau

SEQ ID NO: 30616 - RNA, 19 nt, Homo sapiens
agucaaugaucuuguguua

SEQ ID NO: 30617 - RNA, 19 nt, Homo sapiens
ugaauacuccugugauuaa

SEQ ID NO: 30618 - RNA, 19 nt, Homo sapiens
gaagccaggugugguggua

SEQ ID NO: 30619 - RNA, 19 nt, Homo sapiens
gaacauguaaaguguguau

SEQ ID NO: 30620 - RNA, 19 nt, Homo sapiens
gaacugaaauacgacuugu

SEQ ID NO: 30621 - RNA, 19 nt, Homo sapiens
gauuaaugcugccguggaa

SEQ ID NO: 30622 - RNA, 19 nt, Homo sapiens
ccacugaaacauucuagua

SEQ ID NO: 30623 - RNA, 19 nt, Homo sapiens
caaugcagaagaugaaaua

SEQ ID NO: 30624 - RNA, 19 nt, Homo sapiens
gaacuguaccgaaugucua

SEQ ID NO: 30625 - RNA, 19 nt, Homo sapiens
agacauggccauugacuuu

SEQ ID NO: 30626 - RNA, 19 nt, Homo sapiens
gaaauacgacuugucaugu

SEQ ID NO: 30627 - RNA, 19 nt, Homo sapiens
gcacuacaaacacaauauu

SEQ ID NO: 30628 - RNA, 19 nt, Homo sapiens
gaaacuaagagaaugauag

SEQ ID NO: 30629 - RNA, 19 nt, Homo sapiens
guuaacaacuuggaagcua

SEQ ID NO: 30630 - RNA, 19 nt, Homo sapiens
agauugugcuccuucuuua

SEQ ID NO: 30631 - RNA, 19 nt, Homo sapiens
acaaagaaguguccauagu

SEQ ID NO: 30632 - RNA, 19 nt, Homo sapiens
ucaagacacuucaagauac

SEQ ID NO: 30633 - RNA, 19 nt, Homo sapiens
ugaguuaggucuugugcuu

SEQ ID NO: 30634 - RNA, 19 nt, Homo sapiens
uaagaaaguguccuauuug

SEQ ID NO: 30635 - RNA, 19 nt, Homo sapiens
caagaagaaagaacaugua

SEQ ID NO: 30636 - RNA, 19 nt, Homo sapiens
cugaagcuguguuauauga

SEQ ID NO: 30637 - RNA, 19 nt, Homo sapiens
cuaacugccggaauuauua

SEQ ID NO: 30638 - RNA, 19 nt, Homo sapiens
caacauuugacuuguguaa

SEQ ID NO: 30639 - RNA, 19 nt, Homo sapiens
gcaacuggagagaauuaua

SEQ ID NO: 30640 - RNA, 19 nt, Homo sapiens
gaaaagcgccaacacguuu

SEQ ID NO: 30641 - RNA, 19 nt, Homo sapiens
agucacacauuacaucuuu

SEQ ID NO: 30642 - RNA, 19 nt, Homo sapiens
aaagaaguguccauagugu

SEQ ID NO: 30643 - RNA, 19 nt, Homo sapiens
acacagacgucuuuacaag

SEQ ID NO: 30644 - RNA, 19 nt, Homo sapiens
aaugcagagucaucaauua

SEQ ID NO: 30645 - RNA, 19 nt, Homo sapiens
gauacacaguuucuaaucu

SEQ ID NO: 30646 - RNA, 19 nt, Homo sapiens
cuaguagccuggagaaguu

SEQ ID NO: 30647 - RNA, 19 nt, Homo sapiens
agaaagaacauguaaagug

SEQ ID NO: 30648 - RNA, 19 nt, Homo sapiens
caucuuagaaucagugaaa

SEQ ID NO: 30649 - RNA, 19 nt, Homo sapiens
uagaaucagugaaauaugg

SEQ ID NO: 30650 - RNA, 19 nt, Homo sapiens
aaggugcaauuguguauuu

SEQ ID NO: 30651 - RNA, 19 nt, Homo sapiens
ccugauggcuuaauacaca

SEQ ID NO: 30652 - RNA, 19 nt, Homo sapiens
cuaguaguaugcaaagauu

SEQ ID NO: 30653 - RNA, 19 nt, Homo sapiens
gagaacugauugauacgau

SEQ ID NO: 30654 - RNA, 19 nt, Homo sapiens
caagacacuucaagauaca

SEQ ID NO: 30655 - RNA, 19 nt, Homo sapiens
ggauaaugcuaugucagaa

SEQ ID NO: 30656 - RNA, 19 nt, Homo sapiens
caugugaacuguaccgaau

SEQ ID NO: 30657 - RNA, 19 nt, Homo sapiens
gaaguguccauaguguuua

SEQ ID NO: 30658 - RNA, 19 nt, Homo sapiens
cacagaagauguuucagau

SEQ ID NO: 30659 - RNA, 19 nt, Homo sapiens
ucuacuaacugccggaauu

SEQ ID NO: 30660 - RNA, 19 nt, Homo sapiens
gaacagcugcuauccacau

SEQ ID NO: 30661 - RNA, 19 nt, Homo sapiens
gugaugaugucaaaugcuu

SEQ ID NO: 30662 - RNA, 19 nt, Homo sapiens
uuuagaaucuccauguuga

SEQ ID NO: 30663 - RNA, 19 nt, Homo sapiens
caaagaaguguccauagug

SEQ ID NO: 30664 - RNA, 19 nt, Homo sapiens
ccacagaagauguuucaga

SEQ ID NO: 30665 - RNA, 19 nt, Homo sapiens
ggaagaggagagagaaaga

SEQ ID NO: 30666 - RNA, 19 nt, Homo sapiens
uaaaguguguauggacaaa

SEQ ID NO: 30667 - RNA, 19 nt, Homo sapiens
aaacagacaguucagagaa

SEQ ID NO: 30668 - RNA, 19 nt, Homo sapiens
gaagaccauucagaagaug

SEQ ID NO: 30669 - RNA, 19 nt, Homo sapiens
gaaccgaaggauaaugcua

SEQ ID NO: 30670 - RNA, 19 nt, Homo sapiens
gaauacuccugugauuaau

SEQ ID NO: 30671 - RNA, 19 nt, Homo sapiens
gugaguacuugauaagaau

SEQ ID NO: 30672 - RNA, 19 nt, Homo sapiens
uuucagacauggccauuga

SEQ ID NO: 30673 - RNA, 19 nt, Homo sapiens
caucaaauccuguaaacuc

SEQ ID NO: 30674 - RNA, 19 nt, Homo sapiens
gaaggugugcauauauguu

SEQ ID NO: 30675 - RNA, 19 nt, Homo sapiens
agaaagagcaacugaggaa

SEQ ID NO: 30676 - RNA, 19 nt, Homo sapiens
caaauuccacacacucauu

SEQ ID NO: 30677 - RNA, 19 nt, Homo sapiens
gcagauucguucagagucu

SEQ ID NO: 30678 - RNA, 19 nt, Homo sapiens
aaagaagcuucaugaguca

SEQ ID NO: 30679 - RNA, 19 nt, Homo sapiens
aagaaaguguccuauuugu

SEQ ID NO: 30680 - RNA, 19 nt, Homo sapiens
gagacuacaagaagaaaga

SEQ ID NO: 30681 - RNA, 19 nt, Homo sapiens
gaacaauugcggagacuac

SEQ ID NO: 30682 - RNA, 19 nt, Homo sapiens
uagcaacuggagagaauua

SEQ ID NO: 30683 - RNA, 19 nt, Homo sapiens
guucauccgucaaguucaa

SEQ ID NO: 30684 - RNA, 19 nt, Homo sapiens
ugugaguacuugauaagaa

SEQ ID NO: 30685 - RNA, 19 nt, Homo sapiens
gguaagaacuacugagaaa

SEQ ID NO: 30686 - RNA, 19 nt, Homo sapiens
ggaaagaugucagagauau

SEQ ID NO: 30687 - RNA, 19 nt, Homo sapiens
guagauagauggcaauaug

SEQ ID NO: 30688 - RNA, 19 nt, Homo sapiens
aaauggagcuuucuguaua

SEQ ID NO: 30689 - RNA, 19 nt, Homo sapiens
cgagagauuuggaaagaua

SEQ ID NO: 30690 - RNA, 19 nt, Homo sapiens
cagauaggcuuaacaaaug

SEQ ID NO: 30691 - RNA, 19 nt, Homo sapiens
gaagggacaagaauauaua

SEQ ID NO: 30692 - RNA, 19 nt, Homo sapiens
ggaagaagaauuuguagaa

SEQ ID NO: 30693 - RNA, 19 nt, Homo sapiens
gauauacaccaaacuguua

SEQ ID NO: 30694 - RNA, 19 nt, Homo sapiens
ccuaauugcuucuuuguuu

SEQ ID NO: 30695 - RNA, 19 nt, Homo sapiens
gaggagggcuaacugauug

SEQ ID NO: 30696 - RNA, 19 nt, Homo sapiens
ggaaagauagagauuguuu

SEQ ID NO: 30697 - RNA, 19 nt, Homo sapiens
ugaagaagcuagauuaaag

SEQ ID NO: 30698 - RNA, 19 nt, Homo sapiens
guacugacauggaaagaug

SEQ ID NO: 30699 - RNA, 19 nt, Homo sapiens
agaaagagauuaguacuga

SEQ ID NO: 30700 - RNA, 19 nt, Homo sapiens
gaggaacccugccauguau

SEQ ID NO: 30701 - RNA, 19 nt, Homo sapiens
ggaacaacaugcuaaaugg

SEQ ID NO: 30702 - RNA, 19 nt, Homo sapiens
ggacauggauauacucagu

SEQ ID NO: 30703 - RNA, 19 nt, Homo sapiens
gcacggaucuuuacuuuug

SEQ ID NO: 30704 - RNA, 19 nt, Homo sapiens
gguauuagcuguauuaucc

SEQ ID NO: 30705 - RNA, 19 nt, Homo sapiens
gagguugguuguuguguuu

SEQ ID NO: 30706 - RNA, 19 nt, Homo sapiens
gaugugaacugacuuuaag

SEQ ID NO: 30707 - RNA, 19 nt, Homo sapiens
acaagaagcuauacgaaug

SEQ ID NO: 30708 - RNA, 19 nt, Homo sapiens
gaacagaagggacaagaau

SEQ ID NO: 30709 - RNA, 19 nt, Homo sapiens
ggaaagauauacaccaaac

SEQ ID NO: 30710 - RNA, 19 nt, Homo sapiens
caagaugagucaagucaga

SEQ ID NO: 30711 - RNA, 19 nt, Homo sapiens
gagcaggguuucuuuauac

SEQ ID NO: 30712 - RNA, 19 nt, Homo sapiens
gaucaaaguauguauguug

SEQ ID NO: 30713 - RNA, 19 nt, Homo sapiens
ggagcuuucuguauauaaa

SEQ ID NO: 30714 - RNA, 19 nt, Homo sapiens
gaacacaggcgacacuuuc

SEQ ID NO: 30715 - RNA, 19 nt, Homo sapiens
cuagggagcuguguuguuu

SEQ ID NO: 30716 - RNA, 19 nt, Homo sapiens
acaccaaacuguuaaaugu

SEQ ID NO: 30717 - RNA, 19 nt, Homo sapiens
cgagcaggguuucuuuaua

SEQ ID NO: 30718 - RNA, 19 nt, Homo sapiens
ucagagauauguuaagugu

SEQ ID NO: 30719 - RNA, 19 nt, Homo sapiens
ggacaucuagucacuugua

SEQ ID NO: 30720 - RNA, 19 nt, Homo sapiens
guaaagugauuugccauug

SEQ ID NO: 30721 - RNA, 19 nt, Homo sapiens
gaagaagaauuuguagaag

SEQ ID NO: 30722 - RNA, 19 nt, Homo sapiens
gaaagagauuaguacugaa

SEQ ID NO: 30723 - RNA, 19 nt, Homo sapiens
gcuacacagucauuacuuu

SEQ ID NO: 30724 - RNA, 19 nt, Homo sapiens
gugcaaauaucuguuagaa

SEQ ID NO: 30725 - RNA, 19 nt, Homo sapiens
gaacugggcagguuguaga

SEQ ID NO: 30726 - RNA, 19 nt, Homo sapiens
gagcaacuauaaaucacuu

SEQ ID NO: 30727 - RNA, 19 nt, Homo sapiens
ggacucuacuacacaggua

SEQ ID NO: 30728 - RNA, 19 nt, Homo sapiens
guugaaagcguauuuaaug

SEQ ID NO: 30729 - RNA, 19 nt, Homo sapiens
ggaagacacaggaaaguau

SEQ ID NO: 30730 - RNA, 19 nt, Homo sapiens
gaagaugacuuuuaacagu

SEQ ID NO: 30731 - RNA, 19 nt, Homo sapiens
aagcacggaucuuuacuuu

SEQ ID NO: 30732 - RNA, 19 nt, Homo sapiens
acauggauauacucaguua

SEQ ID NO: 30733 - RNA, 19 nt, Homo sapiens
guaggcauguuauguuguu

SEQ ID NO: 30734 - RNA, 19 nt, Homo sapiens
gaaagacaguaugcaagau

SEQ ID NO: 30735 - RNA, 19 nt, Homo sapiens
ccaccacccuucccucuga

SEQ ID NO: 30736 - RNA, 19 nt, Homo sapiens
ggaggagggcuaacugauu

SEQ ID NO: 30737 - RNA, 19 nt, Homo sapiens
gaacuaacaucaguaaccu

SEQ ID NO: 30738 - RNA, 19 nt, Homo sapiens
ggacgugugcgaaauaugu

SEQ ID NO: 30739 - RNA, 19 nt, Homo sapiens
ugagacacaugcagacuau

SEQ ID NO: 30740 - RNA, 19 nt, Homo sapiens
gcauagaacgagagauuug

SEQ ID NO: 30741 - RNA, 19 nt, Homo sapiens
caaauggagcuuucuguau

SEQ ID NO: 30742 - RNA, 19 nt, Homo sapiens
ucagauaggcuuaacaaau

SEQ ID NO: 30743 - RNA, 19 nt, Homo sapiens
cgaggaacccugccaugua

SEQ ID NO: 30744 - RNA, 19 nt, Homo sapiens
ucaugcagcuguagauaga

SEQ ID NO: 30745 - RNA, 19 nt, Homo sapiens
gcacgagcaggguuucuuu

SEQ ID NO: 30746 - RNA, 19 nt, Homo sapiens
gagccaacauguacugaca

SEQ ID NO: 30747 - RNA, 19 nt, Homo sapiens
uaaagugauuugccauugu

SEQ ID NO: 30748 - RNA, 19 nt, Homo sapiens
guggaaagauagagauugu

SEQ ID NO: 30749 - RNA, 19 nt, Homo sapiens
gauugaaugugugauguga

SEQ ID NO: 30750 - RNA, 19 nt, Homo sapiens
gggaacaacaugcuaaaug

SEQ ID NO: 30751 - RNA, 19 nt, Homo sapiens
aaagugauuugccauuguu

SEQ ID NO: 30752 - RNA, 19 nt, Homo sapiens
ggauugaauuccauuagca

SEQ ID NO: 30753 - RNA, 19 nt, Homo sapiens
aggcgacacuuuccuaauu

SEQ ID NO: 30754 - RNA, 19 nt, Homo sapiens
ugaauuccauuagcauuug

SEQ ID NO: 30755 - RNA, 19 nt, Homo sapiens
guggacaucuagucacuug

SEQ ID NO: 30756 - RNA, 19 nt, Homo sapiens
gagaaaacaccaucacuaa

SEQ ID NO: 30757 - RNA, 19 nt, Homo sapiens
ugaagcaguugacaagugu

SEQ ID NO: 30758 - RNA, 19 nt, Homo sapiens
gacaucuagucacuuguaa

SEQ ID NO: 30759 - RNA, 19 nt, Homo sapiens
aggugaaggugauaaagua

SEQ ID NO: 30760 - RNA, 19 nt, Homo sapiens
gaucgugccuggucagaac

SEQ ID NO: 30761 - RNA, 19 nt, Homo sapiens
cugcagacaucaauaagga

SEQ ID NO: 30762 - RNA, 19 nt, Homo sapiens
ccagaauggucaguacaaa

SEQ ID NO: 30763 - RNA, 19 nt, Homo sapiens
caagagaagaugacuuuua

SEQ ID NO: 30764 - RNA, 19 nt, Homo sapiens
guacaagaagcuauacgaa

SEQ ID NO: 30765 - RNA, 19 nt, Homo sapiens
caggguauuagcuguauua

SEQ ID NO: 30766 - RNA, 19 nt, Homo sapiens
uaucugggagcaacuauaa

SEQ ID NO: 30767 - RNA, 19 nt, Homo sapiens
ggcgacacuuuccuaauug

SEQ ID NO: 30768 - RNA, 19 nt, Homo sapiens
gaagaagcuagauuaaagu

SEQ ID NO: 30769 - RNA, 19 nt, Homo sapiens
ugaagacccuugggaacaa

SEQ ID NO: 30770 - RNA, 19 nt, Homo sapiens
agauauaucagacaccaua

SEQ ID NO: 30771 - RNA, 19 nt, Homo sapiens
gccacgcagucuacaaauu

SEQ ID NO: 30772 - RNA, 19 nt, Homo sapiens
gaacgagagauuuggaaag

SEQ ID NO: 30773 - RNA, 19 nt, Homo sapiens
ucuagugaaugcucagaaa

SEQ ID NO: 30774 - RNA, 19 nt, Homo sapiens
cuagaagaauugaugauac

SEQ ID NO: 30775 - RNA, 19 nt, Homo sapiens
ucacuaacuagaagaauug

SEQ ID NO: 30776 - RNA, 19 nt, Homo sapiens
gugauaaaguaaagugcuu

SEQ ID NO: 30777 - RNA, 19 nt, Homo sapiens
gaagcacggaucuuuacuu

SEQ ID NO: 30778 - RNA, 19 nt, Homo sapiens
gccagacuaugcucaccua

SEQ ID NO: 30779 - RNA, 19 nt, Homo sapiens
gaaagaugucagagauaug

SEQ ID NO: 30780 - RNA, 19 nt, Homo sapiens
agacaucaauaaggaagaa

SEQ ID NO: 30781 - RNA, 19 nt, Homo sapiens
acaaauggagcuuucugua

SEQ ID NO: 30782 - RNA, 19 nt, Homo sapiens
gucauuacuuucaagcaaa

SEQ ID NO: 30783 - RNA, 19 nt, Homo sapiens
gguugcagaucuagugaau

SEQ ID NO: 30784 - RNA, 19 nt, Homo sapiens
gcaacuauaaaucacuuga

SEQ ID NO: 30785 - RNA, 19 nt, Homo sapiens
caacauggcuuucuuauuu

SEQ ID NO: 30786 - RNA, 19 nt, Homo sapiens
gaagcaguuugaagaauua

SEQ ID NO: 30787 - RNA, 19 nt, Homo sapiens
gaaaggagaucaacauuuu

SEQ ID NO: 30788 - RNA, 19 nt, Homo sapiens
caaaggaaaccaacaauaa

SEQ ID NO: 30789 - RNA, 19 nt, Homo sapiens
gaagaaagaauuugaggaa

SEQ ID NO: 30790 - RNA, 19 nt, Homo sapiens
gcacaaagccauucuaagu

SEQ ID NO: 30791 - RNA, 19 nt, Homo sapiens
gcaaaggaaaccaacaaua

SEQ ID NO: 30792 - RNA, 19 nt, Homo sapiens
gcaguggccuaaauccuuu

SEQ ID NO: 30793 - RNA, 19 nt, Homo sapiens
ggcguaagaugauggauuu

SEQ ID NO: 30794 - RNA, 19 nt, Homo sapiens
ggaaaggagaucaacauuu

SEQ ID NO: 30795 - RNA, 19 nt, Homo sapiens
gcugaagucuggcguaaga

SEQ ID NO: 30796 - RNA, 19 nt, Homo sapiens
gaacaaaauugcaaaggaa

SEQ ID NO: 30797 - RNA, 19 nt, Homo sapiens
gcugcaggguggauuguua

SEQ ID NO: 30798 - RNA, 19 nt, Homo sapiens
gagacagaauagagugaua

SEQ ID NO: 30799 - RNA, 19 nt, Homo sapiens
gcagagccuuccacaguga

SEQ ID NO: 30800 - RNA, 19 nt, Homo sapiens
uaacaacauggcuuucuua

SEQ ID NO: 30801 - RNA, 19 nt, Homo sapiens
gaaagaauuugaggaaacu

SEQ ID NO: 30802 - RNA, 19 nt, Homo sapiens
gcagguuccuuaucuguca

SEQ ID NO: 30803 - RNA, 19 nt, Homo sapiens
guagaugcaugacuugugu

SEQ ID NO: 30804 - RNA, 19 nt, Homo sapiens
gaaacuggacagagaaaga

SEQ ID NO: 30805 - RNA, 19 nt, Homo sapiens
ugaggaaacugcgaagaaa

SEQ ID NO: 30806 - RNA, 19 nt, Homo sapiens
agaagcaguuugaagaauu

SEQ ID NO: 30807 - RNA, 19 nt, Homo sapiens
acaaagccauucuaaguca

SEQ ID NO: 30808 - RNA, 19 nt, Homo sapiens
guaagaugauggauuugau

SEQ ID NO: 30809 - RNA, 19 nt, Homo sapiens
cagaauagagugauaggaa

SEQ ID NO: 30810 - RNA, 19 nt, Homo sapiens
gggcagagccuuccacagu

SEQ ID NO: 30811 - RNA, 19 nt, Homo sapiens
gagaaagagccaagaacaa

SEQ ID NO: 30812 - RNA, 19 nt, Homo sapiens
gaaaccaacaauaagaaga

SEQ ID NO: 30813 - RNA, 19 nt, Homo sapiens
gggcugaagucuggcguaa

SEQ ID NO: 30814 - RNA, 19 nt, Homo sapiens
agaaagagccaagaacaaa

SEQ ID NO: 30815 - RNA, 19 nt, Homo sapiens
gaauuaacccuuggugaau

SEQ ID NO: 30816 - RNA, 19 nt, Homo sapiens
caagaagcaguuugaagaa

SEQ ID NO: 30817 - RNA, 19 nt, Homo sapiens
gaaugugucuggaccucau

SEQ ID NO: 30818 - RNA, 19 nt, Homo sapiens
caacugugcuccuguuuug

SEQ ID NO: 30819 - RNA, 19 nt, Homo sapiens
gaagucuggcguaagauga

SEQ ID NO: 30820 - RNA, 19 nt, Homo sapiens
gaauagcacaaacuacaau

SEQ ID NO: 30821 - RNA, 19 nt, Homo sapiens
cagaauagcacaaacuaca

SEQ ID NO: 30822 - RNA, 19 nt, Homo sapiens
caccgcaucucuacauuca

SEQ ID NO: 30823 - RNA, 19 nt, Homo sapiens
agaauuaacccuuggugaa

SEQ ID NO: 30824 - RNA, 19 nt, Homo sapiens
gaggucaucucggcuguuc

SEQ ID NO: 30825 - RNA, 19 nt, Homo sapiens
augcaugacuuguguguga

SEQ ID NO: 30826 - RNA, 19 nt, Homo sapiens
agaaagaauuugaggaaac

SEQ ID NO: 30827 - RNA, 19 nt, Homo sapiens
ccaacaauaagaagaaaga

SEQ ID NO: 30828 - RNA, 19 nt, Homo sapiens
ccacugcugugugauuaga

SEQ ID NO: 30829 - RNA, 19 nt, Homo sapiens
uggaugaggagacagaaua

SEQ ID NO: 30830 - RNA, 19 nt, Homo sapiens
cggcuguuccugagaaaua

SEQ ID NO: 30831 - RNA, 19 nt, Homo sapiens
uuagcaaugucuuaggaaa

SEQ ID NO: 30832 - RNA, 19 nt, Homo sapiens
uuaaaugacuuggcucgau

SEQ ID NO: 30833 - RNA, 19 nt, Homo sapiens
gauuagacaggcccaguga

SEQ ID NO: 30834 - RNA, 19 nt, Homo sapiens
uuaacaacauggcuuucuu

SEQ ID NO: 30835 - RNA, 19 nt, Homo sapiens
ugacuugugugugaugaga

SEQ ID NO: 30836 - RNA, 19 nt, Homo sapiens
gcgcuuuccuuucugucaa

SEQ ID NO: 30837 - RNA, 19 nt, Homo sapiens
uggcuccucuacuguuuaa

SEQ ID NO: 30838 - RNA, 19 nt, Homo sapiens
ugccacugcugugugauua

SEQ ID NO: 30839 - RNA, 19 nt, Homo sapiens
ccgcaucucuacauucaag

SEQ ID NO: 30840 - RNA, 19 nt, Homo sapiens
gagaagugagggaggaaga

SEQ ID NO: 30841 - RNA, 19 nt, Homo sapiens
ucacaucugucacguucuc

SEQ ID NO: 30842 - RNA, 19 nt, Homo sapiens
gcccaaccuucacaucugu

SEQ ID NO: 30843 - RNA, 19 nt, Homo sapiens
ggaaaccaacaauaagaag

SEQ ID NO: 30844 - RNA, 19 nt, Homo sapiens
cacagaauagcacaaacua

SEQ ID NO: 30845 - RNA, 19 nt, Homo sapiens
ccacuuccaggguuuauuc

SEQ ID NO: 30846 - RNA, 19 nt, Homo sapiens
gaaagagccaagaacaaaa

SEQ ID NO: 30847 - RNA, 19 nt, Homo sapiens
ugagaacgagccagacuug

SEQ ID NO: 30848 - RNA, 19 nt, Homo sapiens
ggcaguggccuaaauccuu

SEQ ID NO: 30849 - RNA, 19 nt, Homo sapiens
aagcacaaagccauucuaa

SEQ ID NO: 30850 - RNA, 19 nt, Homo sapiens
gucuggaccucauguuguu

SEQ ID NO: 30851 - RNA, 19 nt, Homo sapiens
ggcuguuccugagaaauaa

SEQ ID NO: 30852 - RNA, 19 nt, Homo sapiens
gcaccacuuccaggguuua

SEQ ID NO: 30853 - RNA, 19 nt, Homo sapiens
aaaggaaaccaacaauaag

SEQ ID NO: 30854 - RNA, 19 nt, Homo sapiens
ccuuagcaaugucuuagga

SEQ ID NO: 30855 - RNA, 19 nt, Homo sapiens
aaggaaaccaacaauaaga

SEQ ID NO: 30856 - RNA, 19 nt, Homo sapiens
aagaagcaguuugaagaau

SEQ ID NO: 30857 - RNA, 19 nt, Homo sapiens
uaacaguggcugcuucucu

SEQ ID NO: 30858 - RNA, 19 nt, Homo sapiens
auuaacccuuggugaauuu

SEQ ID NO: 30859 - RNA, 19 nt, Homo sapiens
uuugguagaugcaugacuu

SEQ ID NO: 30860 - RNA, 19 nt, Homo sapiens
gggcuuaccaggugagaag

SEQ ID NO: 30861 - RNA, 19 nt, Homo sapiens
gcaaugucuuaggaaagga

SEQ ID NO: 30862 - RNA, 19 nt, Homo sapiens
agagaaagagccaagaaca

SEQ ID NO: 30863 - RNA, 19 nt, Homo sapiens
ccuggcuccucuacuguuu

SEQ ID NO: 30864 - RNA, 19 nt, Homo sapiens
ggaugaggagacagaauag

SEQ ID NO: 30865 - RNA, 19 nt, Homo sapiens
ggagaucaacauuuucaaa

SEQ ID NO: 30866 - RNA, 19 nt, Homo sapiens
cguaagaugauggauuuga

SEQ ID NO: 30867 - RNA, 19 nt, Homo sapiens
caaagccauucuaagucau

SEQ ID NO: 30868 - RNA, 19 nt, Homo sapiens
gaccaccgcaucucuacau

SEQ ID NO: 30869 - RNA, 19 nt, Homo sapiens
gcaucucuacauucaagaa

SEQ ID NO: 30870 - RNA, 19 nt, Homo sapiens
gucccuggcuccucuacug

SEQ ID NO: 30871 - RNA, 19 nt, Homo sapiens
gguagaugcaugacuugug

SEQ ID NO: 30872 - RNA, 19 nt, Homo sapiens
gaagugagggaggaagaag

SEQ ID NO: 30873 - RNA, 19 nt, Homo sapiens
ggaaacugcgaagaaagug

SEQ ID NO: 30874 - RNA, 19 nt, Homo sapiens
acagagaaagagccaagaa

SEQ ID NO: 30875 - RNA, 19 nt, Homo sapiens
ucagguggaugaggagaca

SEQ ID NO: 30876 - RNA, 19 nt, Homo sapiens
acaacauggcuuucuuauu

SEQ ID NO: 30877 - RNA, 19 nt, Homo sapiens
uaggaaaggagaucaacau

SEQ ID NO: 30878 - RNA, 19 nt, Homo sapiens
gaggaaacugcgaagaaag

SEQ ID NO: 30879 - RNA, 19 nt, Homo sapiens
cgguugcgcuuuccuuucu

SEQ ID NO: 30880 - RNA, 19 nt, Homo sapiens
ggagacagaauagagugau

SEQ ID NO: 30881 - RNA, 19 nt, Homo sapiens
gagagaauggagacagagu

SEQ ID NO: 30882 - RNA, 19 nt, Homo sapiens
cagacuuggcccaguguuu

SEQ ID NO: 30883 - RNA, 19 nt, Homo sapiens
uuucaacugugcuccuguu

SEQ ID NO: 30884 - RNA, 19 nt, Homo sapiens
ccuccucccugucauagag

SEQ ID NO: 30885 - RNA, 19 nt, Homo sapiens
cuacuaacaucccaauaaa

SEQ ID NO: 30886 - RNA, 19 nt, Homo sapiens
cagacgguguggauauuua

SEQ ID NO: 30887 - RNA, 19 nt, Homo sapiens
ggaauucacccucucaugu

SEQ ID NO: 30888 - RNA, 19 nt, Homo sapiens
ugaacccgcuggaacagua

SEQ ID NO: 30889 - RNA, 19 nt, Homo sapiens
ccaagaaccugccuaaagc

SEQ ID NO: 30890 - RNA, 19 nt, Homo sapiens
gaauucacccucucauguu

SEQ ID NO: 30891 - RNA, 19 nt, Homo sapiens
auaaaguccucuucccuaa

SEQ ID NO: 30892 - RNA, 19 nt, Homo sapiens
gaggagagggugaaucaga

SEQ ID NO: 30893 - RNA, 19 nt, Homo sapiens
gcagacaaccaguccaaga

SEQ ID NO: 30894 - RNA, 19 nt, Homo sapiens
ucucauguuucccuacuaa

SEQ ID NO: 30895 - RNA, 19 nt, Homo sapiens
cguaggaugcgccagauua

SEQ ID NO: 30896 - RNA, 19 nt, Homo sapiens
ggaccaaugugagaguuca

SEQ ID NO: 30897 - RNA, 19 nt, Homo sapiens
ccuacuaacaucccaauaa

SEQ ID NO: 30898 - RNA, 19 nt, Homo sapiens
ccuaagaauucccagauag

SEQ ID NO: 30899 - RNA, 19 nt, Homo sapiens
ugagacggcuggaaauucu

SEQ ID NO: 30900 - RNA, 19 nt, Homo sapiens
guaggaugcgccagauuaa

SEQ ID NO: 30901 - RNA, 19 nt, Homo sapiens
gcagggagucuugaaguga

SEQ ID NO: 30902 - RNA, 19 nt, Homo sapiens
gaaaggugaaugcgucugu

SEQ ID NO: 30903 - RNA, 19 nt, Homo sapiens
gaagaugaacccgcuggaa

SEQ ID NO: 30904 - RNA, 19 nt, Homo sapiens
cugccugccuggugaauuu

SEQ ID NO: 30905 - RNA, 19 nt, Homo sapiens
cgacagcgccugguggaaa

SEQ ID NO: 30906 - RNA, 19 nt, Homo sapiens
cacagccaguagaugauua

SEQ ID NO: 30907 - RNA, 19 nt, Homo sapiens
cuccucaccuuaauuuauu

SEQ ID NO: 30908 - RNA, 19 nt, Homo sapiens
ggguuucccuuuccacuca

SEQ ID NO: 30909 - RNA, 19 nt, Homo sapiens
ggaugcgccagauuaauga

SEQ ID NO: 30910 - RNA, 19 nt, Homo sapiens
gcaguggucggcaaaguca

SEQ ID NO: 30911 - RNA, 19 nt, Homo sapiens
cccuaagaauucccagaua

SEQ ID NO: 30912 - RNA, 19 nt, Homo sapiens
gcuaugagaaccccacuua

SEQ ID NO: 30913 - RNA, 19 nt, Homo sapiens
cgguguggauauuuacuuu

SEQ ID NO: 30914 - RNA, 19 nt, Homo sapiens
aaaauuccaucccuaagaa

SEQ ID NO: 30915 - RNA, 19 nt, Homo sapiens
ggaacaguaugagcgaaag

SEQ ID NO: 30916 - RNA, 19 nt, Homo sapiens
cagacaaccaguccaagaa

SEQ ID NO: 30917 - RNA, 19 nt, Homo sapiens
gggcugaggacgaggaaga

SEQ ID NO: 30918 - RNA, 19 nt, Homo sapiens
uaaaguccucuucccuaaa

SEQ ID NO: 30919 - RNA, 19 nt, Homo sapiens
aauucacccucucauguuu

SEQ ID NO: 30920 - RNA, 19 nt, Homo sapiens
gcaccuccucaccuuaauu

SEQ ID NO: 30921 - RNA, 19 nt, Homo sapiens
aaaguccucuucccuaaaa

SEQ ID NO: 30922 - RNA, 19 nt, Homo sapiens
agacggcuggaaauucuua

SEQ ID NO: 30923 - RNA, 19 nt, Homo sapiens
ccagauuaaugaggugaug

SEQ ID NO: 30924 - RNA, 19 nt, Homo sapiens
ggacgaggaagaggaggaa

SEQ ID NO: 30925 - RNA, 19 nt, Homo sapiens
cagggagucuugaagugau

SEQ ID NO: 30926 - RNA, 19 nt, Homo sapiens
caccuccucaccuuaauuu

SEQ ID NO: 30927 - RNA, 19 nt, Homo sapiens
cuggugaauuugugaguga

SEQ ID NO: 30928 - RNA, 19 nt, Homo sapiens
ggaguacugcagacagaug

SEQ ID NO: 30929 - RNA, 19 nt, Homo sapiens
gaacuccuccacucugaac

SEQ ID NO: 30930 - RNA, 19 nt, Homo sapiens
acuaacaucccaauaaagu

SEQ ID NO: 30931 - RNA, 19 nt, Homo sapiens
gugaaugcgucuguuccaa

SEQ ID NO: 30932 - RNA, 19 nt, Homo sapiens
ccugaaggcugccgguucu

SEQ ID NO: 30933 - RNA, 19 nt, Homo sapiens
gugcggagcagaaggaaca

SEQ ID NO: 30934 - RNA, 19 nt, Homo sapiens
guguggauauuuacuuugg

SEQ ID NO: 30935 - RNA, 19 nt, Homo sapiens
gucuugaagugaucauuuc

SEQ ID NO: 30936 - RNA, 19 nt, Homo sapiens
gcauacccaccuucaagug

SEQ ID NO: 30937 - RNA, 19 nt, Homo sapiens
gugcauacccaccuucaag

SEQ ID NO: 30938 - RNA, 19 nt, Homo sapiens
ccacagccaguagaugauu

SEQ ID NO: 30939 - RNA, 19 nt, Homo sapiens
ccuccucaccuuaauuuau

SEQ ID NO: 30940 - RNA, 19 nt, Homo sapiens
cgagaaggcacagcagaug

SEQ ID NO: 30941 - RNA, 19 nt, Homo sapiens
cgucaucgcccuuaucaac

SEQ ID NO: 30942 - RNA, 19 nt, Homo sapiens
gcacuuccaguccauucug

SEQ ID NO: 30943 - RNA, 19 nt, Homo sapiens
uccaagaaccugccuaaag

SEQ ID NO: 30944 - RNA, 19 nt, Homo sapiens
caaaauuccaucccuaaga

SEQ ID NO: 30945 - RNA, 19 nt, Homo sapiens
cauacccaccuucaaguga

SEQ ID NO: 30946 - RNA, 19 nt, Homo sapiens
ucaucgcccuuaucaacga

SEQ ID NO: 30947 - RNA, 19 nt, Homo sapiens
gacagcgccugguggaaac

SEQ ID NO: 30948 - RNA, 19 nt, Homo sapiens
gagcacuuccaguccauuc

SEQ ID NO: 30949 - RNA, 19 nt, Homo sapiens
uggcaccuccucaccuuaa

SEQ ID NO: 30950 - RNA, 19 nt, Homo sapiens
cguggcaccuccucaccuu

SEQ ID NO: 30951 - RNA, 19 nt, Homo sapiens
aaaggugaaugcgucuguu

SEQ ID NO: 30952 - RNA, 19 nt, Homo sapiens
ucccacagccaguagauga

SEQ ID NO: 30953 - RNA, 19 nt, Homo sapiens
cuggaguacugcagacaga

SEQ ID NO: 30954 - RNA, 19 nt, Homo sapiens
ggaacuccuccacucugaa

SEQ ID NO: 30955 - RNA, 19 nt, Homo sapiens
auuuauggcucuuuaaggu

SEQ ID NO: 30956 - RNA, 19 nt, Homo sapiens
cagcagggagucuugaagu

SEQ ID NO: 30957 - RNA, 19 nt, Homo sapiens
gaacccgcuggaacaguau

SEQ ID NO: 30958 - RNA, 19 nt, Homo sapiens
ccaaaaggguccacagaac

SEQ ID NO: 30959 - RNA, 19 nt, Homo sapiens
uaagaauucccagauaguc

SEQ ID NO: 30960 - RNA, 19 nt, Homo sapiens
cuaagaauucccagauagu

SEQ ID NO: 30961 - RNA, 19 nt, Homo sapiens
gaucauuucacacccuuuu

SEQ ID NO: 30962 - RNA, 19 nt, Homo sapiens
cagcggcacggcuaugaga

SEQ ID NO: 30963 - RNA, 19 nt, Homo sapiens
ccugagaaagagaagauga

SEQ ID NO: 30964 - RNA, 19 nt, Homo sapiens
aggaugcgccagauuaaug

SEQ ID NO: 30965 - RNA, 19 nt, Homo sapiens
gugagacggcuggaaauuc

SEQ ID NO: 30966 - RNA, 19 nt, Homo sapiens
ugucgggucugcugaucau

SEQ ID NO: 30967 - RNA, 19 nt, Homo sapiens
agucuugaagugaucauuu

SEQ ID NO: 30968 - RNA, 19 nt, Homo sapiens
gaacaaagaucgcuuacau

SEQ ID NO: 30969 - RNA, 19 nt, Homo sapiens
gagauuagccuguagcuua

SEQ ID NO: 30970 - RNA, 19 nt, Homo sapiens
ggaaagcuuugaacaauug

SEQ ID NO: 30971 - RNA, 19 nt, Homo sapiens
gcagauauuugauguaguu

SEQ ID NO: 30972 - RNA, 19 nt, Homo sapiens
ggaccgagauuacuacuau

SEQ ID NO: 30973 - RNA, 19 nt, Homo sapiens
caaaggagaugacuacaau

SEQ ID NO: 30974 - RNA, 19 nt, Homo sapiens
ggaagacuaugauguuuau

SEQ ID NO: 30975 - RNA, 19 nt, Homo sapiens
ggaaugaccuuauauagcu

SEQ ID NO: 30976 - RNA, 19 nt, Homo sapiens
cuagagagcuuaguguaua

SEQ ID NO: 30977 - RNA, 19 nt, Homo sapiens
ccaaugauguugaugugua

SEQ ID NO: 30978 - RNA, 19 nt, Homo sapiens
gaacuguaauggccacuga

SEQ ID NO: 30979 - RNA, 19 nt, Homo sapiens
ggagauguauccagagcua

SEQ ID NO: 30980 - RNA, 19 nt, Homo sapiens
gaagaaaggaggaaccaaa

SEQ ID NO: 30981 - RNA, 19 nt, Homo sapiens
gguaaccugugguguauuu

SEQ ID NO: 30982 - RNA, 19 nt, Homo sapiens
cacaugcucucaauauaua

SEQ ID NO: 30983 - RNA, 19 nt, Homo sapiens
gaacugcaauuuccauucu

SEQ ID NO: 30984 - RNA, 19 nt, Homo sapiens
gacacaugcucucaauaua

SEQ ID NO: 30985 - RNA, 19 nt, Homo sapiens
ggauggcucuggagaacua

SEQ ID NO: 30986 - RNA, 19 nt, Homo sapiens
ggaaauuacucaugauguc

SEQ ID NO: 30987 - RNA, 19 nt, Homo sapiens
acaaggaaauuacucauga

SEQ ID NO: 30988 - RNA, 19 nt, Homo sapiens
gaagagaaagugauuaaca

SEQ ID NO: 30989 - RNA, 19 nt, Homo sapiens
gccuguagcuuauauuuga

SEQ ID NO: 30990 - RNA, 19 nt, Homo sapiens
ccuacaaacuccuuaauau

SEQ ID NO: 30991 - RNA, 19 nt, Homo sapiens
gaggaagacuaugauguuu

SEQ ID NO: 30992 - RNA, 19 nt, Homo sapiens
uggagcagaugcagauuua

SEQ ID NO: 30993 - RNA, 19 nt, Homo sapiens
acaaauaccuggagcagau

SEQ ID NO: 30994 - RNA, 19 nt, Homo sapiens
caaaugugauggaggcaaa

SEQ ID NO: 30995 - RNA, 19 nt, Homo sapiens
ccaagaaauucaagaggaa

SEQ ID NO: 30996 - RNA, 19 nt, Homo sapiens
accaagagcugcuuugaaa

SEQ ID NO: 30997 - RNA, 19 nt, Homo sapiens
gagaauguacacaguuuaa

SEQ ID NO: 30998 - RNA, 19 nt, Homo sapiens
ggaaguugcugagaaaugg

SEQ ID NO: 30999 - RNA, 19 nt, Homo sapiens
aaagaucgcuuacauacca

SEQ ID NO: 31000 - RNA, 19 nt, Homo sapiens
gauuaaacuucaccuacaa

SEQ ID NO: 31001 - RNA, 19 nt, Homo sapiens
gagaaagugauuaacagua

SEQ ID NO: 31002 - RNA, 19 nt, Homo sapiens
aaagugaauuuccuacuga

SEQ ID NO: 31003 - RNA, 19 nt, Homo sapiens
guacacaguuuaaacacau

SEQ ID NO: 31004 - RNA, 19 nt, Homo sapiens
guggaaagcuuugaacaau

SEQ ID NO: 31005 - RNA, 19 nt, Homo sapiens
gagaagaccacaccaagga

SEQ ID NO: 31006 - RNA, 19 nt, Homo sapiens
gugcagauauggaccaguu

SEQ ID NO: 31007 - RNA, 19 nt, Homo sapiens
gaaguuaaauaugcaugug

SEQ ID NO: 31008 - RNA, 19 nt, Homo sapiens
ggaaauugaugagcuccuu

SEQ ID NO: 31009 - RNA, 19 nt, Homo sapiens
aagcagaucuggaagacuu

SEQ ID NO: 31010 - RNA, 19 nt, Homo sapiens
agaggaagaugaagaggaa

SEQ ID NO: 31011 - RNA, 19 nt, Homo sapiens
agaggaagaugaagaggaa

SEQ ID NO: 31012 - RNA, 19 nt, Homo sapiens
uggaagcuaugcugaauga

SEQ ID NO: 31013 - RNA, 19 nt, Homo sapiens
caacuccucugccaaccaa

SEQ ID NO: 31014 - RNA, 19 nt, Homo sapiens
ggauggaggugugugagaa

SEQ ID NO: 31015 - RNA, 19 nt, Homo sapiens
gaaugaccuuauauagcua

SEQ ID NO: 31016 - RNA, 19 nt, Homo sapiens
ggagaauguacacaguuua

SEQ ID NO: 31017 - RNA, 19 nt, Homo sapiens
gagguuuguuugugugaaa

SEQ ID NO: 31018 - RNA, 19 nt, Homo sapiens
gaauggacaggguaaagaa

SEQ ID NO: 31019 - RNA, 19 nt, Homo sapiens
ugacacaugcucucaauau

SEQ ID NO: 31020 - RNA, 19 nt, Homo sapiens
ucucgugggugaauuugua

SEQ ID NO: 31021 - RNA, 19 nt, Homo sapiens
ucacaggagucuuuguaau

SEQ ID NO: 31022 - RNA, 19 nt, Homo sapiens
gacauucacucagagaaga

SEQ ID NO: 31023 - RNA, 19 nt, Homo sapiens
gaugugaaaggaccaguuu

SEQ ID NO: 31024 - RNA, 19 nt, Homo sapiens
gaaagugauuaacaguaag

SEQ ID NO: 31025 - RNA, 19 nt, Homo sapiens
uuauguagcccaagaaauu

SEQ ID NO: 31026 - RNA, 19 nt, Homo sapiens
ggaugaggaugaugaggau

SEQ ID NO: 31027 - RNA, 19 nt, Homo sapiens
ggaauagggaacuguaaug

SEQ ID NO: 31028 - RNA, 19 nt, Homo sapiens
gcagaaccauggcuaugag

SEQ ID NO: 31029 - RNA, 19 nt, Homo sapiens
gagcgucaccugaacaaga

SEQ ID NO: 31030 - RNA, 19 nt, Homo sapiens
ugacacaucuccacgugau

SEQ ID NO: 31031 - RNA, 19 nt, Homo sapiens
uuacauaccauccgucauu

SEQ ID NO: 31032 - RNA, 19 nt, Homo sapiens
uggagaauguacacaguuu

SEQ ID NO: 31033 - RNA, 19 nt, Homo sapiens
ccaacuauguccagaugug

SEQ ID NO: 31034 - RNA, 19 nt, Homo sapiens
caaggacguuaaaggcauu

SEQ ID NO: 31035 - RNA, 19 nt, Homo sapiens
guaagaauaaaguggauga

SEQ ID NO: 31036 - RNA, 19 nt, Homo sapiens
gaugaaaucccaggugaug

SEQ ID NO: 31037 - RNA, 19 nt, Homo sapiens
uaugaucuguggagaaugu

SEQ ID NO: 31038 - RNA, 19 nt, Homo sapiens
ggacuguaggacuauauaa

SEQ ID NO: 31039 - RNA, 19 nt, Homo sapiens
gccggaagaucccacgauu

SEQ ID NO: 31040 - RNA, 19 nt, Homo sapiens
cagaagagcgucaccugaa

SEQ ID NO: 31041 - RNA, 19 nt, Homo sapiens
ugcaagagucgcuuuguua

SEQ ID NO: 31042 - RNA, 19 nt, Homo sapiens
caagagcugcuuugaaaca

SEQ ID NO: 31043 - RNA, 19 nt, Homo sapiens
ugaacaagaugcagaacca

SEQ ID NO: 31044 - RNA, 19 nt, Homo sapiens
acgagacucuggauguuaa

SEQ ID NO: 31045 - RNA, 19 nt, Homo sapiens
ccgaagagaaagugauuaa

SEQ ID NO: 31046 - RNA, 19 nt, Homo sapiens
ggagcagcgugcagauaug

SEQ ID NO: 31047 - RNA, 19 nt, Homo sapiens
ggaagcagccagugagaag

SEQ ID NO: 31048 - RNA, 19 nt, Homo sapiens
caaugauguugauguguau

SEQ ID NO: 31049 - RNA, 19 nt, Homo sapiens
ggaacaauuuugagucuga

SEQ ID NO: 31050 - RNA, 19 nt, Homo sapiens
aauaugaucuguggagaau

SEQ ID NO: 31051 - RNA, 19 nt, Homo sapiens
uggaaagcuuugaacaauu

SEQ ID NO: 31052 - RNA, 19 nt, Homo sapiens
ggaccaguuucuugaaguc

SEQ ID NO: 31053 - RNA, 19 nt, Homo sapiens
gagagacccucgcaaaaug

SEQ ID NO: 31054 - RNA, 19 nt, Homo sapiens
ccacuuccauuguauuguc

SEQ ID NO: 31055 - RNA, 19 nt, Homo sapiens
ugacgagacucuggauguu

SEQ ID NO: 31056 - RNA, 19 nt, Homo sapiens
uaaaguggaugaaaacaug

SEQ ID NO: 31057 - RNA, 19 nt, Homo sapiens
uacauaccauccgucauua

SEQ ID NO: 31058 - RNA, 19 nt, Homo sapiens
ugagaacaaagaucgcuua

SEQ ID NO: 31059 - RNA, 19 nt, Homo sapiens
gaaauuacucaugauguca

SEQ ID NO: 31060 - RNA, 19 nt, Homo sapiens
caaggaaauuacucaugau

SEQ ID NO: 31061 - RNA, 19 nt, Homo sapiens
gaagaggaagacuaugaug

SEQ ID NO: 31062 - RNA, 19 nt, Homo sapiens
uaagugauguccugcuagu

SEQ ID NO: 31063 - RNA, 19 nt, Homo sapiens
cuacaaacuccuuaauaug

SEQ ID NO: 31064 - RNA, 19 nt, Homo sapiens
gacgagacucuggauguua

SEQ ID NO: 31065 - RNA, 19 nt, Homo sapiens
gcaccaagagcugcuuuga

SEQ ID NO: 31066 - RNA, 19 nt, Homo sapiens
cgagaccucugcagaugau

SEQ ID NO: 31067 - RNA, 19 nt, Homo sapiens
cgagauuacuacuaugaca

SEQ ID NO: 31068 - RNA, 19 nt, Homo sapiens
gaauaaacguuuccaaagu

SEQ ID NO: 31069 - RNA, 19 nt, Homo sapiens
gaaaacagcuaaaccuaaa

SEQ ID NO: 31070 - RNA, 19 nt, Homo sapiens
ccacggcccuucaggauga

SEQ ID NO: 31071 - RNA, 19 nt, Homo sapiens
guacguggaugugcucaaa

SEQ ID NO: 31072 - RNA, 19 nt, Homo sapiens
gagacuaugugucccaguu

SEQ ID NO: 31073 - RNA, 19 nt, Homo sapiens
ugaaggaccuggccacugu

SEQ ID NO: 31074 - RNA, 19 nt, Homo sapiens
cagaauaaacguuuccaaa

SEQ ID NO: 31075 - RNA, 19 nt, Homo sapiens
aauaaacguuuccaaagug

SEQ ID NO: 31076 - RNA, 19 nt, Homo sapiens
ugagcgcucucgaggagua

SEQ ID NO: 31077 - RNA, 19 nt, Homo sapiens
gggauaaccuggaaaagga

SEQ ID NO: 31078 - RNA, 19 nt, Homo sapiens
ggaaaacagcuaaaccuaa

SEQ ID NO: 31079 - RNA, 19 nt, Homo sapiens
ggcaggagaugagcaagga

SEQ ID NO: 31080 - RNA, 19 nt, Homo sapiens
guucugggauaaccuggaa

SEQ ID NO: 31081 - RNA, 19 nt, Homo sapiens
uaaagcuccuugacaacug

SEQ ID NO: 31082 - RNA, 19 nt, Homo sapiens
gacuaugugucccaguuug

SEQ ID NO: 31083 - RNA, 19 nt, Homo sapiens
aggaggagauggagcucua

SEQ ID NO: 31084 - RNA, 19 nt, Homo sapiens
gaagcucaacacccaguga

SEQ ID NO: 31085 - RNA, 19 nt, Homo sapiens
agaauaaacguuuccaaag

SEQ ID NO: 31086 - RNA, 19 nt, Homo sapiens
gugcucagaauaaacguuu

SEQ ID NO: 31087 - RNA, 19 nt, Homo sapiens
ggaccuggccacuguguac

SEQ ID NO: 31088 - RNA, 19 nt, Homo sapiens
accuaaagcuccuugacaa

SEQ ID NO: 31089 - RNA, 19 nt, Homo sapiens
agacagcggcagagacuau

SEQ ID NO: 31090 - RNA, 19 nt, Homo sapiens
aagcugcggugcugaccuu

SEQ ID NO: 31091 - RNA, 19 nt, Homo sapiens
gaccuuggccgugcucuuc

SEQ ID NO: 31092 - RNA, 19 nt, Homo sapiens
gaaguggcaggaggagaug

SEQ ID NO: 31093 - RNA, 19 nt, Homo sapiens
ucaaagacagcggcagaga

SEQ ID NO: 31094 - RNA, 19 nt, Homo sapiens
acguggaugugcucaaaga

SEQ ID NO: 31095 - RNA, 19 nt, Homo sapiens
ucgaggaguacacuaagaa

SEQ ID NO: 31096 - RNA, 19 nt, Homo sapiens
agaaguggcaggaggagau

SEQ ID NO: 31097 - RNA, 19 nt, Homo sapiens
aaagacagcggcagagacu

SEQ ID NO: 31098 - RNA, 19 nt, Homo sapiens
ucccggugcucagaauaaa

SEQ ID NO: 31099 - RNA, 19 nt, Homo sapiens
gggaaaacagcuaaaccua

SEQ ID NO: 31100 - RNA, 19 nt, Homo sapiens
agacuaugugucccaguuu

SEQ ID NO: 31101 - RNA, 19 nt, Homo sapiens
gaacggaacugguuaacuu

SEQ ID NO: 31102 - RNA, 19 nt, Homo sapiens
gcaaggaccugauggagaa

SEQ ID NO: 31103 - RNA, 19 nt, Homo sapiens
ggaacugguuaacuucuug

SEQ ID NO: 31104 - RNA, 19 nt, Homo sapiens
guuaacuucuugagcuauu

SEQ ID NO: 31105 - RNA, 19 nt, Homo sapiens
gaacugguuaacuucuuga

SEQ ID NO: 31106 - RNA, 19 nt, Homo sapiens
gaaguguccagaccauugu

SEQ ID NO: 31107 - RNA, 19 nt, Homo sapiens
ugaaguguccagaccauug

SEQ ID NO: 31108 - RNA, 19 nt, Homo sapiens
gagccugguuucucaguac

SEQ ID NO: 31109 - RNA, 19 nt, Homo sapiens
ugacaccccugaucaagaa

SEQ ID NO: 31110 - RNA, 19 nt, Homo sapiens
gcuggaacggaacugguua

SEQ ID NO: 31111 - RNA, 19 nt, Homo sapiens
gagcuuugguucggagaca

SEQ ID NO: 31112 - RNA, 19 nt, Homo sapiens
cuugagcuauuucguggaa

SEQ ID NO: 31113 - RNA, 19 nt, Homo sapiens
cccacucuuugcuacaaua

SEQ ID NO: 31114 - RNA, 19 nt, Homo sapiens
ggucaagagcccagagcuu

SEQ ID NO: 31115 - RNA, 19 nt, Homo sapiens
cggaacugguuaacuucuu

SEQ ID NO: 31116 - RNA, 19 nt, Homo sapiens
cagcuggccucuagaacac

SEQ ID NO: 31117 - RNA, 19 nt, Homo sapiens
ccagcuggccucuagaaca

SEQ ID NO: 31118 - RNA, 19 nt, Homo sapiens
ccacucuuugcuacaauaa

SEQ ID NO: 31119 - RNA, 19 nt, Homo sapiens
ugguuaacuucuugagcua

SEQ ID NO: 31120 - RNA, 19 nt, Homo sapiens
agagccugguuucucagua

SEQ ID NO: 31121 - RNA, 19 nt, Homo sapiens
cuacaauaaaugcugaaug

SEQ ID NO: 31122 - RNA, 19 nt, Homo sapiens
uccagaccgugacugacua

SEQ ID NO: 31123 - RNA, 19 nt, Homo sapiens
ucaagagcccagagcuuca

SEQ ID NO: 31124 - RNA, 19 nt, Homo sapiens
caauaaagcugcugagaau

SEQ ID NO: 31125 - RNA, 19 nt, Homo sapiens
gcaagcagcucaggauguu

SEQ ID NO: 31126 - RNA, 19 nt, Homo sapiens
ggccugaccuuccagauga

SEQ ID NO: 31127 - RNA, 19 nt, Homo sapiens
gcccuacgcugacgaauuc

SEQ ID NO: 31128 - RNA, 19 nt, Homo sapiens
gaccaccucucaauauuca

SEQ ID NO: 31129 - RNA, 19 nt, Homo sapiens
ccaaugaggugagccagaa

SEQ ID NO: 31130 - RNA, 19 nt, Homo sapiens
gcaacucaaugcccucuuc

SEQ ID NO: 31131 - RNA, 19 nt, Homo sapiens
gaacucacccagcaacuca

SEQ ID NO: 31132 - RNA, 19 nt, Homo sapiens
uaaagcugcugagaaucua

SEQ ID NO: 31133 - RNA, 19 nt, Homo sapiens
gaacagcucaggacgaaac

SEQ ID NO: 31134 - RNA, 19 nt, Homo sapiens
gaauucaaagucaagauug

SEQ ID NO: 31135 - RNA, 19 nt, Homo sapiens
ucaauaaagcugcugagaa

SEQ ID NO: 31136 - RNA, 19 nt, Homo sapiens
cauccaguguggcaagaaa

SEQ ID NO: 31137 - RNA, 19 nt, Homo sapiens
uggaacagcucaggacgaa

SEQ ID NO: 31138 - RNA, 19 nt, Homo sapiens
cgaauucaaagucaagauu

SEQ ID NO: 31139 - RNA, 19 nt, Homo sapiens
agaaggaccugagggacaa

SEQ ID NO: 31140 - RNA, 19 nt, Homo sapiens
aaagagagccaggacaaga

SEQ ID NO: 31141 - RNA, 19 nt, Homo sapiens
ccaaggaggccguggaaca

SEQ ID NO: 31142 - RNA, 19 nt, Homo sapiens
ucccugagcuggagcaaca

SEQ ID NO: 31143 - RNA, 19 nt, Homo sapiens
agaaagagagccaggacaa

SEQ ID NO: 31144 - RNA, 19 nt, Homo sapiens
ggggaaaacuucaacaaag

SEQ ID NO: 31145 - RNA, 19 nt, Homo sapiens
gaaacugaaggaggagauu

SEQ ID NO: 31146 - RNA, 19 nt, Homo sapiens
guagggaggcauccagugu

SEQ ID NO: 31147 - RNA, 19 nt, Homo sapiens
gaaagagagccaggacaag

SEQ ID NO: 31148 - RNA, 19 nt, Homo sapiens
gaagaagcuggugcccuuu

SEQ ID NO: 31149 - RNA, 19 nt, Homo sapiens
aggccaagaucgaccagaa

SEQ ID NO: 31150 - RNA, 19 nt, Homo sapiens
agagagugcugcgggagaa

SEQ ID NO: 31151 - RNA, 19 nt, Homo sapiens
gaccagguggccacaguga

SEQ ID NO: 31152 - RNA, 19 nt, Homo sapiens
gaacguggaggagcucaag

SEQ ID NO: 31153 - RNA, 19 nt, Homo sapiens
ccagguggccacagugaug

SEQ ID NO: 31154 - RNA, 19 nt, Homo sapiens
ggacaaccugcgagagcuu

SEQ ID NO: 31155 - RNA, 19 nt, Homo sapiens
aggaggagauugggaagga

SEQ ID NO: 31156 - RNA, 19 nt, Homo sapiens
ggccaaggacucggagaaa

SEQ ID NO: 31157 - RNA, 19 nt, Homo sapiens
gggccugaccuuccagaug

SEQ ID NO: 31158 - RNA, 19 nt, Homo sapiens
caaggaggccguggaacau

SEQ ID NO: 31159 - RNA, 19 nt, Homo sapiens
gccaaggacucggagaaac

SEQ ID NO: 31160 - RNA, 19 nt, Homo sapiens
guaugaacuugaggacaca

SEQ ID NO: 31161 - RNA, 19 nt, Homo sapiens
ccagcaagcagcucaggau

SEQ ID NO: 31162 - RNA, 19 nt, Homo sapiens
cuacgcugacgaauucaaa

SEQ ID NO: 31163 - RNA, 19 nt, Homo sapiens
ccaaggacucggagaaacu

SEQ ID NO: 31164 - RNA, 19 nt, Homo sapiens
auaaagcugcugagaaucu

SEQ ID NO: 31165 - RNA, 19 nt, Homo sapiens
ccaccucucaauauucaau

SEQ ID NO: 31166 - RNA, 19 nt, Homo sapiens
gucugucugucccaaagaa

SEQ ID NO: 31167 - RNA, 19 nt, Homo sapiens
ccaggacaaacuuggagaa

SEQ ID NO: 31168 - RNA, 19 nt, Homo sapiens
aaacugaaggaggagauug

SEQ ID NO: 31169 - RNA, 19 nt, Homo sapiens
ggacucggagaaacugaag

SEQ ID NO: 31170 - RNA, 19 nt, Homo sapiens
gcaccuagcuggaaaguua

SEQ ID NO: 31171 - RNA, 19 nt, Homo sapiens
gagcuaaucucuucaauaa

SEQ ID NO: 31172 - RNA, 19 nt, Homo sapiens
gcacguggguuccaaauua

SEQ ID NO: 31173 - RNA, 19 nt, Homo sapiens
gaaagaagcucugaaagaa

SEQ ID NO: 31174 - RNA, 19 nt, Homo sapiens
gaagaaaucugcagaacaa

SEQ ID NO: 31175 - RNA, 19 nt, Homo sapiens
ugaagaagauggcaaauuu

SEQ ID NO: 31176 - RNA, 19 nt, Homo sapiens
gauguaaucucgauguaua

SEQ ID NO: 31177 - RNA, 19 nt, Homo sapiens
gcugagaacuucaucauuu

SEQ ID NO: 31178 - RNA, 19 nt, Homo sapiens
ucaauaagcugguuacuga

SEQ ID NO: 31179 - RNA, 19 nt, Homo sapiens
gacaagagcuuaugggauu

SEQ ID NO: 31180 - RNA, 19 nt, Homo sapiens
caaaggagaguccaaauua

SEQ ID NO: 31181 - RNA, 19 nt, Homo sapiens
gaauaacuaugcacuguuu

SEQ ID NO: 31182 - RNA, 19 nt, Homo sapiens
guuaaaugcugacaucuua

SEQ ID NO: 31183 - RNA, 19 nt, Homo sapiens
gcaaggaucuggagaaaca

SEQ ID NO: 31184 - RNA, 19 nt, Homo sapiens
ggaacaauccucagaguua

SEQ ID NO: 31185 - RNA, 19 nt, Homo sapiens
guugaaagcuggccacaua

SEQ ID NO: 31186 - RNA, 19 nt, Homo sapiens
ccacagaggugcuacguaa

SEQ ID NO: 31187 - RNA, 19 nt, Homo sapiens
ggaugaagaugacgacuuu

SEQ ID NO: 31188 - RNA, 19 nt, Homo sapiens
ggaagcuucucaagaguua

SEQ ID NO: 31189 - RNA, 19 nt, Homo sapiens
gcacagaaauauucaggaa

SEQ ID NO: 31190 - RNA, 19 nt, Homo sapiens
gaaaugcuauugagggaaa

SEQ ID NO: 31191 - RNA, 19 nt, Homo sapiens
caacagaaauauccacuga

SEQ ID NO: 31192 - RNA, 19 nt, Homo sapiens
gaacaauccucagaguuaa

SEQ ID NO: 31193 - RNA, 19 nt, Homo sapiens
ccaaauaacuaccuuccua

SEQ ID NO: 31194 - RNA, 19 nt, Homo sapiens
gaaagaaucucaacuucca

SEQ ID NO: 31195 - RNA, 19 nt, Homo sapiens
gcagauccaucaauacauu

SEQ ID NO: 31196 - RNA, 19 nt, Homo sapiens
ggaaacaacgagaacauua

SEQ ID NO: 31197 - RNA, 19 nt, Homo sapiens
gacuuaagcucucaaauga

SEQ ID NO: 31198 - RNA, 19 nt, Homo sapiens
caaagcagauuauguugaa

SEQ ID NO: 31199 - RNA, 19 nt, Homo sapiens
ccuaagagcuugcauaugu

SEQ ID NO: 31200 - RNA, 19 nt, Homo sapiens
caaauggacucaucugcua

SEQ ID NO: 31201 - RNA, 19 nt, Homo sapiens
caaacugccuauauugaua

SEQ ID NO: 31202 - RNA, 19 nt, Homo sapiens
gcuggacagugaaauauua

SEQ ID NO: 31203 - RNA, 19 nt, Homo sapiens
caaauuaguuucaccauag

SEQ ID NO: 31204 - RNA, 19 nt, Homo sapiens
caaauucagucauguagaa

SEQ ID NO: 31205 - RNA, 19 nt, Homo sapiens
gaagaugggccucgcauuu

SEQ ID NO: 31206 - RNA, 19 nt, Homo sapiens
aaacuugacuucagagaaa

SEQ ID NO: 31207 - RNA, 19 nt, Homo sapiens
gaagggaauuugaaaguuc

SEQ ID NO: 31208 - RNA, 19 nt, Homo sapiens
ccaauaagaucaauagcaa

SEQ ID NO: 31209 - RNA, 19 nt, Homo sapiens
gaacacaggcaccaaugua

SEQ ID NO: 31210 - RNA, 19 nt, Homo sapiens
aaucgaagaugguacguua

SEQ ID NO: 31211 - RNA, 19 nt, Homo sapiens
uuacagcucugacaaguuu

SEQ ID NO: 31212 - RNA, 19 nt, Homo sapiens
gcuuauggcuccacaguuu

SEQ ID NO: 31213 - RNA, 19 nt, Homo sapiens
caggagagauugagcagua

SEQ ID NO: 31214 - RNA, 19 nt, Homo sapiens
gagcaaggguucacuguuc

SEQ ID NO: 31215 - RNA, 19 nt, Homo sapiens
gaaauacaaugcucuggau

SEQ ID NO: 31216 - RNA, 19 nt, Homo sapiens
gaacauugcaggcuuauca

SEQ ID NO: 31217 - RNA, 19 nt, Homo sapiens
ggaugaagauuacaccuau

SEQ ID NO: 31218 - RNA, 19 nt, Homo sapiens
uggaaagccucaccucuua

SEQ ID NO: 31219 - RNA, 19 nt, Homo sapiens
gcaagcaaguuggcaagua

SEQ ID NO: 31220 - RNA, 19 nt, Homo sapiens
gcauguggcugguaaccua

SEQ ID NO: 31221 - RNA, 19 nt, Homo sapiens
gaacaagaacaguuugaaa

SEQ ID NO: 31222 - RNA, 19 nt, Homo sapiens
caagcaaguuggcaaguaa

SEQ ID NO: 31223 - RNA, 19 nt, Homo sapiens
uaucucaacugcagacaua

SEQ ID NO: 31224 - RNA, 19 nt, Homo sapiens
caacaacuaucauaagaca

SEQ ID NO: 31225 - RNA, 19 nt, Homo sapiens
gcaaacaccuaagaguaaa

SEQ ID NO: 31226 - RNA, 19 nt, Homo sapiens
gaaacugacugcucucaca

SEQ ID NO: 31227 - RNA, 19 nt, Homo sapiens
ggaauaaugcucaguguug

SEQ ID NO: 31228 - RNA, 19 nt, Homo sapiens
gagauucccuccauuaagu

SEQ ID NO: 31229 - RNA, 19 nt, Homo sapiens
ggacuuaagcucucaaaug

SEQ ID NO: 31230 - RNA, 19 nt, Homo sapiens
gaaacaacccagucucaaa

SEQ ID NO: 31231 - RNA, 19 nt, Homo sapiens
ggauuacaguugcaaauau

SEQ ID NO: 31232 - RNA, 19 nt, Homo sapiens
aagauagacuuccugaaua

SEQ ID NO: 31233 - RNA, 19 nt, Homo sapiens
cgacaaaccauuauaguug

SEQ ID NO: 31234 - RNA, 19 nt, Homo sapiens
gaauaaugcucaguguuga

SEQ ID NO: 31235 - RNA, 19 nt, Homo sapiens
gaacuggaccugcaccaaa

SEQ ID NO: 31236 - RNA, 19 nt, Homo sapiens
gaacggagcaugggaguga

SEQ ID NO: 31237 - RNA, 19 nt, Homo sapiens
gagacucaauggugaaauu

SEQ ID NO: 31238 - RNA, 19 nt, Homo sapiens
gacaugagcacaaacuaua

SEQ ID NO: 31239 - RNA, 19 nt, Homo sapiens
cuacaaaucuguuucucuu

SEQ ID NO: 31240 - RNA, 19 nt, Homo sapiens
acagaaauauccacugaaa

SEQ ID NO: 31241 - RNA, 19 nt, Homo sapiens
ccacaagauugacaagaaa

SEQ ID NO: 31242 - RNA, 19 nt, Homo sapiens
caaauuccuugacauguug

SEQ ID NO: 31243 - RNA, 19 nt, Homo sapiens
ggaaguacacauacaacua

SEQ ID NO: 31244 - RNA, 19 nt, Homo sapiens
gauaugaccuucucuaagc

SEQ ID NO: 31245 - RNA, 19 nt, Homo sapiens
gagauuggcuuggaaggaa

SEQ ID NO: 31246 - RNA, 19 nt, Homo sapiens
gaagggaaucuuauauuug

SEQ ID NO: 31247 - RNA, 19 nt, Homo sapiens
gcauggauauggaugaaga

SEQ ID NO: 31248 - RNA, 19 nt, Homo sapiens
ccagaagacuccuugauuc

SEQ ID NO: 31249 - RNA, 19 nt, Homo sapiens
gcaagaacuuaauggaaau

SEQ ID NO: 31250 - RNA, 19 nt, Homo sapiens
ggaggcccauguaggaaua

SEQ ID NO: 31251 - RNA, 19 nt, Homo sapiens
gaccaugccugccuuugaa

SEQ ID NO: 31252 - RNA, 19 nt, Homo sapiens
gaacuacgagcugacuuua

SEQ ID NO: 31253 - RNA, 19 nt, Homo sapiens
caacauaugaccacaagaa

SEQ ID NO: 31254 - RNA, 19 nt, Homo sapiens
ggagaaagaugaaccuacu

SEQ ID NO: 31255 - RNA, 19 nt, Homo sapiens
ccaacucucugauuacuau

SEQ ID NO: 31256 - RNA, 19 nt, Homo sapiens
caccagcaguuuagauaua

SEQ ID NO: 31257 - RNA, 19 nt, Homo sapiens
gcgucuaccuuacacaaua

SEQ ID NO: 31258 - RNA, 19 nt, Homo sapiens
gcacauauggccugucuug

SEQ ID NO: 31259 - RNA, 19 nt, Homo sapiens
gaaguacacauacaacuau

SEQ ID NO: 31260 - RNA, 19 nt, Homo sapiens
ccuaugagcuccagagaga

SEQ ID NO: 31261 - RNA, 19 nt, Homo sapiens
uugagaagcugauuaaaga

SEQ ID NO: 31262 - RNA, 19 nt, Homo sapiens
gaagauuacaccuauuuga

SEQ ID NO: 31263 - RNA, 19 nt, Homo sapiens
uuaaacagcugaaagagau

SEQ ID NO: 31264 - RNA, 19 nt, Homo sapiens
ccauagagaugucggcauu

SEQ ID NO: 31265 - RNA, 19 nt, Homo sapiens
gcaauauucuauccaagau

SEQ ID NO: 31266 - RNA, 19 nt, Homo sapiens
gaaggagacuauucagaag

SEQ ID NO: 31267 - RNA, 19 nt, Homo sapiens
acacagacuuugaaacuug

SEQ ID NO: 31268 - RNA, 19 nt, Homo sapiens
gaaagucaagcaucugauu

SEQ ID NO: 31269 - RNA, 19 nt, Homo sapiens
ugacuucagugcagaauau

SEQ ID NO: 31270 - RNA, 19 nt, Homo sapiens
ccagagaacuucguaaaga

SEQ ID NO: 31271 - RNA, 19 nt, Homo sapiens
ggaguaacuauucagauua

SEQ ID NO: 31272 - RNA, 19 nt, Homo sapiens
gcacauggaucaacaaaau

SEQ ID NO: 31273 - RNA, 19 nt, Homo sapiens
ccaaucacguggaaguuaa

SEQ ID NO: 31274 - RNA, 19 nt, Homo sapiens
gaagcucacuggccacaau

SEQ ID NO: 31275 - RNA, 19 nt, Homo sapiens
ggagaugaauaggaugauu

SEQ ID NO: 31276 - RNA, 19 nt, Homo sapiens
ccaaaacucuguagcuuaa

SEQ ID NO: 31277 - RNA, 19 nt, Homo sapiens
uggaguaacuauucagauu

SEQ ID NO: 31278 - RNA, 19 nt, Homo sapiens
gcaaugaugacccacuaaa

SEQ ID NO: 31279 - RNA, 19 nt, Homo sapiens
uagaaauguucacaaggua

SEQ ID NO: 31280 - RNA, 19 nt, Homo sapiens
uaucacugcuggaggaauu

SEQ ID NO: 31281 - RNA, 19 nt, Homo sapiens
gagcaucagaguauuauca

SEQ ID NO: 31282 - RNA, 19 nt, Homo sapiens
cuagaaauguucacaaggu

SEQ ID NO: 31283 - RNA, 19 nt, Homo sapiens
caagaacaagcaaugauga

SEQ ID NO: 31284 - RNA, 19 nt, Homo sapiens
ggaggaauuuugucaacua

SEQ ID NO: 31285 - RNA, 19 nt, Homo sapiens
uaugagagcaucagaguau

SEQ ID NO: 31286 - RNA, 19 nt, Homo sapiens
gcuauuagagaguuucuga

SEQ ID NO: 31287 - RNA, 19 nt, Homo sapiens
gcuuggagaugaauaggau

SEQ ID NO: 31288 - RNA, 19 nt, Homo sapiens
ugagagcaucagaguauua

SEQ ID NO: 31289 - RNA, 19 nt, Homo sapiens
ggaguuugacgucuucuau

SEQ ID NO: 31290 - RNA, 19 nt, Homo sapiens
agacagagcaccaugacuu

SEQ ID NO: 31291 - RNA, 19 nt, Homo sapiens
aagcaaugaugacccacua

SEQ ID NO: 31292 - RNA, 19 nt, Homo sapiens
ucagggaccuuguuaacag

SEQ ID NO: 31293 - RNA, 19 nt, Homo sapiens
ggaaugcucccaggcuauu

SEQ ID NO: 31294 - RNA, 19 nt, Homo sapiens
ucaagaagauggcaaaauc

SEQ ID NO: 31295 - RNA, 19 nt, Homo sapiens
ccacccuguuuaaagauuu

SEQ ID NO: 31296 - RNA, 19 nt, Homo sapiens
gaaaucaaguggggcauga

SEQ ID NO: 31297 - RNA, 19 nt, Homo sapiens
uaacaguggaguaacuauu

SEQ ID NO: 31298 - RNA, 19 nt, Homo sapiens
cggaagaucuggcgaagcu

SEQ ID NO: 31299 - RNA, 19 nt, Homo sapiens
gaggaaguccagagacaga

SEQ ID NO: 31300 - RNA, 19 nt, Homo sapiens
cagagaacuucguaaagag

SEQ ID NO: 31301 - RNA, 19 nt, Homo sapiens
aaugaugacccacuaaaga

SEQ ID NO: 31302 - RNA, 19 nt, Homo sapiens
cuuccacccuguuuaaaga

SEQ ID NO: 31303 - RNA, 19 nt, Homo sapiens
ccacaauacccaccucugu

SEQ ID NO: 31304 - RNA, 19 nt, Homo sapiens
gagagcaucagaguauuau

SEQ ID NO: 31305 - RNA, 19 nt, Homo sapiens
ucaagaacaagcaaugaug

SEQ ID NO: 31306 - RNA, 19 nt, Homo sapiens
aguuugacgucuucuauga

SEQ ID NO: 31307 - RNA, 19 nt, Homo sapiens
gaaugcucccaggcuauua

SEQ ID NO: 31308 - RNA, 19 nt, Homo sapiens
uccaucagcugcuccauca

SEQ ID NO: 31309 - RNA, 19 nt, Homo sapiens
gaaucgaacccugggaguu

SEQ ID NO: 31310 - RNA, 19 nt, Homo sapiens
ggcaugagccggaagaucu

SEQ ID NO: 31311 - RNA, 19 nt, Homo sapiens
aaacugccauuaccaaacg

SEQ ID NO: 31312 - RNA, 19 nt, Homo sapiens
aaucgaacccugggaguuu

SEQ ID NO: 31313 - RNA, 19 nt, Homo sapiens
ccacacauccuuuuagcua

SEQ ID NO: 31314 - RNA, 19 nt, Homo sapiens
agagcaccaugacuucuga

SEQ ID NO: 31315 - RNA, 19 nt, Homo sapiens
uuucagacuucaucuucaa

SEQ ID NO: 31316 - RNA, 19 nt, Homo sapiens
cugcauaauucuaagucuu

SEQ ID NO: 31317 - RNA, 19 nt, Homo sapiens
gugugacucuagugaucua

SEQ ID NO: 31318 - RNA, 19 nt, Homo sapiens
gcucccaggcuauuagaga

SEQ ID NO: 31319 - RNA, 19 nt, Homo sapiens
gauucaagaacaagcaaug

SEQ ID NO: 31320 - RNA, 19 nt, Homo sapiens
gacagagcaccaugacuuc

SEQ ID NO: 31321 - RNA, 19 nt, Homo sapiens
uguguguacugauucaaga

SEQ ID NO: 31322 - RNA, 19 nt, Homo sapiens
ggcaaaaucaucuuacauu

SEQ ID NO: 31323 - RNA, 19 nt, Homo sapiens
acaguggaguaacuauuca

SEQ ID NO: 31324 - RNA, 19 nt, Homo sapiens
gcugcuccaucaccugguu

SEQ ID NO: 31325 - RNA, 19 nt, Homo sapiens
guagcuuaaaccaacaaua

SEQ ID NO: 31326 - RNA, 19 nt, Homo sapiens
aaauuuacgucagaaagag

SEQ ID NO: 31327 - RNA, 19 nt, Homo sapiens
gcacugcauaauucuaagu

SEQ ID NO: 31328 - RNA, 19 nt, Homo sapiens
ugucugcucuacgaaauca

SEQ ID NO: 31329 - RNA, 19 nt, Homo sapiens
caaacgauuccgccacaca

SEQ ID NO: 31330 - RNA, 19 nt, Homo sapiens
uaagucuuccacccuguuu

SEQ ID NO: 31331 - RNA, 19 nt, Homo sapiens
ccugucugcucuacgaaau

SEQ ID NO: 31332 - RNA, 19 nt, Homo sapiens
aggaggaaguccagagaca

SEQ ID NO: 31333 - RNA, 19 nt, Homo sapiens
caaugaugacccacuaaag

SEQ ID NO: 31334 - RNA, 19 nt, Homo sapiens
gaugauuccguguguguac

SEQ ID NO: 31335 - RNA, 19 nt, Homo sapiens
ggaugauuccgugugugua

SEQ ID NO: 31336 - RNA, 19 nt, Homo sapiens
ccugggaguuugacgucuu

SEQ ID NO: 31337 - RNA, 19 nt, Homo sapiens
gcuacagggcugauacauc

SEQ ID NO: 31338 - RNA, 19 nt, Homo sapiens
gaguuugacgucuucuaug

SEQ ID NO: 31339 - RNA, 19 nt, Homo sapiens
cagagacagagcaccauga

SEQ ID NO: 31340 - RNA, 19 nt, Homo sapiens
ccaggcuauuagagaguuu

SEQ ID NO: 31341 - RNA, 19 nt, Homo sapiens
agucuuccacccuguuuaa

SEQ ID NO: 31342 - RNA, 19 nt, Homo sapiens
uccaucaccugguucuugu

SEQ ID NO: 31343 - RNA, 19 nt, Homo sapiens
uguacugauucaagaacaa

SEQ ID NO: 31344 - RNA, 19 nt, Homo sapiens
auaggaugauuccgugugu

SEQ ID NO: 31345 - RNA, 19 nt, Homo sapiens
ucacguggaaguuaauuuu

SEQ ID NO: 31346 - RNA, 19 nt, Homo sapiens
uggcgaagcucaggcaaaa

SEQ ID NO: 31347 - RNA, 19 nt, Homo sapiens
cucuguggaugauguugua

SEQ ID NO: 31348 - RNA, 19 nt, Homo sapiens
accaaucacguggaaguua

SEQ ID NO: 31349 - RNA, 19 nt, Homo sapiens
gcaucagaguauuaucacu

SEQ ID NO: 31350 - RNA, 19 nt, Homo sapiens
uauuagagaguuucugagu

SEQ ID NO: 31351 - RNA, 19 nt, Homo sapiens
ccagagaacuucguaaaga

SEQ ID NO: 31352 - RNA, 19 nt, Homo sapiens
ggaguaacuauucagauua

SEQ ID NO: 31353 - RNA, 19 nt, Homo sapiens
gcacauggaucaacaaaau

SEQ ID NO: 31354 - RNA, 19 nt, Homo sapiens
ccaaucacguggaaguuaa

SEQ ID NO: 31355 - RNA, 19 nt, Homo sapiens
gaagcucacuggccacaau

SEQ ID NO: 31356 - RNA, 19 nt, Homo sapiens
ggagaugaauaggaugauu

SEQ ID NO: 31357 - RNA, 19 nt, Homo sapiens
ccaaaacucuguagcuuaa

SEQ ID NO: 31358 - RNA, 19 nt, Homo sapiens
uggaguaacuauucagauu

SEQ ID NO: 31359 - RNA, 19 nt, Homo sapiens
gcaaugaugacccacuaaa

SEQ ID NO: 31360 - RNA, 19 nt, Homo sapiens
uagaaauguucacaaggua

SEQ ID NO: 31361 - RNA, 19 nt, Homo sapiens
uaucacugcuggaggaauu

SEQ ID NO: 31362 - RNA, 19 nt, Homo sapiens
gagcaucagaguauuauca

SEQ ID NO: 31363 - RNA, 19 nt, Homo sapiens
cuagaaauguucacaaggu

SEQ ID NO: 31364 - RNA, 19 nt, Homo sapiens
caagaacaagcaaugauga

SEQ ID NO: 31365 - RNA, 19 nt, Homo sapiens
ggaggaauuuugucaacua

SEQ ID NO: 31366 - RNA, 19 nt, Homo sapiens
uaugagagcaucagaguau

SEQ ID NO: 31367 - RNA, 19 nt, Homo sapiens
gcuauuagagaguuucuga

SEQ ID NO: 31368 - RNA, 19 nt, Homo sapiens
gcuuggagaugaauaggau

SEQ ID NO: 31369 - RNA, 19 nt, Homo sapiens
ugagagcaucagaguauua

SEQ ID NO: 31370 - RNA, 19 nt, Homo sapiens
ggaguuugacgucuucuau

SEQ ID NO: 31371 - RNA, 19 nt, Homo sapiens
agacagagcaccaugacuu

SEQ ID NO: 31372 - RNA, 19 nt, Homo sapiens
aagcaaugaugacccacua

SEQ ID NO: 31373 - RNA, 19 nt, Homo sapiens
ucagggaccuuguuaacag

SEQ ID NO: 31374 - RNA, 19 nt, Homo sapiens
ggaaugcucccaggcuauu

SEQ ID NO: 31375 - RNA, 19 nt, Homo sapiens
ucaagaagauggcaaaauc

SEQ ID NO: 31376 - RNA, 19 nt, Homo sapiens
ccacccuguuuaaagauuu

SEQ ID NO: 31377 - RNA, 19 nt, Homo sapiens
gaaaucaaguggggcauga

SEQ ID NO: 31378 - RNA, 19 nt, Homo sapiens
uaacaguggaguaacuauu

SEQ ID NO: 31379 - RNA, 19 nt, Homo sapiens
cggaagaucuggcgaagcu

SEQ ID NO: 31380 - RNA, 19 nt, Homo sapiens
gaggaaguccagagacaga

SEQ ID NO: 31381 - RNA, 19 nt, Homo sapiens
cagagaacuucguaaagag

SEQ ID NO: 31382 - RNA, 19 nt, Homo sapiens
aaugaugacccacuaaaga

SEQ ID NO: 31383 - RNA, 19 nt, Homo sapiens
cuuccacccuguuuaaaga

SEQ ID NO: 31384 - RNA, 19 nt, Homo sapiens
ccacaauacccaccucugu

SEQ ID NO: 31385 - RNA, 19 nt, Homo sapiens
gagagcaucagaguauuau

SEQ ID NO: 31386 - RNA, 19 nt, Homo sapiens
ucaagaacaagcaaugaug

SEQ ID NO: 31387 - RNA, 19 nt, Homo sapiens
gaaugcucccaggcuauua

SEQ ID NO: 31388 - RNA, 19 nt, Homo sapiens
uccaucagcugcuccauca

SEQ ID NO: 31389 - RNA, 19 nt, Homo sapiens
aguuugacgucuucuauga

SEQ ID NO: 31390 - RNA, 19 nt, Homo sapiens
gaaucgaacccugggaguu

SEQ ID NO: 31391 - RNA, 19 nt, Homo sapiens
ggcaugagccggaagaucu

SEQ ID NO: 31392 - RNA, 19 nt, Homo sapiens
aaacugccauuaccaaacg

SEQ ID NO: 31393 - RNA, 19 nt, Homo sapiens
aaucgaacccugggaguuu

SEQ ID NO: 31394 - RNA, 19 nt, Homo sapiens
ccacacauccuuuuagcua

SEQ ID NO: 31395 - RNA, 19 nt, Homo sapiens
agagcaccaugacuucuga

SEQ ID NO: 31396 - RNA, 19 nt, Homo sapiens
uuucagacuucaucuucaa

SEQ ID NO: 31397 - RNA, 19 nt, Homo sapiens
cugcauaauucuaagucuu

SEQ ID NO: 31398 - RNA, 19 nt, Homo sapiens
ugagaaaggagaagaaucg

SEQ ID NO: 31399 - RNA, 19 nt, Homo sapiens
gugugacucuagugaucua

SEQ ID NO: 31400 - RNA, 19 nt, Homo sapiens
gcucccaggcuauuagaga

SEQ ID NO: 31401 - RNA, 19 nt, Homo sapiens
gauucaagaacaagcaaug

SEQ ID NO: 31402 - RNA, 19 nt, Homo sapiens
gacagagcaccaugacuuc

SEQ ID NO: 31403 - RNA, 19 nt, Homo sapiens
uguguguacugauucaaga

SEQ ID NO: 31404 - RNA, 19 nt, Homo sapiens
ggcaaaaucaucuuacauu

SEQ ID NO: 31405 - RNA, 19 nt, Homo sapiens
acaguggaguaacuauuca

SEQ ID NO: 31406 - RNA, 19 nt, Homo sapiens
gcugcuccaucaccugguu

SEQ ID NO: 31407 - RNA, 19 nt, Homo sapiens
guagcuuaaaccaacaaua

SEQ ID NO: 31408 - RNA, 19 nt, Homo sapiens
aaauuuacgucagaaagag

SEQ ID NO: 31409 - RNA, 19 nt, Homo sapiens
gcacugcauaauucuaagu

SEQ ID NO: 31410 - RNA, 19 nt, Homo sapiens
ugucugcucuacgaaauca

SEQ ID NO: 31411 - RNA, 19 nt, Homo sapiens
caaacgauuccgccacaca

SEQ ID NO: 31412 - RNA, 19 nt, Homo sapiens
uaagucuuccacccuguuu

SEQ ID NO: 31413 - RNA, 19 nt, Homo sapiens
ccugucugcucuacgaaau

SEQ ID NO: 31414 - RNA, 19 nt, Homo sapiens
aggaggaaguccagagaca

SEQ ID NO: 31415 - RNA, 19 nt, Homo sapiens
caaugaugacccacuaaag

SEQ ID NO: 31416 - RNA, 19 nt, Homo sapiens
gaugauuccguguguguac

SEQ ID NO: 31417 - RNA, 19 nt, Homo sapiens
ggaugauuccgugugugua

SEQ ID NO: 31418 - RNA, 19 nt, Homo sapiens
gcuacagggcugauacauc

SEQ ID NO: 31419 - RNA, 19 nt, Homo sapiens
cagagacagagcaccauga

SEQ ID NO: 31420 - RNA, 19 nt, Homo sapiens
gaguuugacgucuucuaug

SEQ ID NO: 31421 - RNA, 19 nt, Homo sapiens
ccugggaguuugacgucuu

SEQ ID NO: 31422 - RNA, 19 nt, Homo sapiens
ccaggcuauuagagaguuu

SEQ ID NO: 31423 - RNA, 19 nt, Homo sapiens
agucuuccacccuguuuaa

SEQ ID NO: 31424 - RNA, 19 nt, Homo sapiens
uccaucaccugguucuugu

SEQ ID NO: 31425 - RNA, 19 nt, Homo sapiens
uguacugauucaagaacaa

SEQ ID NO: 31426 - RNA, 19 nt, Homo sapiens
auaggaugauuccgugugu

SEQ ID NO: 31427 - RNA, 19 nt, Homo sapiens
uggcgaagcucaggcaaaa

SEQ ID NO: 31428 - RNA, 19 nt, Homo sapiens
cucuguggaugauguugua

SEQ ID NO: 31429 - RNA, 19 nt, Homo sapiens
ucacguggaaguuaauuuu

SEQ ID NO: 31430 - RNA, 19 nt, Homo sapiens
gcaucagaguauuaucacu

SEQ ID NO: 31431 - RNA, 19 nt, Homo sapiens
accaaucacguggaaguua

SEQ ID NO: 31432 - RNA, 19 nt, Homo sapiens
uauuagagaguuucugagu

SEQ ID NO: 31433 - RNA, 19 nt, Homo sapiens
agaaaggagaagaaucgaa

SEQ ID NO: 31434 - RNA, 19 nt, Homo sapiens
gaaacacacuggaggacaa

SEQ ID NO: 31435 - RNA, 19 nt, Homo sapiens
uggauaagcugaaggaguu

SEQ ID NO: 31436 - RNA, 19 nt, Homo sapiens
ggacaaggcucgggaacuc

SEQ ID NO: 31437 - RNA, 19 nt, Homo sapiens
gaacucaucagccgcauca

SEQ ID NO: 31438 - RNA, 19 nt, Homo sapiens
gaaggagaaacucaagauu

SEQ ID NO: 31439 - RNA, 19 nt, Homo sapiens
caaccaagcccuccagcaa

SEQ ID NO: 31440 - RNA, 19 nt, Homo sapiens
caaacagagugaacuuucu

SEQ ID NO: 31441 - RNA, 19 nt, Homo sapiens
ugaacuuucugccaagaug

SEQ ID NO: 31442 - RNA, 19 nt, Homo sapiens
ucaaacagagugaacuuuc

SEQ ID NO: 31443 - RNA, 19 nt, Homo sapiens
aaggagaaacucaagauug

SEQ ID NO: 31444 - RNA, 19 nt, Homo sapiens
ugaaggagaaacucaagau

SEQ ID NO: 31445 - RNA, 19 nt, Homo sapiens
caucaaacagagugaacuu

SEQ ID NO: 31446 - RNA, 19 nt, Homo sapiens
ccaagaugcgggagugguu

SEQ ID NO: 31447 - RNA, 19 nt, Homo sapiens
uuucagagacauuucagaa

SEQ ID NO: 31448 - RNA, 19 nt, Homo sapiens
gaaagugaaggagaaacuc

SEQ ID NO: 31449 - RNA, 19 nt, Homo sapiens
caagaugcgggagugguuu

SEQ ID NO: 31450 - RNA, 19 nt, Homo sapiens
ggaccugaagggugacauc

SEQ ID NO: 31451 - RNA, 19 nt, Homo sapiens
aaagugaaggagaaacuca

SEQ ID NO: 31452 - RNA, 19 nt, Homo sapiens
ucagaaagugaaggagaaa

SEQ ID NO: 31453 - RNA, 19 nt, Homo sapiens
acucaucagccgcaucaaa

SEQ ID NO: 31454 - RNA, 19 nt, Homo sapiens
gauaagcugaaggaguuug

SEQ ID NO: 31455 - RNA, 19 nt, Homo sapiens
gaggagagguucuggaaug

SEQ ID NO: 31456 - RNA, 19 nt, Homo sapiens
ccugaugucuggagagaua

SEQ ID NO: 31457 - RNA, 19 nt, Homo sapiens
gcucuagguucuuggaauu

SEQ ID NO: 31458 - RNA, 19 nt, Homo sapiens
gcaagaguccgauguuugu

SEQ ID NO: 31459 - RNA, 19 nt, Homo sapiens
gcucugcucucuucaucuu

SEQ ID NO: 31460 - RNA, 19 nt, Homo sapiens
gggccugcuuucucagaua

SEQ ID NO: 31461 - RNA, 19 nt, Homo sapiens
gcaauaaauaguccagugu

SEQ ID NO: 31462 - RNA, 19 nt, Homo sapiens
ugacaauucucacuuugca

SEQ ID NO: 31463 - RNA, 19 nt, Homo sapiens
gcugacaauucucacuuug

SEQ ID NO: 31464 - RNA, 19 nt, Homo sapiens
gcugggcucugcucucuuc

SEQ ID NO: 31465 - RNA, 19 nt, Homo sapiens
cucauuaggugcuucauug

SEQ ID NO: 31466 - RNA, 19 nt, Homo sapiens
ggacaaggaggcuguuucu

SEQ ID NO: 31467 - RNA, 19 nt, Homo sapiens
gagagguucuggaaugcau

SEQ ID NO: 31468 - RNA, 19 nt, Homo sapiens
ggaauuccuuugugcucau

SEQ ID NO: 31469 - RNA, 19 nt, Homo sapiens
caauaaauaguccaguguu

SEQ ID NO: 31470 - RNA, 19 nt, Homo sapiens
ggcaagaguccgauguuug

SEQ ID NO: 31471 - RNA, 19 nt, Homo sapiens
ccagagagcagugcaaaca

SEQ ID NO: 31472 - RNA, 19 nt, Homo sapiens
ugaggaggcucuagguucu

SEQ ID NO: 31473 - RNA, 19 nt, Homo sapiens
gcuugggccugcuuucuca

SEQ ID NO: 31474 - RNA, 19 nt, Homo sapiens
gggcucugcucucuucauc

SEQ ID NO: 31475 - RNA, 19 nt, Homo sapiens
gagagauagccauguguga

SEQ ID NO: 31476 - RNA, 19 nt, Homo sapiens
gguggcgaguguccuggua

SEQ ID NO: 31477 - RNA, 19 nt, Homo sapiens
gagccugaauuuggcaaug

SEQ ID NO: 31478 - RNA, 19 nt, Homo sapiens
cuuguuggacugcucauua

SEQ ID NO: 31479 - RNA, 19 nt, Homo sapiens
gcguguuucuugagaggaa

SEQ ID NO: 31480 - RNA, 19 nt, Homo sapiens
ccacuuccuugcuucucaa

SEQ ID NO: 31481 - RNA, 19 nt, Homo sapiens
gcagccaugucuggucgaa

SEQ ID NO: 31482 - RNA, 19 nt, Homo sapiens
ucuggaggcugcaugaauc

SEQ ID NO: 31483 - RNA, 19 nt, Homo sapiens
aggcaagaguccgauguuu

SEQ ID NO: 31484 - RNA, 19 nt, Homo sapiens
cacagcaggugcagguuuc

SEQ ID NO: 31485 - RNA, 19 nt, Homo sapiens
gccugucggucauugagaa

SEQ ID NO: 31486 - RNA, 19 nt, Homo sapiens
caauucucacuuugcaaua

SEQ ID NO: 31487 - RNA, 19 nt, Homo sapiens
gcucauuaggugcuucauu

SEQ ID NO: 31488 - RNA, 19 nt, Homo sapiens
gggcguugguggcagagau

SEQ ID NO: 31489 - RNA, 19 nt, Homo sapiens
caugugugagccugaauuu

SEQ ID NO: 31490 - RNA, 19 nt, Homo sapiens
ccuuugugcucaucagaga

SEQ ID NO: 31491 - RNA, 19 nt, Homo sapiens
gccacuuccuugcuucuca

SEQ ID NO: 31492 - RNA, 19 nt, Homo sapiens
ggccugcuuucucagauag

SEQ ID NO: 31493 - RNA, 19 nt, Homo sapiens
uuucuugcuugauugcuuu

SEQ ID NO: 31494 - RNA, 19 nt, Homo sapiens
gcgaguguccugguacgaa

SEQ ID NO: 31495 - RNA, 19 nt, Homo sapiens
cccagcagcucaggcaaga

SEQ ID NO: 31496 - RNA, 19 nt, Homo sapiens
cuggagagauagccaugug

SEQ ID NO: 31497 - RNA, 19 nt, Homo sapiens
acaauucucacuuugcaau

SEQ ID NO: 31498 - RNA, 19 nt, Homo sapiens
guucuuggaauuccuuugu

SEQ ID NO: 31499 - RNA, 19 nt, Homo sapiens
ugugugagccugaauuugg

SEQ ID NO: 31500 - RNA, 19 nt, Homo sapiens
uugcuugauugcuuuguug

SEQ ID NO: 31501 - RNA, 19 nt, Homo sapiens
gcccagagagcagugcaaa

SEQ ID NO: 31502 - RNA, 19 nt, Homo sapiens
gaauuccuuugugcucauc

SEQ ID NO: 31503 - RNA, 19 nt, Homo sapiens
ggcucuagguucuuggaau

SEQ ID NO: 31504 - RNA, 19 nt, Homo sapiens
ugggugccaucaaugagaa

SEQ ID NO: 31505 - RNA, 19 nt, Homo sapiens
ccaucaaugagaagacaaa

SEQ ID NO: 31506 - RNA, 19 nt, Homo sapiens
agacccgccucauccugaa

SEQ ID NO: 31507 - RNA, 19 nt, Homo sapiens
ggaggcuguuucugcacau

SEQ ID NO: 31508 - RNA, 19 nt, Homo sapiens
cagcagcucaggcaagagu

SEQ ID NO: 31509 - RNA, 19 nt, Homo sapiens
gcugaggaggcucuagguu

SEQ ID NO: 31510 - RNA, 19 nt, Homo sapiens
aggaaucucucuccaguua

SEQ ID NO: 31511 - RNA, 19 nt, Homo sapiens
cagcagccaugagcacuua

SEQ ID NO: 31512 - RNA, 19 nt, Homo sapiens
acucuagccugaauucuuu

SEQ ID NO: 31513 - RNA, 19 nt, Homo sapiens
cccagaaccuguacgagaa

SEQ ID NO: 31514 - RNA, 19 nt, Homo sapiens
gaaucucucuccaguuacu

SEQ ID NO: 31515 - RNA, 19 nt, Homo sapiens
gaggacagccugccagagu

SEQ ID NO: 31516 - RNA, 19 nt, Homo sapiens
ucuggucucuggacacuau

SEQ ID NO: 31517 - RNA, 19 nt, Homo sapiens
ucagggacuuguacagcaa

SEQ ID NO: 31518 - RNA, 19 nt, Homo sapiens
ggaguaacagccagacaca

SEQ ID NO: 31519 - RNA, 19 nt, Homo sapiens
gcacuuagacaggcauuuu

SEQ ID NO: 31520 - RNA, 19 nt, Homo sapiens
gaaacucagggacuuguac

SEQ ID NO: 31521 - RNA, 19 nt, Homo sapiens
gcugaagggagaggaguaa

SEQ ID NO: 31522 - RNA, 19 nt, Homo sapiens
ucccagcucuguuucuugu

SEQ ID NO: 31523 - RNA, 19 nt, Homo sapiens
gaagggagaggaguaacag

SEQ ID NO: 31524 - RNA, 19 nt, Homo sapiens
gagaaacucagggacuugu

SEQ ID NO: 31525 - RNA, 19 nt, Homo sapiens
gaaccuguacgagaagaca

SEQ ID NO: 31526 - RNA, 19 nt, Homo sapiens
ucccaacucuagccugaau

SEQ ID NO: 31527 - RNA, 19 nt, Homo sapiens
ccaacucuagccugaauuc

SEQ ID NO: 31528 - RNA, 19 nt, Homo sapiens
ccucccagcucuguuucuu

SEQ ID NO: 31529 - RNA, 19 nt, Homo sapiens
gcagccaugagcacuuaga

SEQ ID NO: 31530 - RNA, 19 nt, Homo sapiens
ggacagccugccagagucu

SEQ ID NO: 31531 - RNA, 19 nt, Homo sapiens
cagaaccuguacgagaaga

SEQ ID NO: 31532 - RNA, 19 nt, Homo sapiens
uuacugaccaaguucuuuc

SEQ ID NO: 31533 - RNA, 19 nt, Homo sapiens
caauaaagcuggacaagaa

SEQ ID NO: 31534 - RNA, 19 nt, Homo sapiens
ggacaaguucucugaguuc

SEQ ID NO: 31535 - RNA, 19 nt, Homo sapiens
caugcuggccucccaauaa

SEQ ID NO: 31536 - RNA, 19 nt, Homo sapiens
ggagcaccguuaaggacaa

SEQ ID NO: 31537 - RNA, 19 nt, Homo sapiens
ucucugaguucugggauuu

SEQ ID NO: 31538 - RNA, 19 nt, Homo sapiens
ccaccaagaccgccaagga

SEQ ID NO: 31539 - RNA, 19 nt, Homo sapiens
ccaauaaagcuggacaaga

SEQ ID NO: 31540 - RNA, 19 nt, Homo sapiens
ucagcuucaugcaggguua

SEQ ID NO: 31541 - RNA, 19 nt, Homo sapiens
ggugaccgauggcuucagu

SEQ ID NO: 31542 - RNA, 19 nt, Homo sapiens
uuaaggacaaguucucuga

SEQ ID NO: 31543 - RNA, 19 nt, Homo sapiens
gcaugcuggccucccaaua

SEQ ID NO: 31544 - RNA, 19 nt, Homo sapiens
augcuggccucccaauaaa

SEQ ID NO: 31545 - RNA, 19 nt, Homo sapiens
gacaaguucucugaguucu

SEQ ID NO: 31546 - RNA, 19 nt, Homo sapiens
aggacaaguucucugaguu

SEQ ID NO: 31547 - RNA, 19 nt, Homo sapiens
gcaccguuaaggacaaguu

SEQ ID NO: 31548 - RNA, 19 nt, Homo sapiens
aaggacaaguucucugagu

SEQ ID NO: 31549 - RNA, 19 nt, Homo sapiens
ggcagcugcuccaggaaca

SEQ ID NO: 31550 - RNA, 19 nt, Homo sapiens
gagcaccguuaaggacaag

SEQ ID NO: 31551 - RNA, 19 nt, Homo sapiens
caccaagaccgccaaggau

SEQ ID NO: 31552 - RNA, 19 nt, Homo sapiens
guucauacuucuccaauaa

SEQ ID NO: 31553 - RNA, 19 nt, Homo sapiens
gaaaugucccuccucagaa

SEQ ID NO: 31554 - RNA, 19 nt, Homo sapiens
ggacaaggaccaggguuaa

SEQ ID NO: 31555 - RNA, 19 nt, Homo sapiens
aaaugucccuccucagaaa

SEQ ID NO: 31556 - RNA, 19 nt, Homo sapiens
caccaaagcuaaagaugag

SEQ ID NO: 31557 - RNA, 19 nt, Homo sapiens
ccaccaaagcuaaagauga

SEQ ID NO: 31558 - RNA, 19 nt, Homo sapiens
gggacaaggaccaggguua

SEQ ID NO: 31559 - RNA, 19 nt, Homo sapiens
agaaaugucccuccucaga

SEQ ID NO: 31560 - RNA, 19 nt, Homo sapiens
ggaccaggguuaaaauguu

SEQ ID NO: 31561 - RNA, 19 nt, Homo sapiens
caacacagcgagaucucuu

SEQ ID NO: 31562 - RNA, 19 nt, Homo sapiens
gacaaggaccaggguuaaa

SEQ ID NO: 31563 - RNA, 19 nt, Homo sapiens
ggaggcugagguaggauga

SEQ ID NO: 31564 - RNA, 19 nt, Homo sapiens
aguucauacuucuccaaua

SEQ ID NO: 31565 - RNA, 19 nt, Homo sapiens
gaccaggguuaaaauguuc

SEQ ID NO: 31566 - RNA, 19 nt, Homo sapiens
ccugguuccucgaauccaa

SEQ ID NO: 31567 - RNA, 19 nt, Homo sapiens
caaaggaaguugaccuaaa

SEQ ID NO: 31568 - RNA, 19 nt, Homo sapiens
gaauaaguaucucggaaga

SEQ ID NO: 31569 - RNA, 19 nt, Homo sapiens
gaacuaugcccucguguau

SEQ ID NO: 31570 - RNA, 19 nt, Homo sapiens
gaaguugaccuaaacaugu

SEQ ID NO: 31571 - RNA, 19 nt, Homo sapiens
ggaaagaucaaaguguuaa

SEQ ID NO: 31572 - RNA, 19 nt, Homo sapiens
gaagaugguacgaaauuga

SEQ ID NO: 31573 - RNA, 19 nt, Homo sapiens
caacaaccuuugagaaugg

SEQ ID NO: 31574 - RNA, 19 nt, Homo sapiens
gaagaucccaacaaccuuu

SEQ ID NO: 31575 - RNA, 19 nt, Homo sapiens
ggaagaugguacgaaauug

SEQ ID NO: 31576 - RNA, 19 nt, Homo sapiens
ccaacaaccuuugagaaug

SEQ ID NO: 31577 - RNA, 19 nt, Homo sapiens
gguacgaaauugagaagau

SEQ ID NO: 31578 - RNA, 19 nt, Homo sapiens
cugccaagcuggaaguuaa

SEQ ID NO: 31579 - RNA, 19 nt, Homo sapiens
caacuacucacuaauggaa

SEQ ID NO: 31580 - RNA, 19 nt, Homo sapiens
guugagagcugauggaacu

SEQ ID NO: 31581 - RNA, 19 nt, Homo sapiens
ggaaguugaccuaaacaug

SEQ ID NO: 31582 - RNA, 19 nt, Homo sapiens
gaaacaguggacucucuaa

SEQ ID NO: 31583 - RNA, 19 nt, Homo sapiens
aaaggaaguugaccuaaac

SEQ ID NO: 31584 - RNA, 19 nt, Homo sapiens
gacaaaggaaguugaccua

SEQ ID NO: 31585 - RNA, 19 nt, Homo sapiens
caagcuggaaguuaaguuu

SEQ ID NO: 31586 - RNA, 19 nt, Homo sapiens
guacgaaauugagaagauc

SEQ ID NO: 31587 - RNA, 19 nt, Homo sapiens
aaguugaccuaaacaugua

SEQ ID NO: 31588 - RNA, 19 nt, Homo sapiens
ccuaaucucccuccagaaa

SEQ ID NO: 31589 - RNA, 19 nt, Homo sapiens
gagaagaucccaacaaccu

SEQ ID NO: 31590 - RNA, 19 nt, Homo sapiens
cggaagaugguacgaaauu

SEQ ID NO: 31591 - RNA, 19 nt, Homo sapiens
ucacagagccugccaagcu

SEQ ID NO: 31592 - RNA, 19 nt, Homo sapiens
acggaaagaucaaaguguu

SEQ ID NO: 31593 - RNA, 19 nt, Homo sapiens
caggccaacuacucacuaa

SEQ ID NO: 31594 - RNA, 19 nt, Homo sapiens
cagaaacaguggacucucu

SEQ ID NO: 31595 - RNA, 19 nt, Homo sapiens
acuaugcccucguguauuc

SEQ ID NO: 31596 - RNA, 19 nt, Homo sapiens
cauaaagacaaaccaauca

SEQ ID NO: 31597 - RNA, 19 nt, Homo sapiens
uaaucucccuccagaaaca

SEQ ID NO: 31598 - RNA, 19 nt, Homo sapiens
gaacugugaaucaaaucga

SEQ ID NO: 31599 - RNA, 19 nt, Homo sapiens
gggacaagcauuucaucuu

SEQ ID NO: 31600 - RNA, 19 nt, Homo sapiens
gauggaacugugaaucaaa

SEQ ID NO: 31601 - RNA, 19 nt, Homo sapiens
gauccuggccaccgacuau

SEQ ID NO: 31602 - RNA, 19 nt, Homo sapiens
cggaaagaucaaaguguua

SEQ ID NO: 31603 - RNA, 19 nt, Homo sapiens
ggccaacuacucacuaaug

SEQ ID NO: 31604 - RNA, 19 nt, Homo sapiens
accaugcccuacccuguua

SEQ ID NO: 31605 - RNA, 19 nt, Homo sapiens
gccaacuacucacuaaugg

SEQ ID NO: 31606 - RNA, 19 nt, Homo sapiens
ccauaaagacaaaccaauc

SEQ ID NO: 31607 - RNA, 19 nt, Homo sapiens
ggcagagggacaagcauuu

SEQ ID NO: 31608 - RNA, 19 nt, Homo sapiens
aaacaguggacucucuaaa

SEQ ID NO: 31609 - RNA, 19 nt, Homo sapiens
gaccuaaacauguaaccau

SEQ ID NO: 31610 - RNA, 19 nt, Homo sapiens
gcagagggacaagcauuuc

SEQ ID NO: 31611 - RNA, 19 nt, Homo sapiens
gaaucaaaucgaaggugaa

SEQ ID NO: 31612 - RNA, 19 nt, Homo sapiens
ccugacuucuaauaacauu

SEQ ID NO: 31613 - RNA, 19 nt, Homo sapiens
gaugguacgaaauugagaa

SEQ ID NO: 31614 - RNA, 19 nt, Homo sapiens
uauccugacuucuaauaac

SEQ ID NO: 31615 - RNA, 19 nt, Homo sapiens
guaccugcaucauccaacu

SEQ ID NO: 31616 - RNA, 19 nt, Homo sapiens
aaacggaaagaucaaagug

SEQ ID NO: 31617 - RNA, 19 nt, Homo sapiens
ccacgacaaaggaaguuga

SEQ ID NO: 31618 - RNA, 19 nt, Homo sapiens
ccaccgacuaugagaacua

SEQ ID NO: 31619 - RNA, 19 nt, Homo sapiens
cucggaagaugguacgaaa

SEQ ID NO: 31620 - RNA, 19 nt, Homo sapiens
agaacuaugcccucgugua

SEQ ID NO: 31621 - RNA, 19 nt, Homo sapiens
caccgacuaugagaacuau

SEQ ID NO: 31622 - RNA, 19 nt, Homo sapiens
cauuucaucuugggaagug

SEQ ID NO: 31623 - RNA, 19 nt, Homo sapiens
gagcugauggaacugugaa

SEQ ID NO: 31624 - RNA, 19 nt, Homo sapiens
cugcacccacuccauguua

SEQ ID NO: 31625 - RNA, 19 nt, Homo sapiens
ggauuuugcuuggaucuug

SEQ ID NO: 31626 - RNA, 19 nt, Homo sapiens
cccaacaaccuuugagaau

SEQ ID NO: 31627 - RNA, 19 nt, Homo sapiens
aaucaaccacgacaaagga

SEQ ID NO: 31628 - RNA, 19 nt, Homo sapiens
ggaguugagagcugaugga

SEQ ID NO: 31629 - RNA, 19 nt, Homo sapiens
uugagaagaucccaacaac

SEQ ID NO: 31630 - RNA, 19 nt, Homo sapiens
guuaaguuuuccugguuua

SEQ ID NO: 31631 - RNA, 19 nt, Homo sapiens
acaaaggaaguugaccuaa

SEQ ID NO: 31632 - RNA, 19 nt, Homo sapiens
caaccacgacaaaggaagu

SEQ ID NO: 31633 - RNA, 19 nt, Homo sapiens
agaaacaguggacucucua

SEQ ID NO: 31634 - RNA, 19 nt, Homo sapiens
gcccucguguauuccugua

SEQ ID NO: 31635 - RNA, 19 nt, Homo sapiens
cauccaggccaacuacuca

SEQ ID NO: 31636 - RNA, 19 nt, Homo sapiens
ggagaauuuugacgugaau

SEQ ID NO: 31637 - RNA, 19 nt, Homo sapiens
caucggcaccguacuggau

SEQ ID NO: 31638 - RNA, 19 nt, Homo sapiens
cggcagagggacaagcauu

SEQ ID NO: 31639 - RNA, 19 nt, Homo sapiens
gaguugagagcugauggaa

SEQ ID NO: 31640 - RNA, 19 nt, Homo sapiens
uaaagacaaaccaaucaac

SEQ ID NO: 31641 - RNA, 19 nt, Homo sapiens
ggcaagaaacccuaaucuc

SEQ ID NO: 31642 - RNA, 19 nt, Homo sapiens
ccaggccaacuacucacua

SEQ ID NO: 31643 - RNA, 19 nt, Homo sapiens
gguggacccuaguuuaaua

SEQ ID NO: 31644 - RNA, 19 nt, Homo sapiens
gcaggaagaugaagguucu

SEQ ID NO: 31645 - RNA, 19 nt, Homo sapiens
gaacuggaggaacaacuga

SEQ ID NO: 31646 - RNA, 19 nt, Homo sapiens
ggagccgacuggccaauca

SEQ ID NO: 31647 - RNA, 19 nt, Homo sapiens
ggagcaggcccagcagaua

SEQ ID NO: 31648 - RNA, 19 nt, Homo sapiens
aaucggaacuggaggaaca

SEQ ID NO: 31649 - RNA, 19 nt, Homo sapiens
ggaguugaaggccuacaaa

SEQ ID NO: 31650 - RNA, 19 nt, Homo sapiens
agaagcgccuggcagugua

SEQ ID NO: 31651 - RNA, 19 nt, Homo sapiens
cugcguugcuggucacauu

SEQ ID NO: 31652 - RNA, 19 nt, Homo sapiens
gcccagcgacaaucacuga

SEQ ID NO: 31653 - RNA, 19 nt, Homo sapiens
ggaacuggaggaacaacug

SEQ ID NO: 31654 - RNA, 19 nt, Homo sapiens
gagcaggcccagcagauac

SEQ ID NO: 31655 - RNA, 19 nt, Homo sapiens
guugaaggccuacaaaucg

SEQ ID NO: 31656 - RNA, 19 nt, Homo sapiens
uaaagauucaccaaguuuc

SEQ ID NO: 31657 - RNA, 19 nt, Homo sapiens
ucacaggcaggaagaugaa

SEQ ID NO: 31658 - RNA, 19 nt, Homo sapiens
cagaagcgccuggcagugu

SEQ ID NO: 31659 - RNA, 19 nt, Homo sapiens
aaagauucaccaaguuuca

SEQ ID NO: 31660 - RNA, 19 nt, Homo sapiens
ccaaucacaggcaggaaga

SEQ ID NO: 31661 - RNA, 19 nt, Homo sapiens
agcaagcgguggagacaga

SEQ ID NO: 31662 - RNA, 19 nt, Homo sapiens
gaguugaaggccuacaaau

SEQ ID NO: 31663 - RNA, 19 nt, Homo sapiens
acgagaccaugaaggaguu

SEQ ID NO: 31664 - RNA, 19 nt, Homo sapiens
ggagcaagcgguggagaca

SEQ ID NO: 31665 - RNA, 19 nt, Homo sapiens
caaaucggaacuggaggaa

SEQ ID NO: 31666 - RNA, 19 nt, Homo sapiens
guggacccuaguuuaauaa

SEQ ID NO: 31667 - RNA, 19 nt, Homo sapiens
gagaagagauuacguauuc

SEQ ID NO: 31668 - RNA, 19 nt, Homo sapiens
gaaaagaaguguagcuaua

SEQ ID NO: 31669 - RNA, 19 nt, Homo sapiens
caaggaaccuaauugaaau

SEQ ID NO: 31670 - RNA, 19 nt, Homo sapiens
ccaaggaaccuaauugaaa

SEQ ID NO: 31671 - RNA, 19 nt, Homo sapiens
gaaauagaauguaccaaac

SEQ ID NO: 31672 - RNA, 19 nt, Homo sapiens
ggacuaaauuaccagaaug

SEQ ID NO: 31673 - RNA, 19 nt, Homo sapiens
ggagagagaguaaagauuc

SEQ ID NO: 31674 - RNA, 19 nt, Homo sapiens
ggagggaugagaaaguuua

SEQ ID NO: 31675 - RNA, 19 nt, Homo sapiens
gaaauguacacccagagua

SEQ ID NO: 31676 - RNA, 19 nt, Homo sapiens
gaggagggaugagaaaguu

SEQ ID NO: 31677 - RNA, 19 nt, Homo sapiens
caucaacacucugaaaugu

SEQ ID NO: 31678 - RNA, 19 nt, Homo sapiens
gccaucagcuggaaacaau

SEQ ID NO: 31679 - RNA, 19 nt, Homo sapiens
gccagaugauuuaccauuu

SEQ ID NO: 31680 - RNA, 19 nt, Homo sapiens
gaguaaagauucaggaaaa

SEQ ID NO: 31681 - RNA, 19 nt, Homo sapiens
gagagagaguaaagauuca

SEQ ID NO: 31682 - RNA, 19 nt, Homo sapiens
ggucugccaugccaaguug

SEQ ID NO: 31683 - RNA, 19 nt, Homo sapiens
gcacgacacauggaaauug

SEQ ID NO: 31684 - RNA, 19 nt, Homo sapiens
gcuacauggugauaaaguu

SEQ ID NO: 31685 - RNA, 19 nt, Homo sapiens
caagugcacugaggaagga

SEQ ID NO: 31686 - RNA, 19 nt, Homo sapiens
ccaaaugcuucaaggaaca

SEQ ID NO: 31687 - RNA, 19 nt, Homo sapiens
guaccaaacugggaaacug

SEQ ID NO: 31688 - RNA, 19 nt, Homo sapiens
cauggaaauuggacuaaau

SEQ ID NO: 31689 - RNA, 19 nt, Homo sapiens
ggaaugcuacauggugaua

SEQ ID NO: 31690 - RNA, 19 nt, Homo sapiens
ggagaagagauuacguauu

SEQ ID NO: 31691 - RNA, 19 nt, Homo sapiens
gaugcucaguguauagaug

SEQ ID NO: 31692 - RNA, 19 nt, Homo sapiens
gaagaaauagaauguacca

SEQ ID NO: 31693 - RNA, 19 nt, Homo sapiens
ucaacacucugaaauguac

SEQ ID NO: 31694 - RNA, 19 nt, Homo sapiens
caauggauuugugaacuau

SEQ ID NO: 31695 - RNA, 19 nt, Homo sapiens
gaauaucccaacacgauca

SEQ ID NO: 31696 - RNA, 19 nt, Homo sapiens
caagccagaugauuuacca

SEQ ID NO: 31697 - RNA, 19 nt, Homo sapiens
agaggaugcucaguguaua

SEQ ID NO: 31698 - RNA, 19 nt, Homo sapiens
cggaagaaauagaauguac

SEQ ID NO: 31699 - RNA, 19 nt, Homo sapiens
gaaacaauucccucuaucg

SEQ ID NO: 31700 - RNA, 19 nt, Homo sapiens
caggagaagagauuacgua

SEQ ID NO: 31701 - RNA, 19 nt, Homo sapiens
ucacacuuguuucuuguuc

SEQ ID NO: 31702 - RNA, 19 nt, Homo sapiens
gagaguaaagauucaggaa

SEQ ID NO: 31703 - RNA, 19 nt, Homo sapiens
aaauggagccguacgcuau

SEQ ID NO: 31704 - RNA, 19 nt, Homo sapiens
cagaggaugcucaguguau

SEQ ID NO: 31705 - RNA, 19 nt, Homo sapiens
aaugcuacauggugauaaa

SEQ ID NO: 31706 - RNA, 19 nt, Homo sapiens
gcuauacgacuuuugaaua

SEQ ID NO: 31707 - RNA, 19 nt, Homo sapiens
cuacauggugauaaaguuu

SEQ ID NO: 31708 - RNA, 19 nt, Homo sapiens
ucccaagccagaugauuua

SEQ ID NO: 31709 - RNA, 19 nt, Homo sapiens
guaccaaggagagagagua

SEQ ID NO: 31710 - RNA, 19 nt, Homo sapiens
guuguaaagcaucuuguaa

SEQ ID NO: 31711 - RNA, 19 nt, Homo sapiens
aaguuuaucugcccucuca

SEQ ID NO: 31712 - RNA, 19 nt, Homo sapiens
ccagaugauuuaccauuuu

SEQ ID NO: 31713 - RNA, 19 nt, Homo sapiens
ugauggauauucucuggau

SEQ ID NO: 31714 - RNA, 19 nt, Homo sapiens
uauaagccaucagcuggaa

SEQ ID NO: 31715 - RNA, 19 nt, Homo sapiens
gaacuauccugcaaaacca

SEQ ID NO: 31716 - RNA, 19 nt, Homo sapiens
ccagaaugcagggaaguaa

SEQ ID NO: 31717 - RNA, 19 nt, Homo sapiens
uggacuaaauuaccagaau

SEQ ID NO: 31718 - RNA, 19 nt, Homo sapiens
gucccaagccagaugauuu

SEQ ID NO: 31719 - RNA, 19 nt, Homo sapiens
uacagaggaugcucagugu

SEQ ID NO: 31720 - RNA, 19 nt, Homo sapiens
aauagaauguaccaaacug

SEQ ID NO: 31721 - RNA, 19 nt, Homo sapiens
caaggauaaagccacauuu

SEQ ID NO: 31722 - RNA, 19 nt, Homo sapiens
gcaaaaccaacacuuuauu

SEQ ID NO: 31723 - RNA, 19 nt, Homo sapiens
ggacuguggcccaucaaca

SEQ ID NO: 31724 - RNA, 19 nt, Homo sapiens
ccaaggagagagaguaaag

SEQ ID NO: 31725 - RNA, 19 nt, Homo sapiens
caccauccauaccuacguu

SEQ ID NO: 31726 - RNA, 19 nt, Homo sapiens
gcuggaaucuuagaaaaug

SEQ ID NO: 31727 - RNA, 19 nt, Homo sapiens
gggaugagaaaguuuaucu

SEQ ID NO: 31728 - RNA, 19 nt, Homo sapiens
cauccaaggaaccuaauug

SEQ ID NO: 31729 - RNA, 19 nt, Homo sapiens
cauaaaaugucacacuugu

SEQ ID NO: 31730 - RNA, 19 nt, Homo sapiens
ucucugccauguugcuauu

SEQ ID NO: 31731 - RNA, 19 nt, Homo sapiens
caucaagaccagacaaugg

SEQ ID NO: 31732 - RNA, 19 nt, Homo sapiens
caugcgauguuuggaaaug

SEQ ID NO: 31733 - RNA, 19 nt, Homo sapiens
gagccaggagaagagauua

SEQ ID NO: 31734 - RNA, 19 nt, Homo sapiens
aaauguacacccagaguau

SEQ ID NO: 31735 - RNA, 19 nt, Homo sapiens
cgauguaaagccaugcuaa

SEQ ID NO: 31736 - RNA, 19 nt, Homo sapiens
cuccagugcucaucuuguu

SEQ ID NO: 31737 - RNA, 19 nt, Homo sapiens
acacauggaaauuggacua

SEQ ID NO: 31738 - RNA, 19 nt, Homo sapiens
gauguaaagccaugcuaag

SEQ ID NO: 31739 - RNA, 19 nt, Homo sapiens
cagaaugcagggaaguaaa

SEQ ID NO: 31740 - RNA, 19 nt, Homo sapiens
acauggaaauuggacuaaa

SEQ ID NO: 31741 - RNA, 19 nt, Homo sapiens
caagaccagacaauggauu

SEQ ID NO: 31742 - RNA, 19 nt, Homo sapiens
ccuccaccauccauaccua

SEQ ID NO: 31743 - RNA, 19 nt, Homo sapiens
ugucugugcucccaucauc

SEQ ID NO: 31744 - RNA, 19 nt, Homo sapiens
gcgcugauucugccaagug

SEQ ID NO: 31745 - RNA, 19 nt, Homo sapiens
gcccaucaacacucugaaa

SEQ ID NO: 31746 - RNA, 19 nt, Homo sapiens
gaaugcuacauggugauaa

SEQ ID NO: 31747 - RNA, 19 nt, Homo sapiens
aagaauggaaugcuacaug

SEQ ID NO: 31748 - RNA, 19 nt, Homo sapiens
aaggauaaagccacauuug

SEQ ID NO: 31749 - RNA, 19 nt, Homo sapiens
gcgauguuuggaaaugaua

SEQ ID NO: 31750 - RNA, 19 nt, Homo sapiens
ucaucuuguucucgaguuu

SEQ ID NO: 31751 - RNA, 19 nt, Homo sapiens
ccaucaacacucugaaaug

SEQ ID NO: 31752 - RNA, 19 nt, Homo sapiens
agaguaaagauucaggaaa

SEQ ID NO: 31753 - RNA, 19 nt, Homo sapiens
acaaggauaaagccacauu

SEQ ID NO: 31754 - RNA, 19 nt, Homo sapiens
ugucacacuuguuucuugu

SEQ ID NO: 31755 - RNA, 19 nt, Homo sapiens
guuuucagauuccacauaa

SEQ ID NO: 31756 - RNA, 19 nt, Homo sapiens
gaggaugcucaguguauag

SEQ ID NO: 31757 - RNA, 19 nt, Homo sapiens
uaccaaggagagagaguaa

SEQ ID NO: 31758 - RNA, 19 nt, Homo sapiens
cacgacacauggaaauugg

SEQ ID NO: 31759 - RNA, 19 nt, Homo sapiens
caucagcuggaaacaauuc

SEQ ID NO: 31760 - RNA, 19 nt, Homo sapiens
uugaauaucccaacacgau

SEQ ID NO: 31761 - RNA, 19 nt, Homo sapiens
acacuuguuucuuguucau

SEQ ID NO: 31762 - RNA, 19 nt, Homo sapiens
uaaggugguuuucagauuc

SEQ ID NO: 31763 - RNA, 19 nt, Homo sapiens
ggaaaagaaguguagcuau

SEQ ID NO: 31764 - RNA, 19 nt, Homo sapiens
ggaaaugauacaauuaccu

SEQ ID NO: 31765 - RNA, 19 nt, Homo sapiens
gaagagauuacguauuccu

SEQ ID NO: 31766 - RNA, 19 nt, Homo sapiens
cuaaggugguuuucagauu

SEQ ID NO: 31767 - RNA, 19 nt, Homo sapiens
gaagauggaugcagaauuc

SEQ ID NO: 31768 - RNA, 19 nt, Homo sapiens
aaacaaaggugcaaucauu

SEQ ID NO: 31769 - RNA, 19 nt, Homo sapiens
gaacaacuuugacacagaa

SEQ ID NO: 31770 - RNA, 19 nt, Homo sapiens
gaauuuagcuguaucaaac

SEQ ID NO: 31771 - RNA, 19 nt, Homo sapiens
gaggagaucucugaaguga

SEQ ID NO: 31772 - RNA, 19 nt, Homo sapiens
guagaugccugaacuugaa

SEQ ID NO: 31773 - RNA, 19 nt, Homo sapiens
ggagaucucugaagugaag

SEQ ID NO: 31774 - RNA, 19 nt, Homo sapiens
ggacaaacccuucuuuuaa

SEQ ID NO: 31775 - RNA, 19 nt, Homo sapiens
aaauggaaguggcaauaua

SEQ ID NO: 31776 - RNA, 19 nt, Homo sapiens
gaagaggcagauucaauuu

SEQ ID NO: 31777 - RNA, 19 nt, Homo sapiens
gaacuugccuaaagcugau

SEQ ID NO: 31778 - RNA, 19 nt, Homo sapiens
ggaacaacuuugacacaga

SEQ ID NO: 31779 - RNA, 19 nt, Homo sapiens
ggugggcgguguugucaua

SEQ ID NO: 31780 - RNA, 19 nt, Homo sapiens
caagaaagccgcucagauc

SEQ ID NO: 31781 - RNA, 19 nt, Homo sapiens
aaagagacaugcagugaga

SEQ ID NO: 31782 - RNA, 19 nt, Homo sapiens
gcaggaugauuguacagaa

SEQ ID NO: 31783 - RNA, 19 nt, Homo sapiens
ccgaggagauucaggauga

SEQ ID NO: 31784 - RNA, 19 nt, Homo sapiens
gaaggcauccugcaguauu

SEQ ID NO: 31785 - RNA, 19 nt, Homo sapiens
gaaucccuguucauuguaa

SEQ ID NO: 31786 - RNA, 19 nt, Homo sapiens
uagauucucuccugauuau

SEQ ID NO: 31787 - RNA, 19 nt, Homo sapiens
ucaaacuagugcaugaaua

SEQ ID NO: 31788 - RNA, 19 nt, Homo sapiens
ugacaagugcaaauucuua

SEQ ID NO: 31789 - RNA, 19 nt, Homo sapiens
cagaagauguggguucaaa

SEQ ID NO: 31790 - RNA, 19 nt, Homo sapiens
cgacaugacucaggauaug

SEQ ID NO: 31791 - RNA, 19 nt, Homo sapiens
gguucuggguugacaaaua

SEQ ID NO: 31792 - RNA, 19 nt, Homo sapiens
ggguagaguuuguguguug

SEQ ID NO: 31793 - RNA, 19 nt, Homo sapiens
agacaaaguaguagaagua

SEQ ID NO: 31794 - RNA, 19 nt, Homo sapiens
gagaagaggcagauucaau

SEQ ID NO: 31795 - RNA, 19 nt, Homo sapiens
gagagaaccaccagcauug

SEQ ID NO: 31796 - RNA, 19 nt, Homo sapiens
ugaagaaagugacaaugug

SEQ ID NO: 31797 - RNA, 19 nt, Homo sapiens
guaccaacuugcaugacua

SEQ ID NO: 31798 - RNA, 19 nt, Homo sapiens
guaucaaacuagugcauga

SEQ ID NO: 31799 - RNA, 19 nt, Homo sapiens
guucuggguugacaaauau

SEQ ID NO: 31800 - RNA, 19 nt, Homo sapiens
cagauccggucccagguua

SEQ ID NO: 31801 - RNA, 19 nt, Homo sapiens
ggaagcagccaacgagaga

SEQ ID NO: 31802 - RNA, 19 nt, Homo sapiens
cuuagccaguuguauauua

SEQ ID NO: 31803 - RNA, 19 nt, Homo sapiens
gagcaaaacuauucagaug

SEQ ID NO: 31804 - RNA, 19 nt, Homo sapiens
gccuaaagcugauaagaag

SEQ ID NO: 31805 - RNA, 19 nt, Homo sapiens
gagugaagacaaaguagua

SEQ ID NO: 31806 - RNA, 19 nt, Homo sapiens
agaauaaugugggaagaaa

SEQ ID NO: 31807 - RNA, 19 nt, Homo sapiens
acccaucgguguccauuua

SEQ ID NO: 31808 - RNA, 19 nt, Homo sapiens
cgaagaagccacagagaga

SEQ ID NO: 31809 - RNA, 19 nt, Homo sapiens
aagaaucccuguucauugu

SEQ ID NO: 31810 - RNA, 19 nt, Homo sapiens
gauugcugcuucugcuaua

SEQ ID NO: 31811 - RNA, 19 nt, Homo sapiens
uugaugagcugcuucagaa

SEQ ID NO: 31812 - RNA, 19 nt, Homo sapiens
caugguggaucccaagaaa

SEQ ID NO: 31813 - RNA, 19 nt, Homo sapiens
gauucucuccugauuauuu

SEQ ID NO: 31814 - RNA, 19 nt, Homo sapiens
gaagauguggguucaaaca

SEQ ID NO: 31815 - RNA, 19 nt, Homo sapiens
uggaagccaugcucaauga

SEQ ID NO: 31816 - RNA, 19 nt, Homo sapiens
cugcuuaguuggugaguuu

SEQ ID NO: 31817 - RNA, 19 nt, Homo sapiens
gguguccauuuauagaaua

SEQ ID NO: 31818 - RNA, 19 nt, Homo sapiens
cggaaacgaugcucucaug

SEQ ID NO: 31819 - RNA, 19 nt, Homo sapiens
ugacaaguaucucgagaca

SEQ ID NO: 31820 - RNA, 19 nt, Homo sapiens
gugaugagguagaggaaga

SEQ ID NO: 31821 - RNA, 19 nt, Homo sapiens
gaugugucuucaauuugua

SEQ ID NO: 31822 - RNA, 19 nt, Homo sapiens
ggaauuaagaggauacaca

SEQ ID NO: 31823 - RNA, 19 nt, Homo sapiens
uaaagcauuucgagcaugu

SEQ ID NO: 31824 - RNA, 19 nt, Homo sapiens
caaagaacuugccuaaagc

SEQ ID NO: 31825 - RNA, 19 nt, Homo sapiens
gaacugcagaucaccaaug

SEQ ID NO: 31826 - RNA, 19 nt, Homo sapiens
caugaucgcuuucuacacu

SEQ ID NO: 31827 - RNA, 19 nt, Homo sapiens
cuuaugacaugaucgcuuu

SEQ ID NO: 31828 - RNA, 19 nt, Homo sapiens
ugaggaacccuacgaagaa

SEQ ID NO: 31829 - RNA, 19 nt, Homo sapiens
ccacguaucuuugggucuu

SEQ ID NO: 31830 - RNA, 19 nt, Homo sapiens
gaguucagcugcuucucuu

SEQ ID NO: 31831 - RNA, 19 nt, Homo sapiens
caaccuacaaguucuuuga

SEQ ID NO: 31832 - RNA, 19 nt, Homo sapiens
gaagaagccacagagagaa

SEQ ID NO: 31833 - RNA, 19 nt, Homo sapiens
ugaggauggugaugaggua

SEQ ID NO: 31834 - RNA, 19 nt, Homo sapiens
ugagaagaguaccaacuug

SEQ ID NO: 31835 - RNA, 19 nt, Homo sapiens
uguacagaaucauugcuua

SEQ ID NO: 31836 - RNA, 19 nt, Homo sapiens
caagaagucuacccugaac

SEQ ID NO: 31837 - RNA, 19 nt, Homo sapiens
gaagccaaccaaccaguga

SEQ ID NO: 31838 - RNA, 19 nt, Homo sapiens
uggcugagguggaagaaga

SEQ ID NO: 31839 - RNA, 19 nt, Homo sapiens
ccaaagagacaugcaguga

SEQ ID NO: 31840 - RNA, 19 nt, Homo sapiens
gaaaauggaaguggcaaua

SEQ ID NO: 31841 - RNA, 19 nt, Homo sapiens
agaagaggcagauucaauu

SEQ ID NO: 31842 - RNA, 19 nt, Homo sapiens
aauagauucucuccugauu

SEQ ID NO: 31843 - RNA, 19 nt, Homo sapiens
ccaucgguguccauuuaua

SEQ ID NO: 31844 - RNA, 19 nt, Homo sapiens
agauguggguucaaacaaa

SEQ ID NO: 31845 - RNA, 19 nt, Homo sapiens
ggaagaggcagaacgucaa

SEQ ID NO: 31846 - RNA, 19 nt, Homo sapiens
agaaguggcugagguggaa

SEQ ID NO: 31847 - RNA, 19 nt, Homo sapiens
aaggaugacuacagacauu

SEQ ID NO: 31848 - RNA, 19 nt, Homo sapiens
caaacuagugcaugaauag

SEQ ID NO: 31849 - RNA, 19 nt, Homo sapiens
ugccugaacuugaauuaau

SEQ ID NO: 31850 - RNA, 19 nt, Homo sapiens
acaaguagaugccugaacu

SEQ ID NO: 31851 - RNA, 19 nt, Homo sapiens
cagcagaacggcuacgaaa

SEQ ID NO: 31852 - RNA, 19 nt, Homo sapiens
gaaacaguacacauccauu

SEQ ID NO: 31853 - RNA, 19 nt, Homo sapiens
gauguggguucaaacaaag

SEQ ID NO: 31854 - RNA, 19 nt, Homo sapiens
cuauucagaugacgucuug

SEQ ID NO: 31855 - RNA, 19 nt, Homo sapiens
cagcacacccuaaagcauu

SEQ ID NO: 31856 - RNA, 19 nt, Homo sapiens
caaaguuuacucaagacua

SEQ ID NO: 31857 - RNA, 19 nt, Homo sapiens
ucccaaaguuuacucaaga

SEQ ID NO: 31858 - RNA, 19 nt, Homo sapiens
guacagaaucauugcuuau

SEQ ID NO: 31859 - RNA, 19 nt, Homo sapiens
cgccaugucccaaaguuua

SEQ ID NO: 31860 - RNA, 19 nt, Homo sapiens
aaagaaucccuguucauug

SEQ ID NO: 31861 - RNA, 19 nt, Homo sapiens
gagcagaugcagaacuaga

SEQ ID NO: 31862 - RNA, 19 nt, Homo sapiens
cggaggagaucucugaagu

SEQ ID NO: 31863 - RNA, 19 nt, Homo sapiens
caacaugauuagugaacca

SEQ ID NO: 31864 - RNA, 19 nt, Homo sapiens
gaaggcaguuauccagcau

SEQ ID NO: 31865 - RNA, 19 nt, Homo sapiens
gagaaugucccaggucaug

SEQ ID NO: 31866 - RNA, 19 nt, Homo sapiens
cugaugccguugacaagua

SEQ ID NO: 31867 - RNA, 19 nt, Homo sapiens
gagcugaccucgcuuaagg

SEQ ID NO: 31868 - RNA, 19 nt, Homo sapiens
gaacgcaguaaacagcuuu

SEQ ID NO: 31869 - RNA, 19 nt, Homo sapiens
gggcaaagcuguguuucag

SEQ ID NO: 31870 - RNA, 19 nt, Homo sapiens
aggcugagcuggagauuca

SEQ ID NO: 31871 - RNA, 19 nt, Homo sapiens
gcugcgugcucauccgaaa

SEQ ID NO: 31872 - RNA, 19 nt, Homo sapiens
cagccacacugaacccaau

SEQ ID NO: 31873 - RNA, 19 nt, Homo sapiens
ucucucuccugcaguauga

SEQ ID NO: 31874 - RNA, 19 nt, Homo sapiens
ggagaagcuggcaccugua

SEQ ID NO: 31875 - RNA, 19 nt, Homo sapiens
ccaugaacgcugccuguga

SEQ ID NO: 31876 - RNA, 19 nt, Homo sapiens
ggaaggcugagcuggagau

SEQ ID NO: 31877 - RNA, 19 nt, Homo sapiens
gagaagcuggcaccuguac

SEQ ID NO: 31878 - RNA, 19 nt, Homo sapiens
guggagcugaccucgcuua

SEQ ID NO: 31879 - RNA, 19 nt, Homo sapiens
agcuggagauucagaaaga

SEQ ID NO: 31880 - RNA, 19 nt, Homo sapiens
gccacacugaacccaauua

SEQ ID NO: 31881 - RNA, 19 nt, Homo sapiens
ucuucucucuccugcagua

SEQ ID NO: 31882 - RNA, 19 nt, Homo sapiens
acacugaacccaauuacac

SEQ ID NO: 31883 - RNA, 19 nt, Homo sapiens
gagcuggagauucagaaag

SEQ ID NO: 31884 - RNA, 19 nt, Homo sapiens
ggguggucgucguggauga

SEQ ID NO: 31885 - RNA, 19 nt, Homo sapiens
cuacaucgcaggccuagac

SEQ ID NO: 31886 - RNA, 19 nt, Homo sapiens
gcaccuguacccuucuucu

SEQ ID NO: 31887 - RNA, 19 nt, Homo sapiens
gaaggcugagcuggagauu

SEQ ID NO: 31888 - RNA, 19 nt, Homo sapiens
caaagaaacuucagugugu

SEQ ID NO: 31889 - RNA, 19 nt, Homo sapiens
ggagacauaucacucaauu

SEQ ID NO: 31890 - RNA, 19 nt, Homo sapiens
ggauggagcugaaaacaua

SEQ ID NO: 31891 - RNA, 19 nt, Homo sapiens
ggccaugccuggagacaua

SEQ ID NO: 31892 - RNA, 19 nt, Homo sapiens
cuacugaccuuuguccuua

SEQ ID NO: 31893 - RNA, 19 nt, Homo sapiens
gauaugagccuccugaaga

SEQ ID NO: 31894 - RNA, 19 nt, Homo sapiens
ccuggaagcugauucacua

SEQ ID NO: 31895 - RNA, 19 nt, Homo sapiens
ccagacaacccucagauuu

SEQ ID NO: 31896 - RNA, 19 nt, Homo sapiens
cgaaaggccuucccuguac

SEQ ID NO: 31897 - RNA, 19 nt, Homo sapiens
gaacucacagaaauaaaga

SEQ ID NO: 31898 - RNA, 19 nt, Homo sapiens
guagaacucacagaaauaa

SEQ ID NO: 31899 - RNA, 19 nt, Homo sapiens
agacaacccucagauuuga

SEQ ID NO: 31900 - RNA, 19 nt, Homo sapiens
guaguaaacuuggaaccuu

SEQ ID NO: 31901 - RNA, 19 nt, Homo sapiens
cagauuugaugauuuccua

SEQ ID NO: 31902 - RNA, 19 nt, Homo sapiens
gagggagggucuuccuuug

SEQ ID NO: 31903 - RNA, 19 nt, Homo sapiens
ggagggagggucuuccuuu

SEQ ID NO: 31904 - RNA, 19 nt, Homo sapiens
ccagaguguuucuuaaaug

SEQ ID NO: 31905 - RNA, 19 nt, Homo sapiens
uaguagaacucacagaaau

SEQ ID NO: 31906 - RNA, 19 nt, Homo sapiens
ggaagcugauucacuaugg

SEQ ID NO: 31907 - RNA, 19 nt, Homo sapiens
gaccagaguguuucuuaaa

SEQ ID NO: 31908 - RNA, 19 nt, Homo sapiens
gacaugugcuggacacugu

SEQ ID NO: 31909 - RNA, 19 nt, Homo sapiens
ccucagauuugaugauuuc

SEQ ID NO: 31910 - RNA, 19 nt, Homo sapiens
agacauaucacucaauuuc

SEQ ID NO: 31911 - RNA, 19 nt, Homo sapiens
gaaaugaccaggccaagac

SEQ ID NO: 31912 - RNA, 19 nt, Homo sapiens
gaaaggccuucccuguaca

SEQ ID NO: 31913 - RNA, 19 nt, Homo sapiens
gaaaagaaaucagcagaca

SEQ ID NO: 31914 - RNA, 19 nt, Homo sapiens
gcacugggaagccuagaga

SEQ ID NO: 31915 - RNA, 19 nt, Homo sapiens
gguccaggguugcuaggaa

SEQ ID NO: 31916 - RNA, 19 nt, Homo sapiens
gcacaacgcaccagacacu

SEQ ID NO: 31917 - RNA, 19 nt, Homo sapiens
agaccagaguguuucuuaa

SEQ ID NO: 31918 - RNA, 19 nt, Homo sapiens
agacacaggccagguauuu

SEQ ID NO: 31919 - RNA, 19 nt, Homo sapiens
gaagacacaggccagguau

SEQ ID NO: 31920 - RNA, 19 nt, Homo sapiens
ggaaaugaccaggccaaga

SEQ ID NO: 31921 - RNA, 19 nt, Homo sapiens
ccgaaaggccuucccugua

SEQ ID NO: 31922 - RNA, 19 nt, Homo sapiens
gcauugaaccagaggaguu

SEQ ID NO: 31923 - RNA, 19 nt, Homo sapiens
cagacaacccucagauuug

SEQ ID NO: 31924 - RNA, 19 nt, Homo sapiens
gaacaaaagcgugaucuug

SEQ ID NO: 31925 - RNA, 19 nt, Homo sapiens
cuuggaaccuuggaaauga

SEQ ID NO: 31926 - RNA, 19 nt, Homo sapiens
aaagaaaucagcagacaca

SEQ ID NO: 31927 - RNA, 19 nt, Homo sapiens
ggccuucccuguacaccaa

SEQ ID NO: 31928 - RNA, 19 nt, Homo sapiens
cucagaaggugaccaaguu

SEQ ID NO: 31929 - RNA, 19 nt, Homo sapiens
uagaccagaguguuucuua

SEQ ID NO: 31930 - RNA, 19 nt, Homo sapiens
cagaguguuucuuaaaugg

SEQ ID NO: 31931 - RNA, 19 nt, Homo sapiens
ugaagacacaggccaggua

SEQ ID NO: 31932 - RNA, 19 nt, Homo sapiens
gguguagaccagaguguuu

SEQ ID NO: 31933 - RNA, 19 nt, Homo sapiens
ccacacccgcucuacgaua

SEQ ID NO: 31934 - RNA, 19 nt, Homo sapiens
aaacuuggaaccuuggaaa

SEQ ID NO: 31935 - RNA, 19 nt, Homo sapiens
gaaggugaccaaguucaug

SEQ ID NO: 31936 - RNA, 19 nt, Homo sapiens
caauuucucugaggacaca

SEQ ID NO: 31937 - RNA, 19 nt, Homo sapiens
guccaggguugcuaggaaa

SEQ ID NO: 31938 - RNA, 19 nt, Homo sapiens
ugacgugugugcgcaaguu

SEQ ID NO: 31939 - RNA, 19 nt, Homo sapiens
cacacccgcucuacgauau

SEQ ID NO: 31940 - RNA, 19 nt, Homo sapiens
ggaccuccauguuauuucc

SEQ ID NO: 31941 - RNA, 19 nt, Homo sapiens
auaugagccuccugaagaa

SEQ ID NO: 31942 - RNA, 19 nt, Homo sapiens
gggugucuguguuauuugu

SEQ ID NO: 31943 - RNA, 19 nt, Homo sapiens
cagaaauaaagagcuguua

SEQ ID NO: 31944 - RNA, 19 nt, Homo sapiens
ccuaguagaacucacagaa

SEQ ID NO: 31945 - RNA, 19 nt, Homo sapiens
cugagagaguggagaguga

SEQ ID NO: 31946 - RNA, 19 nt, Homo sapiens
acauaucacucaauuucuc

SEQ ID NO: 31947 - RNA, 19 nt, Homo sapiens
acacaggccagguauuuca

SEQ ID NO: 31948 - RNA, 19 nt, Homo sapiens
uccauguuauuuccaauga

SEQ ID NO: 31949 - RNA, 19 nt, Homo sapiens
cuaguagaacucacagaaa

SEQ ID NO: 31950 - RNA, 19 nt, Homo sapiens
gagaguggagagugacaug

SEQ ID NO: 31951 - RNA, 19 nt, Homo sapiens
caugugcccugcccgaaag

SEQ ID NO: 31952 - RNA, 19 nt, Homo sapiens
aguagaacucacagaaaua

SEQ ID NO: 31953 - RNA, 19 nt, Homo sapiens
gagacauaucacucaauuu

SEQ ID NO: 31954 - RNA, 19 nt, Homo sapiens
caugaagcacugagcagaa

SEQ ID NO: 31955 - RNA, 19 nt, Homo sapiens
ccaugugggucccgguugu

SEQ ID NO: 31956 - RNA, 19 nt, Homo sapiens
uaaagagcuguuauacugu

SEQ ID NO: 31957 - RNA, 19 nt, Homo sapiens
gcaaguucacccucagaag

SEQ ID NO: 31958 - RNA, 19 nt, Homo sapiens
caccagacacucacagcaa

SEQ ID NO: 31959 - RNA, 19 nt, Homo sapiens
accagaguguuucuuaaau

SEQ ID NO: 31960 - RNA, 19 nt, Homo sapiens
gaguggagagugacaugug

SEQ ID NO: 31961 - RNA, 19 nt, Homo sapiens
cacccgcucuacgauauga

SEQ ID NO: 31962 - RNA, 19 nt, Homo sapiens
uugaugauuuccuaguaga

SEQ ID NO: 31963 - RNA, 19 nt, Homo sapiens
acccucagauuugaugauu

SEQ ID NO: 31964 - RNA, 19 nt, Homo sapiens
ccaugugcccugcccgaaa

SEQ ID NO: 31965 - RNA, 19 nt, Homo sapiens
agaacucacagaaauaaag

SEQ ID NO: 31966 - RNA, 19 nt, Homo sapiens
gcaaggauggagcugaaaa

SEQ ID NO: 31967 - RNA, 19 nt, Homo sapiens
guaauuuuguccucucugu

SEQ ID NO: 31968 - RNA, 19 nt, Homo sapiens
uucaagguaucacgucaug

SEQ ID NO: 31969 - RNA, 19 nt, Homo sapiens
aauggugugcuucaaggua

SEQ ID NO: 31970 - RNA, 19 nt, Homo sapiens
gggcccacuugucuguaau

SEQ ID NO: 31971 - RNA, 19 nt, Homo sapiens
ccaaggaccucucucaaug

SEQ ID NO: 31972 - RNA, 19 nt, Homo sapiens
gcucccagcugcuuuacua

SEQ ID NO: 31973 - RNA, 19 nt, Homo sapiens
caacugaaccucgccauaa

SEQ ID NO: 31974 - RNA, 19 nt, Homo sapiens
gcaacugaaccucgccaua

SEQ ID NO: 31975 - RNA, 19 nt, Homo sapiens
ccucauucccugacucuua

SEQ ID NO: 31976 - RNA, 19 nt, Homo sapiens
acucagaccagaacuguuu

SEQ ID NO: 31977 - RNA, 19 nt, Homo sapiens
ucaauccuaucacagucua

SEQ ID NO: 31978 - RNA, 19 nt, Homo sapiens
gcaaugggacucugagaac

SEQ ID NO: 31979 - RNA, 19 nt, Homo sapiens
guaccaaguuucccuucuc

SEQ ID NO: 31980 - RNA, 19 nt, Homo sapiens
caacucagaccagaacugu

SEQ ID NO: 31981 - RNA, 19 nt, Homo sapiens
agacaccuccuucuuccua

SEQ ID NO: 31982 - RNA, 19 nt, Homo sapiens
gcccuaggauacccagaug

SEQ ID NO: 31983 - RNA, 19 nt, Homo sapiens
ccucagaauccacaacuug

SEQ ID NO: 31984 - RNA, 19 nt, Homo sapiens
caaccugggacuuccuaaa

SEQ ID NO: 31985 - RNA, 19 nt, Homo sapiens
ucugggcgcugucuugugu

SEQ ID NO: 31986 - RNA, 19 nt, Homo sapiens
ccccaaaucugcauccuuu

SEQ ID NO: 31987 - RNA, 19 nt, Homo sapiens
ccugggacuuccuaaacuu

SEQ ID NO: 31988 - RNA, 19 nt, Homo sapiens
ggcaaugggacucugagaa

SEQ ID NO: 31989 - RNA, 19 nt, Homo sapiens
caaaugggucccucagucu

SEQ ID NO: 31990 - RNA, 19 nt, Homo sapiens
cccagacucuucauucagu

SEQ ID NO: 31991 - RNA, 19 nt, Homo sapiens
gcaucuccguguuucucuu

SEQ ID NO: 31992 - RNA, 19 nt, Homo sapiens
ccaugugggucccgguugu

SEQ ID NO: 31993 - RNA, 19 nt, Homo sapiens
uaucuggccugagacaaca

SEQ ID NO: 31994 - RNA, 19 nt, Homo sapiens
ggccugagacaacaaaugg

SEQ ID NO: 31995 - RNA, 19 nt, Homo sapiens
ccacuuaccccagaacuuu

SEQ ID NO: 31996 - RNA, 19 nt, Homo sapiens
ccaaucuugcccuaggaua

SEQ ID NO: 31997 - RNA, 19 nt, Homo sapiens
caucuccguguuucucuuu

SEQ ID NO: 31998 - RNA, 19 nt, Homo sapiens
acugccagcucucugauuc

SEQ ID NO: 31999 - RNA, 19 nt, Homo sapiens
caaugggacucugagaacu

SEQ ID NO: 32000 - RNA, 19 nt, Homo sapiens
gcacuuaucccugguuccu

SEQ ID NO: 32001 - RNA, 19 nt, Homo sapiens
acaacugccagcucucuga

SEQ ID NO: 32002 - RNA, 19 nt, Homo sapiens
gaaaugaaauccaaagcuu

SEQ ID NO: 32003 - RNA, 19 nt, Homo sapiens
ucaauaaugucccauguaa

SEQ ID NO: 32004 - RNA, 19 nt, Homo sapiens
gaaagaauggugucaauga

SEQ ID NO: 32005 - RNA, 19 nt, Homo sapiens
ccacuuugccucuaaauua

SEQ ID NO: 32006 - RNA, 19 nt, Homo sapiens
uagaugagaucaagaauga

SEQ ID NO: 32007 - RNA, 19 nt, Homo sapiens
gaaagaagcguaugacaca

SEQ ID NO: 32008 - RNA, 19 nt, Homo sapiens
gauacuaacugcucucaga

SEQ ID NO: 32009 - RNA, 19 nt, Homo sapiens
ucaugaaucuccaaccuua

SEQ ID NO: 32010 - RNA, 19 nt, Homo sapiens
gauguugacuugaguaaau

SEQ ID NO: 32011 - RNA, 19 nt, Homo sapiens
ucaaggacauuacuaguga

SEQ ID NO: 32012 - RNA, 19 nt, Homo sapiens
gaauugaggaagacuguua

SEQ ID NO: 32013 - RNA, 19 nt, Homo sapiens
cuuaauagcuggcuguaaa

SEQ ID NO: 32014 - RNA, 19 nt, Homo sapiens
gaaagaaagaagcguauga

SEQ ID NO: 32015 - RNA, 19 nt, Homo sapiens
guauuugagugcagaauuu

SEQ ID NO: 32016 - RNA, 19 nt, Homo sapiens
ggacauuacuagugacuca

SEQ ID NO: 32017 - RNA, 19 nt, Homo sapiens
ugaaggacauggcuuagaa

SEQ ID NO: 32018 - RNA, 19 nt, Homo sapiens
gcuuagaaguggaaauaaa

SEQ ID NO: 32019 - RNA, 19 nt, Homo sapiens
ccaaguugcugaaucaaug

SEQ ID NO: 32020 - RNA, 19 nt, Homo sapiens
gacacuaagucaaguuaaa

SEQ ID NO: 32021 - RNA, 19 nt, Homo sapiens
ggaagcgguuuacgaguga

SEQ ID NO: 32022 - RNA, 19 nt, Homo sapiens
caaacuucaucaagaguaa

SEQ ID NO: 32023 - RNA, 19 nt, Homo sapiens
ggaaccaccuaaagaacuu

SEQ ID NO: 32024 - RNA, 19 nt, Homo sapiens
aggaauugcucuugucaua

SEQ ID NO: 32025 - RNA, 19 nt, Homo sapiens
gaacccauguuugcaauca

SEQ ID NO: 32026 - RNA, 19 nt, Homo sapiens
gaaacaguggcaauaaauu

SEQ ID NO: 32027 - RNA, 19 nt, Homo sapiens
gagaaaggaaguacagaaa

SEQ ID NO: 32028 - RNA, 19 nt, Homo sapiens
guuauaaacugaagcagau

SEQ ID NO: 32029 - RNA, 19 nt, Homo sapiens
agaagaagcuaugaccuuu

SEQ ID NO: 32030 - RNA, 19 nt, Homo sapiens
cugaagagccaacauauuu

SEQ ID NO: 32031 - RNA, 19 nt, Homo sapiens
ugcagaggaugaaagauua

SEQ ID NO: 32032 - RNA, 19 nt, Homo sapiens
gcagaaagcacagaaagga

SEQ ID NO: 32033 - RNA, 19 nt, Homo sapiens
gaggaagacuguuacuaca

SEQ ID NO: 32034 - RNA, 19 nt, Homo sapiens
gcaagacugcccuuagaaa

SEQ ID NO: 32035 - RNA, 19 nt, Homo sapiens
gcucuggcaucuaacauau

SEQ ID NO: 32036 - RNA, 19 nt, Homo sapiens
aaacaaacuucaucaagag

SEQ ID NO: 32037 - RNA, 19 nt, Homo sapiens
ggcaucaacuucauggaaa

SEQ ID NO: 32038 - RNA, 19 nt, Homo sapiens
caugcuaaguacccaaaua

SEQ ID NO: 32039 - RNA, 19 nt, Homo sapiens
aaagaauggugucaaugaa

SEQ ID NO: 32040 - RNA, 19 nt, Homo sapiens
cagaagauguagauugugu

SEQ ID NO: 32041 - RNA, 19 nt, Homo sapiens
ggauuggaauugaggaaga

SEQ ID NO: 32042 - RNA, 19 nt, Homo sapiens
gcguaugacacauugauua

SEQ ID NO: 32043 - RNA, 19 nt, Homo sapiens
gaagauguagauuguguga

SEQ ID NO: 32044 - RNA, 19 nt, Homo sapiens
ugacugacaucaacuccaa

SEQ ID NO: 32045 - RNA, 19 nt, Homo sapiens
gaaauucuagccugguuug

SEQ ID NO: 32046 - RNA, 19 nt, Homo sapiens
uggaaggccugcaucauga

SEQ ID NO: 32047 - RNA, 19 nt, Homo sapiens
uuacuacuauccuacguuu

SEQ ID NO: 32048 - RNA, 19 nt, Homo sapiens
aaauaaggcucuaccucaa

SEQ ID NO: 32049 - RNA, 19 nt, Homo sapiens
gaacaggcaggccacuuug

SEQ ID NO: 32050 - RNA, 19 nt, Homo sapiens
uguaaauacugcuugguuu

SEQ ID NO: 32051 - RNA, 19 nt, Homo sapiens
gaggauugcucaacaacca

SEQ ID NO: 32052 - RNA, 19 nt, Homo sapiens
gaagagccaacauauuugu

SEQ ID NO: 32053 - RNA, 19 nt, Homo sapiens
agacacagcagaacagaaa

SEQ ID NO: 32054 - RNA, 19 nt, Homo sapiens
gccaacauauuuguagauu

SEQ ID NO: 32055 - RNA, 19 nt, Homo sapiens
gccaaucuuuguacucuug

SEQ ID NO: 32056 - RNA, 19 nt, Homo sapiens
ccaagguucucaugaaucu

SEQ ID NO: 32057 - RNA, 19 nt, Homo sapiens
gaaggaguacacagacaaa

SEQ ID NO: 32058 - RNA, 19 nt, Homo sapiens
gagccaacauauuuguaga

SEQ ID NO: 32059 - RNA, 19 nt, Homo sapiens
gugcagaauuuaaauaagg

SEQ ID NO: 32060 - RNA, 19 nt, Homo sapiens
gcaguggcaugcuaaguac

SEQ ID NO: 32061 - RNA, 19 nt, Homo sapiens
guaauuggcaucaacuuca

SEQ ID NO: 32062 - RNA, 19 nt, Homo sapiens
ucucugaucucgcgcaaga

SEQ ID NO: 32063 - RNA, 19 nt, Homo sapiens
agauguagauugugugaug

SEQ ID NO: 32064 - RNA, 19 nt, Homo sapiens
ccaagugacugacaucaac

SEQ ID NO: 32065 - RNA, 19 nt, Homo sapiens
uuacgucuguugcuagauu

SEQ ID NO: 32066 - RNA, 19 nt, Homo sapiens
agacugcccuuagaaauuc

SEQ ID NO: 32067 - RNA, 19 nt, Homo sapiens
guuuauaacucugagaaga

SEQ ID NO: 32068 - RNA, 19 nt, Homo sapiens
gcgcugaagagccaacaua

SEQ ID NO: 32069 - RNA, 19 nt, Homo sapiens
guucaacugcuucguaauu

SEQ ID NO: 32070 - RNA, 19 nt, Homo sapiens
uaacucuacuguaugugaa

SEQ ID NO: 32071 - RNA, 19 nt, Homo sapiens
aauggcagcuuauacauag

SEQ ID NO: 32072 - RNA, 19 nt, Homo sapiens
guaugaauguaaucagugu

SEQ ID NO: 32073 - RNA, 19 nt, Homo sapiens
gaagagaaaggaaguacag

SEQ ID NO: 32074 - RNA, 19 nt, Homo sapiens
cugaaacaguggcaauaaa

SEQ ID NO: 32075 - RNA, 19 nt, Homo sapiens
ggaaggaguacacagacaa

SEQ ID NO: 32076 - RNA, 19 nt, Homo sapiens
caaaauagaugagaucaag

SEQ ID NO: 32077 - RNA, 19 nt, Homo sapiens
uagauugugugaugaagga

SEQ ID NO: 32078 - RNA, 19 nt, Homo sapiens
ucaucuggauuuaggaauu

SEQ ID NO: 32079 - RNA, 19 nt, Homo sapiens
guucuuacgucuguugcua

SEQ ID NO: 32080 - RNA, 19 nt, Homo sapiens
gcucaaaacuaccuacuuc

SEQ ID NO: 32081 - RNA, 19 nt, Homo sapiens
gaauguaaucaguguaugu

SEQ ID NO: 32082 - RNA, 19 nt, Homo sapiens
gcuaaguacccaaauagga

SEQ ID NO: 32083 - RNA, 19 nt, Homo sapiens
guaacucuacuguauguga

SEQ ID NO: 32084 - RNA, 19 nt, Homo sapiens
aagauucuccuuacuacua

SEQ ID NO: 32085 - RNA, 19 nt, Homo sapiens
cuacaaauggcagcuuaua

SEQ ID NO: 32086 - RNA, 19 nt, Homo sapiens
ucuggcaucuaacauauga

SEQ ID NO: 32087 - RNA, 19 nt, Homo sapiens
gcagaggaugaaagauuaa

SEQ ID NO: 32088 - RNA, 19 nt, Homo sapiens
gaaaggaaguacagaaaac

SEQ ID NO: 32089 - RNA, 19 nt, Homo sapiens
gauguagauugugugauga

SEQ ID NO: 32090 - RNA, 19 nt, Homo sapiens
agaagcguaugacacauug

SEQ ID NO: 32091 - RNA, 19 nt, Homo sapiens
ucaacuucauggaaagaaa

SEQ ID NO: 32092 - RNA, 19 nt, Homo sapiens
ugaugaaggacauggcuua

SEQ ID NO: 32093 - RNA, 19 nt, Homo sapiens
gaauugcucuugucauacc

SEQ ID NO: 32094 - RNA, 19 nt, Homo sapiens
caucuggauuuaggaauug

SEQ ID NO: 32095 - RNA, 19 nt, Homo sapiens
caagacugcccuuagaaau

SEQ ID NO: 32096 - RNA, 19 nt, Homo sapiens
gcugaagagccaacauauu

SEQ ID NO: 32097 - RNA, 19 nt, Homo sapiens
gaugagaucaagaaugaca

SEQ ID NO: 32098 - RNA, 19 nt, Homo sapiens
gcuggagucaugacacuaa

SEQ ID NO: 32099 - RNA, 19 nt, Homo sapiens
ugcagaagauguagauugu

SEQ ID NO: 32100 - RNA, 19 nt, Homo sapiens
gccaagaagggaaggagua

SEQ ID NO: 32101 - RNA, 19 nt, Homo sapiens
guucaauaaugucccaugu

SEQ ID NO: 32102 - RNA, 19 nt, Homo sapiens
gaaaugaaauccaaagcuu

SEQ ID NO: 32103 - RNA, 19 nt, Homo sapiens
ucaauaaugucccauguaa

SEQ ID NO: 32104 - RNA, 19 nt, Homo sapiens
gaaagaauggugucaauga

SEQ ID NO: 32105 - RNA, 19 nt, Homo sapiens
ccacuuugccucuaaauua

SEQ ID NO: 32106 - RNA, 19 nt, Homo sapiens
uagaugagaucaagaauga

SEQ ID NO: 32107 - RNA, 19 nt, Homo sapiens
gaaagaagcguaugacaca

SEQ ID NO: 32108 - RNA, 19 nt, Homo sapiens
gauacuaacugcucucaga

SEQ ID NO: 32109 - RNA, 19 nt, Homo sapiens
ucaugaaucuccaaccuua

SEQ ID NO: 32110 - RNA, 19 nt, Homo sapiens
gauguugacuugaguaaau

SEQ ID NO: 32111 - RNA, 19 nt, Homo sapiens
ucaaggacauuacuaguga

SEQ ID NO: 32112 - RNA, 19 nt, Homo sapiens
gaauugaggaagacuguua

SEQ ID NO: 32113 - RNA, 19 nt, Homo sapiens
cuuaauagcuggcuguaaa

SEQ ID NO: 32114 - RNA, 19 nt, Homo sapiens
gaaagaaagaagcguauga

SEQ ID NO: 32115 - RNA, 19 nt, Homo sapiens
guauuugagugcagaauuu

SEQ ID NO: 32116 - RNA, 19 nt, Homo sapiens
ggacauuacuagugacuca

SEQ ID NO: 32117 - RNA, 19 nt, Homo sapiens
ugaaggacauggcuuagaa

SEQ ID NO: 32118 - RNA, 19 nt, Homo sapiens
gcuuagaaguggaaauaaa

SEQ ID NO: 32119 - RNA, 19 nt, Homo sapiens
ccaaguugcugaaucaaug

SEQ ID NO: 32120 - RNA, 19 nt, Homo sapiens
gacacuaagucaaguuaaa

SEQ ID NO: 32121 - RNA, 19 nt, Homo sapiens
ggaagcgguuuacgaguga

SEQ ID NO: 32122 - RNA, 19 nt, Homo sapiens
caaacuucaucaagaguaa

SEQ ID NO: 32123 - RNA, 19 nt, Homo sapiens
ggaaccaccuaaagaacuu

SEQ ID NO: 32124 - RNA, 19 nt, Homo sapiens
aggaauugcucuugucaua

SEQ ID NO: 32125 - RNA, 19 nt, Homo sapiens
gaacccauguuugcaauca

SEQ ID NO: 32126 - RNA, 19 nt, Homo sapiens
gaaacaguggcaauaaauu

SEQ ID NO: 32127 - RNA, 19 nt, Homo sapiens
gagaaaggaaguacagaaa

SEQ ID NO: 32128 - RNA, 19 nt, Homo sapiens
guuauaaacugaagcagau

SEQ ID NO: 32129 - RNA, 19 nt, Homo sapiens
agaagaagcuaugaccuuu

SEQ ID NO: 32130 - RNA, 19 nt, Homo sapiens
cugaagagccaacauauuu

SEQ ID NO: 32131 - RNA, 19 nt, Homo sapiens
ugcagaggaugaaagauua

SEQ ID NO: 32132 - RNA, 19 nt, Homo sapiens
gcagaaagcacagaaagga

SEQ ID NO: 32133 - RNA, 19 nt, Homo sapiens
gaggaagacuguuacuaca

SEQ ID NO: 32134 - RNA, 19 nt, Homo sapiens
gcaagacugcccuuagaaa

SEQ ID NO: 32135 - RNA, 19 nt, Homo sapiens
gcucuggcaucuaacauau

SEQ ID NO: 32136 - RNA, 19 nt, Homo sapiens
aaacaaacuucaucaagag

SEQ ID NO: 32137 - RNA, 19 nt, Homo sapiens
ggcaucaacuucauggaaa

SEQ ID NO: 32138 - RNA, 19 nt, Homo sapiens
caugcuaaguacccaaaua

SEQ ID NO: 32139 - RNA, 19 nt, Homo sapiens
aaagaauggugucaaugaa

SEQ ID NO: 32140 - RNA, 19 nt, Homo sapiens
cagaagauguagauugugu

SEQ ID NO: 32141 - RNA, 19 nt, Homo sapiens
ggauuggaauugaggaaga

SEQ ID NO: 32142 - RNA, 19 nt, Homo sapiens
gcguaugacacauugauua

SEQ ID NO: 32143 - RNA, 19 nt, Homo sapiens
aagaggaagugaagagaaa

SEQ ID NO: 32144 - RNA, 19 nt, Homo sapiens
gaagauguagauuguguga

SEQ ID NO: 32145 - RNA, 19 nt, Homo sapiens
ugacugacaucaacuccaa

SEQ ID NO: 32146 - RNA, 19 nt, Homo sapiens
gaaauucuagccugguuug

SEQ ID NO: 32147 - RNA, 19 nt, Homo sapiens
uggaaggccugcaucauga

SEQ ID NO: 32148 - RNA, 19 nt, Homo sapiens
uuacuacuauccuacguuu

SEQ ID NO: 32149 - RNA, 19 nt, Homo sapiens
aaauaaggcucuaccucaa

SEQ ID NO: 32150 - RNA, 19 nt, Homo sapiens
gaacaggcaggccacuuug

SEQ ID NO: 32151 - RNA, 19 nt, Homo sapiens
uguaaauacugcuugguuu

SEQ ID NO: 32152 - RNA, 19 nt, Homo sapiens
gaggauugcucaacaacca

SEQ ID NO: 32153 - RNA, 19 nt, Homo sapiens
gaagagccaacauauuugu

SEQ ID NO: 32154 - RNA, 19 nt, Homo sapiens
agacacagcagaacagaaa

SEQ ID NO: 32155 - RNA, 19 nt, Homo sapiens
gccaacauauuuguagauu

SEQ ID NO: 32156 - RNA, 19 nt, Homo sapiens
gccaaucuuuguacucuug

SEQ ID NO: 32157 - RNA, 19 nt, Homo sapiens
ccaagguucucaugaaucu

SEQ ID NO: 32158 - RNA, 19 nt, Homo sapiens
gaaggaguacacagacaaa

SEQ ID NO: 32159 - RNA, 19 nt, Homo sapiens
gagccaacauauuuguaga

SEQ ID NO: 32160 - RNA, 19 nt, Homo sapiens
gugcagaauuuaaauaagg

SEQ ID NO: 32161 - RNA, 19 nt, Homo sapiens
gcaguggcaugcuaaguac

SEQ ID NO: 32162 - RNA, 19 nt, Homo sapiens
guaauuggcaucaacuuca

SEQ ID NO: 32163 - RNA, 19 nt, Homo sapiens
ucucugaucucgcgcaaga

SEQ ID NO: 32164 - RNA, 19 nt, Homo sapiens
gcaaagaggaagugaagag

SEQ ID NO: 32165 - RNA, 19 nt, Homo sapiens
agauguagauugugugaug

SEQ ID NO: 32166 - RNA, 19 nt, Homo sapiens
ccaagugacugacaucaac

SEQ ID NO: 32167 - RNA, 19 nt, Homo sapiens
uuacgucuguugcuagauu

SEQ ID NO: 32168 - RNA, 19 nt, Homo sapiens
agacugcccuuagaaauuc

SEQ ID NO: 32169 - RNA, 19 nt, Homo sapiens
guuuauaacucugagaaga

SEQ ID NO: 32170 - RNA, 19 nt, Homo sapiens
gcgcugaagagccaacaua

SEQ ID NO: 32171 - RNA, 19 nt, Homo sapiens
guucaacugcuucguaauu

SEQ ID NO: 32172 - RNA, 19 nt, Homo sapiens
uaacucuacuguaugugaa

SEQ ID NO: 32173 - RNA, 19 nt, Homo sapiens
aauggcagcuuauacauag

SEQ ID NO: 32174 - RNA, 19 nt, Homo sapiens
guaugaauguaaucagugu

SEQ ID NO: 32175 - RNA, 19 nt, Homo sapiens
gaagagaaaggaaguacag

SEQ ID NO: 32176 - RNA, 19 nt, Homo sapiens
cugaaacaguggcaauaaa

SEQ ID NO: 32177 - RNA, 19 nt, Homo sapiens
ggaaggaguacacagacaa

SEQ ID NO: 32178 - RNA, 19 nt, Homo sapiens
caaaauagaugagaucaag

SEQ ID NO: 32179 - RNA, 19 nt, Homo sapiens
uagauugugugaugaagga

SEQ ID NO: 32180 - RNA, 19 nt, Homo sapiens
ucaucuggauuuaggaauu

SEQ ID NO: 32181 - RNA, 19 nt, Homo sapiens
gcucaaaacuaccuacuuc

SEQ ID NO: 32182 - RNA, 19 nt, Homo sapiens
gaauguaaucaguguaugu

SEQ ID NO: 32183 - RNA, 19 nt, Homo sapiens
gcuaaguacccaaauagga

SEQ ID NO: 32184 - RNA, 19 nt, Homo sapiens
guucuuacgucuguugcua

SEQ ID NO: 32185 - RNA, 19 nt, Homo sapiens
guaacucuacuguauguga

SEQ ID NO: 32186 - RNA, 19 nt, Homo sapiens
aagauucuccuuacuacua

SEQ ID NO: 32187 - RNA, 19 nt, Homo sapiens
cuacaaauggcagcuuaua

SEQ ID NO: 32188 - RNA, 19 nt, Homo sapiens
ucuggcaucuaacauauga

SEQ ID NO: 32189 - RNA, 19 nt, Homo sapiens
gcagaggaugaaagauuaa

SEQ ID NO: 32190 - RNA, 19 nt, Homo sapiens
gaaaggaaguacagaaaac

SEQ ID NO: 32191 - RNA, 19 nt, Homo sapiens
gauguagauugugugauga

SEQ ID NO: 32192 - RNA, 19 nt, Homo sapiens
agaagcguaugacacauug

SEQ ID NO: 32193 - RNA, 19 nt, Homo sapiens
ucaacuucauggaaagaaa

SEQ ID NO: 32194 - RNA, 19 nt, Homo sapiens
ugaugaaggacauggcuua

SEQ ID NO: 32195 - RNA, 19 nt, Homo sapiens
gaauugcucuugucauacc

SEQ ID NO: 32196 - RNA, 19 nt, Homo sapiens
caucuggauuuaggaauug

SEQ ID NO: 32197 - RNA, 19 nt, Homo sapiens
caagacugcccuuagaaau

SEQ ID NO: 32198 - RNA, 19 nt, Homo sapiens
gcugaagagccaacauauu

SEQ ID NO: 32199 - RNA, 19 nt, Homo sapiens
gaugagaucaagaaugaca

SEQ ID NO: 32200 - RNA, 19 nt, Homo sapiens
gcuggagucaugacacuaa

SEQ ID NO: 32201 - RNA, 19 nt, Homo sapiens
ugcagaagauguagauugu

SEQ ID NO: 32202 - RNA, 19 nt, Homo sapiens
gaaaugaaauccaaagcuu

SEQ ID NO: 32203 - RNA, 19 nt, Homo sapiens
ucaauaaugucccauguaa

SEQ ID NO: 32204 - RNA, 19 nt, Homo sapiens
gaaagaauggugucaauga

SEQ ID NO: 32205 - RNA, 19 nt, Homo sapiens
ccacuuugccucuaaauua

SEQ ID NO: 32206 - RNA, 19 nt, Homo sapiens
uagaugagaucaagaauga

SEQ ID NO: 32207 - RNA, 19 nt, Homo sapiens
gaaagaagcguaugacaca

SEQ ID NO: 32208 - RNA, 19 nt, Homo sapiens
gauacuaacugcucucaga

SEQ ID NO: 32209 - RNA, 19 nt, Homo sapiens
ucaugaaucuccaaccuua

SEQ ID NO: 32210 - RNA, 19 nt, Homo sapiens
ucaaggacauuacuaguga

SEQ ID NO: 32211 - RNA, 19 nt, Homo sapiens
gaauugaggaagacuguua

SEQ ID NO: 32212 - RNA, 19 nt, Homo sapiens
cuuaauagcuggcuguaaa

SEQ ID NO: 32213 - RNA, 19 nt, Homo sapiens
gaaagaaagaagcguauga

SEQ ID NO: 32214 - RNA, 19 nt, Homo sapiens
guauuugagugcagaauuu

SEQ ID NO: 32215 - RNA, 19 nt, Homo sapiens
ggacauuacuagugacuca

SEQ ID NO: 32216 - RNA, 19 nt, Homo sapiens
ugaaggacauggcuuagaa

SEQ ID NO: 32217 - RNA, 19 nt, Homo sapiens
gcuuagaaguggaaauaaa

SEQ ID NO: 32218 - RNA, 19 nt, Homo sapiens
ccaaguugcugaaucaaug

SEQ ID NO: 32219 - RNA, 19 nt, Homo sapiens
gacacuaagucaaguuaaa

SEQ ID NO: 32220 - RNA, 19 nt, Homo sapiens
ggaagcgguuuacgaguga

SEQ ID NO: 32221 - RNA, 19 nt, Homo sapiens
caaacuucaucaagaguaa

SEQ ID NO: 32222 - RNA, 19 nt, Homo sapiens
ggaaccaccuaaagaacuu

SEQ ID NO: 32223 - RNA, 19 nt, Homo sapiens
aggaauugcucuugucaua

SEQ ID NO: 32224 - RNA, 19 nt, Homo sapiens
gaacccauguuugcaauca

SEQ ID NO: 32225 - RNA, 19 nt, Homo sapiens
uaaauccuauguugacuug

SEQ ID NO: 32226 - RNA, 19 nt, Homo sapiens
gagaaaggaaguacagaaa

SEQ ID NO: 32227 - RNA, 19 nt, Homo sapiens
guuauaaacugaagcagau

SEQ ID NO: 32228 - RNA, 19 nt, Homo sapiens
agaagaagcuaugaccuuu

SEQ ID NO: 32229 - RNA, 19 nt, Homo sapiens
cugaagagccaacauauuu

SEQ ID NO: 32230 - RNA, 19 nt, Homo sapiens
ugcagaggaugaaagauua

SEQ ID NO: 32231 - RNA, 19 nt, Homo sapiens
gcagaaagcacagaaagga

SEQ ID NO: 32232 - RNA, 19 nt, Homo sapiens
gaggaagacuguuacuaca

SEQ ID NO: 32233 - RNA, 19 nt, Homo sapiens
gcaagacugcccuuagaaa

SEQ ID NO: 32234 - RNA, 19 nt, Homo sapiens
gcucuggcaucuaacauau

SEQ ID NO: 32235 - RNA, 19 nt, Homo sapiens
aaacaaacuucaucaagag

SEQ ID NO: 32236 - RNA, 19 nt, Homo sapiens
ggcaucaacuucauggaaa

SEQ ID NO: 32237 - RNA, 19 nt, Homo sapiens
caugcuaaguacccaaaua

SEQ ID NO: 32238 - RNA, 19 nt, Homo sapiens
aaagaauggugucaaugaa

SEQ ID NO: 32239 - RNA, 19 nt, Homo sapiens
cagaagauguagauugugu

SEQ ID NO: 32240 - RNA, 19 nt, Homo sapiens
ggauuggaauugaggaaga

SEQ ID NO: 32241 - RNA, 19 nt, Homo sapiens
gcguaugacacauugauua

SEQ ID NO: 32242 - RNA, 19 nt, Homo sapiens
gaagauguagauuguguga

SEQ ID NO: 32243 - RNA, 19 nt, Homo sapiens
ugacugacaucaacuccaa

SEQ ID NO: 32244 - RNA, 19 nt, Homo sapiens
gaaauucuagccugguuug

SEQ ID NO: 32245 - RNA, 19 nt, Homo sapiens
uggaaggccugcaucauga

SEQ ID NO: 32246 - RNA, 19 nt, Homo sapiens
uuacuacuauccuacguuu

SEQ ID NO: 32247 - RNA, 19 nt, Homo sapiens
aaauaaggcucuaccucaa

SEQ ID NO: 32248 - RNA, 19 nt, Homo sapiens
gaacaggcaggccacuuug

SEQ ID NO: 32249 - RNA, 19 nt, Homo sapiens
uguaaauacugcuugguuu

SEQ ID NO: 32250 - RNA, 19 nt, Homo sapiens
gaggauugcucaacaacca

SEQ ID NO: 32251 - RNA, 19 nt, Homo sapiens
gaagagccaacauauuugu

SEQ ID NO: 32252 - RNA, 19 nt, Homo sapiens
agacacagcagaacagaaa

SEQ ID NO: 32253 - RNA, 19 nt, Homo sapiens
gccaacauauuuguagauu

SEQ ID NO: 32254 - RNA, 19 nt, Homo sapiens
gccaaucuuuguacucuug

SEQ ID NO: 32255 - RNA, 19 nt, Homo sapiens
ucuccaaccuuaaauccua

SEQ ID NO: 32256 - RNA, 19 nt, Homo sapiens
ccaagguucucaugaaucu

SEQ ID NO: 32257 - RNA, 19 nt, Homo sapiens
gaaggaguacacagacaaa

SEQ ID NO: 32258 - RNA, 19 nt, Homo sapiens
gagccaacauauuuguaga

SEQ ID NO: 32259 - RNA, 19 nt, Homo sapiens
gugcagaauuuaaauaagg

SEQ ID NO: 32260 - RNA, 19 nt, Homo sapiens
ucucugaucucgcgcaaga

SEQ ID NO: 32261 - RNA, 19 nt, Homo sapiens
gcaguggcaugcuaaguac

SEQ ID NO: 32262 - RNA, 19 nt, Homo sapiens
guaauuggcaucaacuuca

SEQ ID NO: 32263 - RNA, 19 nt, Homo sapiens
agauguagauugugugaug

SEQ ID NO: 32264 - RNA, 19 nt, Homo sapiens
ccaagugacugacaucaac

SEQ ID NO: 32265 - RNA, 19 nt, Homo sapiens
uuacgucuguugcuagauu

SEQ ID NO: 32266 - RNA, 19 nt, Homo sapiens
agacugcccuuagaaauuc

SEQ ID NO: 32267 - RNA, 19 nt, Homo sapiens
guuuauaacucugagaaga

SEQ ID NO: 32268 - RNA, 19 nt, Homo sapiens
gcgcugaagagccaacaua

SEQ ID NO: 32269 - RNA, 19 nt, Homo sapiens
guucaacugcuucguaauu

SEQ ID NO: 32270 - RNA, 19 nt, Homo sapiens
aaccuuaaauccuauguug

SEQ ID NO: 32271 - RNA, 19 nt, Homo sapiens
uaacucuacuguaugugaa

SEQ ID NO: 32272 - RNA, 19 nt, Homo sapiens
aauggcagcuuauacauag

SEQ ID NO: 32273 - RNA, 19 nt, Homo sapiens
guaugaauguaaucagugu

SEQ ID NO: 32274 - RNA, 19 nt, Homo sapiens
gaagagaaaggaaguacag

SEQ ID NO: 32275 - RNA, 19 nt, Homo sapiens
ggaaggaguacacagacaa

SEQ ID NO: 32276 - RNA, 19 nt, Homo sapiens
caaaauagaugagaucaag

SEQ ID NO: 32277 - RNA, 19 nt, Homo sapiens
uagauugugugaugaagga

SEQ ID NO: 32278 - RNA, 19 nt, Homo sapiens
ucaucuggauuuaggaauu

SEQ ID NO: 32279 - RNA, 19 nt, Homo sapiens
guucuuacgucuguugcua

SEQ ID NO: 32280 - RNA, 19 nt, Homo sapiens
gcucaaaacuaccuacuuc

SEQ ID NO: 32281 - RNA, 19 nt, Homo sapiens
gaauguaaucaguguaugu

SEQ ID NO: 32282 - RNA, 19 nt, Homo sapiens
gcuaaguacccaaauagga

SEQ ID NO: 32283 - RNA, 19 nt, Homo sapiens
guaacucuacuguauguga

SEQ ID NO: 32284 - RNA, 19 nt, Homo sapiens
aagauucuccuuacuacua

SEQ ID NO: 32285 - RNA, 19 nt, Homo sapiens
cuacaaauggcagcuuaua

SEQ ID NO: 32286 - RNA, 19 nt, Homo sapiens
ucuggcaucuaacauauga

SEQ ID NO: 32287 - RNA, 19 nt, Homo sapiens
gcagaggaugaaagauuaa

SEQ ID NO: 32288 - RNA, 19 nt, Homo sapiens
gaaaggaaguacagaaaac

SEQ ID NO: 32289 - RNA, 19 nt, Homo sapiens
gauguagauugugugauga

SEQ ID NO: 32290 - RNA, 19 nt, Homo sapiens
agaagcguaugacacauug

SEQ ID NO: 32291 - RNA, 19 nt, Homo sapiens
ucaacuucauggaaagaaa

SEQ ID NO: 32292 - RNA, 19 nt, Homo sapiens
ugaugaaggacauggcuua

SEQ ID NO: 32293 - RNA, 19 nt, Homo sapiens
gaauugcucuugucauacc

SEQ ID NO: 32294 - RNA, 19 nt, Homo sapiens
caucuggauuuaggaauug

SEQ ID NO: 32295 - RNA, 19 nt, Homo sapiens
caagacugcccuuagaaau

SEQ ID NO: 32296 - RNA, 19 nt, Homo sapiens
gcugaagagccaacauauu

SEQ ID NO: 32297 - RNA, 19 nt, Homo sapiens
gaugagaucaagaaugaca

SEQ ID NO: 32298 - RNA, 19 nt, Homo sapiens
gcuggagucaugacacuaa

SEQ ID NO: 32299 - RNA, 19 nt, Homo sapiens
ugcagaagauguagauugu

SEQ ID NO: 32300 - RNA, 19 nt, Homo sapiens
gccaagaagggaaggagua

SEQ ID NO: 32301 - RNA, 19 nt, Homo sapiens
guucaauaaugucccaugu

SEQ ID NO: 32302 - RNA, 19 nt, Homo sapiens
gaaaugaaauccaaagcuu

SEQ ID NO: 32303 - RNA, 19 nt, Homo sapiens
ucaauaaugucccauguaa

SEQ ID NO: 32304 - RNA, 19 nt, Homo sapiens
gaaagaauggugucaauga

SEQ ID NO: 32305 - RNA, 19 nt, Homo sapiens
ccacuuugccucuaaauua

SEQ ID NO: 32306 - RNA, 19 nt, Homo sapiens
uagaugagaucaagaauga

SEQ ID NO: 32307 - RNA, 19 nt, Homo sapiens
gaaagaagcguaugacaca

SEQ ID NO: 32308 - RNA, 19 nt, Homo sapiens
gauacuaacugcucucaga

SEQ ID NO: 32309 - RNA, 19 nt, Homo sapiens
ucaugaaucuccaaccuua

SEQ ID NO: 32310 - RNA, 19 nt, Homo sapiens
gauguugacuugaguaaau

SEQ ID NO: 32311 - RNA, 19 nt, Homo sapiens
ucaaggacauuacuaguga

SEQ ID NO: 32312 - RNA, 19 nt, Homo sapiens
gaauugaggaagacuguua

SEQ ID NO: 32313 - RNA, 19 nt, Homo sapiens
cuuaauagcuggcuguaaa

SEQ ID NO: 32314 - RNA, 19 nt, Homo sapiens
gaaagaaagaagcguauga

SEQ ID NO: 32315 - RNA, 19 nt, Homo sapiens
guauuugagugcagaauuu

SEQ ID NO: 32316 - RNA, 19 nt, Homo sapiens
ggacauuacuagugacuca

SEQ ID NO: 32317 - RNA, 19 nt, Homo sapiens
ccaaguugcugaaucaaug

SEQ ID NO: 32318 - RNA, 19 nt, Homo sapiens
gacacuaagucaaguuaaa

SEQ ID NO: 32319 - RNA, 19 nt, Homo sapiens
ggaagcgguuuacgaguga

SEQ ID NO: 32320 - RNA, 19 nt, Homo sapiens
caaacuucaucaagaguaa

SEQ ID NO: 32321 - RNA, 19 nt, Homo sapiens
ggaaccaccuaaagaacuu

SEQ ID NO: 32322 - RNA, 19 nt, Homo sapiens
aggaauugcucuugucaua

SEQ ID NO: 32323 - RNA, 19 nt, Homo sapiens
gaacccauguuugcaauca

SEQ ID NO: 32324 - RNA, 19 nt, Homo sapiens
gaaacaguggcaauaaauu

SEQ ID NO: 32325 - RNA, 19 nt, Homo sapiens
gagaaaggaaguacagaaa

SEQ ID NO: 32326 - RNA, 19 nt, Homo sapiens
guuauaaacugaagcagau

SEQ ID NO: 32327 - RNA, 19 nt, Homo sapiens
agaagaagcuaugaccuuu

SEQ ID NO: 32328 - RNA, 19 nt, Homo sapiens
cugaagagccaacauauuu

SEQ ID NO: 32329 - RNA, 19 nt, Homo sapiens
ugcagaggaugaaagauua

SEQ ID NO: 32330 - RNA, 19 nt, Homo sapiens
gcagaaagcacagaaagga

SEQ ID NO: 32331 - RNA, 19 nt, Homo sapiens
gaggaagacuguuacuaca

SEQ ID NO: 32332 - RNA, 19 nt, Homo sapiens
gcaagacugcccuuagaaa

SEQ ID NO: 32333 - RNA, 19 nt, Homo sapiens
gcucuggcaucuaacauau

SEQ ID NO: 32334 - RNA, 19 nt, Homo sapiens
aaacaaacuucaucaagag

SEQ ID NO: 32335 - RNA, 19 nt, Homo sapiens
ggcaucaacuucauggaaa

SEQ ID NO: 32336 - RNA, 19 nt, Homo sapiens
caugcuaaguacccaaaua

SEQ ID NO: 32337 - RNA, 19 nt, Homo sapiens
aaagaauggugucaaugaa

SEQ ID NO: 32338 - RNA, 19 nt, Homo sapiens
cagaagauguagauugugu

SEQ ID NO: 32339 - RNA, 19 nt, Homo sapiens
ggauuggaauugaggaaga

SEQ ID NO: 32340 - RNA, 19 nt, Homo sapiens
gcguaugacacauugauua

SEQ ID NO: 32341 - RNA, 19 nt, Homo sapiens
gaagauguagauuguguga

SEQ ID NO: 32342 - RNA, 19 nt, Homo sapiens
ugacugacaucaacuccaa

SEQ ID NO: 32343 - RNA, 19 nt, Homo sapiens
gaaauucuagccugguuug

SEQ ID NO: 32344 - RNA, 19 nt, Homo sapiens
uggaaggccugcaucauga

SEQ ID NO: 32345 - RNA, 19 nt, Homo sapiens
uuacuacuauccuacguuu

SEQ ID NO: 32346 - RNA, 19 nt, Homo sapiens
aaauaaggcucuaccucaa

SEQ ID NO: 32347 - RNA, 19 nt, Homo sapiens
gaacaggcaggccacuuug

SEQ ID NO: 32348 - RNA, 19 nt, Homo sapiens
uguaaauacugcuugguuu

SEQ ID NO: 32349 - RNA, 19 nt, Homo sapiens
gaggauugcucaacaacca

SEQ ID NO: 32350 - RNA, 19 nt, Homo sapiens
gaagagccaacauauuugu

SEQ ID NO: 32351 - RNA, 19 nt, Homo sapiens
agacacagcagaacagaaa

SEQ ID NO: 32352 - RNA, 19 nt, Homo sapiens
gccaacauauuuguagauu

SEQ ID NO: 32353 - RNA, 19 nt, Homo sapiens
gccaaucuuuguacucuug

SEQ ID NO: 32354 - RNA, 19 nt, Homo sapiens
ccaagguucucaugaaucu

SEQ ID NO: 32355 - RNA, 19 nt, Homo sapiens
gaaggaguacacagacaaa

SEQ ID NO: 32356 - RNA, 19 nt, Homo sapiens
gagccaacauauuuguaga

SEQ ID NO: 32357 - RNA, 19 nt, Homo sapiens
gugcagaauuuaaauaagg

SEQ ID NO: 32358 - RNA, 19 nt, Homo sapiens
gcaguggcaugcuaaguac

SEQ ID NO: 32359 - RNA, 19 nt, Homo sapiens
ucucugaucucgcgcaaga

SEQ ID NO: 32360 - RNA, 19 nt, Homo sapiens
guaauuggcaucaacuuca

SEQ ID NO: 32361 - RNA, 19 nt, Homo sapiens
agauguagauugugugaug

SEQ ID NO: 32362 - RNA, 19 nt, Homo sapiens
ccaagugacugacaucaac

SEQ ID NO: 32363 - RNA, 19 nt, Homo sapiens
uuacgucuguugcuagauu

SEQ ID NO: 32364 - RNA, 19 nt, Homo sapiens
agacugcccuuagaaauuc

SEQ ID NO: 32365 - RNA, 19 nt, Homo sapiens
guuuauaacucugagaaga

SEQ ID NO: 32366 - RNA, 19 nt, Homo sapiens
gcgcugaagagccaacaua

SEQ ID NO: 32367 - RNA, 19 nt, Homo sapiens
guucaacugcuucguaauu

SEQ ID NO: 32368 - RNA, 19 nt, Homo sapiens
aauggcagcuuauacauag

SEQ ID NO: 32369 - RNA, 19 nt, Homo sapiens
guaugaauguaaucagugu

SEQ ID NO: 32370 - RNA, 19 nt, Homo sapiens
gaagagaaaggaaguacag

SEQ ID NO: 32371 - RNA, 19 nt, Homo sapiens
cugaaacaguggcaauaaa

SEQ ID NO: 32372 - RNA, 19 nt, Homo sapiens
ggaaggaguacacagacaa

SEQ ID NO: 32373 - RNA, 19 nt, Homo sapiens
caaaauagaugagaucaag

SEQ ID NO: 32374 - RNA, 19 nt, Homo sapiens
uagauugugugaugaagga

SEQ ID NO: 32375 - RNA, 19 nt, Homo sapiens
ucaucuggauuuaggaauu

SEQ ID NO: 32376 - RNA, 19 nt, Homo sapiens
gcucaaaacuaccuacuuc

SEQ ID NO: 32377 - RNA, 19 nt, Homo sapiens
gaauguaaucaguguaugu

SEQ ID NO: 32378 - RNA, 19 nt, Homo sapiens
gcuaaguacccaaauagga

SEQ ID NO: 32379 - RNA, 19 nt, Homo sapiens
guucuuacgucuguugcua

SEQ ID NO: 32380 - RNA, 19 nt, Homo sapiens
aagauucuccuuacuacua

SEQ ID NO: 32381 - RNA, 19 nt, Homo sapiens
cuacaaauggcagcuuaua

SEQ ID NO: 32382 - RNA, 19 nt, Homo sapiens
ucuggcaucuaacauauga

SEQ ID NO: 32383 - RNA, 19 nt, Homo sapiens
gcagaggaugaaagauuaa

SEQ ID NO: 32384 - RNA, 19 nt, Homo sapiens
gaaaggaaguacagaaaac

SEQ ID NO: 32385 - RNA, 19 nt, Homo sapiens
gauguagauugugugauga

SEQ ID NO: 32386 - RNA, 19 nt, Homo sapiens
agaagcguaugacacauug

SEQ ID NO: 32387 - RNA, 19 nt, Homo sapiens
ucaacuucauggaaagaaa

SEQ ID NO: 32388 - RNA, 19 nt, Homo sapiens
gaauugcucuugucauacc

SEQ ID NO: 32389 - RNA, 19 nt, Homo sapiens
caucuggauuuaggaauug

SEQ ID NO: 32390 - RNA, 19 nt, Homo sapiens
caagacugcccuuagaaau

SEQ ID NO: 32391 - RNA, 19 nt, Homo sapiens
gcugaagagccaacauauu

SEQ ID NO: 32392 - RNA, 19 nt, Homo sapiens
gaugagaucaagaaugaca

SEQ ID NO: 32393 - RNA, 19 nt, Homo sapiens
gcuggagucaugacacuaa

SEQ ID NO: 32394 - RNA, 19 nt, Homo sapiens
ugcagaagauguagauugu

SEQ ID NO: 32395 - RNA, 19 nt, Homo sapiens
gccaagaagggaaggagua

SEQ ID NO: 32396 - RNA, 19 nt, Homo sapiens
guucaauaaugucccaugu

SEQ ID NO: 32397 - RNA, 19 nt, Homo sapiens
ccgaaaauguucaauaaug

SEQ ID NO: 32398 - RNA, 19 nt, Homo sapiens
ugaacaggcaggccacuuu

SEQ ID NO: 32399 - RNA, 19 nt, Homo sapiens
gcuaugaccuuuugcugaa

SEQ ID NO: 32400 - RNA, 19 nt, Homo sapiens
cccacucuaugaaucaaua

SEQ ID NO: 32401 - RNA, 19 nt, Homo sapiens
aaagcuuggucuagaguga

SEQ ID NO: 32402 - RNA, 19 nt, Homo sapiens
gaaaugaaauccaaagcuu

SEQ ID NO: 32403 - RNA, 19 nt, Homo sapiens
ucaauaaugucccauguaa

SEQ ID NO: 32404 - RNA, 19 nt, Homo sapiens
gaaagaauggugucaauga

SEQ ID NO: 32405 - RNA, 19 nt, Homo sapiens
ccacuuugccucuaaauua

SEQ ID NO: 32406 - RNA, 19 nt, Homo sapiens
uagaugagaucaagaauga

SEQ ID NO: 32407 - RNA, 19 nt, Homo sapiens
gaaagaagcguaugacaca

SEQ ID NO: 32408 - RNA, 19 nt, Homo sapiens
gauacuaacugcucucaga

SEQ ID NO: 32409 - RNA, 19 nt, Homo sapiens
gauguugacuugaguaaau

SEQ ID NO: 32410 - RNA, 19 nt, Homo sapiens
ucaaggacauuacuaguga

SEQ ID NO: 32411 - RNA, 19 nt, Homo sapiens
gaauugaggaagacuguua

SEQ ID NO: 32412 - RNA, 19 nt, Homo sapiens
cuuaauagcuggcuguaaa

SEQ ID NO: 32413 - RNA, 19 nt, Homo sapiens
gaaagaaagaagcguauga

SEQ ID NO: 32414 - RNA, 19 nt, Homo sapiens
guauuugagugcagaauuu

SEQ ID NO: 32415 - RNA, 19 nt, Homo sapiens
ggacauuacuagugacuca

SEQ ID NO: 32416 - RNA, 19 nt, Homo sapiens
gggaaacaguggcaauaaa

SEQ ID NO: 32417 - RNA, 19 nt, Homo sapiens
ccaaguugcugaaucaaug

SEQ ID NO: 32418 - RNA, 19 nt, Homo sapiens
gacacuaagucaaguuaaa

SEQ ID NO: 32419 - RNA, 19 nt, Homo sapiens
ggaagcgguuuacgaguga

SEQ ID NO: 32420 - RNA, 19 nt, Homo sapiens
caaacuucaucaagaguaa

SEQ ID NO: 32421 - RNA, 19 nt, Homo sapiens
ggaaccaccuaaagaacuu

SEQ ID NO: 32422 - RNA, 19 nt, Homo sapiens
aggaauugcucuugucaua

SEQ ID NO: 32423 - RNA, 19 nt, Homo sapiens
gaacccauguuugcaauca

SEQ ID NO: 32424 - RNA, 19 nt, Homo sapiens
gaaacaguggcaauaaauu

SEQ ID NO: 32425 - RNA, 19 nt, Homo sapiens
guuauaaacugaagcagau

SEQ ID NO: 32426 - RNA, 19 nt, Homo sapiens
agaagaagcuaugaccuuu

SEQ ID NO: 32427 - RNA, 19 nt, Homo sapiens
cugaagagccaacauauuu

SEQ ID NO: 32428 - RNA, 19 nt, Homo sapiens
ugcagaggaugaaagauua

SEQ ID NO: 32429 - RNA, 19 nt, Homo sapiens
ggaaacaguggcaauaaau

SEQ ID NO: 32430 - RNA, 19 nt, Homo sapiens
gaggaagacuguuacuaca

SEQ ID NO: 32431 - RNA, 19 nt, Homo sapiens
gcaagacugcccuuagaaa

SEQ ID NO: 32432 - RNA, 19 nt, Homo sapiens
gcucuggcaucuaacauau

SEQ ID NO: 32433 - RNA, 19 nt, Homo sapiens
aaacaaacuucaucaagag

SEQ ID NO: 32434 - RNA, 19 nt, Homo sapiens
ggcaucaacuucauggaaa

SEQ ID NO: 32435 - RNA, 19 nt, Homo sapiens
caugcuaaguacccaaaua

SEQ ID NO: 32436 - RNA, 19 nt, Homo sapiens
aaagaauggugucaaugaa

SEQ ID NO: 32437 - RNA, 19 nt, Homo sapiens
cagaagauguagauugugu

SEQ ID NO: 32438 - RNA, 19 nt, Homo sapiens
ggauuggaauugaggaaga

SEQ ID NO: 32439 - RNA, 19 nt, Homo sapiens
gcguaugacacauugauua

SEQ ID NO: 32440 - RNA, 19 nt, Homo sapiens
gaagauguagauuguguga

SEQ ID NO: 32441 - RNA, 19 nt, Homo sapiens
ugacugacaucaacuccaa

SEQ ID NO: 32442 - RNA, 19 nt, Homo sapiens
gaaauucuagccugguuug

SEQ ID NO: 32443 - RNA, 19 nt, Homo sapiens
uggaaggccugcaucauga

SEQ ID NO: 32444 - RNA, 19 nt, Homo sapiens
uuacuacuauccuacguuu

SEQ ID NO: 32445 - RNA, 19 nt, Homo sapiens
aaauaaggcucuaccucaa

SEQ ID NO: 32446 - RNA, 19 nt, Homo sapiens
gaacaggcaggccacuuug

SEQ ID NO: 32447 - RNA, 19 nt, Homo sapiens
uguaaauacugcuugguuu

SEQ ID NO: 32448 - RNA, 19 nt, Homo sapiens
gaggauugcucaacaacca

SEQ ID NO: 32449 - RNA, 19 nt, Homo sapiens
gaagagccaacauauuugu

SEQ ID NO: 32450 - RNA, 19 nt, Homo sapiens
agacacagcagaacagaaa

SEQ ID NO: 32451 - RNA, 19 nt, Homo sapiens
gccaacauauuuguagauu

SEQ ID NO: 32452 - RNA, 19 nt, Homo sapiens
gccaaucuuuguacucuug

SEQ ID NO: 32453 - RNA, 19 nt, Homo sapiens
gaaggaguacacagacaaa

SEQ ID NO: 32454 - RNA, 19 nt, Homo sapiens
gagccaacauauuuguaga

SEQ ID NO: 32455 - RNA, 19 nt, Homo sapiens
gugcagaauuuaaauaagg

SEQ ID NO: 32456 - RNA, 19 nt, Homo sapiens
gcaguggcaugcuaaguac

SEQ ID NO: 32457 - RNA, 19 nt, Homo sapiens
ucucugaucucgcgcaaga

SEQ ID NO: 32458 - RNA, 19 nt, Homo sapiens
guaauuggcaucaacuuca

SEQ ID NO: 32459 - RNA, 19 nt, Homo sapiens
agauguagauugugugaug

SEQ ID NO: 32460 - RNA, 19 nt, Homo sapiens
ccaagugacugacaucaac

SEQ ID NO: 32461 - RNA, 19 nt, Homo sapiens
uuacgucuguugcuagauu

SEQ ID NO: 32462 - RNA, 19 nt, Homo sapiens
agacugcccuuagaaauuc

SEQ ID NO: 32463 - RNA, 19 nt, Homo sapiens
guuuauaacucugagaaga

SEQ ID NO: 32464 - RNA, 19 nt, Homo sapiens
gcgcugaagagccaacaua

SEQ ID NO: 32465 - RNA, 19 nt, Homo sapiens
guucaacugcuucguaauu

SEQ ID NO: 32466 - RNA, 19 nt, Homo sapiens
aauggcagcuuauacauag

SEQ ID NO: 32467 - RNA, 19 nt, Homo sapiens
guaugaauguaaucagugu

SEQ ID NO: 32468 - RNA, 19 nt, Homo sapiens
ggaaggaguacacagacaa

SEQ ID NO: 32469 - RNA, 19 nt, Homo sapiens
caaaauagaugagaucaag

SEQ ID NO: 32470 - RNA, 19 nt, Homo sapiens
uagauugugugaugaagga

SEQ ID NO: 32471 - RNA, 19 nt, Homo sapiens
ucaucuggauuuaggaauu

SEQ ID NO: 32472 - RNA, 19 nt, Homo sapiens
gcucaaaacuaccuacuuc

SEQ ID NO: 32473 - RNA, 19 nt, Homo sapiens
gaauguaaucaguguaugu

SEQ ID NO: 32474 - RNA, 19 nt, Homo sapiens
gcuaaguacccaaauagga

SEQ ID NO: 32475 - RNA, 19 nt, Homo sapiens
guucuuacgucuguugcua

SEQ ID NO: 32476 - RNA, 19 nt, Homo sapiens
aagauucuccuuacuacua

SEQ ID NO: 32477 - RNA, 19 nt, Homo sapiens
cuacaaauggcagcuuaua

SEQ ID NO: 32478 - RNA, 19 nt, Homo sapiens
ucuggcaucuaacauauga

SEQ ID NO: 32479 - RNA, 19 nt, Homo sapiens
gcagaggaugaaagauuaa

SEQ ID NO: 32480 - RNA, 19 nt, Homo sapiens
gauguagauugugugauga

SEQ ID NO: 32481 - RNA, 19 nt, Homo sapiens
agaagcguaugacacauug

SEQ ID NO: 32482 - RNA, 19 nt, Homo sapiens
ucaacuucauggaaagaaa

SEQ ID NO: 32483 - RNA, 19 nt, Homo sapiens
gaauugcucuugucauacc

SEQ ID NO: 32484 - RNA, 19 nt, Homo sapiens
caucuggauuuaggaauug

SEQ ID NO: 32485 - RNA, 19 nt, Homo sapiens
caagacugcccuuagaaau

SEQ ID NO: 32486 - RNA, 19 nt, Homo sapiens
gcugaagagccaacauauu

SEQ ID NO: 32487 - RNA, 19 nt, Homo sapiens
gaugagaucaagaaugaca

SEQ ID NO: 32488 - RNA, 19 nt, Homo sapiens
gcuggagucaugacacuaa

SEQ ID NO: 32489 - RNA, 19 nt, Homo sapiens
ugcagaagauguagauugu

SEQ ID NO: 32490 - RNA, 19 nt, Homo sapiens
gccaagaagggaaggagua

SEQ ID NO: 32491 - RNA, 19 nt, Homo sapiens
guucaauaaugucccaugu

SEQ ID NO: 32492 - RNA, 19 nt, Homo sapiens
ccgaaaauguucaauaaug

SEQ ID NO: 32493 - RNA, 19 nt, Homo sapiens
ugaacaggcaggccacuuu

SEQ ID NO: 32494 - RNA, 19 nt, Homo sapiens
gcuaugaccuuuugcugaa

SEQ ID NO: 32495 - RNA, 19 nt, Homo sapiens
cccacucuaugaaucaaua

SEQ ID NO: 32496 - RNA, 19 nt, Homo sapiens
aaagcuuggucuagaguga

SEQ ID NO: 32497 - RNA, 19 nt, Homo sapiens
cguaugacacauugauuaa

SEQ ID NO: 32498 - RNA, 19 nt, Homo sapiens
ucgaaagaauggugucaau

SEQ ID NO: 32499 - RNA, 19 nt, Homo sapiens
aaauggcagcuuauacaua

SEQ ID NO: 32500 - RNA, 19 nt, Homo sapiens
acaaauggcagcuuauaca

SEQ ID NO: 32501 - RNA, 19 nt, Homo sapiens
acaguuuauuggugucaua

SEQ ID NO: 32502 - RNA, 19 nt, Homo sapiens
gaaaugaaauccaaagcuu

SEQ ID NO: 32503 - RNA, 19 nt, Homo sapiens
ucaauaaugucccauguaa

SEQ ID NO: 32504 - RNA, 19 nt, Homo sapiens
gaaagaauggugucaauga

SEQ ID NO: 32505 - RNA, 19 nt, Homo sapiens
ccacuuugccucuaaauua

SEQ ID NO: 32506 - RNA, 19 nt, Homo sapiens
uagaugagaucaagaauga

SEQ ID NO: 32507 - RNA, 19 nt, Homo sapiens
gaaagaagcguaugacaca

SEQ ID NO: 32508 - RNA, 19 nt, Homo sapiens
gauacuaacugcucucaga

SEQ ID NO: 32509 - RNA, 19 nt, Homo sapiens
ucaugaaucuccaaccuua

SEQ ID NO: 32510 - RNA, 19 nt, Homo sapiens
gauguugacuugaguaaau

SEQ ID NO: 32511 - RNA, 19 nt, Homo sapiens
ucaaggacauuacuaguga

SEQ ID NO: 32512 - RNA, 19 nt, Homo sapiens
gaauugaggaagacuguua

SEQ ID NO: 32513 - RNA, 19 nt, Homo sapiens
cuuaauagcuggcuguaaa

SEQ ID NO: 32514 - RNA, 19 nt, Homo sapiens
gaaagaaagaagcguauga

SEQ ID NO: 32515 - RNA, 19 nt, Homo sapiens
guauuugagugcagaauuu

SEQ ID NO: 32516 - RNA, 19 nt, Homo sapiens
ggacauuacuagugacuca

SEQ ID NO: 32517 - RNA, 19 nt, Homo sapiens
ccaaguugcugaaucaaug

SEQ ID NO: 32518 - RNA, 19 nt, Homo sapiens
gacacuaagucaaguuaaa

SEQ ID NO: 32519 - RNA, 19 nt, Homo sapiens
ggaagcgguuuacgaguga

SEQ ID NO: 32520 - RNA, 19 nt, Homo sapiens
caaacuucaucaagaguaa

SEQ ID NO: 32521 - RNA, 19 nt, Homo sapiens
ggaaccaccuaaagaacuu

SEQ ID NO: 32522 - RNA, 19 nt, Homo sapiens
aggaauugcucuugucaua

SEQ ID NO: 32523 - RNA, 19 nt, Homo sapiens
gaacccauguuugcaauca

SEQ ID NO: 32524 - RNA, 19 nt, Homo sapiens
gaaacaguggcaauaaauu

SEQ ID NO: 32525 - RNA, 19 nt, Homo sapiens
gagaaaggaaguacagaaa

SEQ ID NO: 32526 - RNA, 19 nt, Homo sapiens
guuauaaacugaagcagau

SEQ ID NO: 32527 - RNA, 19 nt, Homo sapiens
agaagaagcuaugaccuuu

SEQ ID NO: 32528 - RNA, 19 nt, Homo sapiens
cugaagagccaacauauuu

SEQ ID NO: 32529 - RNA, 19 nt, Homo sapiens
ugcagaggaugaaagauua

SEQ ID NO: 32530 - RNA, 19 nt, Homo sapiens
gcagaaagcacagaaagga

SEQ ID NO: 32531 - RNA, 19 nt, Homo sapiens
gaggaagacuguuacuaca

SEQ ID NO: 32532 - RNA, 19 nt, Homo sapiens
gcaagacugcccuuagaaa

SEQ ID NO: 32533 - RNA, 19 nt, Homo sapiens
gcucuggcaucuaacauau

SEQ ID NO: 32534 - RNA, 19 nt, Homo sapiens
aaacaaacuucaucaagag

SEQ ID NO: 32535 - RNA, 19 nt, Homo sapiens
ggcaucaacuucauggaaa

SEQ ID NO: 32536 - RNA, 19 nt, Homo sapiens
caugcuaaguacccaaaua

SEQ ID NO: 32537 - RNA, 19 nt, Homo sapiens
aaagaauggugucaaugaa

SEQ ID NO: 32538 - RNA, 19 nt, Homo sapiens
cagaagauguagauugugu

SEQ ID NO: 32539 - RNA, 19 nt, Homo sapiens
ggauuggaauugaggaaga

SEQ ID NO: 32540 - RNA, 19 nt, Homo sapiens
gcguaugacacauugauua

SEQ ID NO: 32541 - RNA, 19 nt, Homo sapiens
aagaggaagugaagagaaa

SEQ ID NO: 32542 - RNA, 19 nt, Homo sapiens
gaagauguagauuguguga

SEQ ID NO: 32543 - RNA, 19 nt, Homo sapiens
ugacugacaucaacuccaa

SEQ ID NO: 32544 - RNA, 19 nt, Homo sapiens
gaaauucuagccugguuug

SEQ ID NO: 32545 - RNA, 19 nt, Homo sapiens
uggaaggccugcaucauga

SEQ ID NO: 32546 - RNA, 19 nt, Homo sapiens
uuacuacuauccuacguuu

SEQ ID NO: 32547 - RNA, 19 nt, Homo sapiens
aaauaaggcucuaccucaa

SEQ ID NO: 32548 - RNA, 19 nt, Homo sapiens
gaacaggcaggccacuuug

SEQ ID NO: 32549 - RNA, 19 nt, Homo sapiens
uguaaauacugcuugguuu

SEQ ID NO: 32550 - RNA, 19 nt, Homo sapiens
gaggauugcucaacaacca

SEQ ID NO: 32551 - RNA, 19 nt, Homo sapiens
gaagagccaacauauuugu

SEQ ID NO: 32552 - RNA, 19 nt, Homo sapiens
agacacagcagaacagaaa

SEQ ID NO: 32553 - RNA, 19 nt, Homo sapiens
gccaacauauuuguagauu

SEQ ID NO: 32554 - RNA, 19 nt, Homo sapiens
gccaaucuuuguacucuug

SEQ ID NO: 32555 - RNA, 19 nt, Homo sapiens
ccaagguucucaugaaucu

SEQ ID NO: 32556 - RNA, 19 nt, Homo sapiens
gaaggaguacacagacaaa

SEQ ID NO: 32557 - RNA, 19 nt, Homo sapiens
gagccaacauauuuguaga

SEQ ID NO: 32558 - RNA, 19 nt, Homo sapiens
gugcagaauuuaaauaagg

SEQ ID NO: 32559 - RNA, 19 nt, Homo sapiens
gcaguggcaugcuaaguac

SEQ ID NO: 32560 - RNA, 19 nt, Homo sapiens
ucucugaucucgcgcaaga

SEQ ID NO: 32561 - RNA, 19 nt, Homo sapiens
guaauuggcaucaacuuca

SEQ ID NO: 32562 - RNA, 19 nt, Homo sapiens
gcaaagaggaagugaagag

SEQ ID NO: 32563 - RNA, 19 nt, Homo sapiens
agauguagauugugugaug

SEQ ID NO: 32564 - RNA, 19 nt, Homo sapiens
ccaagugacugacaucaac

SEQ ID NO: 32565 - RNA, 19 nt, Homo sapiens
uuacgucuguugcuagauu

SEQ ID NO: 32566 - RNA, 19 nt, Homo sapiens
agacugcccuuagaaauuc

SEQ ID NO: 32567 - RNA, 19 nt, Homo sapiens
guuuauaacucugagaaga

SEQ ID NO: 32568 - RNA, 19 nt, Homo sapiens
gcgcugaagagccaacaua

SEQ ID NO: 32569 - RNA, 19 nt, Homo sapiens
guucaacugcuucguaauu

SEQ ID NO: 32570 - RNA, 19 nt, Homo sapiens
aauggcagcuuauacauag

SEQ ID NO: 32571 - RNA, 19 nt, Homo sapiens
guaugaauguaaucagugu

SEQ ID NO: 32572 - RNA, 19 nt, Homo sapiens
gaagagaaaggaaguacag

SEQ ID NO: 32573 - RNA, 19 nt, Homo sapiens
cugaaacaguggcaauaaa

SEQ ID NO: 32574 - RNA, 19 nt, Homo sapiens
ggaaggaguacacagacaa

SEQ ID NO: 32575 - RNA, 19 nt, Homo sapiens
caaaauagaugagaucaag

SEQ ID NO: 32576 - RNA, 19 nt, Homo sapiens
uagauugugugaugaagga

SEQ ID NO: 32577 - RNA, 19 nt, Homo sapiens
ucaucuggauuuaggaauu

SEQ ID NO: 32578 - RNA, 19 nt, Homo sapiens
gcucaaaacuaccuacuuc

SEQ ID NO: 32579 - RNA, 19 nt, Homo sapiens
guucuuacgucuguugcua

SEQ ID NO: 32580 - RNA, 19 nt, Homo sapiens
gaauguaaucaguguaugu

SEQ ID NO: 32581 - RNA, 19 nt, Homo sapiens
gcuaaguacccaaauagga

SEQ ID NO: 32582 - RNA, 19 nt, Homo sapiens
aagauucuccuuacuacua

SEQ ID NO: 32583 - RNA, 19 nt, Homo sapiens
cuacaaauggcagcuuaua

SEQ ID NO: 32584 - RNA, 19 nt, Homo sapiens
ucuggcaucuaacauauga

SEQ ID NO: 32585 - RNA, 19 nt, Homo sapiens
gcagaggaugaaagauuaa

SEQ ID NO: 32586 - RNA, 19 nt, Homo sapiens
gaaaggaaguacagaaaac

SEQ ID NO: 32587 - RNA, 19 nt, Homo sapiens
gauguagauugugugauga

SEQ ID NO: 32588 - RNA, 19 nt, Homo sapiens
agaagcguaugacacauug

SEQ ID NO: 32589 - RNA, 19 nt, Homo sapiens
ucaacuucauggaaagaaa

SEQ ID NO: 32590 - RNA, 19 nt, Homo sapiens
gaauugcucuugucauacc

SEQ ID NO: 32591 - RNA, 19 nt, Homo sapiens
caucuggauuuaggaauug

SEQ ID NO: 32592 - RNA, 19 nt, Homo sapiens
caagacugcccuuagaaau

SEQ ID NO: 32593 - RNA, 19 nt, Homo sapiens
gcugaagagccaacauauu

SEQ ID NO: 32594 - RNA, 19 nt, Homo sapiens
gaugagaucaagaaugaca

SEQ ID NO: 32595 - RNA, 19 nt, Homo sapiens
gcuggagucaugacacuaa

SEQ ID NO: 32596 - RNA, 19 nt, Homo sapiens
ugcagaagauguagauugu

SEQ ID NO: 32597 - RNA, 19 nt, Homo sapiens
gccaagaagggaaggagua

SEQ ID NO: 32598 - RNA, 19 nt, Homo sapiens
guucaauaaugucccaugu

SEQ ID NO: 32599 - RNA, 19 nt, Homo sapiens
ccgaaaauguucaauaaug

SEQ ID NO: 32600 - RNA, 19 nt, Homo sapiens
ugaacaggcaggccacuuu

SEQ ID NO: 32601 - RNA, 19 nt, Homo sapiens
gcuaugaccuuuugcugaa

SEQ ID NO: 32602 - RNA, 19 nt, Homo sapiens
gaaaugaaauccaaagcuu

SEQ ID NO: 32603 - RNA, 19 nt, Homo sapiens
ucaauaaugucccauguaa

SEQ ID NO: 32604 - RNA, 19 nt, Homo sapiens
gaaagaauggugucaauga

SEQ ID NO: 32605 - RNA, 19 nt, Homo sapiens
ccacuuugccucuaaauua

SEQ ID NO: 32606 - RNA, 19 nt, Homo sapiens
uagaugagaucaagaauga

SEQ ID NO: 32607 - RNA, 19 nt, Homo sapiens
gaaagaagcguaugacaca

SEQ ID NO: 32608 - RNA, 19 nt, Homo sapiens
gauacuaacugcucucaga

SEQ ID NO: 32609 - RNA, 19 nt, Homo sapiens
ucaugaaucuccaaccuua

SEQ ID NO: 32610 - RNA, 19 nt, Homo sapiens
gauguugacuugaguaaau

SEQ ID NO: 32611 - RNA, 19 nt, Homo sapiens
ucaaggacauuacuaguga

SEQ ID NO: 32612 - RNA, 19 nt, Homo sapiens
gaauugaggaagacuguua

SEQ ID NO: 32613 - RNA, 19 nt, Homo sapiens
cuuaauagcuggcuguaaa

SEQ ID NO: 32614 - RNA, 19 nt, Homo sapiens
gaaagaaagaagcguauga

SEQ ID NO: 32615 - RNA, 19 nt, Homo sapiens
guauuugagugcagaauuu

SEQ ID NO: 32616 - RNA, 19 nt, Homo sapiens
ggacauuacuagugacuca

SEQ ID NO: 32617 - RNA, 19 nt, Homo sapiens
ccaaguugcugaaucaaug

SEQ ID NO: 32618 - RNA, 19 nt, Homo sapiens
gacacuaagucaaguuaaa

SEQ ID NO: 32619 - RNA, 19 nt, Homo sapiens
ggaagcgguuuacgaguga

SEQ ID NO: 32620 - RNA, 19 nt, Homo sapiens
caaacuucaucaagaguaa

SEQ ID NO: 32621 - RNA, 19 nt, Homo sapiens
ggaaccaccuaaagaacuu

SEQ ID NO: 32622 - RNA, 19 nt, Homo sapiens
aggaauugcucuugucaua

SEQ ID NO: 32623 - RNA, 19 nt, Homo sapiens
gaacccauguuugcaauca

SEQ ID NO: 32624 - RNA, 19 nt, Homo sapiens
gaaacaguggcaauaaauu

SEQ ID NO: 32625 - RNA, 19 nt, Homo sapiens
gagaaaggaaguacagaaa

SEQ ID NO: 32626 - RNA, 19 nt, Homo sapiens
guuauaaacugaagcagau

SEQ ID NO: 32627 - RNA, 19 nt, Homo sapiens
agaagaagcuaugaccuuu

SEQ ID NO: 32628 - RNA, 19 nt, Homo sapiens
cugaagagccaacauauuu

SEQ ID NO: 32629 - RNA, 19 nt, Homo sapiens
ugcagaggaugaaagauua

SEQ ID NO: 32630 - RNA, 19 nt, Homo sapiens
gcagaaagcacagaaagga

SEQ ID NO: 32631 - RNA, 19 nt, Homo sapiens
gaggaagacuguuacuaca

SEQ ID NO: 32632 - RNA, 19 nt, Homo sapiens
gcaagacugcccuuagaaa

SEQ ID NO: 32633 - RNA, 19 nt, Homo sapiens
gcucuggcaucuaacauau

SEQ ID NO: 32634 - RNA, 19 nt, Homo sapiens
aaacaaacuucaucaagag

SEQ ID NO: 32635 - RNA, 19 nt, Homo sapiens
ggcaucaacuucauggaaa

SEQ ID NO: 32636 - RNA, 19 nt, Homo sapiens
caugcuaaguacccaaaua

SEQ ID NO: 32637 - RNA, 19 nt, Homo sapiens
aaagaauggugucaaugaa

SEQ ID NO: 32638 - RNA, 19 nt, Homo sapiens
ggauuggaauugaggaaga

SEQ ID NO: 32639 - RNA, 19 nt, Homo sapiens
gcguaugacacauugauua

SEQ ID NO: 32640 - RNA, 19 nt, Homo sapiens
aagaggaagugaagagaaa

SEQ ID NO: 32641 - RNA, 19 nt, Homo sapiens
ugacugacaucaacuccaa

SEQ ID NO: 32642 - RNA, 19 nt, Homo sapiens
gaaauucuagccugguuug

SEQ ID NO: 32643 - RNA, 19 nt, Homo sapiens
uggaaggccugcaucauga

SEQ ID NO: 32644 - RNA, 19 nt, Homo sapiens
uuacuacuauccuacguuu

SEQ ID NO: 32645 - RNA, 19 nt, Homo sapiens
aaauaaggcucuaccucaa

SEQ ID NO: 32646 - RNA, 19 nt, Homo sapiens
gaacaggcaggccacuuug

SEQ ID NO: 32647 - RNA, 19 nt, Homo sapiens
uguaaauacugcuugguuu

SEQ ID NO: 32648 - RNA, 19 nt, Homo sapiens
gaggauugcucaacaacca

SEQ ID NO: 32649 - RNA, 19 nt, Homo sapiens
gaagagccaacauauuugu

SEQ ID NO: 32650 - RNA, 19 nt, Homo sapiens
agacacagcagaacagaaa

SEQ ID NO: 32651 - RNA, 19 nt, Homo sapiens
gccaacauauuuguagauu

SEQ ID NO: 32652 - RNA, 19 nt, Homo sapiens
gccaaucuuuguacucuug

SEQ ID NO: 32653 - RNA, 19 nt, Homo sapiens
ccaagguucucaugaaucu

SEQ ID NO: 32654 - RNA, 19 nt, Homo sapiens
gagccaacauauuuguaga

SEQ ID NO: 32655 - RNA, 19 nt, Homo sapiens
gugcagaauuuaaauaagg

SEQ ID NO: 32656 - RNA, 19 nt, Homo sapiens
gcaguggcaugcuaaguac

SEQ ID NO: 32657 - RNA, 19 nt, Homo sapiens
ucucugaucucgcgcaaga

SEQ ID NO: 32658 - RNA, 19 nt, Homo sapiens
guaauuggcaucaacuuca

SEQ ID NO: 32659 - RNA, 19 nt, Homo sapiens
gcaaagaggaagugaagag

SEQ ID NO: 32660 - RNA, 19 nt, Homo sapiens
ccaagugacugacaucaac

SEQ ID NO: 32661 - RNA, 19 nt, Homo sapiens
uuacgucuguugcuagauu

SEQ ID NO: 32662 - RNA, 19 nt, Homo sapiens
agacugcccuuagaaauuc

SEQ ID NO: 32663 - RNA, 19 nt, Homo sapiens
guuuauaacucugagaaga

SEQ ID NO: 32664 - RNA, 19 nt, Homo sapiens
gcgcugaagagccaacaua

SEQ ID NO: 32665 - RNA, 19 nt, Homo sapiens
guucaacugcuucguaauu

SEQ ID NO: 32666 - RNA, 19 nt, Homo sapiens
aauggcagcuuauacauag

SEQ ID NO: 32667 - RNA, 19 nt, Homo sapiens
guaugaauguaaucagugu

SEQ ID NO: 32668 - RNA, 19 nt, Homo sapiens
gaagagaaaggaaguacag

SEQ ID NO: 32669 - RNA, 19 nt, Homo sapiens
cugaaacaguggcaauaaa

SEQ ID NO: 32670 - RNA, 19 nt, Homo sapiens
caaaauagaugagaucaag

SEQ ID NO: 32671 - RNA, 19 nt, Homo sapiens
ucaucuggauuuaggaauu

SEQ ID NO: 32672 - RNA, 19 nt, Homo sapiens
gcucaaaacuaccuacuuc

SEQ ID NO: 32673 - RNA, 19 nt, Homo sapiens
gaauguaaucaguguaugu

SEQ ID NO: 32674 - RNA, 19 nt, Homo sapiens
gcuaaguacccaaauagga

SEQ ID NO: 32675 - RNA, 19 nt, Homo sapiens
guucuuacgucuguugcua

SEQ ID NO: 32676 - RNA, 19 nt, Homo sapiens
aagauucuccuuacuacua

SEQ ID NO: 32677 - RNA, 19 nt, Homo sapiens
cuacaaauggcagcuuaua

SEQ ID NO: 32678 - RNA, 19 nt, Homo sapiens
ucuggcaucuaacauauga

SEQ ID NO: 32679 - RNA, 19 nt, Homo sapiens
gcagaggaugaaagauuaa

SEQ ID NO: 32680 - RNA, 19 nt, Homo sapiens
gaaaggaaguacagaaaac

SEQ ID NO: 32681 - RNA, 19 nt, Homo sapiens
agaagcguaugacacauug

SEQ ID NO: 32682 - RNA, 19 nt, Homo sapiens
ucaacuucauggaaagaaa

SEQ ID NO: 32683 - RNA, 19 nt, Homo sapiens
gaauugcucuugucauacc

SEQ ID NO: 32684 - RNA, 19 nt, Homo sapiens
caucuggauuuaggaauug

SEQ ID NO: 32685 - RNA, 19 nt, Homo sapiens
caagacugcccuuagaaau

SEQ ID NO: 32686 - RNA, 19 nt, Homo sapiens
gcugaagagccaacauauu

SEQ ID NO: 32687 - RNA, 19 nt, Homo sapiens
gaugagaucaagaaugaca

SEQ ID NO: 32688 - RNA, 19 nt, Homo sapiens
gcuggagucaugacacuaa

SEQ ID NO: 32689 - RNA, 19 nt, Homo sapiens
guucaauaaugucccaugu

SEQ ID NO: 32690 - RNA, 19 nt, Homo sapiens
ccgaaaauguucaauaaug

SEQ ID NO: 32691 - RNA, 19 nt, Homo sapiens
ugaacaggcaggccacuuu

SEQ ID NO: 32692 - RNA, 19 nt, Homo sapiens
gcuaugaccuuuugcugaa

SEQ ID NO: 32693 - RNA, 19 nt, Homo sapiens
cccacucuaugaaucaaua

SEQ ID NO: 32694 - RNA, 19 nt, Homo sapiens
aaagcuuggucuagaguga

SEQ ID NO: 32695 - RNA, 19 nt, Homo sapiens
cguaugacacauugauuaa

SEQ ID NO: 32696 - RNA, 19 nt, Homo sapiens
ucgaaagaauggugucaau

SEQ ID NO: 32697 - RNA, 19 nt, Homo sapiens
ugaaacaguggcaauaaau

SEQ ID NO: 32698 - RNA, 19 nt, Homo sapiens
agaaagcacagaaaggaaa

SEQ ID NO: 32699 - RNA, 19 nt, Homo sapiens
aaauggcagcuuauacaua

SEQ ID NO: 32700 - RNA, 19 nt, Homo sapiens
acaaauggcagcuuauaca

SEQ ID NO: 32701 - RNA, 19 nt, Homo sapiens
acaguuuauuggugucaua

SEQ ID NO: 32702 - RNA, 19 nt, Homo sapiens
gaaaugaaauccaaagcuu

SEQ ID NO: 32703 - RNA, 19 nt, Homo sapiens
ucaauaaugucccauguaa

SEQ ID NO: 32704 - RNA, 19 nt, Homo sapiens
gaaagaauggugucaauga

SEQ ID NO: 32705 - RNA, 19 nt, Homo sapiens
ccacuuugccucuaaauua

SEQ ID NO: 32706 - RNA, 19 nt, Homo sapiens
uagaugagaucaagaauga

SEQ ID NO: 32707 - RNA, 19 nt, Homo sapiens
gaaagaagcguaugacaca

SEQ ID NO: 32708 - RNA, 19 nt, Homo sapiens
gauacuaacugcucucaga

SEQ ID NO: 32709 - RNA, 19 nt, Homo sapiens
ucaugaaucuccaaccuua

SEQ ID NO: 32710 - RNA, 19 nt, Homo sapiens
gauguugacuugaguaaau

SEQ ID NO: 32711 - RNA, 19 nt, Homo sapiens
ucaaggacauuacuaguga

SEQ ID NO: 32712 - RNA, 19 nt, Homo sapiens
gaauugaggaagacuguua

SEQ ID NO: 32713 - RNA, 19 nt, Homo sapiens
cuuaauagcuggcuguaaa

SEQ ID NO: 32714 - RNA, 19 nt, Homo sapiens
gaaagaaagaagcguauga

SEQ ID NO: 32715 - RNA, 19 nt, Homo sapiens
guauuugagugcagaauuu

SEQ ID NO: 32716 - RNA, 19 nt, Homo sapiens
ggacauuacuagugacuca

SEQ ID NO: 32717 - RNA, 19 nt, Homo sapiens
ccaaguugcugaaucaaug

SEQ ID NO: 32718 - RNA, 19 nt, Homo sapiens
gacacuaagucaaguuaaa

SEQ ID NO: 32719 - RNA, 19 nt, Homo sapiens
ggaagcgguuuacgaguga

SEQ ID NO: 32720 - RNA, 19 nt, Homo sapiens
caaacuucaucaagaguaa

SEQ ID NO: 32721 - RNA, 19 nt, Homo sapiens
ggaaccaccuaaagaacuu

SEQ ID NO: 32722 - RNA, 19 nt, Homo sapiens
aggaauugcucuugucaua

SEQ ID NO: 32723 - RNA, 19 nt, Homo sapiens
gaacccauguuugcaauca

SEQ ID NO: 32724 - RNA, 19 nt, Homo sapiens
gaaacaguggcaauaaauu

SEQ ID NO: 32725 - RNA, 19 nt, Homo sapiens
gagaaaggaaguacagaaa

SEQ ID NO: 32726 - RNA, 19 nt, Homo sapiens
guuauaaacugaagcagau

SEQ ID NO: 32727 - RNA, 19 nt, Homo sapiens
agaagaagcuaugaccuuu

SEQ ID NO: 32728 - RNA, 19 nt, Homo sapiens
cugaagagccaacauauuu

SEQ ID NO: 32729 - RNA, 19 nt, Homo sapiens
ugcagaggaugaaagauua

SEQ ID NO: 32730 - RNA, 19 nt, Homo sapiens
gcagaaagcacagaaagga

SEQ ID NO: 32731 - RNA, 19 nt, Homo sapiens
gaggaagacuguuacuaca

SEQ ID NO: 32732 - RNA, 19 nt, Homo sapiens
gcaagacugcccuuagaaa

SEQ ID NO: 32733 - RNA, 19 nt, Homo sapiens
gcucuggcaucuaacauau

SEQ ID NO: 32734 - RNA, 19 nt, Homo sapiens
aaacaaacuucaucaagag

SEQ ID NO: 32735 - RNA, 19 nt, Homo sapiens
ggcaucaacuucauggaaa

SEQ ID NO: 32736 - RNA, 19 nt, Homo sapiens
caugcuaaguacccaaaua

SEQ ID NO: 32737 - RNA, 19 nt, Homo sapiens
aaagaauggugucaaugaa

SEQ ID NO: 32738 - RNA, 19 nt, Homo sapiens
ggauuggaauugaggaaga

SEQ ID NO: 32739 - RNA, 19 nt, Homo sapiens
gcguaugacacauugauua

SEQ ID NO: 32740 - RNA, 19 nt, Homo sapiens
ugacugacaucaacuccaa

SEQ ID NO: 32741 - RNA, 19 nt, Homo sapiens
gaaauucuagccugguuug

SEQ ID NO: 32742 - RNA, 19 nt, Homo sapiens
uggaaggccugcaucauga

SEQ ID NO: 32743 - RNA, 19 nt, Homo sapiens
uuacuacuauccuacguuu

SEQ ID NO: 32744 - RNA, 19 nt, Homo sapiens
aaauaaggcucuaccucaa

SEQ ID NO: 32745 - RNA, 19 nt, Homo sapiens
gaacaggcaggccacuuug

SEQ ID NO: 32746 - RNA, 19 nt, Homo sapiens
uguaaauacugcuugguuu

SEQ ID NO: 32747 - RNA, 19 nt, Homo sapiens
gaggauugcucaacaacca

SEQ ID NO: 32748 - RNA, 19 nt, Homo sapiens
gaagagccaacauauuugu

SEQ ID NO: 32749 - RNA, 19 nt, Homo sapiens
agacacagcagaacagaaa

SEQ ID NO: 32750 - RNA, 19 nt, Homo sapiens
gccaacauauuuguagauu

SEQ ID NO: 32751 - RNA, 19 nt, Homo sapiens
gccaaucuuuguacucuug

SEQ ID NO: 32752 - RNA, 19 nt, Homo sapiens
ccaagguucucaugaaucu

SEQ ID NO: 32753 - RNA, 19 nt, Homo sapiens
gagccaacauauuuguaga

SEQ ID NO: 32754 - RNA, 19 nt, Homo sapiens
gugcagaauuuaaauaagg

SEQ ID NO: 32755 - RNA, 19 nt, Homo sapiens
gcaguggcaugcuaaguac

SEQ ID NO: 32756 - RNA, 19 nt, Homo sapiens
ucucugaucucgcgcaaga

SEQ ID NO: 32757 - RNA, 19 nt, Homo sapiens
guaauuggcaucaacuuca

SEQ ID NO: 32758 - RNA, 19 nt, Homo sapiens
ccaagugacugacaucaac

SEQ ID NO: 32759 - RNA, 19 nt, Homo sapiens
uuacgucuguugcuagauu

SEQ ID NO: 32760 - RNA, 19 nt, Homo sapiens
agacugcccuuagaaauuc

SEQ ID NO: 32761 - RNA, 19 nt, Homo sapiens
guuuauaacucugagaaga

SEQ ID NO: 32762 - RNA, 19 nt, Homo sapiens
gcgcugaagagccaacaua

SEQ ID NO: 32763 - RNA, 19 nt, Homo sapiens
guucaacugcuucguaauu

SEQ ID NO: 32764 - RNA, 19 nt, Homo sapiens
aauggcagcuuauacauag

SEQ ID NO: 32765 - RNA, 19 nt, Homo sapiens
guaugaauguaaucagugu

SEQ ID NO: 32766 - RNA, 19 nt, Homo sapiens
gaagagaaaggaaguacag

SEQ ID NO: 32767 - RNA, 19 nt, Homo sapiens
cugaaacaguggcaauaaa

SEQ ID NO: 32768 - RNA, 19 nt, Homo sapiens
caaaauagaugagaucaag

SEQ ID NO: 32769 - RNA, 19 nt, Homo sapiens
ucaucuggauuuaggaauu

SEQ ID NO: 32770 - RNA, 19 nt, Homo sapiens
gcucaaaacuaccuacuuc

SEQ ID NO: 32771 - RNA, 19 nt, Homo sapiens
gaauguaaucaguguaugu

SEQ ID NO: 32772 - RNA, 19 nt, Homo sapiens
gcuaaguacccaaauagga

SEQ ID NO: 32773 - RNA, 19 nt, Homo sapiens
guucuuacgucuguugcua

SEQ ID NO: 32774 - RNA, 19 nt, Homo sapiens
aagauucuccuuacuacua

SEQ ID NO: 32775 - RNA, 19 nt, Homo sapiens
cuacaaauggcagcuuaua

SEQ ID NO: 32776 - RNA, 19 nt, Homo sapiens
ucuggcaucuaacauauga

SEQ ID NO: 32777 - RNA, 19 nt, Homo sapiens
gcagaggaugaaagauuaa

SEQ ID NO: 32778 - RNA, 19 nt, Homo sapiens
gaaaggaaguacagaaaac

SEQ ID NO: 32779 - RNA, 19 nt, Homo sapiens
agaagcguaugacacauug

SEQ ID NO: 32780 - RNA, 19 nt, Homo sapiens
ucaacuucauggaaagaaa

SEQ ID NO: 32781 - RNA, 19 nt, Homo sapiens
gaauugcucuugucauacc

SEQ ID NO: 32782 - RNA, 19 nt, Homo sapiens
caucuggauuuaggaauug

SEQ ID NO: 32783 - RNA, 19 nt, Homo sapiens
caagacugcccuuagaaau

SEQ ID NO: 32784 - RNA, 19 nt, Homo sapiens
gcugaagagccaacauauu

SEQ ID NO: 32785 - RNA, 19 nt, Homo sapiens
gaugagaucaagaaugaca

SEQ ID NO: 32786 - RNA, 19 nt, Homo sapiens
gcuggagucaugacacuaa

SEQ ID NO: 32787 - RNA, 19 nt, Homo sapiens
guucaauaaugucccaugu

SEQ ID NO: 32788 - RNA, 19 nt, Homo sapiens
ccgaaaauguucaauaaug

SEQ ID NO: 32789 - RNA, 19 nt, Homo sapiens
ugaacaggcaggccacuuu

SEQ ID NO: 32790 - RNA, 19 nt, Homo sapiens
gcuaugaccuuuugcugaa

SEQ ID NO: 32791 - RNA, 19 nt, Homo sapiens
cccacucuaugaaucaaua

SEQ ID NO: 32792 - RNA, 19 nt, Homo sapiens
aaagcuuggucuagaguga

SEQ ID NO: 32793 - RNA, 19 nt, Homo sapiens
cguaugacacauugauuaa

SEQ ID NO: 32794 - RNA, 19 nt, Homo sapiens
ucgaaagaauggugucaau

SEQ ID NO: 32795 - RNA, 19 nt, Homo sapiens
ugaaacaguggcaauaaau

SEQ ID NO: 32796 - RNA, 19 nt, Homo sapiens
agaaagcacagaaaggaaa

SEQ ID NO: 32797 - RNA, 19 nt, Homo sapiens
aaauggcagcuuauacaua

SEQ ID NO: 32798 - RNA, 19 nt, Homo sapiens
acaaauggcagcuuauaca

SEQ ID NO: 32799 - RNA, 19 nt, Homo sapiens
acaguuuauuggugucaua

SEQ ID NO: 32800 - RNA, 19 nt, Homo sapiens
aaccuuaaauccugaaaca

SEQ ID NO: 32801 - RNA, 19 nt, Homo sapiens
gaacuuggaaggccugcau

SEQ ID NO: 32802 - RNA, 19 nt, Homo sapiens
gaagacaccuauggaauug

SEQ ID NO: 32803 - RNA, 19 nt, Homo sapiens
gaaaguggcccauuuaaca

SEQ ID NO: 32804 - RNA, 19 nt, Homo sapiens
ggacucauuucauuccuaa

SEQ ID NO: 32805 - RNA, 19 nt, Homo sapiens
ccagacaaauggaggaaua

SEQ ID NO: 32806 - RNA, 19 nt, Homo sapiens
caacucaccuaauguuuau

SEQ ID NO: 32807 - RNA, 19 nt, Homo sapiens
acuagaggcuugcauaaua

SEQ ID NO: 32808 - RNA, 19 nt, Homo sapiens
ggaggaauaugacggaaga

SEQ ID NO: 32809 - RNA, 19 nt, Homo sapiens
uaccagugcugaucauuua

SEQ ID NO: 32810 - RNA, 19 nt, Homo sapiens
ggaagacaccuauggaauu

SEQ ID NO: 32811 - RNA, 19 nt, Homo sapiens
gcacacagcaucaucuuug

SEQ ID NO: 32812 - RNA, 19 nt, Homo sapiens
aaacugggcuguacuuugu

SEQ ID NO: 32813 - RNA, 19 nt, Homo sapiens
gaauguagauauugugaag

SEQ ID NO: 32814 - RNA, 19 nt, Homo sapiens
guugugaccugaggauuua

SEQ ID NO: 32815 - RNA, 19 nt, Homo sapiens
gaggaaaguggcccauuua

SEQ ID NO: 32816 - RNA, 19 nt, Homo sapiens
gagagaauguagauauugu

SEQ ID NO: 32817 - RNA, 19 nt, Homo sapiens
gagaagcacuuugggauuc

SEQ ID NO: 32818 - RNA, 19 nt, Homo sapiens
gaaacuaacagauaagcaa

SEQ ID NO: 32819 - RNA, 19 nt, Homo sapiens
gggauucuuuccauuauga

SEQ ID NO: 32820 - RNA, 19 nt, Homo sapiens
ugaggaaaguggcccauuu

SEQ ID NO: 32821 - RNA, 19 nt, Homo sapiens
acaaucaacucuaauagug

SEQ ID NO: 32822 - RNA, 19 nt, Homo sapiens
cuagaggcuugcauaauaa

SEQ ID NO: 32823 - RNA, 19 nt, Homo sapiens
caacguaucugagcucucu

SEQ ID NO: 32824 - RNA, 19 nt, Homo sapiens
gaaacugggcuguacuuug

SEQ ID NO: 32825 - RNA, 19 nt, Homo sapiens
ggcagcaucuucacuucua

SEQ ID NO: 32826 - RNA, 19 nt, Homo sapiens
ucaacucaccuaauguuua

SEQ ID NO: 32827 - RNA, 19 nt, Homo sapiens
gcaccgagaauguuguauu

SEQ ID NO: 32828 - RNA, 19 nt, Homo sapiens
gcaacagggucccguccuu

SEQ ID NO: 32829 - RNA, 19 nt, Homo sapiens
caucuucacuucuaaaugc

SEQ ID NO: 32830 - RNA, 19 nt, Homo sapiens
gugagggucuucuuacaug

SEQ ID NO: 32831 - RNA, 19 nt, Homo sapiens
gcugaucauuuauauguca

SEQ ID NO: 32832 - RNA, 19 nt, Homo sapiens
ugcagcagcccuucaauua

SEQ ID NO: 32833 - RNA, 19 nt, Homo sapiens
cggugaaacuaacagauaa

SEQ ID NO: 32834 - RNA, 19 nt, Homo sapiens
agaaggagcuggcagaacu

SEQ ID NO: 32835 - RNA, 19 nt, Homo sapiens
ggacugagaagaaguaaaa

SEQ ID NO: 32836 - RNA, 19 nt, Homo sapiens
gagaguauuuaggcagauu

SEQ ID NO: 32837 - RNA, 19 nt, Homo sapiens
gagaauguagauauuguga

SEQ ID NO: 32838 - RNA, 19 nt, Homo sapiens
gcagcaucuucacuucuaa

SEQ ID NO: 32839 - RNA, 19 nt, Homo sapiens
gggcuguacuuuguauauu

SEQ ID NO: 32840 - RNA, 19 nt, Homo sapiens
uuucuggagugaaguauaa

SEQ ID NO: 32841 - RNA, 19 nt, Homo sapiens
ggaauuguccugcuuucug

SEQ ID NO: 32842 - RNA, 19 nt, Homo sapiens
ggaaugggaagacaccuau

SEQ ID NO: 32843 - RNA, 19 nt, Homo sapiens
cagaaggccuggucaaagg

SEQ ID NO: 32844 - RNA, 19 nt, Homo sapiens
gcccuucaauuacccauau

SEQ ID NO: 32845 - RNA, 19 nt, Homo sapiens
caacucuaauagugcuuaa

SEQ ID NO: 32846 - RNA, 19 nt, Homo sapiens
guauuuaggcagauugaaa

SEQ ID NO: 32847 - RNA, 19 nt, Homo sapiens
guucuacacucaucuuagu

SEQ ID NO: 32848 - RNA, 19 nt, Homo sapiens
gaauaugacggaagaacau

SEQ ID NO: 32849 - RNA, 19 nt, Homo sapiens
gacaaauggaggaauauga

SEQ ID NO: 32850 - RNA, 19 nt, Homo sapiens
acucugggcugccauguga

SEQ ID NO: 32851 - RNA, 19 nt, Homo sapiens
aagaagacaugaaccaagu

SEQ ID NO: 32852 - RNA, 19 nt, Homo sapiens
gugcugaucauuuauaugu

SEQ ID NO: 32853 - RNA, 19 nt, Homo sapiens
ggaagaugaugagcuacug

SEQ ID NO: 32854 - RNA, 19 nt, Homo sapiens
gcagcuaccagguguucua

SEQ ID NO: 32855 - RNA, 19 nt, Homo sapiens
gauugucagcuacuaauga

SEQ ID NO: 32856 - RNA, 19 nt, Homo sapiens
ggacugucuuucagauaca

SEQ ID NO: 32857 - RNA, 19 nt, Homo sapiens
gggacugucuuucagauac

SEQ ID NO: 32858 - RNA, 19 nt, Homo sapiens
ggaauaugacggaagaaca

SEQ ID NO: 32859 - RNA, 19 nt, Homo sapiens
caaugaaacugggcuguac

SEQ ID NO: 32860 - RNA, 19 nt, Homo sapiens
ccagugcugaucauuuaua

SEQ ID NO: 32861 - RNA, 19 nt, Homo sapiens
gggaagacaccuauggaau

SEQ ID NO: 32862 - RNA, 19 nt, Homo sapiens
gggacucauuucauuccua

SEQ ID NO: 32863 - RNA, 19 nt, Homo sapiens
cagauaagcaagagagaug

SEQ ID NO: 32864 - RNA, 19 nt, Homo sapiens
augaugagcuacugcacua

SEQ ID NO: 32865 - RNA, 19 nt, Homo sapiens
cuaaagagagaauguagau

SEQ ID NO: 32866 - RNA, 19 nt, Homo sapiens
guguaugacuaaagagaga

SEQ ID NO: 32867 - RNA, 19 nt, Homo sapiens
gguugugaccugaggauuu

SEQ ID NO: 32868 - RNA, 19 nt, Homo sapiens
cuacaggacugagaagaag

SEQ ID NO: 32869 - RNA, 19 nt, Homo sapiens
caucaucuuuggagaagca

SEQ ID NO: 32870 - RNA, 19 nt, Homo sapiens
gaaugcuuccugacaauca

SEQ ID NO: 32871 - RNA, 19 nt, Homo sapiens
ggaaaguggcccauuuaac

SEQ ID NO: 32872 - RNA, 19 nt, Homo sapiens
gacaaucaacucuaauagu

SEQ ID NO: 32873 - RNA, 19 nt, Homo sapiens
ugaagagggagaagcauga

SEQ ID NO: 32874 - RNA, 19 nt, Homo sapiens
ggcuguacuuuguauauuc

SEQ ID NO: 32875 - RNA, 19 nt, Homo sapiens
guguguguaugacuaaaga

SEQ ID NO: 32876 - RNA, 19 nt, Homo sapiens
gauaagcaagagagauguu

SEQ ID NO: 32877 - RNA, 19 nt, Homo sapiens
ucggugaaacuaacagaua

SEQ ID NO: 32878 - RNA, 19 nt, Homo sapiens
gaagagggagaagcaugaa

SEQ ID NO: 32879 - RNA, 19 nt, Homo sapiens
ugacuaaagagagaaugua

SEQ ID NO: 32880 - RNA, 19 nt, Homo sapiens
guaagaagacaugaaccaa

SEQ ID NO: 32881 - RNA, 19 nt, Homo sapiens
caaguaagaagacaugaac

SEQ ID NO: 32882 - RNA, 19 nt, Homo sapiens
ggucaaguaagaagacaug

SEQ ID NO: 32883 - RNA, 19 nt, Homo sapiens
caugaggaacucuaaguau

SEQ ID NO: 32884 - RNA, 19 nt, Homo sapiens
aaaaggagcugaggaaagu

SEQ ID NO: 32885 - RNA, 19 nt, Homo sapiens
ggucuucuuacaugcauuu

SEQ ID NO: 32886 - RNA, 19 nt, Homo sapiens
cuauggaaacucuauaaga

SEQ ID NO: 32887 - RNA, 19 nt, Homo sapiens
cagcuugccuccucuugag

SEQ ID NO: 32888 - RNA, 19 nt, Homo sapiens
cuucacuucuaaaugcaua

SEQ ID NO: 32889 - RNA, 19 nt, Homo sapiens
cuccucaacucaccuaaug

SEQ ID NO: 32890 - RNA, 19 nt, Homo sapiens
agacuagaggcuugcauaa

SEQ ID NO: 32891 - RNA, 19 nt, Homo sapiens
uuuaugagccagacaaaug

SEQ ID NO: 32892 - RNA, 19 nt, Homo sapiens
gguucugguugccuuggua

SEQ ID NO: 32893 - RNA, 19 nt, Homo sapiens
gaagcacuuugggauucuu

SEQ ID NO: 32894 - RNA, 19 nt, Homo sapiens
cagugcugaucauuuauau

SEQ ID NO: 32895 - RNA, 19 nt, Homo sapiens
ucaaugaaacugggcugua

SEQ ID NO: 32896 - RNA, 19 nt, Homo sapiens
cugacaaucaacucuaaua

SEQ ID NO: 32897 - RNA, 19 nt, Homo sapiens
gggcaguguucaaucuuac

SEQ ID NO: 32898 - RNA, 19 nt, Homo sapiens
gccacaaggucuacaugag

SEQ ID NO: 32899 - RNA, 19 nt, Homo sapiens
gugaaguacauauuaggaa

SEQ ID NO: 32900 - RNA, 19 nt, Homo sapiens
guguguguguguaugacua

SEQ ID NO: 32901 - RNA, 19 nt, Homo sapiens
gcagcagcccuucaauuac

SEQ ID NO: 32902 - RNA, 19 nt, Homo sapiens
gcaaauagcuuuaguccuu

SEQ ID NO: 32903 - RNA, 19 nt, Homo sapiens
gaaauaacgugcaugcuuu

SEQ ID NO: 32904 - RNA, 19 nt, Homo sapiens
gcaaagaggcuguuauaaa

SEQ ID NO: 32905 - RNA, 19 nt, Homo sapiens
gcaggaagcuucugucgaa

SEQ ID NO: 32906 - RNA, 19 nt, Homo sapiens
cagauuaaauugccacuua

SEQ ID NO: 32907 - RNA, 19 nt, Homo sapiens
gaagcuggcugugcacuua

SEQ ID NO: 32908 - RNA, 19 nt, Homo sapiens
ccaaggagcucaaggagaa

SEQ ID NO: 32909 - RNA, 19 nt, Homo sapiens
agaaugcccucaauaauuu

SEQ ID NO: 32910 - RNA, 19 nt, Homo sapiens
ggauaaaugucuuuccaaa

SEQ ID NO: 32911 - RNA, 19 nt, Homo sapiens
gagaaugcccucaauaauu

SEQ ID NO: 32912 - RNA, 19 nt, Homo sapiens
caaagaggcuguuauaaaa

SEQ ID NO: 32913 - RNA, 19 nt, Homo sapiens
ggaaugagauccagaugca

SEQ ID NO: 32914 - RNA, 19 nt, Homo sapiens
caacauccauaacucugua

SEQ ID NO: 32915 - RNA, 19 nt, Homo sapiens
aagagagccugguuuguua

SEQ ID NO: 32916 - RNA, 19 nt, Homo sapiens
gguaaugcauucucuauag

SEQ ID NO: 32917 - RNA, 19 nt, Homo sapiens
gccgauggcuugguuauaa

SEQ ID NO: 32918 - RNA, 19 nt, Homo sapiens
ugaaauggcaggauucuaa

SEQ ID NO: 32919 - RNA, 19 nt, Homo sapiens
gccaugaaguuuaaagauu

SEQ ID NO: 32920 - RNA, 19 nt, Homo sapiens
gaauagacacuucaccaaa

SEQ ID NO: 32921 - RNA, 19 nt, Homo sapiens
gaaccuacagcgcaccuua

SEQ ID NO: 32922 - RNA, 19 nt, Homo sapiens
ccaaggaauuucagaguau

SEQ ID NO: 32923 - RNA, 19 nt, Homo sapiens
gagccaagcugcagaagag

SEQ ID NO: 32924 - RNA, 19 nt, Homo sapiens
guuaagagcguguccagua

SEQ ID NO: 32925 - RNA, 19 nt, Homo sapiens
gcaccaagcaggcaaauag

SEQ ID NO: 32926 - RNA, 19 nt, Homo sapiens
gugaauaguuuccuaaugg

SEQ ID NO: 32927 - RNA, 19 nt, Homo sapiens
ggcaaucacugcuugagaa

SEQ ID NO: 32928 - RNA, 19 nt, Homo sapiens
gagcacaucugagcaguuc

SEQ ID NO: 32929 - RNA, 19 nt, Homo sapiens
guucacagcugagcagaaa

SEQ ID NO: 32930 - RNA, 19 nt, Homo sapiens
cagcaaauguguguagauu

SEQ ID NO: 32931 - RNA, 19 nt, Homo sapiens
acaaacagcccaagugaaa

SEQ ID NO: 32932 - RNA, 19 nt, Homo sapiens
caucuucucuugucauuca

SEQ ID NO: 32933 - RNA, 19 nt, Homo sapiens
uagcaaagaggcuguuaua

SEQ ID NO: 32934 - RNA, 19 nt, Homo sapiens
gaaacgagcaaaccuguuc

SEQ ID NO: 32935 - RNA, 19 nt, Homo sapiens
gcucgacacuuaccacuca

SEQ ID NO: 32936 - RNA, 19 nt, Homo sapiens
guaaugcauucucuauaga

SEQ ID NO: 32937 - RNA, 19 nt, Homo sapiens
ugugugggaugauuuauuu

SEQ ID NO: 32938 - RNA, 19 nt, Homo sapiens
gcacagaggagaggaaaga

SEQ ID NO: 32939 - RNA, 19 nt, Homo sapiens
gcagagcuuuuaccuguua

SEQ ID NO: 32940 - RNA, 19 nt, Homo sapiens
gagcauuugucucuguuau

SEQ ID NO: 32941 - RNA, 19 nt, Homo sapiens
ccacucaccuaucaacaga

SEQ ID NO: 32942 - RNA, 19 nt, Homo sapiens
caaagauucuagugaguca

SEQ ID NO: 32943 - RNA, 19 nt, Homo sapiens
gaaauggcaggauucuaaa

SEQ ID NO: 32944 - RNA, 19 nt, Homo sapiens
cgugauaauuggcuacuuu

SEQ ID NO: 32945 - RNA, 19 nt, Homo sapiens
guaguaaugugcuuguuag

SEQ ID NO: 32946 - RNA, 19 nt, Homo sapiens
ggagaaugcccucaauaau

SEQ ID NO: 32947 - RNA, 19 nt, Homo sapiens
ccaugaaguuuaaagauuc

SEQ ID NO: 32948 - RNA, 19 nt, Homo sapiens
gcucagcccugcucuccaa

SEQ ID NO: 32949 - RNA, 19 nt, Homo sapiens
gaugugcgcuucccucagu

SEQ ID NO: 32950 - RNA, 19 nt, Homo sapiens
aggagaagcucaguuguuu

SEQ ID NO: 32951 - RNA, 19 nt, Homo sapiens
gaccacaccuuguccaaag

SEQ ID NO: 32952 - RNA, 19 nt, Homo sapiens
uaaauagugucucuucaag

SEQ ID NO: 32953 - RNA, 19 nt, Homo sapiens
ggagacgacccaaggaauu

SEQ ID NO: 32954 - RNA, 19 nt, Homo sapiens
caaaccggauaguaagaaa

SEQ ID NO: 32955 - RNA, 19 nt, Homo sapiens
gaugaggauucaaccagaa

SEQ ID NO: 32956 - RNA, 19 nt, Homo sapiens
gagaaagaccagaucaaga

SEQ ID NO: 32957 - RNA, 19 nt, Homo sapiens
gaauugagcgggugaugga

SEQ ID NO: 32958 - RNA, 19 nt, Homo sapiens
ccagcgaguuugacaaguu

SEQ ID NO: 32959 - RNA, 19 nt, Homo sapiens
gcacaucugagcaguucua

SEQ ID NO: 32960 - RNA, 19 nt, Homo sapiens
gaaaaucaaucuggugcua

SEQ ID NO: 32961 - RNA, 19 nt, Homo sapiens
aaacaaacagcccaaguga

SEQ ID NO: 32962 - RNA, 19 nt, Homo sapiens
ggugaauaguuuccuaaug

SEQ ID NO: 32963 - RNA, 19 nt, Homo sapiens
acacacagaugucuuaaaa

SEQ ID NO: 32964 - RNA, 19 nt, Homo sapiens
gcauguuaauggugaguga

SEQ ID NO: 32965 - RNA, 19 nt, Homo sapiens
gcugucaguucccaauuga

SEQ ID NO: 32966 - RNA, 19 nt, Homo sapiens
cagcagaaaucaucaucau

SEQ ID NO: 32967 - RNA, 19 nt, Homo sapiens
cgaguauccuuguagcaaa

SEQ ID NO: 32968 - RNA, 19 nt, Homo sapiens
caaggaauuucagaguauu

SEQ ID NO: 32969 - RNA, 19 nt, Homo sapiens
caucacaguuguucugcaa

SEQ ID NO: 32970 - RNA, 19 nt, Homo sapiens
cagcugagcagaaauugaa

SEQ ID NO: 32971 - RNA, 19 nt, Homo sapiens
gaggagaagcucaguuguu

SEQ ID NO: 32972 - RNA, 19 nt, Homo sapiens
aauagugucucuucaagug

SEQ ID NO: 32973 - RNA, 19 nt, Homo sapiens
cccaaggaauuucagagua

SEQ ID NO: 32974 - RNA, 19 nt, Homo sapiens
aaagagagccugguuuguu

SEQ ID NO: 32975 - RNA, 19 nt, Homo sapiens
gcauuugucucuguuaucu

SEQ ID NO: 32976 - RNA, 19 nt, Homo sapiens
ggaagcuucugucgaacug

SEQ ID NO: 32977 - RNA, 19 nt, Homo sapiens
ucugguauguucccgauaa

SEQ ID NO: 32978 - RNA, 19 nt, Homo sapiens
gcacagaugcacacacaca

SEQ ID NO: 32979 - RNA, 19 nt, Homo sapiens
gcaaaagacuugaauagac

SEQ ID NO: 32980 - RNA, 19 nt, Homo sapiens
uaacgugcaugcuuuaaaa

SEQ ID NO: 32981 - RNA, 19 nt, Homo sapiens
gugguuggguucacucauu

SEQ ID NO: 32982 - RNA, 19 nt, Homo sapiens
gugaagagcagcugaagug

SEQ ID NO: 32983 - RNA, 19 nt, Homo sapiens
gaagucggcccucaucauc

SEQ ID NO: 32984 - RNA, 19 nt, Homo sapiens
ggagauacagggccacaga

SEQ ID NO: 32985 - RNA, 19 nt, Homo sapiens
gaacccuaccucgagauua

SEQ ID NO: 32986 - RNA, 19 nt, Homo sapiens
gagacgacccaaggaauuu

SEQ ID NO: 32987 - RNA, 19 nt, Homo sapiens
aaauuaagcucuugcuaac

SEQ ID NO: 32988 - RNA, 19 nt, Homo sapiens
gcucaaugaugcaggcaau

SEQ ID NO: 32989 - RNA, 19 nt, Homo sapiens
guacaaagaacucucaaac

SEQ ID NO: 32990 - RNA, 19 nt, Homo sapiens
uuggaagggugaauaguuu

SEQ ID NO: 32991 - RNA, 19 nt, Homo sapiens
agcgggagcuggaagauaa

SEQ ID NO: 32992 - RNA, 19 nt, Homo sapiens
gcgcaucgucuuugacauu

SEQ ID NO: 32993 - RNA, 19 nt, Homo sapiens
ggacaucugaggauacugu

SEQ ID NO: 32994 - RNA, 19 nt, Homo sapiens
cuauaaagaccaccugaaa

SEQ ID NO: 32995 - RNA, 19 nt, Homo sapiens
ccaccacccugcggaauga

SEQ ID NO: 32996 - RNA, 19 nt, Homo sapiens
ccucugaaacgucugguua

SEQ ID NO: 32997 - RNA, 19 nt, Homo sapiens
gaccacagccuuaccaaag

SEQ ID NO: 32998 - RNA, 19 nt, Homo sapiens
ccaguggaauggagauuuc

SEQ ID NO: 32999 - RNA, 19 nt, Homo sapiens
gcaaaucguguaucugaca

SEQ ID NO: 33000 - RNA, 19 nt, Homo sapiens
ugauugaaauggcaggauu

SEQ ID NO: 33001 - RNA, 19 nt, Homo sapiens
caguuguucugcaaaguaa

SEQ ID NO: 33002 - RNA, 19 nt, Homo sapiens
ggaccaagauuuaccaauu

SEQ ID NO: 33003 - RNA, 19 nt, Homo sapiens
gcauauaugucucuuugga

SEQ ID NO: 33004 - RNA, 19 nt, Homo sapiens
gaaagggacccaccugcua

SEQ ID NO: 33005 - RNA, 19 nt, Homo sapiens
gcaagugccugggauucua

SEQ ID NO: 33006 - RNA, 19 nt, Homo sapiens
gggcugcucuuuccacuug

SEQ ID NO: 33007 - RNA, 19 nt, Homo sapiens
ccacacgccucugcauaua

SEQ ID NO: 33008 - RNA, 19 nt, Homo sapiens
guaauugcuuugugccuuu

SEQ ID NO: 33009 - RNA, 19 nt, Homo sapiens
gaccaagauuuaccaauuc

SEQ ID NO: 33010 - RNA, 19 nt, Homo sapiens
ggaguuggaauuucauuau

SEQ ID NO: 33011 - RNA, 19 nt, Homo sapiens
gagaugaagcccaaauaga

SEQ ID NO: 33012 - RNA, 19 nt, Homo sapiens
ccagcgaguucaagaagaa

SEQ ID NO: 33013 - RNA, 19 nt, Homo sapiens
ggacaccuccuggcuauug

SEQ ID NO: 33014 - RNA, 19 nt, Homo sapiens
gaugggaggugugccagaa

SEQ ID NO: 33015 - RNA, 19 nt, Homo sapiens
cugcauauaugucucuuug

SEQ ID NO: 33016 - RNA, 19 nt, Homo sapiens
ggaggaguaugaccuggau

SEQ ID NO: 33017 - RNA, 19 nt, Homo sapiens
ccacgacccucuuugucuu

SEQ ID NO: 33018 - RNA, 19 nt, Homo sapiens
agaugaagcccaaauagaa

SEQ ID NO: 33019 - RNA, 19 nt, Homo sapiens
uacacuggcugugggauua

SEQ ID NO: 33020 - RNA, 19 nt, Homo sapiens
ggagaugaagcccaaauag

SEQ ID NO: 33021 - RNA, 19 nt, Homo sapiens
gcaccuugcucccaauggu

SEQ ID NO: 33022 - RNA, 19 nt, Homo sapiens
ggugaaauccauacuguag

SEQ ID NO: 33023 - RNA, 19 nt, Homo sapiens
gaccagggcugcucuuucc

SEQ ID NO: 33024 - RNA, 19 nt, Homo sapiens
aagcuuugcuccuucaguu

SEQ ID NO: 33025 - RNA, 19 nt, Homo sapiens
cgacucaccugcgcaagug

SEQ ID NO: 33026 - RNA, 19 nt, Homo sapiens
gaacucgcuuggccgcaau

SEQ ID NO: 33027 - RNA, 19 nt, Homo sapiens
acacgccucugcauauaug

SEQ ID NO: 33028 - RNA, 19 nt, Homo sapiens
guacucaucuacgacuuca

SEQ ID NO: 33029 - RNA, 19 nt, Homo sapiens
cagcauggguccagaagac

SEQ ID NO: 33030 - RNA, 19 nt, Homo sapiens
uggaggaggugaaagaaag

SEQ ID NO: 33031 - RNA, 19 nt, Homo sapiens
cugacaagcuggccaaagu

SEQ ID NO: 33032 - RNA, 19 nt, Homo sapiens
caucuuccgugcccucaug

SEQ ID NO: 33033 - RNA, 19 nt, Homo sapiens
cugcucagcugccagauca

SEQ ID NO: 33034 - RNA, 19 nt, Homo sapiens
ccacuugcccuguguucuu

SEQ ID NO: 33035 - RNA, 19 nt, Homo sapiens
guuucuaucucuuucuuuc

SEQ ID NO: 33036 - RNA, 19 nt, Homo sapiens
cagcauggccagcgaguuc

SEQ ID NO: 33037 - RNA, 19 nt, Homo sapiens
ugaaauccauacuguagac

SEQ ID NO: 33038 - RNA, 19 nt, Homo sapiens
gaugaagcccaaauagaag

SEQ ID NO: 33039 - RNA, 19 nt, Homo sapiens
ggugaucacacacaacuuc

SEQ ID NO: 33040 - RNA, 19 nt, Homo sapiens
ggacuuacugccugaccuu

SEQ ID NO: 33041 - RNA, 19 nt, Homo sapiens
gcuccgcggugaucacaca

SEQ ID NO: 33042 - RNA, 19 nt, Homo sapiens
uaacccugcucgguccuuu

SEQ ID NO: 33043 - RNA, 19 nt, Homo sapiens
gacaccuccuggcuauuga

SEQ ID NO: 33044 - RNA, 19 nt, Homo sapiens
gccagcgaguucaagaaga

SEQ ID NO: 33045 - RNA, 19 nt, Homo sapiens
gccacacgccucugcauau

SEQ ID NO: 33046 - RNA, 19 nt, Homo sapiens
ggaaucgucccuauaucag

SEQ ID NO: 33047 - RNA, 19 nt, Homo sapiens
cacuugcccuguguucuuu

SEQ ID NO: 33048 - RNA, 19 nt, Homo sapiens
uggaaucgucccuauauca

SEQ ID NO: 33049 - RNA, 19 nt, Homo sapiens
gacaagcuggccaaaguca

SEQ ID NO: 33050 - RNA, 19 nt, Homo sapiens
gggccugagugaccuccuu

SEQ ID NO: 33051 - RNA, 19 nt, Homo sapiens
ccacucccuugaaguugug

SEQ ID NO: 33052 - RNA, 19 nt, Homo sapiens
gauucuaccguaauugcuu

SEQ ID NO: 33053 - RNA, 19 nt, Homo sapiens
uggagaugaagcccaaaua

SEQ ID NO: 33054 - RNA, 19 nt, Homo sapiens
ucacacacaacuucagcaa

SEQ ID NO: 33055 - RNA, 19 nt, Homo sapiens
cuuggaaucgucccuauau

SEQ ID NO: 33056 - RNA, 19 nt, Homo sapiens
gacccucuuugucuucauc

SEQ ID NO: 33057 - RNA, 19 nt, Homo sapiens
guguuucuaucucuuucuu

SEQ ID NO: 33058 - RNA, 19 nt, Homo sapiens
ccuccuggcuauugacuac

SEQ ID NO: 33059 - RNA, 19 nt, Homo sapiens
uuggacaccuccuggcuau

SEQ ID NO: 33060 - RNA, 19 nt, Homo sapiens
auaugucucuuuggaguug

SEQ ID NO: 33061 - RNA, 19 nt, Homo sapiens
ggcaggcccuccuucuuuu

SEQ ID NO: 33062 - RNA, 19 nt, Homo sapiens
gggugaaauccauacugua

SEQ ID NO: 33063 - RNA, 19 nt, Homo sapiens
uggcuguacucaucuacga

SEQ ID NO: 33064 - RNA, 19 nt, Homo sapiens
uggaguuggaauuucauua

SEQ ID NO: 33065 - RNA, 19 nt, Homo sapiens
cuuuggaguuggaauuuca

SEQ ID NO: 33066 - RNA, 19 nt, Homo sapiens
cugggauucuaccguaauu

SEQ ID NO: 33067 - RNA, 19 nt, Homo sapiens
gccauccucucaggcauca

SEQ ID NO: 33068 - RNA, 19 nt, Homo sapiens
ccgcggugaucacacacaa

SEQ ID NO: 33069 - RNA, 19 nt, Homo sapiens
uaauugcuuugugccuuug

SEQ ID NO: 33070 - RNA, 19 nt, Homo sapiens
guggaggaggugaaagaaa

SEQ ID NO: 33071 - RNA, 19 nt, Homo sapiens
ggggugaaauccauacugu

SEQ ID NO: 33072 - RNA, 19 nt, Homo sapiens
gccaucggccucucuguag

SEQ ID NO: 33073 - RNA, 19 nt, Homo sapiens
gccugggauucuaccguaa

SEQ ID NO: 33074 - RNA, 19 nt, Homo sapiens
cacccacucccuugaaguu

SEQ ID NO: 33075 - RNA, 19 nt, Homo sapiens
accaagauuuaccaauuca

SEQ ID NO: 33076 - RNA, 19 nt, Homo sapiens
gugaaauccauacuguaga

SEQ ID NO: 33077 - RNA, 19 nt, Homo sapiens
auucuaccguaauugcuuu

SEQ ID NO: 33078 - RNA, 19 nt, Homo sapiens
ggguguuucuaucucuuuc

SEQ ID NO: 33079 - RNA, 19 nt, Homo sapiens
gccagguggaggaguauga

SEQ ID NO: 33080 - RNA, 19 nt, Homo sapiens
gaacagguuugccuacguu

SEQ ID NO: 33081 - RNA, 19 nt, Homo sapiens
ugucgucacuggcaaauuu

SEQ ID NO: 33082 - RNA, 19 nt, Homo sapiens
ggaaugaugcaacugguuu

SEQ ID NO: 33083 - RNA, 19 nt, Homo sapiens
ggaggcaggugggugguaa

SEQ ID NO: 33084 - RNA, 19 nt, Homo sapiens
gcguuuggcuuggguauug

SEQ ID NO: 33085 - RNA, 19 nt, Homo sapiens
ggaccuggcugucaaugcu

SEQ ID NO: 33086 - RNA, 19 nt, Homo sapiens
ucagggaacugggaaacuu

SEQ ID NO: 33087 - RNA, 19 nt, Homo sapiens
uacaccggcugcucuauga

SEQ ID NO: 33088 - RNA, 19 nt, Homo sapiens
caucaacccugccgugacu

SEQ ID NO: 33089 - RNA, 19 nt, Homo sapiens
gcucccuccucuacaacua

SEQ ID NO: 33090 - RNA, 19 nt, Homo sapiens
guccucacaugcagaguug

SEQ ID NO: 33091 - RNA, 19 nt, Homo sapiens
cagggaacugggaaacuua

SEQ ID NO: 33092 - RNA, 19 nt, Homo sapiens
cuacaacuacgugcuguuu

SEQ ID NO: 33093 - RNA, 19 nt, Homo sapiens
ccacacuccucuucgucuu

SEQ ID NO: 33094 - RNA, 19 nt, Homo sapiens
gguggcuucuccugccuuu

SEQ ID NO: 33095 - RNA, 19 nt, Homo sapiens
gggcuguguucgcagaguu

SEQ ID NO: 33096 - RNA, 19 nt, Homo sapiens
gcaacugguuuuacuagug

SEQ ID NO: 33097 - RNA, 19 nt, Homo sapiens
gaucacgccagcagacauc

SEQ ID NO: 33098 - RNA, 19 nt, Homo sapiens
caacugguuuuacuagugu

SEQ ID NO: 33099 - RNA, 19 nt, Homo sapiens
gagcauccuggcccugaga

SEQ ID NO: 33100 - RNA, 19 nt, Homo sapiens
gggaaugaugcaacugguu

SEQ ID NO: 33101 - RNA, 19 nt, Homo sapiens
ucacuggcaaauuugauga

SEQ ID NO: 33102 - RNA, 19 nt, Homo sapiens
ugaacagguuugccuacgu

SEQ ID NO: 33103 - RNA, 19 nt, Homo sapiens
gcuggggacuucucacuuc

SEQ ID NO: 33104 - RNA, 19 nt, Homo sapiens
cagaguuccuggccacacu

SEQ ID NO: 33105 - RNA, 19 nt, Homo sapiens
ccgcucugcuccaugagau

SEQ ID NO: 33106 - RNA, 19 nt, Homo sapiens
gaagucaggucauaaguuu

SEQ ID NO: 33107 - RNA, 19 nt, Homo sapiens
ggucauaaguuucauguuu

SEQ ID NO: 33108 - RNA, 19 nt, Homo sapiens
cuaaggagcucccuaucua

SEQ ID NO: 33109 - RNA, 19 nt, Homo sapiens
ggagugaagucaggucaua

SEQ ID NO: 33110 - RNA, 19 nt, Homo sapiens
ggaucaagcugcccaucua

SEQ ID NO: 33111 - RNA, 19 nt, Homo sapiens
gaauuugggucaauacauc

SEQ ID NO: 33112 - RNA, 19 nt, Homo sapiens
ggacguguuucugucauaa

SEQ ID NO: 33113 - RNA, 19 nt, Homo sapiens
gcagauagauauguguuuc

SEQ ID NO: 33114 - RNA, 19 nt, Homo sapiens
ggucgucacuccuuuaauc

SEQ ID NO: 33115 - RNA, 19 nt, Homo sapiens
gauauguguuucuguguau

SEQ ID NO: 33116 - RNA, 19 nt, Homo sapiens
uaugaucaauggcuucuuu

SEQ ID NO: 33117 - RNA, 19 nt, Homo sapiens
caaccuggccuuuggcuuu

SEQ ID NO: 33118 - RNA, 19 nt, Homo sapiens
uggaggagcugcagauaga

SEQ ID NO: 33119 - RNA, 19 nt, Homo sapiens
acucaacaauguacucuuu

SEQ ID NO: 33120 - RNA, 19 nt, Homo sapiens
cuucuugggugcuggaaua

SEQ ID NO: 33121 - RNA, 19 nt, Homo sapiens
gaagggauucuggcuauug

SEQ ID NO: 33122 - RNA, 19 nt, Homo sapiens
gcacaaggagcagaucuga

SEQ ID NO: 33123 - RNA, 19 nt, Homo sapiens
gucauaaguuucauguuug

SEQ ID NO: 33124 - RNA, 19 nt, Homo sapiens
guuuggagcucuggaugua

SEQ ID NO: 33125 - RNA, 19 nt, Homo sapiens
uagcagauguuacagucuu

SEQ ID NO: 33126 - RNA, 19 nt, Homo sapiens
gaggagcugcagauagaua

SEQ ID NO: 33127 - RNA, 19 nt, Homo sapiens
cggaagggauucuggcuau

SEQ ID NO: 33128 - RNA, 19 nt, Homo sapiens
gggacguguuucugucaua

SEQ ID NO: 33129 - RNA, 19 nt, Homo sapiens
ggaagggauucuggcuauu

SEQ ID NO: 33130 - RNA, 19 nt, Homo sapiens
uggcacagccggcaucuuu

SEQ ID NO: 33131 - RNA, 19 nt, Homo sapiens
agauauguguuucugugua

SEQ ID NO: 33132 - RNA, 19 nt, Homo sapiens
gaagcuggcccaugugaag

SEQ ID NO: 33133 - RNA, 19 nt, Homo sapiens
uaauguauguagcagaugu

SEQ ID NO: 33134 - RNA, 19 nt, Homo sapiens
gagaaugggcagcagguau

SEQ ID NO: 33135 - RNA, 19 nt, Homo sapiens
caugaaggguggagugaag

SEQ ID NO: 33136 - RNA, 19 nt, Homo sapiens
gaaccggaauuugggucaa

SEQ ID NO: 33137 - RNA, 19 nt, Homo sapiens
ggccacagcuuagguuugg

SEQ ID NO: 33138 - RNA, 19 nt, Homo sapiens
guccaucugugcauaagga

SEQ ID NO: 33139 - RNA, 19 nt, Homo sapiens
gaaaguuccagggugugua

SEQ ID NO: 33140 - RNA, 19 nt, Homo sapiens
ggaccagucggaagggauu

SEQ ID NO: 33141 - RNA, 19 nt, Homo sapiens
ggaccuugcccaaauagca

SEQ ID NO: 33142 - RNA, 19 nt, Homo sapiens
uuaauccucuacucaacaa

SEQ ID NO: 33143 - RNA, 19 nt, Homo sapiens
caagggccacucccaagaa

SEQ ID NO: 33144 - RNA, 19 nt, Homo sapiens
ucuggacacuuggauauga

SEQ ID NO: 33145 - RNA, 19 nt, Homo sapiens
ggaauuugggucaauacau

SEQ ID NO: 33146 - RNA, 19 nt, Homo sapiens
gaacccugccgugaccuuu

SEQ ID NO: 33147 - RNA, 19 nt, Homo sapiens
acaaggagcagaucugagu

SEQ ID NO: 33148 - RNA, 19 nt, Homo sapiens
ugaagucaggucauaaguu

SEQ ID NO: 33149 - RNA, 19 nt, Homo sapiens
guguuucuguguaugugua

SEQ ID NO: 33150 - RNA, 19 nt, Homo sapiens
gcaccuccaugggcuucaa

SEQ ID NO: 33151 - RNA, 19 nt, Homo sapiens
ccaucaaccuggccuuugg

SEQ ID NO: 33152 - RNA, 19 nt, Homo sapiens
cuugggugcuggaauaguu

SEQ ID NO: 33153 - RNA, 19 nt, Homo sapiens
ggagcagugggacguguuu

SEQ ID NO: 33154 - RNA, 19 nt, Homo sapiens
gcuaaggagcucccuaucu

SEQ ID NO: 33155 - RNA, 19 nt, Homo sapiens
acacuuggauaugaucaau

SEQ ID NO: 33156 - RNA, 19 nt, Homo sapiens
gccgugaccuuugccaugu

SEQ ID NO: 33157 - RNA, 19 nt, Homo sapiens
cacuggaccuugcccaaau

SEQ ID NO: 33158 - RNA, 19 nt, Homo sapiens
gacagccccuucaggauuu

SEQ ID NO: 33159 - RNA, 19 nt, Homo sapiens
gcuguauuaugaugcaauc

SEQ ID NO: 33160 - RNA, 19 nt, Homo sapiens
cauguuugcuuuuguuuug

SEQ ID NO: 33161 - RNA, 19 nt, Homo sapiens
acuggaccuugcccaaaua

SEQ ID NO: 33162 - RNA, 19 nt, Homo sapiens
ccaagggccacucccaaga

SEQ ID NO: 33163 - RNA, 19 nt, Homo sapiens
ccaacgaggaagagaaugu

SEQ ID NO: 33164 - RNA, 19 nt, Homo sapiens
cauaaggagaggaaaguuc

SEQ ID NO: 33165 - RNA, 19 nt, Homo sapiens
ccacuggaccuugcccaaa

SEQ ID NO: 33166 - RNA, 19 nt, Homo sapiens
gcauaaggagaggaaaguu

SEQ ID NO: 33167 - RNA, 19 nt, Homo sapiens
gccuuuggcuuugcuguca

SEQ ID NO: 33168 - RNA, 19 nt, Homo sapiens
gagugaagucaggucauaa

SEQ ID NO: 33169 - RNA, 19 nt, Homo sapiens
cgccaugggucgacagaag

SEQ ID NO: 33170 - RNA, 19 nt, Homo sapiens
guuccaggguguguauguu

SEQ ID NO: 33171 - RNA, 19 nt, Homo sapiens
gcacagccggcaucuuugc

SEQ ID NO: 33172 - RNA, 19 nt, Homo sapiens
gagcugcagauagauaugu

SEQ ID NO: 33173 - RNA, 19 nt, Homo sapiens
gggcagcagguaugugugu

SEQ ID NO: 33174 - RNA, 19 nt, Homo sapiens
agaaugggcagcagguaug

SEQ ID NO: 33175 - RNA, 19 nt, Homo sapiens
gugaagcuggcccauguga

SEQ ID NO: 33176 - RNA, 19 nt, Homo sapiens
gggcuucaacuccggcuau

SEQ ID NO: 33177 - RNA, 19 nt, Homo sapiens
agauagauauguguuucug

SEQ ID NO: 33178 - RNA, 19 nt, Homo sapiens
caacgaggaagagaaugug

SEQ ID NO: 33179 - RNA, 19 nt, Homo sapiens
ugugugugcuggccauugu

SEQ ID NO: 33180 - RNA, 19 nt, Homo sapiens
ccucuggacacuuggauau

SEQ ID NO: 33181 - RNA, 19 nt, Homo sapiens
ucacuccuuuaauccucua

SEQ ID NO: 33182 - RNA, 19 nt, Homo sapiens
agcagauguuacagucuua

SEQ ID NO: 33183 - RNA, 19 nt, Homo sapiens
ccuucacgauccacccuuu

SEQ ID NO: 33184 - RNA, 19 nt, Homo sapiens
ggcacagccucccuuaucg

SEQ ID NO: 33185 - RNA, 19 nt, Homo sapiens
ucauaaguuucauguuugc

SEQ ID NO: 33186 - RNA, 19 nt, Homo sapiens
gaaggguggagugaaguca

SEQ ID NO: 33187 - RNA, 19 nt, Homo sapiens
gcaugaaggguggagugaa

SEQ ID NO: 33188 - RNA, 19 nt, Homo sapiens
aaaguuccaggguguguau

SEQ ID NO: 33189 - RNA, 19 nt, Homo sapiens
uggcuucuuugaccaguuc

SEQ ID NO: 33190 - RNA, 19 nt, Homo sapiens
ggacacuuggauaugauca

SEQ ID NO: 33191 - RNA, 19 nt, Homo sapiens
ggagaccccacuuuagaaa

SEQ ID NO: 33192 - RNA, 19 nt, Homo sapiens
ggguggaaccggaauuugg

SEQ ID NO: 33193 - RNA, 19 nt, Homo sapiens
uugcccaaauagcaccuua

SEQ ID NO: 33194 - RNA, 19 nt, Homo sapiens
uugcgggugucuucgugua

SEQ ID NO: 33195 - RNA, 19 nt, Homo sapiens
gcacagccucccuuaucgu

SEQ ID NO: 33196 - RNA, 19 nt, Homo sapiens
agucaggucauaaguuuca

SEQ ID NO: 33197 - RNA, 19 nt, Homo sapiens
cauggaggagcugcagaua

SEQ ID NO: 33198 - RNA, 19 nt, Homo sapiens
gaucaagcugcccaucuac

SEQ ID NO: 33199 - RNA, 19 nt, Homo sapiens
gaaugggcagcagguaugu

SEQ ID NO: 33200 - RNA, 19 nt, Homo sapiens
augugaagcuggcccaugu

SEQ ID NO: 33201 - RNA, 19 nt, Homo sapiens
cgaggaagagaaugugaag

SEQ ID NO: 33202 - RNA, 19 nt, Homo sapiens
acuuggauaugaucaaugg

SEQ ID NO: 33203 - RNA, 19 nt, Homo sapiens
ucacgaccggccagcauug

SEQ ID NO: 33204 - RNA, 19 nt, Homo sapiens
gaagaaaccuauugugaau

SEQ ID NO: 33205 - RNA, 19 nt, Homo sapiens
gguauugucuucaguauga

SEQ ID NO: 33206 - RNA, 19 nt, Homo sapiens
ggaagaaaccuauugugaa

SEQ ID NO: 33207 - RNA, 19 nt, Homo sapiens
cucaauagcuuuagcaauu

SEQ ID NO: 33208 - RNA, 19 nt, Homo sapiens
gaaaugugcagguuuguug

SEQ ID NO: 33209 - RNA, 19 nt, Homo sapiens
gaacggaagaaaccuauug

SEQ ID NO: 33210 - RNA, 19 nt, Homo sapiens
ggacauuuauuugcaauca

SEQ ID NO: 33211 - RNA, 19 nt, Homo sapiens
gcaauuggacauuuauuug

SEQ ID NO: 33212 - RNA, 19 nt, Homo sapiens
agaccaaucuggagaggua

SEQ ID NO: 33213 - RNA, 19 nt, Homo sapiens
gcaauuggauuuucuguug

SEQ ID NO: 33214 - RNA, 19 nt, Homo sapiens
cggaugaccugauucuaaa

SEQ ID NO: 33215 - RNA, 19 nt, Homo sapiens
ugaugucacuggcucaaua

SEQ ID NO: 33216 - RNA, 19 nt, Homo sapiens
gcaguuaucaugggaaauu

SEQ ID NO: 33217 - RNA, 19 nt, Homo sapiens
agaaaccuauugugaauuc

SEQ ID NO: 33218 - RNA, 19 nt, Homo sapiens
gaauuucuggccaugcuua

SEQ ID NO: 33219 - RNA, 19 nt, Homo sapiens
cuacuggaauauugguaua

SEQ ID NO: 33220 - RNA, 19 nt, Homo sapiens
gcagguuuguuguuucaug

SEQ ID NO: 33221 - RNA, 19 nt, Homo sapiens
uuagaaaugugcagguuug

SEQ ID NO: 33222 - RNA, 19 nt, Homo sapiens
ggucuggacucaagcuuuc

SEQ ID NO: 33223 - RNA, 19 nt, Homo sapiens
ggaaaaccauuggauauau

SEQ ID NO: 33224 - RNA, 19 nt, Homo sapiens
ggacucaagcuuucuggaa

SEQ ID NO: 33225 - RNA, 19 nt, Homo sapiens
gugcagugcuuuggccaua

SEQ ID NO: 33226 - RNA, 19 nt, Homo sapiens
uuagaacuguccucagauu

SEQ ID NO: 33227 - RNA, 19 nt, Homo sapiens
ccuuagaacuguccucaga

SEQ ID NO: 33228 - RNA, 19 nt, Homo sapiens
gagguauugucuucaguau

SEQ ID NO: 33229 - RNA, 19 nt, Homo sapiens
ggacaacaggagucaggua

SEQ ID NO: 33230 - RNA, 19 nt, Homo sapiens
gaagaucgcacugaaagca

SEQ ID NO: 33231 - RNA, 19 nt, Homo sapiens
caauugguguuuacuaucu

SEQ ID NO: 33232 - RNA, 19 nt, Homo sapiens
cggaagaaaccuauuguga

SEQ ID NO: 33233 - RNA, 19 nt, Homo sapiens
agacaagacuccuuagaac

SEQ ID NO: 33234 - RNA, 19 nt, Homo sapiens
agagacggaugaccugauu

SEQ ID NO: 33235 - RNA, 19 nt, Homo sapiens
ccaagucugucuucuacau

SEQ ID NO: 33236 - RNA, 19 nt, Homo sapiens
ggagagguauugucuucag

SEQ ID NO: 33237 - RNA, 19 nt, Homo sapiens
gguuaagucuugccugaca

SEQ ID NO: 33238 - RNA, 19 nt, Homo sapiens
cagacaagacuccuuagaa

SEQ ID NO: 33239 - RNA, 19 nt, Homo sapiens
caaacggacugaugucacu

SEQ ID NO: 33240 - RNA, 19 nt, Homo sapiens
caacaggagucagguagag

SEQ ID NO: 33241 - RNA, 19 nt, Homo sapiens
aagcagacaagacuccuua

SEQ ID NO: 33242 - RNA, 19 nt, Homo sapiens
gcagacaagacuccuuaga

SEQ ID NO: 33243 - RNA, 19 nt, Homo sapiens
caucaacccugcagugacu

SEQ ID NO: 33244 - RNA, 19 nt, Homo sapiens
uaucagcgguggccacauc

SEQ ID NO: 33245 - RNA, 19 nt, Homo sapiens
gcagugcuuuggccauauc

SEQ ID NO: 33246 - RNA, 19 nt, Homo sapiens
gugcagguuuguuguuuca

SEQ ID NO: 33247 - RNA, 19 nt, Homo sapiens
ccauuaaggaaacagauuu

SEQ ID NO: 33248 - RNA, 19 nt, Homo sapiens
gcacugaaagcagacaaga

SEQ ID NO: 33249 - RNA, 19 nt, Homo sapiens
acuagaagaucgcacugaa

SEQ ID NO: 33250 - RNA, 19 nt, Homo sapiens
cugguggccuuuaugagua

SEQ ID NO: 33251 - RNA, 19 nt, Homo sapiens
gucauggucuccugguuga

SEQ ID NO: 33252 - RNA, 19 nt, Homo sapiens
caaccauggugcagugcuu

SEQ ID NO: 33253 - RNA, 19 nt, Homo sapiens
ucucaucucccuuugcuuu

SEQ ID NO: 33254 - RNA, 19 nt, Homo sapiens
caacugggguggaacagaa

SEQ ID NO: 33255 - RNA, 19 nt, Homo sapiens
acacgucuaucagcuuauu

SEQ ID NO: 33256 - RNA, 19 nt, Homo sapiens
gucaagauuugguuaaguc

SEQ ID NO: 33257 - RNA, 19 nt, Homo sapiens
ggguaaguguggaccuuug

SEQ ID NO: 33258 - RNA, 19 nt, Homo sapiens
caagacuccuuagaacugu

SEQ ID NO: 33259 - RNA, 19 nt, Homo sapiens
gcuuauuccuucucuacug

SEQ ID NO: 33260 - RNA, 19 nt, Homo sapiens
caaaggaggaacggaagaa

SEQ ID NO: 33261 - RNA, 19 nt, Homo sapiens
gaacuguccucagauuucc

SEQ ID NO: 33262 - RNA, 19 nt, Homo sapiens
caucaugguggcuuucaaa

SEQ ID NO: 33263 - RNA, 19 nt, Homo sapiens
gaggaacggaagaaaccua

SEQ ID NO: 33264 - RNA, 19 nt, Homo sapiens
cuggagagguauugucuuc

SEQ ID NO: 33265 - RNA, 19 nt, Homo sapiens
uguugcaauuggacauuua

SEQ ID NO: 33266 - RNA, 19 nt, Homo sapiens
cuucucuacuggaauauug

SEQ ID NO: 33267 - RNA, 19 nt, Homo sapiens
acauggagguggaggacaa

SEQ ID NO: 33268 - RNA, 19 nt, Homo sapiens
gucacuggcucaauagcuu

SEQ ID NO: 33269 - RNA, 19 nt, Homo sapiens
uagaagaucgcacugaaag

SEQ ID NO: 33270 - RNA, 19 nt, Homo sapiens
acggaugaccugauucuaa

SEQ ID NO: 33271 - RNA, 19 nt, Homo sapiens
cgccaagucugucuucuac

SEQ ID NO: 33272 - RNA, 19 nt, Homo sapiens
gagagguauugucuucagu

SEQ ID NO: 33273 - RNA, 19 nt, Homo sapiens
gcugguggccuuuaugagu

SEQ ID NO: 33274 - RNA, 19 nt, Homo sapiens
gaaauugggaaaaccauug

SEQ ID NO: 33275 - RNA, 19 nt, Homo sapiens
aaccgugugucaagauuug

SEQ ID NO: 33276 - RNA, 19 nt, Homo sapiens
gauuuccuuccacccauua

SEQ ID NO: 33277 - RNA, 19 nt, Homo sapiens
gggaaaaccauuggauaua

SEQ ID NO: 33278 - RNA, 19 nt, Homo sapiens
acaagacuccuuagaacug

SEQ ID NO: 33279 - RNA, 19 nt, Homo sapiens
agaacaucaugguggcuuu

SEQ ID NO: 33280 - RNA, 19 nt, Homo sapiens
ggacucagcauugcaacca

SEQ ID NO: 33281 - RNA, 19 nt, Homo sapiens
gaacaucaugguggcuuuc

SEQ ID NO: 33282 - RNA, 19 nt, Homo sapiens
uuaaccgugugucaagauu

SEQ ID NO: 33283 - RNA, 19 nt, Homo sapiens
gaguggugcaugugauuga

SEQ ID NO: 33284 - RNA, 19 nt, Homo sapiens
ugccagcugugauuccaaa

SEQ ID NO: 33285 - RNA, 19 nt, Homo sapiens
ccagagagaacaucauggu

SEQ ID NO: 33286 - RNA, 19 nt, Homo sapiens
cagguuuguuguuucaugu

SEQ ID NO: 33287 - RNA, 19 nt, Homo sapiens
ggaauauugguauagucaa

SEQ ID NO: 33288 - RNA, 19 nt, Homo sapiens
gguuuguuguuucauguca

SEQ ID NO: 33289 - RNA, 19 nt, Homo sapiens
aauuagaaaugugcagguu

SEQ ID NO: 33290 - RNA, 19 nt, Homo sapiens
uuucuggccaugcuuauuu

SEQ ID NO: 33291 - RNA, 19 nt, Homo sapiens
uaaccgugugucaagauuu

SEQ ID NO: 33292 - RNA, 19 nt, Homo sapiens
agaacuguccucagauuuc

SEQ ID NO: 33293 - RNA, 19 nt, Homo sapiens
cuagaagaucgcacugaaa

SEQ ID NO: 33294 - RNA, 19 nt, Homo sapiens
cugcaguuaucaugggaaa

SEQ ID NO: 33295 - RNA, 19 nt, Homo sapiens
guucucaucucccuuugcu

SEQ ID NO: 33296 - RNA, 19 nt, Homo sapiens
ucuccugguugaguugaua

SEQ ID NO: 33297 - RNA, 19 nt, Homo sapiens
ggaacggaagaaaccuauu

SEQ ID NO: 33298 - RNA, 19 nt, Homo sapiens
agagguauugucuucagua

SEQ ID NO: 33299 - RNA, 19 nt, Homo sapiens
uuaugaguaugucuucugu

SEQ ID NO: 33300 - RNA, 19 nt, Homo sapiens
gcucaauagcuuuagcaau

SEQ ID NO: 33301 - RNA, 19 nt, Homo sapiens
gaucagcaucgccaagucu

SEQ ID NO: 33302 - RNA, 19 nt, Homo sapiens
uagaacuguccucagauuu

SEQ ID NO: 33303 - RNA, 19 nt, Homo sapiens
gacaagacuccuuagaacu

SEQ ID NO: 33304 - RNA, 19 nt, Homo sapiens
gaagaaaccuauugugaau

SEQ ID NO: 33305 - RNA, 19 nt, Homo sapiens
gguauugucuucaguauga

SEQ ID NO: 33306 - RNA, 19 nt, Homo sapiens
ggaagaaaccuauugugaa

SEQ ID NO: 33307 - RNA, 19 nt, Homo sapiens
cucaauagcuuuagcaauu

SEQ ID NO: 33308 - RNA, 19 nt, Homo sapiens
gaaaugugcagguuuguug

SEQ ID NO: 33309 - RNA, 19 nt, Homo sapiens
gaacggaagaaaccuauug

SEQ ID NO: 33310 - RNA, 19 nt, Homo sapiens
ggacauuuauuugcaauca

SEQ ID NO: 33311 - RNA, 19 nt, Homo sapiens
gcaauuggacauuuauuug

SEQ ID NO: 33312 - RNA, 19 nt, Homo sapiens
agaccaaucuggagaggua

SEQ ID NO: 33313 - RNA, 19 nt, Homo sapiens
gcaauuggauuuucuguug

SEQ ID NO: 33314 - RNA, 19 nt, Homo sapiens
cggaugaccugauucuaaa

SEQ ID NO: 33315 - RNA, 19 nt, Homo sapiens
ugaugucacuggcucaaua

SEQ ID NO: 33316 - RNA, 19 nt, Homo sapiens
gcaguuaucaugggaaauu

SEQ ID NO: 33317 - RNA, 19 nt, Homo sapiens
agaaaccuauugugaauuc

SEQ ID NO: 33318 - RNA, 19 nt, Homo sapiens
gaauuucuggccaugcuua

SEQ ID NO: 33319 - RNA, 19 nt, Homo sapiens
cuacuggaauauugguaua

SEQ ID NO: 33320 - RNA, 19 nt, Homo sapiens
gcagguuuguuguuucaug

SEQ ID NO: 33321 - RNA, 19 nt, Homo sapiens
uuagaaaugugcagguuug

SEQ ID NO: 33322 - RNA, 19 nt, Homo sapiens
ggucuggacucaagcuuuc

SEQ ID NO: 33323 - RNA, 19 nt, Homo sapiens
ggacucaagcuuucuggaa

SEQ ID NO: 33324 - RNA, 19 nt, Homo sapiens
ggaaaaccauuggauauau

SEQ ID NO: 33325 - RNA, 19 nt, Homo sapiens
gugcagugcuuuggccaua

SEQ ID NO: 33326 - RNA, 19 nt, Homo sapiens
uuagaacuguccucagauu

SEQ ID NO: 33327 - RNA, 19 nt, Homo sapiens
ccuuagaacuguccucaga

SEQ ID NO: 33328 - RNA, 19 nt, Homo sapiens
gagguauugucuucaguau

SEQ ID NO: 33329 - RNA, 19 nt, Homo sapiens
ggacaacaggagucaggua

SEQ ID NO: 33330 - RNA, 19 nt, Homo sapiens
gaagaucgcacugaaagca

SEQ ID NO: 33331 - RNA, 19 nt, Homo sapiens
caauugguguuuacuaucu

SEQ ID NO: 33332 - RNA, 19 nt, Homo sapiens
cggaagaaaccuauuguga

SEQ ID NO: 33333 - RNA, 19 nt, Homo sapiens
agacaagacuccuuagaac

SEQ ID NO: 33334 - RNA, 19 nt, Homo sapiens
agagacggaugaccugauu

SEQ ID NO: 33335 - RNA, 19 nt, Homo sapiens
ccaagucugucuucuacau

SEQ ID NO: 33336 - RNA, 19 nt, Homo sapiens
ggagagguauugucuucag

SEQ ID NO: 33337 - RNA, 19 nt, Homo sapiens
gguuaagucuugccugaca

SEQ ID NO: 33338 - RNA, 19 nt, Homo sapiens
cagacaagacuccuuagaa

SEQ ID NO: 33339 - RNA, 19 nt, Homo sapiens
caaacggacugaugucacu

SEQ ID NO: 33340 - RNA, 19 nt, Homo sapiens
caacaggagucagguagag

SEQ ID NO: 33341 - RNA, 19 nt, Homo sapiens
aagcagacaagacuccuua

SEQ ID NO: 33342 - RNA, 19 nt, Homo sapiens
gcagacaagacuccuuaga

SEQ ID NO: 33343 - RNA, 19 nt, Homo sapiens
caucaacccugcagugacu

SEQ ID NO: 33344 - RNA, 19 nt, Homo sapiens
uaucagcgguggccacauc

SEQ ID NO: 33345 - RNA, 19 nt, Homo sapiens
gcagugcuuuggccauauc

SEQ ID NO: 33346 - RNA, 19 nt, Homo sapiens
gugcagguuuguuguuuca

SEQ ID NO: 33347 - RNA, 19 nt, Homo sapiens
ccauuaaggaaacagauuu

SEQ ID NO: 33348 - RNA, 19 nt, Homo sapiens
caacugggguggaacagaa

SEQ ID NO: 33349 - RNA, 19 nt, Homo sapiens
gcacugaaagcagacaaga

SEQ ID NO: 33350 - RNA, 19 nt, Homo sapiens
acuagaagaucgcacugaa

SEQ ID NO: 33351 - RNA, 19 nt, Homo sapiens
cugguggccuuuaugagua

SEQ ID NO: 33352 - RNA, 19 nt, Homo sapiens
gucauggucuccugguuga

SEQ ID NO: 33353 - RNA, 19 nt, Homo sapiens
caaccauggugcagugcuu

SEQ ID NO: 33354 - RNA, 19 nt, Homo sapiens
ucucaucucccuuugcuuu

SEQ ID NO: 33355 - RNA, 19 nt, Homo sapiens
acacgucuaucagcuuauu

SEQ ID NO: 33356 - RNA, 19 nt, Homo sapiens
gucaagauuugguuaaguc

SEQ ID NO: 33357 - RNA, 19 nt, Homo sapiens
caagacuccuuagaacugu

SEQ ID NO: 33358 - RNA, 19 nt, Homo sapiens
gcuuauuccuucucuacug

SEQ ID NO: 33359 - RNA, 19 nt, Homo sapiens
caaaggaggaacggaagaa

SEQ ID NO: 33360 - RNA, 19 nt, Homo sapiens
gaacuguccucagauuucc

SEQ ID NO: 33361 - RNA, 19 nt, Homo sapiens
caucaugguggcuuucaaa

SEQ ID NO: 33362 - RNA, 19 nt, Homo sapiens
gaggaacggaagaaaccua

SEQ ID NO: 33363 - RNA, 19 nt, Homo sapiens
cuggagagguauugucuuc

SEQ ID NO: 33364 - RNA, 19 nt, Homo sapiens
uguugcaauuggacauuua

SEQ ID NO: 33365 - RNA, 19 nt, Homo sapiens
cuucucuacuggaauauug

SEQ ID NO: 33366 - RNA, 19 nt, Homo sapiens
acauggagguggaggacaa

SEQ ID NO: 33367 - RNA, 19 nt, Homo sapiens
gucacuggcucaauagcuu

SEQ ID NO: 33368 - RNA, 19 nt, Homo sapiens
uagaagaucgcacugaaag

SEQ ID NO: 33369 - RNA, 19 nt, Homo sapiens
acggaugaccugauucuaa

SEQ ID NO: 33370 - RNA, 19 nt, Homo sapiens
cgccaagucugucuucuac

SEQ ID NO: 33371 - RNA, 19 nt, Homo sapiens
gagagguauugucuucagu

SEQ ID NO: 33372 - RNA, 19 nt, Homo sapiens
gcugguggccuuuaugagu

SEQ ID NO: 33373 - RNA, 19 nt, Homo sapiens
gaaauugggaaaaccauug

SEQ ID NO: 33374 - RNA, 19 nt, Homo sapiens
aaccgugugucaagauuug

SEQ ID NO: 33375 - RNA, 19 nt, Homo sapiens
gauuuccuuccacccauua

SEQ ID NO: 33376 - RNA, 19 nt, Homo sapiens
gggaaaaccauuggauaua

SEQ ID NO: 33377 - RNA, 19 nt, Homo sapiens
acaagacuccuuagaacug

SEQ ID NO: 33378 - RNA, 19 nt, Homo sapiens
ggacucagcauugcaacca

SEQ ID NO: 33379 - RNA, 19 nt, Homo sapiens
uuaaccgugugucaagauu

SEQ ID NO: 33380 - RNA, 19 nt, Homo sapiens
gaacaucaugguggcuuuc

SEQ ID NO: 33381 - RNA, 19 nt, Homo sapiens
gaguggugcaugugauuga

SEQ ID NO: 33382 - RNA, 19 nt, Homo sapiens
ugccagcugugauuccaaa

SEQ ID NO: 33383 - RNA, 19 nt, Homo sapiens
cagguuuguuguuucaugu

SEQ ID NO: 33384 - RNA, 19 nt, Homo sapiens
ggaauauugguauagucaa

SEQ ID NO: 33385 - RNA, 19 nt, Homo sapiens
gguuuguuguuucauguca

SEQ ID NO: 33386 - RNA, 19 nt, Homo sapiens
aauuagaaaugugcagguu

SEQ ID NO: 33387 - RNA, 19 nt, Homo sapiens
uuucuggccaugcuuauuu

SEQ ID NO: 33388 - RNA, 19 nt, Homo sapiens
uaaccgugugucaagauuu

SEQ ID NO: 33389 - RNA, 19 nt, Homo sapiens
agaacuguccucagauuuc

SEQ ID NO: 33390 - RNA, 19 nt, Homo sapiens
cuagaagaucgcacugaaa

SEQ ID NO: 33391 - RNA, 19 nt, Homo sapiens
cugcaguuaucaugggaaa

SEQ ID NO: 33392 - RNA, 19 nt, Homo sapiens
guucucaucucccuuugcu

SEQ ID NO: 33393 - RNA, 19 nt, Homo sapiens
ucuccugguugaguugaua

SEQ ID NO: 33394 - RNA, 19 nt, Homo sapiens
ggaacggaagaaaccuauu

SEQ ID NO: 33395 - RNA, 19 nt, Homo sapiens
agagguauugucuucagua

SEQ ID NO: 33396 - RNA, 19 nt, Homo sapiens
gaucagcaucgccaagucu

SEQ ID NO: 33397 - RNA, 19 nt, Homo sapiens
uuaugaguaugucuucugu

SEQ ID NO: 33398 - RNA, 19 nt, Homo sapiens
gcucaauagcuuuagcaau

SEQ ID NO: 33399 - RNA, 19 nt, Homo sapiens
uagaacuguccucagauuu

SEQ ID NO: 33400 - RNA, 19 nt, Homo sapiens
gacaagacuccuuagaacu

SEQ ID NO: 33401 - RNA, 19 nt, Homo sapiens
gucauauuacucagucuaa

SEQ ID NO: 33402 - RNA, 19 nt, Homo sapiens
ggaguggugcaugugauug

SEQ ID NO: 33403 - RNA, 19 nt, Homo sapiens
cauuaaggaaacagauuug

SEQ ID NO: 33404 - RNA, 19 nt, Homo sapiens
ucaacgcgcucaacaacaa

SEQ ID NO: 33405 - RNA, 19 nt, Homo sapiens
gcagaucgcgcuggcguuu

SEQ ID NO: 33406 - RNA, 19 nt, Homo sapiens
gcuccgggcuuucuucuac

SEQ ID NO: 33407 - RNA, 19 nt, Homo sapiens
gcccugcgguggucaugaa

SEQ ID NO: 33408 - RNA, 19 nt, Homo sapiens
gggaagagcggaagaagac

SEQ ID NO: 33409 - RNA, 19 nt, Homo sapiens
gaacccagcccgcucuuuu

SEQ ID NO: 33410 - RNA, 19 nt, Homo sapiens
ccucaucuucgucuucuuu

SEQ ID NO: 33411 - RNA, 19 nt, Homo sapiens
gcguguggccaucaucaaa

SEQ ID NO: 33412 - RNA, 19 nt, Homo sapiens
gagcguguggccaucauca

SEQ ID NO: 33413 - RNA, 19 nt, Homo sapiens
caucaucaaaggcacguau

SEQ ID NO: 33414 - RNA, 19 nt, Homo sapiens
uucacuggcugcuccauga

SEQ ID NO: 33415 - RNA, 19 nt, Homo sapiens
cggccaccaugaagaagga

SEQ ID NO: 33416 - RNA, 19 nt, Homo sapiens
cugccauccuuuacuucua

SEQ ID NO: 33417 - RNA, 19 nt, Homo sapiens
gugguggagcugauucuga

SEQ ID NO: 33418 - RNA, 19 nt, Homo sapiens
gcgcucaacaacaacacaa

SEQ ID NO: 33419 - RNA, 19 nt, Homo sapiens
guucuuggccacccucauc

SEQ ID NO: 33420 - RNA, 19 nt, Homo sapiens
ccagaaagcuguugaauaa

SEQ ID NO: 33421 - RNA, 19 nt, Homo sapiens
gaacugacacagagaagaa

SEQ ID NO: 33422 - RNA, 19 nt, Homo sapiens
ggagugaauuugucccauu

SEQ ID NO: 33423 - RNA, 19 nt, Homo sapiens
ccaaguagcugggauuaca

SEQ ID NO: 33424 - RNA, 19 nt, Homo sapiens
ggacugcugugaaaucaag

SEQ ID NO: 33425 - RNA, 19 nt, Homo sapiens
gcugugaaaucaagaaauc

SEQ ID NO: 33426 - RNA, 19 nt, Homo sapiens
gcacugggccaccucauug

SEQ ID NO: 33427 - RNA, 19 nt, Homo sapiens
ccaggaaacuaagauuuga

SEQ ID NO: 33428 - RNA, 19 nt, Homo sapiens
gaagaagacaggaagaauc

SEQ ID NO: 33429 - RNA, 19 nt, Homo sapiens
gaagaacugacacagagaa

SEQ ID NO: 33430 - RNA, 19 nt, Homo sapiens
gggcugcucugcuuuaugg

SEQ ID NO: 33431 - RNA, 19 nt, Homo sapiens
gguagaaucugggagugaa

SEQ ID NO: 33432 - RNA, 19 nt, Homo sapiens
guuaaaagcugcuguagau

SEQ ID NO: 33433 - RNA, 19 nt, Homo sapiens
guagagaggugggauagag

SEQ ID NO: 33434 - RNA, 19 nt, Homo sapiens
agagaagccuccacagaga

SEQ ID NO: 33435 - RNA, 19 nt, Homo sapiens
gaaaucaagaaaucggaaa

SEQ ID NO: 33436 - RNA, 19 nt, Homo sapiens
aaaagcugcuguagauuua

SEQ ID NO: 33437 - RNA, 19 nt, Homo sapiens
accaauagaucuuuguuug

SEQ ID NO: 33438 - RNA, 19 nt, Homo sapiens
ggagugcaguggcaugauc

SEQ ID NO: 33439 - RNA, 19 nt, Homo sapiens
ccaaagugcugggauuaca

SEQ ID NO: 33440 - RNA, 19 nt, Homo sapiens
ggagauggagaguguguga

SEQ ID NO: 33441 - RNA, 19 nt, Homo sapiens
gagagacccuugggaucaa

SEQ ID NO: 33442 - RNA, 19 nt, Homo sapiens
gagggacccaggaaacuaa

SEQ ID NO: 33443 - RNA, 19 nt, Homo sapiens
gaagacaggacaccagaag

SEQ ID NO: 33444 - RNA, 19 nt, Homo sapiens
ggagggacccaggaaacua

SEQ ID NO: 33445 - RNA, 19 nt, Homo sapiens
ggagguuacuuuugucuga

SEQ ID NO: 33446 - RNA, 19 nt, Homo sapiens
cgacagccgucagacauca

SEQ ID NO: 33447 - RNA, 19 nt, Homo sapiens
gaagacaggaagaaucaag

SEQ ID NO: 33448 - RNA, 19 nt, Homo sapiens
gaaagacuaccaaaaucua

SEQ ID NO: 33449 - RNA, 19 nt, Homo sapiens
ccagagaagccuccacaga

SEQ ID NO: 33450 - RNA, 19 nt, Homo sapiens
agacaggacaccagaagaa

SEQ ID NO: 33451 - RNA, 19 nt, Homo sapiens
agaaagcuguugaauaagc

SEQ ID NO: 33452 - RNA, 19 nt, Homo sapiens
cccagaaagcuguugaaua

SEQ ID NO: 33453 - RNA, 19 nt, Homo sapiens
ccaccacgcccagcuaauu

SEQ ID NO: 33454 - RNA, 19 nt, Homo sapiens
ggguauauuuccuccuuca

SEQ ID NO: 33455 - RNA, 19 nt, Homo sapiens
uaaaagcugcuguagauuu

SEQ ID NO: 33456 - RNA, 19 nt, Homo sapiens
caagaagaccagaggaaca

SEQ ID NO: 33457 - RNA, 19 nt, Homo sapiens
ggcuggagcagguauauga

SEQ ID NO: 33458 - RNA, 19 nt, Homo sapiens
aagcugcuguagauuuauu

SEQ ID NO: 33459 - RNA, 19 nt, Homo sapiens
gugcccaucuagccauuga

SEQ ID NO: 33460 - RNA, 19 nt, Homo sapiens
guauauuuccuccuucaga

SEQ ID NO: 33461 - RNA, 19 nt, Homo sapiens
cgagagacccuugggauca

SEQ ID NO: 33462 - RNA, 19 nt, Homo sapiens
uccagggacugcugugaaa

SEQ ID NO: 33463 - RNA, 19 nt, Homo sapiens
caggcucucugucagcauu

SEQ ID NO: 33464 - RNA, 19 nt, Homo sapiens
gcuuagacaugggagcuau

SEQ ID NO: 33465 - RNA, 19 nt, Homo sapiens
cagccacucugcuuagaca

SEQ ID NO: 33466 - RNA, 19 nt, Homo sapiens
gacgcuggccuuccucgua

SEQ ID NO: 33467 - RNA, 19 nt, Homo sapiens
aagaagacaggaagaauca

SEQ ID NO: 33468 - RNA, 19 nt, Homo sapiens
gcagguauaugagcaacac

SEQ ID NO: 33469 - RNA, 19 nt, Homo sapiens
gauagaggaagggagguuu

SEQ ID NO: 33470 - RNA, 19 nt, Homo sapiens
gacagccacucugcuuaga

SEQ ID NO: 33471 - RNA, 19 nt, Homo sapiens
uaccuggcauuacguucua

SEQ ID NO: 33472 - RNA, 19 nt, Homo sapiens
ccucacugaucuacaacuu

SEQ ID NO: 33473 - RNA, 19 nt, Homo sapiens
aaacaaccccaauaaauga

SEQ ID NO: 33474 - RNA, 19 nt, Homo sapiens
ugagaagaacugacacaga

SEQ ID NO: 33475 - RNA, 19 nt, Homo sapiens
caucaucauugggaaguuc

SEQ ID NO: 33476 - RNA, 19 nt, Homo sapiens
acaggaagaaucaagaaga

SEQ ID NO: 33477 - RNA, 19 nt, Homo sapiens
cagugccucugaaagacua

SEQ ID NO: 33478 - RNA, 19 nt, Homo sapiens
acacagagaagaacauuuu

SEQ ID NO: 33479 - RNA, 19 nt, Homo sapiens
ugccucagccucccaagua

SEQ ID NO: 33480 - RNA, 19 nt, Homo sapiens
ccaauagaucuuuguuugu

SEQ ID NO: 33481 - RNA, 19 nt, Homo sapiens
ccacggggcuguauguguu

SEQ ID NO: 33482 - RNA, 19 nt, Homo sapiens
gcuguugaauaagcccuaa

SEQ ID NO: 33483 - RNA, 19 nt, Homo sapiens
cagaagaagacaggaagaa

SEQ ID NO: 33484 - RNA, 19 nt, Homo sapiens
caggaagaaucaagaagac

SEQ ID NO: 33485 - RNA, 19 nt, Homo sapiens
caccacgcccagcuaauuu

SEQ ID NO: 33486 - RNA, 19 nt, Homo sapiens
uggccucacugaucuacaa

SEQ ID NO: 33487 - RNA, 19 nt, Homo sapiens
ccagcucagugcccagaga

SEQ ID NO: 33488 - RNA, 19 nt, Homo sapiens
gaggggaagugcccaucua

SEQ ID NO: 33489 - RNA, 19 nt, Homo sapiens
ccguggagauggagagugu

SEQ ID NO: 33490 - RNA, 19 nt, Homo sapiens
gaggaaggcaggggauuua

SEQ ID NO: 33491 - RNA, 19 nt, Homo sapiens
ggucaugccgggagacauc

SEQ ID NO: 33492 - RNA, 19 nt, Homo sapiens
aaaacaaccccaauaaaug

SEQ ID NO: 33493 - RNA, 19 nt, Homo sapiens
gauuuauucugcccacaac

SEQ ID NO: 33494 - RNA, 19 nt, Homo sapiens
cccaggaaacuaagauuug

SEQ ID NO: 33495 - RNA, 19 nt, Homo sapiens
ggacccaggaaacuaagau

SEQ ID NO: 33496 - RNA, 19 nt, Homo sapiens
ccaucuagccauugacuca

SEQ ID NO: 33497 - RNA, 19 nt, Homo sapiens
gcggcuggcuauccucaca

SEQ ID NO: 33498 - RNA, 19 nt, Homo sapiens
gaccagaggaacagagaag

SEQ ID NO: 33499 - RNA, 19 nt, Homo sapiens
ugacacagagaagaacauu

SEQ ID NO: 33500 - RNA, 19 nt, Homo sapiens
caaggcaccaggacaugga

SEQ ID NO: 33501 - RNA, 19 nt, Homo sapiens
gaaucugggagugaauuug

SEQ ID NO: 33502 - RNA, 19 nt, Homo sapiens
aagccuauaccuggcauua

SEQ ID NO: 33503 - RNA, 19 nt, Homo sapiens
agauggagagugugugaaa

SEQ ID NO: 33504 - RNA, 19 nt, Homo sapiens
gcccugccaucaucauugg

SEQ ID NO: 33505 - RNA, 19 nt, Homo sapiens
agacaggaagaaucaagaa

SEQ ID NO: 33506 - RNA, 19 nt, Homo sapiens
gagacugcucuaccaauag

SEQ ID NO: 33507 - RNA, 19 nt, Homo sapiens
gacaggcuuucuggaggaa

SEQ ID NO: 33508 - RNA, 19 nt, Homo sapiens
gggcgcuguuugcagaguu

SEQ ID NO: 33509 - RNA, 19 nt, Homo sapiens
ggauagaggaagggagguu

SEQ ID NO: 33510 - RNA, 19 nt, Homo sapiens
ggcaugaucucggcucacu

SEQ ID NO: 33511 - RNA, 19 nt, Homo sapiens
ggcuguauguguucuuugg

SEQ ID NO: 33512 - RNA, 19 nt, Homo sapiens
uggcauuacguucuaggua

SEQ ID NO: 33513 - RNA, 19 nt, Homo sapiens
gccuauaccuggcauuacg

SEQ ID NO: 33514 - RNA, 19 nt, Homo sapiens
cuacaacuucguccuguuc

SEQ ID NO: 33515 - RNA, 19 nt, Homo sapiens
uucacuggcugcuccauga

SEQ ID NO: 33516 - RNA, 19 nt, Homo sapiens
ugagacagaaucuugaucu

SEQ ID NO: 33517 - RNA, 19 nt, Homo sapiens
ucuagccauugacucauga

SEQ ID NO: 33518 - RNA, 19 nt, Homo sapiens
gacacagagaagaacauuu

SEQ ID NO: 33519 - RNA, 19 nt, Homo sapiens
gauggagagugugugaaac

SEQ ID NO: 33520 - RNA, 19 nt, Homo sapiens
ccagaaagcuguugaauaa

SEQ ID NO: 33521 - RNA, 19 nt, Homo sapiens
gaacuuacuuucuggguuu

SEQ ID NO: 33522 - RNA, 19 nt, Homo sapiens
gaacaugaacagucugaaa

SEQ ID NO: 33523 - RNA, 19 nt, Homo sapiens
gaacugacacagagaagaa

SEQ ID NO: 33524 - RNA, 19 nt, Homo sapiens
ggagggaacuuacuuucug

SEQ ID NO: 33525 - RNA, 19 nt, Homo sapiens
uaucuaagcugacauugga

SEQ ID NO: 33526 - RNA, 19 nt, Homo sapiens
ggagugaauuugucccauu

SEQ ID NO: 33527 - RNA, 19 nt, Homo sapiens
ggcauuacguuucuaggua

SEQ ID NO: 33528 - RNA, 19 nt, Homo sapiens
gaaguuacaauccuaauca

SEQ ID NO: 33529 - RNA, 19 nt, Homo sapiens
gagcaugaaugagcuuaaa

SEQ ID NO: 33530 - RNA, 19 nt, Homo sapiens
gggaagccaucuugaauuc

SEQ ID NO: 33531 - RNA, 19 nt, Homo sapiens
ccacugcacuuagcacuuu

SEQ ID NO: 33532 - RNA, 19 nt, Homo sapiens
caucagaccucccuaccuu

SEQ ID NO: 33533 - RNA, 19 nt, Homo sapiens
gcacauuuacuccuaacua

SEQ ID NO: 33534 - RNA, 19 nt, Homo sapiens
ccaaguagcugggauuaca

SEQ ID NO: 33535 - RNA, 19 nt, Homo sapiens
ggacugcugugaaaucaag

SEQ ID NO: 33536 - RNA, 19 nt, Homo sapiens
gggaagaagucaagagaag

SEQ ID NO: 33537 - RNA, 19 nt, Homo sapiens
gcugugaaaucaagaaauc

SEQ ID NO: 33538 - RNA, 19 nt, Homo sapiens
aaacagaaauagacacaca

SEQ ID NO: 33539 - RNA, 19 nt, Homo sapiens
gcacugggccaccucauug

SEQ ID NO: 33540 - RNA, 19 nt, Homo sapiens
cuagguaucagcacauuua

SEQ ID NO: 33541 - RNA, 19 nt, Homo sapiens
ccaggaaacuaagauuuga

SEQ ID NO: 33542 - RNA, 19 nt, Homo sapiens
ucucaaauuuagcaccuua

SEQ ID NO: 33543 - RNA, 19 nt, Homo sapiens
gaagaacugacacagagaa

SEQ ID NO: 33544 - RNA, 19 nt, Homo sapiens
gggcugcucugcuuuaugg

SEQ ID NO: 33545 - RNA, 19 nt, Homo sapiens
gguagaaucugggagugaa

SEQ ID NO: 33546 - RNA, 19 nt, Homo sapiens
gaagcaaagccuagauaug

SEQ ID NO: 33547 - RNA, 19 nt, Homo sapiens
guuaaaagcugcuguagau

SEQ ID NO: 33548 - RNA, 19 nt, Homo sapiens
guagagaggugggauagag

SEQ ID NO: 33549 - RNA, 19 nt, Homo sapiens
agagaagccuccacagaga

SEQ ID NO: 33550 - RNA, 19 nt, Homo sapiens
gaaaucaucguaggagguu

SEQ ID NO: 33551 - RNA, 19 nt, Homo sapiens
gaaaucaagaaaucggaaa

SEQ ID NO: 33552 - RNA, 19 nt, Homo sapiens
aaaagcugcuguagauuua

SEQ ID NO: 33553 - RNA, 19 nt, Homo sapiens
accaauagaucuuuguuug

SEQ ID NO: 33554 - RNA, 19 nt, Homo sapiens
ugagugaucuugcuguauc

SEQ ID NO: 33555 - RNA, 19 nt, Homo sapiens
gauaaggaaccucggcaaa

SEQ ID NO: 33556 - RNA, 19 nt, Homo sapiens
ggagugcaguggcaugauc

SEQ ID NO: 33557 - RNA, 19 nt, Homo sapiens
acucgugguucucaaauuu

SEQ ID NO: 33558 - RNA, 19 nt, Homo sapiens
ggaagcaaagccuagauau

SEQ ID NO: 33559 - RNA, 19 nt, Homo sapiens
gcauaaaugaggaucuuga

SEQ ID NO: 33560 - RNA, 19 nt, Homo sapiens
ccaaagugcugggauuaca

SEQ ID NO: 33561 - RNA, 19 nt, Homo sapiens
gaagagacaggagaucaga

SEQ ID NO: 33562 - RNA, 19 nt, Homo sapiens
caagagagggucccaguca

SEQ ID NO: 33563 - RNA, 19 nt, Homo sapiens
ggagauggagaguguguga

SEQ ID NO: 33564 - RNA, 19 nt, Homo sapiens
gagagacccuugggaucaa

SEQ ID NO: 33565 - RNA, 19 nt, Homo sapiens
augaggaucuugagguuaa

SEQ ID NO: 33566 - RNA, 19 nt, Homo sapiens
aaaugaggaucuugagguu

SEQ ID NO: 33567 - RNA, 19 nt, Homo sapiens
gagggacccaggaaacuaa

SEQ ID NO: 33568 - RNA, 19 nt, Homo sapiens
ggaggagggaacuuacuuu

SEQ ID NO: 33569 - RNA, 19 nt, Homo sapiens
gguaaagucgacuauauuc

SEQ ID NO: 33570 - RNA, 19 nt, Homo sapiens
gcagaggucaggagacuca

SEQ ID NO: 33571 - RNA, 19 nt, Homo sapiens
ggagggacccaggaaacua

SEQ ID NO: 33572 - RNA, 19 nt, Homo sapiens
aaauuuagcaccuuacaga

SEQ ID NO: 33573 - RNA, 19 nt, Homo sapiens
ggaccaauuuucaaacuug

SEQ ID NO: 33574 - RNA, 19 nt, Homo sapiens
gcacguuuauagggaagaa

SEQ ID NO: 33575 - RNA, 19 nt, Homo sapiens
gcugggagguggacaaggu

SEQ ID NO: 33576 - RNA, 19 nt, Homo sapiens
cagggaaguuacaauccua

SEQ ID NO: 33577 - RNA, 19 nt, Homo sapiens
ggugucagcccauuuggaa

SEQ ID NO: 33578 - RNA, 19 nt, Homo sapiens
gcaguguucacaauccuuu

SEQ ID NO: 33579 - RNA, 19 nt, Homo sapiens
cgacagccgucagacauca

SEQ ID NO: 33580 - RNA, 19 nt, Homo sapiens
guuacaauccuaaucauuc

SEQ ID NO: 33581 - RNA, 19 nt, Homo sapiens
gcccuaggcagccagauaa

SEQ ID NO: 33582 - RNA, 19 nt, Homo sapiens
ggagguggacaaggugaua

SEQ ID NO: 33583 - RNA, 19 nt, Homo sapiens
gaaagacuaccaaaaucua

SEQ ID NO: 33584 - RNA, 19 nt, Homo sapiens
ccagagaagccuccacaga

SEQ ID NO: 33585 - RNA, 19 nt, Homo sapiens
ccacagcguccuugguaaa

SEQ ID NO: 33586 - RNA, 19 nt, Homo sapiens
gaccuuggacugucuacaa

SEQ ID NO: 33587 - RNA, 19 nt, Homo sapiens
gaguggaggagggaacuua

SEQ ID NO: 33588 - RNA, 19 nt, Homo sapiens
gugcugaggugccugucuu

SEQ ID NO: 33589 - RNA, 19 nt, Homo sapiens
gagcaagcccuggucaaug

SEQ ID NO: 33590 - RNA, 19 nt, Homo sapiens
agaaagcuguugaauaagc

SEQ ID NO: 33591 - RNA, 19 nt, Homo sapiens
uugguaaagucgacuauau

SEQ ID NO: 33592 - RNA, 19 nt, Homo sapiens
gcucucaacaggcacguuu

SEQ ID NO: 33593 - RNA, 19 nt, Homo sapiens
gcagggaaguuacaauccu

SEQ ID NO: 33594 - RNA, 19 nt, Homo sapiens
ggagcaagcccuggucaau

SEQ ID NO: 33595 - RNA, 19 nt, Homo sapiens
cccagaaagcuguugaaua

SEQ ID NO: 33596 - RNA, 19 nt, Homo sapiens
ccaccacgcccagcuaauu

SEQ ID NO: 33597 - RNA, 19 nt, Homo sapiens
ggguauauuuccuccuuca

SEQ ID NO: 33598 - RNA, 19 nt, Homo sapiens
gcacgggaagccaucuuga

SEQ ID NO: 33599 - RNA, 19 nt, Homo sapiens
uaaaagcugcuguagauuu

SEQ ID NO: 33600 - RNA, 19 nt, Homo sapiens
gcagagacagaaacagcaa

SEQ ID NO: 33601 - RNA, 19 nt, Homo sapiens
aagcaaagccuagauaugg

SEQ ID NO: 33602 - RNA, 19 nt, Homo sapiens
guccacagcguccuuggua

SEQ ID NO: 33603 - RNA, 19 nt, Homo sapiens
gggcagaggucaggagacu

SEQ ID NO: 33604 - RNA, 19 nt, Homo sapiens
aagcugcuguagauuuauu

SEQ ID NO: 33605 - RNA, 19 nt, Homo sapiens
gugcccaucuagccauuga

SEQ ID NO: 33606 - RNA, 19 nt, Homo sapiens
guauauuuccuccuucaga

SEQ ID NO: 33607 - RNA, 19 nt, Homo sapiens
agagacagaaacagcaaua

SEQ ID NO: 33608 - RNA, 19 nt, Homo sapiens
gcaaggguccagagcagau

SEQ ID NO: 33609 - RNA, 19 nt, Homo sapiens
gaggagcaccacucacuuc

SEQ ID NO: 33610 - RNA, 19 nt, Homo sapiens
cgagagacccuugggauca

SEQ ID NO: 33611 - RNA, 19 nt, Homo sapiens
ucaacaggcacguuuauag

SEQ ID NO: 33612 - RNA, 19 nt, Homo sapiens
gaggagggaauuauuagca

SEQ ID NO: 33613 - RNA, 19 nt, Homo sapiens
ggaaguuacaauccuaauc

SEQ ID NO: 33614 - RNA, 19 nt, Homo sapiens
uccagggacugcugugaaa

SEQ ID NO: 33615 - RNA, 19 nt, Homo sapiens
caggcucucugucagcauu

SEQ ID NO: 33616 - RNA, 19 nt, Homo sapiens
gcuuagacaugggagcuau

SEQ ID NO: 33617 - RNA, 19 nt, Homo sapiens
cagccacucugcuuagaca

SEQ ID NO: 33618 - RNA, 19 nt, Homo sapiens
ccacuggcuggaccaauuu

SEQ ID NO: 33619 - RNA, 19 nt, Homo sapiens
gacgcuggccuuccucgua

SEQ ID NO: 33620 - RNA, 19 nt, Homo sapiens
gaacgcagcugugaccuuu

SEQ ID NO: 33621 - RNA, 19 nt, Homo sapiens
gcaaacaggucuucagcaa

SEQ ID NO: 33622 - RNA, 19 nt, Homo sapiens
aagcagagauuauuuguga

SEQ ID NO: 33623 - RNA, 19 nt, Homo sapiens
cuacaaaucugaaagacaa

SEQ ID NO: 33624 - RNA, 19 nt, Homo sapiens
gcacauaugucaugauggu

SEQ ID NO: 33625 - RNA, 19 nt, Homo sapiens
aaacaggucuucagcaaug

SEQ ID NO: 33626 - RNA, 19 nt, Homo sapiens
gagcacauaugucaugaug

SEQ ID NO: 33627 - RNA, 19 nt, Homo sapiens
uagcaaagauccaggaaau

SEQ ID NO: 33628 - RNA, 19 nt, Homo sapiens
cagcagacaucuacaaauc

SEQ ID NO: 33629 - RNA, 19 nt, Homo sapiens
gaacagaggcgcuggugau

SEQ ID NO: 33630 - RNA, 19 nt, Homo sapiens
ccaccuaccuuccugauca

SEQ ID NO: 33631 - RNA, 19 nt, Homo sapiens
gcccauaugguucuaaaua

SEQ ID NO: 33632 - RNA, 19 nt, Homo sapiens
gcaaagauccaggaaauac

SEQ ID NO: 33633 - RNA, 19 nt, Homo sapiens
cccauaugguucuaaauaa

SEQ ID NO: 33634 - RNA, 19 nt, Homo sapiens
gagaguuccuggccgaguu

SEQ ID NO: 33635 - RNA, 19 nt, Homo sapiens
gaaauacugcagaggaaga

SEQ ID NO: 33636 - RNA, 19 nt, Homo sapiens
guaugaagaccacgggaua

SEQ ID NO: 33637 - RNA, 19 nt, Homo sapiens
caagaugcgcuguaacuga

SEQ ID NO: 33638 - RNA, 19 nt, Homo sapiens
gcacuucuaagcagagauu

SEQ ID NO: 33639 - RNA, 19 nt, Homo sapiens
ggaagauggugcgagaguu

SEQ ID NO: 33640 - RNA, 19 nt, Homo sapiens
gaagauggugcgagaguuc

SEQ ID NO: 33641 - RNA, 19 nt, Homo sapiens
gagaaucagagacauuuca

SEQ ID NO: 33642 - RNA, 19 nt, Homo sapiens
ggagcuaccuuggugucaa

SEQ ID NO: 33643 - RNA, 19 nt, Homo sapiens
ggaggaacaagaucaagau

SEQ ID NO: 33644 - RNA, 19 nt, Homo sapiens
gcagagauuauuugugauc

SEQ ID NO: 33645 - RNA, 19 nt, Homo sapiens
ggaggauucuguggcguau

SEQ ID NO: 33646 - RNA, 19 nt, Homo sapiens
cauaugucaugaugguauu

SEQ ID NO: 33647 - RNA, 19 nt, Homo sapiens
cagaggcgcuggugauagg

SEQ ID NO: 33648 - RNA, 19 nt, Homo sapiens
aggauucuguggcguauga

SEQ ID NO: 33649 - RNA, 19 nt, Homo sapiens
ucacggaccaggagaacaa

SEQ ID NO: 33650 - RNA, 19 nt, Homo sapiens
caucuacagucucuucuac

SEQ ID NO: 33651 - RNA, 19 nt, Homo sapiens
gcugugaccuuugcuaacu

SEQ ID NO: 33652 - RNA, 19 nt, Homo sapiens
cuaccuuggugucaacuug

SEQ ID NO: 33653 - RNA, 19 nt, Homo sapiens
ugugagcccugccaacaga

SEQ ID NO: 33654 - RNA, 19 nt, Homo sapiens
agaucaagaugcgcuguaa

SEQ ID NO: 33655 - RNA, 19 nt, Homo sapiens
gaaguuuccggucuaugug

SEQ ID NO: 33656 - RNA, 19 nt, Homo sapiens
aggaaauacugcagaggaa

SEQ ID NO: 33657 - RNA, 19 nt, Homo sapiens
gagcacuucuaagcagaga

SEQ ID NO: 33658 - RNA, 19 nt, Homo sapiens
cuaccuuccugaucacaug

SEQ ID NO: 33659 - RNA, 19 nt, Homo sapiens
gaugcgcuguaacugagaa

SEQ ID NO: 33660 - RNA, 19 nt, Homo sapiens
ggacagucacggaggaaca

SEQ ID NO: 33661 - RNA, 19 nt, Homo sapiens
caucuacaaaucugaaaga

SEQ ID NO: 33662 - RNA, 19 nt, Homo sapiens
acacggccauucuccacuu

SEQ ID NO: 33663 - RNA, 19 nt, Homo sapiens
cagcugugaccuuugcuaa

SEQ ID NO: 33664 - RNA, 19 nt, Homo sapiens
gagcuaccuuggugucaac

SEQ ID NO: 33665 - RNA, 19 nt, Homo sapiens
cuucuaagcagagauuauu

SEQ ID NO: 33666 - RNA, 19 nt, Homo sapiens
ccaaggcggaggcugagaa

SEQ ID NO: 33667 - RNA, 19 nt, Homo sapiens
ugaaauuggaggauucugu

SEQ ID NO: 33668 - RNA, 19 nt, Homo sapiens
cuaucuagguggcaucauc

SEQ ID NO: 33669 - RNA, 19 nt, Homo sapiens
cacaggauaugccaucaac

SEQ ID NO: 33670 - RNA, 19 nt, Homo sapiens
ucacggaggaacaagauca

SEQ ID NO: 33671 - RNA, 19 nt, Homo sapiens
ccgaguucaugagcacaua

SEQ ID NO: 33672 - RNA, 19 nt, Homo sapiens
caaacaggucuucagcaau

SEQ ID NO: 33673 - RNA, 19 nt, Homo sapiens
gauagcaaagauccaggaa

SEQ ID NO: 33674 - RNA, 19 nt, Homo sapiens
ccugguccgugauagcaaa

SEQ ID NO: 33675 - RNA, 19 nt, Homo sapiens
gaggaacaagaucaagaug

SEQ ID NO: 33676 - RNA, 19 nt, Homo sapiens
ucaucuaccuggucuucau

SEQ ID NO: 33677 - RNA, 19 nt, Homo sapiens
ggucuccugguccgugaua

SEQ ID NO: 33678 - RNA, 19 nt, Homo sapiens
ucuaagcagagauuauuug

SEQ ID NO: 33679 - RNA, 19 nt, Homo sapiens
ccauggcccuagagcacuu

SEQ ID NO: 33680 - RNA, 19 nt, Homo sapiens
gggugucccuuggcaugaa

SEQ ID NO: 33681 - RNA, 19 nt, Homo sapiens
gcagcugugaccuuugcua

SEQ ID NO: 33682 - RNA, 19 nt, Homo sapiens
gguccgugauagcaaagau

SEQ ID NO: 33683 - RNA, 19 nt, Homo sapiens
uaaccguauugcccaagau

SEQ ID NO: 33684 - RNA, 19 nt, Homo sapiens
agacaucuacaaaucugaa

SEQ ID NO: 33685 - RNA, 19 nt, Homo sapiens
uaugaagaccacgggauaa

SEQ ID NO: 33686 - RNA, 19 nt, Homo sapiens
aggcggaggcugagaauca

SEQ ID NO: 33687 - RNA, 19 nt, Homo sapiens
uggcccauaugguucuaaa

SEQ ID NO: 33688 - RNA, 19 nt, Homo sapiens
aaagauccaggaaauacug

SEQ ID NO: 33689 - RNA, 19 nt, Homo sapiens
cuaagcagagauuauuugu

SEQ ID NO: 33690 - RNA, 19 nt, Homo sapiens
cggaggaacaagaucaaga

SEQ ID NO: 33691 - RNA, 19 nt, Homo sapiens
acauaugucaugaugguau

SEQ ID NO: 33692 - RNA, 19 nt, Homo sapiens
caucaucuaccuggucuuc

SEQ ID NO: 33693 - RNA, 19 nt, Homo sapiens
ggcaugaacacaggauaug

SEQ ID NO: 33694 - RNA, 19 nt, Homo sapiens
caaagauccaggaaauacu

SEQ ID NO: 33695 - RNA, 19 nt, Homo sapiens
ccugaucacaugacauugu

SEQ ID NO: 33696 - RNA, 19 nt, Homo sapiens
ggaaagugguagcaauuua

SEQ ID NO: 33697 - RNA, 19 nt, Homo sapiens
cgacugugcuuguccauua

SEQ ID NO: 33698 - RNA, 19 nt, Homo sapiens
gaagcuaccuggauauuuc

SEQ ID NO: 33699 - RNA, 19 nt, Homo sapiens
aaagaucgccuaugaguua

SEQ ID NO: 33700 - RNA, 19 nt, Homo sapiens
cagcagaaauuaaauguga

SEQ ID NO: 33701 - RNA, 19 nt, Homo sapiens
gaagauaaguugaguuguc

SEQ ID NO: 33702 - RNA, 19 nt, Homo sapiens
gaacagacauuugacaagu

SEQ ID NO: 33703 - RNA, 19 nt, Homo sapiens
caacccagcugugucuuua

SEQ ID NO: 33704 - RNA, 19 nt, Homo sapiens
ggaaaccauuuaucagauu

SEQ ID NO: 33705 - RNA, 19 nt, Homo sapiens
cgacaaagauuacauucug

SEQ ID NO: 33706 - RNA, 19 nt, Homo sapiens
gaaggaaagugguagcaau

SEQ ID NO: 33707 - RNA, 19 nt, Homo sapiens
gaaagugguagcaauuuaa

SEQ ID NO: 33708 - RNA, 19 nt, Homo sapiens
ggacaaaccagagaaauau

SEQ ID NO: 33709 - RNA, 19 nt, Homo sapiens
ggaugcaccuucagucaaa

SEQ ID NO: 33710 - RNA, 19 nt, Homo sapiens
caaccaaacccuaaauuga

SEQ ID NO: 33711 - RNA, 19 nt, Homo sapiens
acagacauuugacaaguua

SEQ ID NO: 33712 - RNA, 19 nt, Homo sapiens
ggucaucacuaucaauguu

SEQ ID NO: 33713 - RNA, 19 nt, Homo sapiens
gaacgcauuugcagaucaa

SEQ ID NO: 33714 - RNA, 19 nt, Homo sapiens
gacaaaagaucgccuauga

SEQ ID NO: 33715 - RNA, 19 nt, Homo sapiens
gaacagcagaaauuaaaug

SEQ ID NO: 33716 - RNA, 19 nt, Homo sapiens
cgaaagaaacccucucuga

SEQ ID NO: 33717 - RNA, 19 nt, Homo sapiens
ugacuuauguucuacaauc

SEQ ID NO: 33718 - RNA, 19 nt, Homo sapiens
cagaacagcagaaauuaaa

SEQ ID NO: 33719 - RNA, 19 nt, Homo sapiens
uaucagaacagcagaaauu

SEQ ID NO: 33720 - RNA, 19 nt, Homo sapiens
caacugcuuugugcugaua

SEQ ID NO: 33721 - RNA, 19 nt, Homo sapiens
cacugaaaguugaauguua

SEQ ID NO: 33722 - RNA, 19 nt, Homo sapiens
gcaaccgucuuuggcauuu

SEQ ID NO: 33723 - RNA, 19 nt, Homo sapiens
gaagagcagcuuagcgaaa

SEQ ID NO: 33724 - RNA, 19 nt, Homo sapiens
gggaggacauuguggcauu

SEQ ID NO: 33725 - RNA, 19 nt, Homo sapiens
gagacaagaugaauuugag

SEQ ID NO: 33726 - RNA, 19 nt, Homo sapiens
caacagguagguauuggua

SEQ ID NO: 33727 - RNA, 19 nt, Homo sapiens
gcaccaaacauuacauuca

SEQ ID NO: 33728 - RNA, 19 nt, Homo sapiens
gcacguucaucuugauugu

SEQ ID NO: 33729 - RNA, 19 nt, Homo sapiens
ggaauuggcagcuucuaga

SEQ ID NO: 33730 - RNA, 19 nt, Homo sapiens
ugccaaaucuuccuugcua

SEQ ID NO: 33731 - RNA, 19 nt, Homo sapiens
gacaaagauuacauucuga

SEQ ID NO: 33732 - RNA, 19 nt, Homo sapiens
ccagacaucuccaggaauc

SEQ ID NO: 33733 - RNA, 19 nt, Homo sapiens
uaaguugaguuguccaaga

SEQ ID NO: 33734 - RNA, 19 nt, Homo sapiens
ggagacaagaugaauuuga

SEQ ID NO: 33735 - RNA, 19 nt, Homo sapiens
gaccacuucucuaccauug

SEQ ID NO: 33736 - RNA, 19 nt, Homo sapiens
aagaaacccucucugaguu

SEQ ID NO: 33737 - RNA, 19 nt, Homo sapiens
ucugaugacuuauguucua

SEQ ID NO: 33738 - RNA, 19 nt, Homo sapiens
gcucagcucuggauuugca

SEQ ID NO: 33739 - RNA, 19 nt, Homo sapiens
gaguacagaugaaggaaag

SEQ ID NO: 33740 - RNA, 19 nt, Homo sapiens
gggaagauaaguugaguug

SEQ ID NO: 33741 - RNA, 19 nt, Homo sapiens
caggagacaagaugaauuu

SEQ ID NO: 33742 - RNA, 19 nt, Homo sapiens
gcuacuggauuuguauaaa

SEQ ID NO: 33743 - RNA, 19 nt, Homo sapiens
agaacaaucugaggacaaa

SEQ ID NO: 33744 - RNA, 19 nt, Homo sapiens
cuaagugucuguguucuug

SEQ ID NO: 33745 - RNA, 19 nt, Homo sapiens
gaacucagugucaucaugu

SEQ ID NO: 33746 - RNA, 19 nt, Homo sapiens
agagaaauaugaacucagu

SEQ ID NO: 33747 - RNA, 19 nt, Homo sapiens
gccaucggccuccugauua

SEQ ID NO: 33748 - RNA, 19 nt, Homo sapiens
uagaggacaccaauuaauu

SEQ ID NO: 33749 - RNA, 19 nt, Homo sapiens
gggaauucuugcuagguaa

SEQ ID NO: 33750 - RNA, 19 nt, Homo sapiens
gaaaagcaucugcauaaaa

SEQ ID NO: 33751 - RNA, 19 nt, Homo sapiens
gaaguggaauuggcagcuu

SEQ ID NO: 33752 - RNA, 19 nt, Homo sapiens
cccuugaaguucucuaaua

SEQ ID NO: 33753 - RNA, 19 nt, Homo sapiens
auuggcagcuucuagaaua

SEQ ID NO: 33754 - RNA, 19 nt, Homo sapiens
gagaacagacauuugacaa

SEQ ID NO: 33755 - RNA, 19 nt, Homo sapiens
ccgcuaugcuacuggauuu

SEQ ID NO: 33756 - RNA, 19 nt, Homo sapiens
gguuucagcugcacuaucu

SEQ ID NO: 33757 - RNA, 19 nt, Homo sapiens
gcaucuaagugucuguguu

SEQ ID NO: 33758 - RNA, 19 nt, Homo sapiens
caucuauguucuugucauu

SEQ ID NO: 33759 - RNA, 19 nt, Homo sapiens
gaaacaacuucugguggau

SEQ ID NO: 33760 - RNA, 19 nt, Homo sapiens
gaugacuuauguucuacaa

SEQ ID NO: 33761 - RNA, 19 nt, Homo sapiens
cuucagagcuggaaacaac

SEQ ID NO: 33762 - RNA, 19 nt, Homo sapiens
cacuaucaauguuggauuu

SEQ ID NO: 33763 - RNA, 19 nt, Homo sapiens
uaccagacaucuccaggaa

SEQ ID NO: 33764 - RNA, 19 nt, Homo sapiens
ggaaaagcaucugcauaaa

SEQ ID NO: 33765 - RNA, 19 nt, Homo sapiens
ccagagaaauaugaacuca

SEQ ID NO: 33766 - RNA, 19 nt, Homo sapiens
agucgcagauucaaacaaa

SEQ ID NO: 33767 - RNA, 19 nt, Homo sapiens
gcauuagguuucccaacug

SEQ ID NO: 33768 - RNA, 19 nt, Homo sapiens
ucuauguucuugucauuga

SEQ ID NO: 33769 - RNA, 19 nt, Homo sapiens
aaagaaacccucucugagu

SEQ ID NO: 33770 - RNA, 19 nt, Homo sapiens
agaggacaccaauuaauuu

SEQ ID NO: 33771 - RNA, 19 nt, Homo sapiens
gcaggagacaagaugaauu

SEQ ID NO: 33772 - RNA, 19 nt, Homo sapiens
cauaugggacaucuaauug

SEQ ID NO: 33773 - RNA, 19 nt, Homo sapiens
ccauaugggacaucuaauu

SEQ ID NO: 33774 - RNA, 19 nt, Homo sapiens
caaccgucuuuggcauuua

SEQ ID NO: 33775 - RNA, 19 nt, Homo sapiens
cuggauauuuccuauuuga

SEQ ID NO: 33776 - RNA, 19 nt, Homo sapiens
guacaccucuggacaaaau

SEQ ID NO: 33777 - RNA, 19 nt, Homo sapiens
gaauuggcagcuucuagaa

SEQ ID NO: 33778 - RNA, 19 nt, Homo sapiens
ugggaauucuugcuaggua

SEQ ID NO: 33779 - RNA, 19 nt, Homo sapiens
cuuugaagcuaccuggaua

SEQ ID NO: 33780 - RNA, 19 nt, Homo sapiens
ggcauuagguuucccaacu

SEQ ID NO: 33781 - RNA, 19 nt, Homo sapiens
gauacaaagacccucauug

SEQ ID NO: 33782 - RNA, 19 nt, Homo sapiens
ucgcagauucaaacaaaua

SEQ ID NO: 33783 - RNA, 19 nt, Homo sapiens
ccaaccaaacccuaaauug

SEQ ID NO: 33784 - RNA, 19 nt, Homo sapiens
ccacuucucuaccauuguc

SEQ ID NO: 33785 - RNA, 19 nt, Homo sapiens
uuacuaugauggacuuaug

SEQ ID NO: 33786 - RNA, 19 nt, Homo sapiens
gugaggaccacaacaggua

SEQ ID NO: 33787 - RNA, 19 nt, Homo sapiens
ucagaacagcagaaauuaa

SEQ ID NO: 33788 - RNA, 19 nt, Homo sapiens
caagagcacacugaaaguu

SEQ ID NO: 33789 - RNA, 19 nt, Homo sapiens
uuaauuuccuggucuuuag

SEQ ID NO: 33790 - RNA, 19 nt, Homo sapiens
caauuaauuuccuggucuu

SEQ ID NO: 33791 - RNA, 19 nt, Homo sapiens
ggacaccaauuaauuuccu

SEQ ID NO: 33792 - RNA, 19 nt, Homo sapiens
aaccaaacccuaaauugaa

SEQ ID NO: 33793 - RNA, 19 nt, Homo sapiens
aagauuacauucugaguac

SEQ ID NO: 33794 - RNA, 19 nt, Homo sapiens
uggaaacaaugaccacuuc

SEQ ID NO: 33795 - RNA, 19 nt, Homo sapiens
ugaacucagugucaucaug

SEQ ID NO: 33796 - RNA, 19 nt, Homo sapiens
ggaaguagguggaagauuc

SEQ ID NO: 33797 - RNA, 19 nt, Homo sapiens
cgagagagcugcaucaguu

SEQ ID NO: 33798 - RNA, 19 nt, Homo sapiens
ggaacucgaucguaucauu

SEQ ID NO: 33799 - RNA, 19 nt, Homo sapiens
caagggagguuacaccaaa

SEQ ID NO: 33800 - RNA, 19 nt, Homo sapiens
ccacacaaacguuuacuua

SEQ ID NO: 33801 - RNA, 19 nt, Homo sapiens
gaaacuugguaaucugaaa

SEQ ID NO: 33802 - RNA, 19 nt, Homo sapiens
gaagaaacuugguaaucug

SEQ ID NO: 33803 - RNA, 19 nt, Homo sapiens
ucaaggaacucgaucguau

SEQ ID NO: 33804 - RNA, 19 nt, Homo sapiens
gaaaugauugcacuauuga

SEQ ID NO: 33805 - RNA, 19 nt, Homo sapiens
gcacuucgaccauuucuga

SEQ ID NO: 33806 - RNA, 19 nt, Homo sapiens
gaucaucucugugcaagug

SEQ ID NO: 33807 - RNA, 19 nt, Homo sapiens
gcagucaggucuucaguag

SEQ ID NO: 33808 - RNA, 19 nt, Homo sapiens
gagcugcccuuuccucuuc

SEQ ID NO: 33809 - RNA, 19 nt, Homo sapiens
agaaaugauugcacuauug

SEQ ID NO: 33810 - RNA, 19 nt, Homo sapiens
gaagaaggccaguuguaug

SEQ ID NO: 33811 - RNA, 19 nt, Homo sapiens
acacaaacguuuacuuauc

SEQ ID NO: 33812 - RNA, 19 nt, Homo sapiens
cauggcaccuucagacuuu

SEQ ID NO: 33813 - RNA, 19 nt, Homo sapiens
gaaucuacccuucaaguau

SEQ ID NO: 33814 - RNA, 19 nt, Homo sapiens
gcaaggaaagugccuggua

SEQ ID NO: 33815 - RNA, 19 nt, Homo sapiens
ccgaggagcuuuccagaau

SEQ ID NO: 33816 - RNA, 19 nt, Homo sapiens
cagaagaccugccugaucu

SEQ ID NO: 33817 - RNA, 19 nt, Homo sapiens
ugaagaaacuugguaaucu

SEQ ID NO: 33818 - RNA, 19 nt, Homo sapiens
cagaaaugauugcacuauu

SEQ ID NO: 33819 - RNA, 19 nt, Homo sapiens
gaaagucaagcccaucuau

SEQ ID NO: 33820 - RNA, 19 nt, Homo sapiens
caagagcacugaagauacu

SEQ ID NO: 33821 - RNA, 19 nt, Homo sapiens
gguguuguaugccuuuaaa

SEQ ID NO: 33822 - RNA, 19 nt, Homo sapiens
ggcaagagcacugaagaua

SEQ ID NO: 33823 - RNA, 19 nt, Homo sapiens
cuauggagcucucacaugu

SEQ ID NO: 33824 - RNA, 19 nt, Homo sapiens
aaucuacccuucaaguauu

SEQ ID NO: 33825 - RNA, 19 nt, Homo sapiens
gaacucgaucguaucauug

SEQ ID NO: 33826 - RNA, 19 nt, Homo sapiens
gaacuucgaaugaacuaca

SEQ ID NO: 33827 - RNA, 19 nt, Homo sapiens
agacuuugcuucccauugu

SEQ ID NO: 33828 - RNA, 19 nt, Homo sapiens
guugaacucuucugagcaa

SEQ ID NO: 33829 - RNA, 19 nt, Homo sapiens
ccagauggcugucauucag

SEQ ID NO: 33830 - RNA, 19 nt, Homo sapiens
ggagagagacagcuuguac

SEQ ID NO: 33831 - RNA, 19 nt, Homo sapiens
gcagaaaugauugcacuau

SEQ ID NO: 33832 - RNA, 19 nt, Homo sapiens
gcccauugacuauuacuuu

SEQ ID NO: 33833 - RNA, 19 nt, Homo sapiens
augcaaagguucucugcua

SEQ ID NO: 33834 - RNA, 19 nt, Homo sapiens
cacaaacguuuacuuaucu

SEQ ID NO: 33835 - RNA, 19 nt, Homo sapiens
caaccagcccgacuccuuu

SEQ ID NO: 33836 - RNA, 19 nt, Homo sapiens
cagcccaucuuucugaaug

SEQ ID NO: 33837 - RNA, 19 nt, Homo sapiens
gcugcaaggucuucuucaa

SEQ ID NO: 33838 - RNA, 19 nt, Homo sapiens
uuuggaagguggaggauuu

SEQ ID NO: 33839 - RNA, 19 nt, Homo sapiens
gaggagcuuuccagaaucu

SEQ ID NO: 33840 - RNA, 19 nt, Homo sapiens
cauuguggcuccuaucugu

SEQ ID NO: 33841 - RNA, 19 nt, Homo sapiens
ggaauuccugugcaugaaa

SEQ ID NO: 33842 - RNA, 19 nt, Homo sapiens
cgaagaaggccaguuguau

SEQ ID NO: 33843 - RNA, 19 nt, Homo sapiens
cgagcuagcugcacauugc

SEQ ID NO: 33844 - RNA, 19 nt, Homo sapiens
gcaaagguucucugcuaga

SEQ ID NO: 33845 - RNA, 19 nt, Homo sapiens
gaaguagguggaagauuca

SEQ ID NO: 33846 - RNA, 19 nt, Homo sapiens
gaauuccugugcaugaaag

SEQ ID NO: 33847 - RNA, 19 nt, Homo sapiens
ggacaugcguuuggagacu

SEQ ID NO: 33848 - RNA, 19 nt, Homo sapiens
cgucuacccugucucucua

SEQ ID NO: 33849 - RNA, 19 nt, Homo sapiens
ggauggaagugcaguuagg

SEQ ID NO: 33850 - RNA, 19 nt, Homo sapiens
ggaaagucaagcccaucua

SEQ ID NO: 33851 - RNA, 19 nt, Homo sapiens
gcaagagcacugaagauac

SEQ ID NO: 33852 - RNA, 19 nt, Homo sapiens
ccgcugaccuuaaagacau

SEQ ID NO: 33853 - RNA, 19 nt, Homo sapiens
cuucuucccucccuaucua

SEQ ID NO: 33854 - RNA, 19 nt, Homo sapiens
gaugucuucugccuguuau

SEQ ID NO: 33855 - RNA, 19 nt, Homo sapiens
aagucaagcccaucuauuu

SEQ ID NO: 33856 - RNA, 19 nt, Homo sapiens
gaaugaacuacaucaagga

SEQ ID NO: 33857 - RNA, 19 nt, Homo sapiens
gcacaagucccggauguac

SEQ ID NO: 33858 - RNA, 19 nt, Homo sapiens
aagagccgcugaagggaaa

SEQ ID NO: 33859 - RNA, 19 nt, Homo sapiens
cugcuccgcugaccuuaaa

SEQ ID NO: 33860 - RNA, 19 nt, Homo sapiens
gaauuuccucuauugaugu

SEQ ID NO: 33861 - RNA, 19 nt, Homo sapiens
agauggcugucauucagua

SEQ ID NO: 33862 - RNA, 19 nt, Homo sapiens
gaaacuacaggaggaagga

SEQ ID NO: 33863 - RNA, 19 nt, Homo sapiens
ucggaaauguuaugaagca

SEQ ID NO: 33864 - RNA, 19 nt, Homo sapiens
ggaggaagcaaggaaagug

SEQ ID NO: 33865 - RNA, 19 nt, Homo sapiens
gccaaggaguuguguaagg

SEQ ID NO: 33866 - RNA, 19 nt, Homo sapiens
gcuaaucaagucacacaug

SEQ ID NO: 33867 - RNA, 19 nt, Homo sapiens
gaucuuguccaccgugugu

SEQ ID NO: 33868 - RNA, 19 nt, Homo sapiens
acauguuccugaauucuau

SEQ ID NO: 33869 - RNA, 19 nt, Homo sapiens
caagugcccaagauccuuu

SEQ ID NO: 33870 - RNA, 19 nt, Homo sapiens
ggaaaugauggcagagauc

SEQ ID NO: 33871 - RNA, 19 nt, Homo sapiens
ugaacuacaucaaggaacu

SEQ ID NO: 33872 - RNA, 19 nt, Homo sapiens
uugaugaacuucgaaugaa

SEQ ID NO: 33873 - RNA, 19 nt, Homo sapiens
ccgaagaaggccaguugua

SEQ ID NO: 33874 - RNA, 19 nt, Homo sapiens
cuucaaguauuaagagaca

SEQ ID NO: 33875 - RNA, 19 nt, Homo sapiens
gccuuuaaaucugugauga

SEQ ID NO: 33876 - RNA, 19 nt, Homo sapiens
gaaugucagcccaucuuuc

SEQ ID NO: 33877 - RNA, 19 nt, Homo sapiens
ccagaagaccugccugauc

SEQ ID NO: 33878 - RNA, 19 nt, Homo sapiens
cuccaaggacaauuacuua

SEQ ID NO: 33879 - RNA, 19 nt, Homo sapiens
ggcgauccuucaccaaugu

SEQ ID NO: 33880 - RNA, 19 nt, Homo sapiens
ugagccagguguagugugu

SEQ ID NO: 33881 - RNA, 19 nt, Homo sapiens
cccggaagcugaagaaacu

SEQ ID NO: 33882 - RNA, 19 nt, Homo sapiens
auugauaaauuccgaagga

SEQ ID NO: 33883 - RNA, 19 nt, Homo sapiens
cgacagccaacgccucuug

SEQ ID NO: 33884 - RNA, 19 nt, Homo sapiens
ggagcucucacauguggaa

SEQ ID NO: 33885 - RNA, 19 nt, Homo sapiens
cggaaaugauggcagagau

SEQ ID NO: 33886 - RNA, 19 nt, Homo sapiens
caaagguucucugcuagac

SEQ ID NO: 33887 - RNA, 19 nt, Homo sapiens
gcuaccugguccuggauga

SEQ ID NO: 33888 - RNA, 19 nt, Homo sapiens
uuauaacucugcacuacuc

SEQ ID NO: 33889 - RNA, 19 nt, Homo sapiens
ggacugacggcugccuuug

SEQ ID NO: 33890 - RNA, 19 nt, Homo sapiens
uggagaacccgcuggacua

SEQ ID NO: 33891 - RNA, 19 nt, Homo sapiens
gcuccuaucuguguuuuga

SEQ ID NO: 33892 - RNA, 19 nt, Homo sapiens
cagccaguguguccgaaug

SEQ ID NO: 33893 - RNA, 19 nt, Homo sapiens
ggauguacagccagugugu

SEQ ID NO: 33894 - RNA, 19 nt, Homo sapiens
ggauggggcucaugguguu

SEQ ID NO: 33895 - RNA, 19 nt, Homo sapiens
gaagaccugccugaucugu

SEQ ID NO: 33896 - RNA, 19 nt, Homo sapiens
gaacaaugcucgcguagau

SEQ ID NO: 33897 - RNA, 19 nt, Homo sapiens
gaaaggacagcauccaaua

SEQ ID NO: 33898 - RNA, 19 nt, Homo sapiens
caacaaggcaauagcauuu

SEQ ID NO: 33899 - RNA, 19 nt, Homo sapiens
ggacagaccuagagaacag

SEQ ID NO: 33900 - RNA, 19 nt, Homo sapiens
gagcaaagcccaccucagu

SEQ ID NO: 33901 - RNA, 19 nt, Homo sapiens
ggacgacccugcaguaggu

SEQ ID NO: 33902 - RNA, 19 nt, Homo sapiens
gaugaaagccagaggauca

SEQ ID NO: 33903 - RNA, 19 nt, Homo sapiens
ggaauccacacuucaauug

SEQ ID NO: 33904 - RNA, 19 nt, Homo sapiens
ggaauggccugguguuugc

SEQ ID NO: 33905 - RNA, 19 nt, Homo sapiens
acacugcgcuccaggauca

SEQ ID NO: 33906 - RNA, 19 nt, Homo sapiens
acaaggcaauagcauuuaa

SEQ ID NO: 33907 - RNA, 19 nt, Homo sapiens
ucagugaugucuucagguu

SEQ ID NO: 33908 - RNA, 19 nt, Homo sapiens
gcacagugguccgggcauu

SEQ ID NO: 33909 - RNA, 19 nt, Homo sapiens
cuggagugcuguuugguua

SEQ ID NO: 33910 - RNA, 19 nt, Homo sapiens
ggaaaggacagcauccaau

SEQ ID NO: 33911 - RNA, 19 nt, Homo sapiens
gagaaggaccguaccacuu

SEQ ID NO: 33912 - RNA, 19 nt, Homo sapiens
gcaauagcauuuaaaagga

SEQ ID NO: 33913 - RNA, 19 nt, Homo sapiens
gccaggagauagaggagaa

SEQ ID NO: 33914 - RNA, 19 nt, Homo sapiens
gagcagggcaugaaucucu

SEQ ID NO: 33915 - RNA, 19 nt, Homo sapiens
caacaaggcccaggcuuuc

SEQ ID NO: 33916 - RNA, 19 nt, Homo sapiens
ccaagugucuacauuucug

SEQ ID NO: 33917 - RNA, 19 nt, Homo sapiens
ucgcagagauggguuccua

SEQ ID NO: 33918 - RNA, 19 nt, Homo sapiens
ggaggccacugagaccaaa

SEQ ID NO: 33919 - RNA, 19 nt, Homo sapiens
guuacuggcuucucugcuu

SEQ ID NO: 33920 - RNA, 19 nt, Homo sapiens
ucauagugcuggcaaaugg

SEQ ID NO: 33921 - RNA, 19 nt, Homo sapiens
gaaggauugcaucaccaua

SEQ ID NO: 33922 - RNA, 19 nt, Homo sapiens
gcacaacaaggcaauagca

SEQ ID NO: 33923 - RNA, 19 nt, Homo sapiens
ggauacaggaggccacuga

SEQ ID NO: 33924 - RNA, 19 nt, Homo sapiens
ucaacaaggcccaggcuuu

SEQ ID NO: 33925 - RNA, 19 nt, Homo sapiens
ggcugucgcucuuuggaaa

SEQ ID NO: 33926 - RNA, 19 nt, Homo sapiens
gggaauggccugguguuug

SEQ ID NO: 33927 - RNA, 19 nt, Homo sapiens
gcacggcucaccagcucua

SEQ ID NO: 33928 - RNA, 19 nt, Homo sapiens
uggcagguguuccauucua

SEQ ID NO: 33929 - RNA, 19 nt, Homo sapiens
gaaagccagaggaucaguu

SEQ ID NO: 33930 - RNA, 19 nt, Homo sapiens
gggaauccacacuucaauu

SEQ ID NO: 33931 - RNA, 19 nt, Homo sapiens
ggccgagaaugcuaugaau

SEQ ID NO: 33932 - RNA, 19 nt, Homo sapiens
uuacuggcuucucugcuuu

SEQ ID NO: 33933 - RNA, 19 nt, Homo sapiens
gagggaauccacacuucaa

SEQ ID NO: 33934 - RNA, 19 nt, Homo sapiens
gaucauagugcuggcaaau

SEQ ID NO: 33935 - RNA, 19 nt, Homo sapiens
ucacuggccugguguacag

SEQ ID NO: 33936 - RNA, 19 nt, Homo sapiens
ucaaggugcugcagaugag

SEQ ID NO: 33937 - RNA, 19 nt, Homo sapiens
gagagaaggugggcaucgu

SEQ ID NO: 33938 - RNA, 19 nt, Homo sapiens
ggacauuccagacaaacuc

SEQ ID NO: 33939 - RNA, 19 nt, Homo sapiens
guggugcgaucucccauca

SEQ ID NO: 33940 - RNA, 19 nt, Homo sapiens
acaaugcucgcguagauga

SEQ ID NO: 33941 - RNA, 19 nt, Homo sapiens
gaggagaaggagaaacaga

SEQ ID NO: 33942 - RNA, 19 nt, Homo sapiens
cuguguaccugcuggauga

SEQ ID NO: 33943 - RNA, 19 nt, Homo sapiens
ucucacaguucucaacauc

SEQ ID NO: 33944 - RNA, 19 nt, Homo sapiens
ggccuccucuucucugugu

SEQ ID NO: 33945 - RNA, 19 nt, Homo sapiens
ggaacucgaagaccaucaa

SEQ ID NO: 33946 - RNA, 19 nt, Homo sapiens
gcaguguuccugauucaca

SEQ ID NO: 33947 - RNA, 19 nt, Homo sapiens
acgaugagcuucgcagugu

SEQ ID NO: 33948 - RNA, 19 nt, Homo sapiens
caacuggacagaccuagag

SEQ ID NO: 33949 - RNA, 19 nt, Homo sapiens
cgagagguccaucaaguca

SEQ ID NO: 33950 - RNA, 19 nt, Homo sapiens
cgaagaccaucaaguucca

SEQ ID NO: 33951 - RNA, 19 nt, Homo sapiens
acucgaagaccaucaaguu

SEQ ID NO: 33952 - RNA, 19 nt, Homo sapiens
gaacauguacaggcucaag

SEQ ID NO: 33953 - RNA, 19 nt, Homo sapiens
caaggcaauagcauuuaaa

SEQ ID NO: 33954 - RNA, 19 nt, Homo sapiens
cagaaaggcagcuguguac

SEQ ID NO: 33955 - RNA, 19 nt, Homo sapiens
caucuggagugcuguuugg

SEQ ID NO: 33956 - RNA, 19 nt, Homo sapiens
gggcguguccuucaagauc

SEQ ID NO: 33957 - RNA, 19 nt, Homo sapiens
gcaacuggacagaccuaga

SEQ ID NO: 33958 - RNA, 19 nt, Homo sapiens
caggauggccagcaggaaa

SEQ ID NO: 33959 - RNA, 19 nt, Homo sapiens
ggaucauagugcuggcaaa

SEQ ID NO: 33960 - RNA, 19 nt, Homo sapiens
ucacugccaucgcugucuu

SEQ ID NO: 33961 - RNA, 19 nt, Homo sapiens
ccggccagcugcaguacaa

SEQ ID NO: 33962 - RNA, 19 nt, Homo sapiens
ggacuuugggcuaagauac

SEQ ID NO: 33963 - RNA, 19 nt, Homo sapiens
gcuuggauucgcccucaua

SEQ ID NO: 33964 - RNA, 19 nt, Homo sapiens
aaagccagaggaucaguuu

SEQ ID NO: 33965 - RNA, 19 nt, Homo sapiens
cgcgagagguccaucaagu

SEQ ID NO: 33966 - RNA, 19 nt, Homo sapiens
uagaggagaaggagaaaca

SEQ ID NO: 33967 - RNA, 19 nt, Homo sapiens
ccaucuaccuccucuucau

SEQ ID NO: 33968 - RNA, 19 nt, Homo sapiens
gaaaggcagcuguguaccu

SEQ ID NO: 33969 - RNA, 19 nt, Homo sapiens
gcugguguccuuccaagug

SEQ ID NO: 33970 - RNA, 19 nt, Homo sapiens
caucaggaggagcaaauga

SEQ ID NO: 33971 - RNA, 19 nt, Homo sapiens
ccagugcggugggugaugu

SEQ ID NO: 33972 - RNA, 19 nt, Homo sapiens
agugaugucuucagguuca

SEQ ID NO: 33973 - RNA, 19 nt, Homo sapiens
cagagccuguaugugguua

SEQ ID NO: 33974 - RNA, 19 nt, Homo sapiens
gaugagcuucgcaguguuc

SEQ ID NO: 33975 - RNA, 19 nt, Homo sapiens
uggcuucucugcuuugucu

SEQ ID NO: 33976 - RNA, 19 nt, Homo sapiens
gaucgaguuccgggacuuu

SEQ ID NO: 33977 - RNA, 19 nt, Homo sapiens
gaaccagacagagccugaa

SEQ ID NO: 33978 - RNA, 19 nt, Homo sapiens
uaaaccgcuucuccaagga

SEQ ID NO: 33979 - RNA, 19 nt, Homo sapiens
gaucucccaucagcuucuu

SEQ ID NO: 33980 - RNA, 19 nt, Homo sapiens
ggaccguaccacuucagaa

SEQ ID NO: 33981 - RNA, 19 nt, Homo sapiens
gauagaggagaaggagaaa

SEQ ID NO: 33982 - RNA, 19 nt, Homo sapiens
ucuggcagguguuccauuc

SEQ ID NO: 33983 - RNA, 19 nt, Homo sapiens
acaacaaggcaauagcauu

SEQ ID NO: 33984 - RNA, 19 nt, Homo sapiens
aaacuccucagaagaacuu

SEQ ID NO: 33985 - RNA, 19 nt, Homo sapiens
ggagugcuguuugguuacu

SEQ ID NO: 33986 - RNA, 19 nt, Homo sapiens
uggagcggaugcaggacua

SEQ ID NO: 33987 - RNA, 19 nt, Homo sapiens
uccggucccugcugaugua

SEQ ID NO: 33988 - RNA, 19 nt, Homo sapiens
agauagaggagaaggagaa

SEQ ID NO: 33989 - RNA, 19 nt, Homo sapiens
ccagggaacaacacggauu

SEQ ID NO: 33990 - RNA, 19 nt, Homo sapiens
ggaaggauugcaucaccau

SEQ ID NO: 33991 - RNA, 19 nt, Homo sapiens
cgagaaugcuaugaaugca

SEQ ID NO: 33992 - RNA, 19 nt, Homo sapiens
ggaagacccagauccucau

SEQ ID NO: 33993 - RNA, 19 nt, Homo sapiens
gauccacgcaggagagaag

SEQ ID NO: 33994 - RNA, 19 nt, Homo sapiens
gagccugugcuuccugaga

SEQ ID NO: 33995 - RNA, 19 nt, Homo sapiens
cacccuggcuggagagagu

SEQ ID NO: 33996 - RNA, 19 nt, Homo sapiens
gaaccucucuggaauuugu

SEQ ID NO: 33997 - RNA, 19 nt, Homo sapiens
ggacuccucucuuucuuca

SEQ ID NO: 33998 - RNA, 19 nt, Homo sapiens
ggaaguccuuggccgauga

SEQ ID NO: 33999 - RNA, 19 nt, Homo sapiens
cagcugaggugauccguau

SEQ ID NO: 34000 - RNA, 19 nt, Homo sapiens
gaucucaagucuaacaaca

SEQ ID NO: 34001 - RNA, 19 nt, Homo sapiens
accgagaucucaagucuaa

SEQ ID NO: 34002 - RNA, 19 nt, Homo sapiens
ccaccgagaucucaagucu

SEQ ID NO: 34003 - RNA, 19 nt, Homo sapiens
gaacaucauccaccgagau

SEQ ID NO: 34004 - RNA, 19 nt, Homo sapiens
aacaacaucuuccuacaug

SEQ ID NO: 34005 - RNA, 19 nt, Homo sapiens
guucgucucugcccugaug

SEQ ID NO: 34006 - RNA, 19 nt, Homo sapiens
gcuccagccucuaccauca

SEQ ID NO: 34007 - RNA, 19 nt, Homo sapiens
aaguauaccugcccaacaa

SEQ ID NO: 34008 - RNA, 19 nt, Homo sapiens
gauggcagcugaggugauc

SEQ ID NO: 34009 - RNA, 19 nt, Homo sapiens
ggcccaggcuuucaagaau

SEQ ID NO: 34010 - RNA, 19 nt, Homo sapiens
cuacgacucucuagacaag

SEQ ID NO: 34011 - RNA, 19 nt, Homo sapiens
ggggauacuucuaaauuuu

SEQ ID NO: 34012 - RNA, 19 nt, Homo sapiens
gcagggauuccacucagaa

SEQ ID NO: 34013 - RNA, 19 nt, Homo sapiens
gagcagcccucaggaucug

SEQ ID NO: 34014 - RNA, 19 nt, Homo sapiens
gaucgggacgggcucguuu

SEQ ID NO: 34015 - RNA, 19 nt, Homo sapiens
gcacccaggccgaugaguu

SEQ ID NO: 34016 - RNA, 19 nt, Homo sapiens
uagaggagguagugaugga

SEQ ID NO: 34017 - RNA, 19 nt, Homo sapiens
guaccaaccgccaacaguu

SEQ ID NO: 34018 - RNA, 19 nt, Homo sapiens
ccaaaccuguggcuacaag

SEQ ID NO: 34019 - RNA, 19 nt, Homo sapiens
ggacugcuguguggucuac

SEQ ID NO: 34020 - RNA, 19 nt, Homo sapiens
acaagaagaaagugaagaa

SEQ ID NO: 34021 - RNA, 19 nt, Homo sapiens
ucucaagucuaacaacauc

SEQ ID NO: 34022 - RNA, 19 nt, Homo sapiens
cgacacacgcuucgacaug

SEQ ID NO: 34023 - RNA, 19 nt, Homo sapiens
gcccaggcuuucaagaaug

SEQ ID NO: 34024 - RNA, 19 nt, Homo sapiens
ggugaagaucggugacuuu

SEQ ID NO: 34025 - RNA, 19 nt, Homo sapiens
gauuugccaucaucacaca

SEQ ID NO: 34026 - RNA, 19 nt, Homo sapiens
ggaagacgcgacaugucaa

SEQ ID NO: 34027 - RNA, 19 nt, Homo sapiens
ucauuugguuuccucuuug

SEQ ID NO: 34028 - RNA, 19 nt, Homo sapiens
gaugacaagaagaaaguga

SEQ ID NO: 34029 - RNA, 19 nt, Homo sapiens
cuaacaacaucuuccuaca

SEQ ID NO: 34030 - RNA, 19 nt, Homo sapiens
uaacaacaucuuccuacau

SEQ ID NO: 34031 - RNA, 19 nt, Homo sapiens
ccgcugaccaugcacaauu

SEQ ID NO: 34032 - RNA, 19 nt, Homo sapiens
caagaagagaggcccaaga

SEQ ID NO: 34033 - RNA, 19 nt, Homo sapiens
caggaucugugcuguggau

SEQ ID NO: 34034 - RNA, 19 nt, Homo sapiens
cccaggcuuucaagaauga

SEQ ID NO: 34035 - RNA, 19 nt, Homo sapiens
agaagaaagugaagaaccu

SEQ ID NO: 34036 - RNA, 19 nt, Homo sapiens
gggauggcaugagugucua

SEQ ID NO: 34037 - RNA, 19 nt, Homo sapiens
ccugucuccuccaucauuu

SEQ ID NO: 34038 - RNA, 19 nt, Homo sapiens
agaugcaggugcucaggaa

SEQ ID NO: 34039 - RNA, 19 nt, Homo sapiens
uccaauggcugggauuugu

SEQ ID NO: 34040 - RNA, 19 nt, Homo sapiens
uggcugccgugaccagauu

SEQ ID NO: 34041 - RNA, 19 nt, Homo sapiens
guaccgggacucaggcuau

SEQ ID NO: 34042 - RNA, 19 nt, Homo sapiens
gugaagaucggugacuuug

SEQ ID NO: 34043 - RNA, 19 nt, Homo sapiens
caacaucuuccuacaugag

SEQ ID NO: 34044 - RNA, 19 nt, Homo sapiens
cgagaucucaagucuaaca

SEQ ID NO: 34045 - RNA, 19 nt, Homo sapiens
ucaccaagaagcacagaau

SEQ ID NO: 34046 - RNA, 19 nt, Homo sapiens
ggcagggauuccacucaga

SEQ ID NO: 34047 - RNA, 19 nt, Homo sapiens
aagaagagaggcccaagau

SEQ ID NO: 34048 - RNA, 19 nt, Homo sapiens
cgcugaccaugcacaauuu

SEQ ID NO: 34049 - RNA, 19 nt, Homo sapiens
gguaguagaggagguagug

SEQ ID NO: 34050 - RNA, 19 nt, Homo sapiens
uggaauuugugccugaugu

SEQ ID NO: 34051 - RNA, 19 nt, Homo sapiens
ggcggacucugugaggaaa

SEQ ID NO: 34052 - RNA, 19 nt, Homo sapiens
ucgagguccuugaagaugu

SEQ ID NO: 34053 - RNA, 19 nt, Homo sapiens
caccaagaagcacagaauu

SEQ ID NO: 34054 - RNA, 19 nt, Homo sapiens
ugacuggcucacugccuua

SEQ ID NO: 34055 - RNA, 19 nt, Homo sapiens
acaacaucuuccuacauga

SEQ ID NO: 34056 - RNA, 19 nt, Homo sapiens
gagcaggcccaggcuuuca

SEQ ID NO: 34057 - RNA, 19 nt, Homo sapiens
ggaauuugugccugaugug

SEQ ID NO: 34058 - RNA, 19 nt, Homo sapiens
cacccaggccgaugaguug

SEQ ID NO: 34059 - RNA, 19 nt, Homo sapiens
aagagaggcccaagaugga

SEQ ID NO: 34060 - RNA, 19 nt, Homo sapiens
ucuccuccaucauuugguu

SEQ ID NO: 34061 - RNA, 19 nt, Homo sapiens
ggagcagcccucaggaucu

SEQ ID NO: 34062 - RNA, 19 nt, Homo sapiens
gggauuugccaucaucaca

SEQ ID NO: 34063 - RNA, 19 nt, Homo sapiens
gacaagaagaaagugaaga

SEQ ID NO: 34064 - RNA, 19 nt, Homo sapiens
uucugugacuucugccuua

SEQ ID NO: 34065 - RNA, 19 nt, Homo sapiens
uaaaucaggacugcugugu

SEQ ID NO: 34066 - RNA, 19 nt, Homo sapiens
ugggcaccgucaaaguaua

SEQ ID NO: 34067 - RNA, 19 nt, Homo sapiens
aucauuugguuuccucuuu

SEQ ID NO: 34068 - RNA, 19 nt, Homo sapiens
agugggcaccgucaaagua

SEQ ID NO: 34069 - RNA, 19 nt, Homo sapiens
ugaguccgcagagccaaua

SEQ ID NO: 34070 - RNA, 19 nt, Homo sapiens
gccgggauuugccaucauc

SEQ ID NO: 34071 - RNA, 19 nt, Homo sapiens
ccgugaaggugcucaaggu

SEQ ID NO: 34072 - RNA, 19 nt, Homo sapiens
aaaccuguggcuacaaguu

SEQ ID NO: 34073 - RNA, 19 nt, Homo sapiens
gguuuccucuuuggcuuug

SEQ ID NO: 34074 - RNA, 19 nt, Homo sapiens
gauccuggccacaauugag

SEQ ID NO: 34075 - RNA, 19 nt, Homo sapiens
ucaagucuaacaacaucuu

SEQ ID NO: 34076 - RNA, 19 nt, Homo sapiens
ccaccucagcccaucuuga

SEQ ID NO: 34077 - RNA, 19 nt, Homo sapiens
gggagguaccacccaguga

SEQ ID NO: 34078 - RNA, 19 nt, Homo sapiens
uaccgggacucaggcuauu

SEQ ID NO: 34079 - RNA, 19 nt, Homo sapiens
gcagugggcaccgucaaag

SEQ ID NO: 34080 - RNA, 19 nt, Homo sapiens
ccacaguguccaggauuug

SEQ ID NO: 34081 - RNA, 19 nt, Homo sapiens
cuaccacaguguccaggau

SEQ ID NO: 34082 - RNA, 19 nt, Homo sapiens
cagcccaucuugacaaaau

SEQ ID NO: 34083 - RNA, 19 nt, Homo sapiens
cgagguccuugaagauguc

SEQ ID NO: 34084 - RNA, 19 nt, Homo sapiens
ggcagugggcaccgucaaa

SEQ ID NO: 34085 - RNA, 19 nt, Homo sapiens
gaagacgcgacaugucaac

SEQ ID NO: 34086 - RNA, 19 nt, Homo sapiens
ucaggaagacgcgacaugu

SEQ ID NO: 34087 - RNA, 19 nt, Homo sapiens
acaaguuccaccagcauug

SEQ ID NO: 34088 - RNA, 19 nt, Homo sapiens
ggauggcgaggagcucauu

SEQ ID NO: 34089 - RNA, 19 nt, Homo sapiens
gagcuccuccaucuccaau

SEQ ID NO: 34090 - RNA, 19 nt, Homo sapiens
uggggauacuucuaaauuu

SEQ ID NO: 34091 - RNA, 19 nt, Homo sapiens
aggaagacgcgacauguca

SEQ ID NO: 34092 - RNA, 19 nt, Homo sapiens
uguguggucuaccgacuca

SEQ ID NO: 34093 - RNA, 19 nt, Homo sapiens
ccucagcccaucuugacaa

SEQ ID NO: 34094 - RNA, 19 nt, Homo sapiens
ucugugacuucugccuuaa

SEQ ID NO: 34095 - RNA, 19 nt, Homo sapiens
caagaagucugucauguua

SEQ ID NO: 34096 - RNA, 19 nt, Homo sapiens
gcagagcacucacacauaa

SEQ ID NO: 34097 - RNA, 19 nt, Homo sapiens
gcacugggaucaucuguuu

SEQ ID NO: 34098 - RNA, 19 nt, Homo sapiens
ggaaauggcacaaacauaa

SEQ ID NO: 34099 - RNA, 19 nt, Homo sapiens
gcacaaacauaaagggaaa

SEQ ID NO: 34100 - RNA, 19 nt, Homo sapiens
ggaaauggcugugauguca

SEQ ID NO: 34101 - RNA, 19 nt, Homo sapiens
gguuaugucuguccaguua

SEQ ID NO: 34102 - RNA, 19 nt, Homo sapiens
cuaaguugcuccuuuauuu

SEQ ID NO: 34103 - RNA, 19 nt, Homo sapiens
caagagugaucccugaaua

SEQ ID NO: 34104 - RNA, 19 nt, Homo sapiens
gaaggcaaauucuuuaauc

SEQ ID NO: 34105 - RNA, 19 nt, Homo sapiens
acagagacauucuuugaua

SEQ ID NO: 34106 - RNA, 19 nt, Homo sapiens
ccacuugugucaauauuaa

SEQ ID NO: 34107 - RNA, 19 nt, Homo sapiens
gauggagucucacuuugua

SEQ ID NO: 34108 - RNA, 19 nt, Homo sapiens
aaacagagaguguaagaua

SEQ ID NO: 34109 - RNA, 19 nt, Homo sapiens
gaucagaaccuucacagaa

SEQ ID NO: 34110 - RNA, 19 nt, Homo sapiens
ggaauugcuugccaaagaa

SEQ ID NO: 34111 - RNA, 19 nt, Homo sapiens
aaugauggcugaagaguuu

SEQ ID NO: 34112 - RNA, 19 nt, Homo sapiens
gacggaggauuacagaaua

SEQ ID NO: 34113 - RNA, 19 nt, Homo sapiens
gaaaguuguuuguccguau

SEQ ID NO: 34114 - RNA, 19 nt, Homo sapiens
gagaagcaccuuucaaaug

SEQ ID NO: 34115 - RNA, 19 nt, Homo sapiens
gcaacugauuguuucgaua

SEQ ID NO: 34116 - RNA, 19 nt, Homo sapiens
ggaggcaacugauuguuuc

SEQ ID NO: 34117 - RNA, 19 nt, Homo sapiens
ucacagagaccaucauuga

SEQ ID NO: 34118 - RNA, 19 nt, Homo sapiens
ugaaauaucugagcacugu

SEQ ID NO: 34119 - RNA, 19 nt, Homo sapiens
gggaaaggcugcuaauuuu

SEQ ID NO: 34120 - RNA, 19 nt, Homo sapiens
ugacaaguauggccgaauu

SEQ ID NO: 34121 - RNA, 19 nt, Homo sapiens
gaaauggcacaaacauaaa

SEQ ID NO: 34122 - RNA, 19 nt, Homo sapiens
gcacagaucagaaccuuca

SEQ ID NO: 34123 - RNA, 19 nt, Homo sapiens
aauaugagcuacaagaaga

SEQ ID NO: 34124 - RNA, 19 nt, Homo sapiens
ccgaagagaugcagagaga

SEQ ID NO: 34125 - RNA, 19 nt, Homo sapiens
uaccuaaguugcuccuuua

SEQ ID NO: 34126 - RNA, 19 nt, Homo sapiens
ggagaaacuguauauggua

SEQ ID NO: 34127 - RNA, 19 nt, Homo sapiens
gcaggaaaggcuauuguuu

SEQ ID NO: 34128 - RNA, 19 nt, Homo sapiens
caccacgccuggcuaauuu

SEQ ID NO: 34129 - RNA, 19 nt, Homo sapiens
gaaauccuuccuucucuuu

SEQ ID NO: 34130 - RNA, 19 nt, Homo sapiens
cagagacauucuuugauaa

SEQ ID NO: 34131 - RNA, 19 nt, Homo sapiens
ucacagagacauucuuuga

SEQ ID NO: 34132 - RNA, 19 nt, Homo sapiens
gaaaguguacauaugaaga

SEQ ID NO: 34133 - RNA, 19 nt, Homo sapiens
gagaagucauuuccaguca

SEQ ID NO: 34134 - RNA, 19 nt, Homo sapiens
gcaagaaauccuacuaauc

SEQ ID NO: 34135 - RNA, 19 nt, Homo sapiens
caacaggcccgaagagaug

SEQ ID NO: 34136 - RNA, 19 nt, Homo sapiens
uggaauugcuugccaaaga

SEQ ID NO: 34137 - RNA, 19 nt, Homo sapiens
ggcaagaaauccuacuaau

SEQ ID NO: 34138 - RNA, 19 nt, Homo sapiens
ggccuguccuuccaguuua

SEQ ID NO: 34139 - RNA, 19 nt, Homo sapiens
ggauaaguaugaaauucug

SEQ ID NO: 34140 - RNA, 19 nt, Homo sapiens
gcagacgacuagaugacuu

SEQ ID NO: 34141 - RNA, 19 nt, Homo sapiens
ggaagaggcagacgacuag

SEQ ID NO: 34142 - RNA, 19 nt, Homo sapiens
aaagaaugguuaugucugu

SEQ ID NO: 34143 - RNA, 19 nt, Homo sapiens
agaagcaccuuucaaaugg

SEQ ID NO: 34144 - RNA, 19 nt, Homo sapiens
caagaaauccuacuaaucc

SEQ ID NO: 34145 - RNA, 19 nt, Homo sapiens
caugacagucgacgaaaua

SEQ ID NO: 34146 - RNA, 19 nt, Homo sapiens
gaacugaaugaugugguua

SEQ ID NO: 34147 - RNA, 19 nt, Homo sapiens
cuagaugacuucugcacuu

SEQ ID NO: 34148 - RNA, 19 nt, Homo sapiens
gguuccaucucauccauuu

SEQ ID NO: 34149 - RNA, 19 nt, Homo sapiens
gacauucuuugauaaggaa

SEQ ID NO: 34150 - RNA, 19 nt, Homo sapiens
uaaagaagacgccaaugau

SEQ ID NO: 34151 - RNA, 19 nt, Homo sapiens
gaaaccaucauguccucua

SEQ ID NO: 34152 - RNA, 19 nt, Homo sapiens
gaagagaugcagagagaca

SEQ ID NO: 34153 - RNA, 19 nt, Homo sapiens
gaaucccacuugugucaau

SEQ ID NO: 34154 - RNA, 19 nt, Homo sapiens
ucuaacccauucuugauuu

SEQ ID NO: 34155 - RNA, 19 nt, Homo sapiens
uuaccuaaguugcuccuuu

SEQ ID NO: 34156 - RNA, 19 nt, Homo sapiens
cuacagacccauccaaaug

SEQ ID NO: 34157 - RNA, 19 nt, Homo sapiens
uagcuugguuuccacauga

SEQ ID NO: 34158 - RNA, 19 nt, Homo sapiens
caaagaguguacugugcuu

SEQ ID NO: 34159 - RNA, 19 nt, Homo sapiens
caacugauuguuucgauau

SEQ ID NO: 34160 - RNA, 19 nt, Homo sapiens
gaucacagagaccaucauu

SEQ ID NO: 34161 - RNA, 19 nt, Homo sapiens
gaugacuucugcacuuuua

SEQ ID NO: 34162 - RNA, 19 nt, Homo sapiens
gggaagaggcagacgacua

SEQ ID NO: 34163 - RNA, 19 nt, Homo sapiens
caaaggaaaggaaguagau

SEQ ID NO: 34164 - RNA, 19 nt, Homo sapiens
cagcaaggcuuuaaaacuu

SEQ ID NO: 34165 - RNA, 19 nt, Homo sapiens
acagagaccaucauugaaa

SEQ ID NO: 34166 - RNA, 19 nt, Homo sapiens
aaucaugucugcugcuguu

SEQ ID NO: 34167 - RNA, 19 nt, Homo sapiens
gaagucauuuccagucaac

SEQ ID NO: 34168 - RNA, 19 nt, Homo sapiens
guguacauaugaagauuga

SEQ ID NO: 34169 - RNA, 19 nt, Homo sapiens
guacauauuacucacguau

SEQ ID NO: 34170 - RNA, 19 nt, Homo sapiens
uucauacccuuuaccuuua

SEQ ID NO: 34171 - RNA, 19 nt, Homo sapiens
uuaaauaccuccucuaccu

SEQ ID NO: 34172 - RNA, 19 nt, Homo sapiens
agggaaaggcugcuaauuu

SEQ ID NO: 34173 - RNA, 19 nt, Homo sapiens
cuucuucccuguucaaguu

SEQ ID NO: 34174 - RNA, 19 nt, Homo sapiens
ggauaccgggagaauguua

SEQ ID NO: 34175 - RNA, 19 nt, Homo sapiens
auacaaagaaggcaaauuc

SEQ ID NO: 34176 - RNA, 19 nt, Homo sapiens
gaauaugagcuacaagaag

SEQ ID NO: 34177 - RNA, 19 nt, Homo sapiens
uagaugacuucugcacuuu

SEQ ID NO: 34178 - RNA, 19 nt, Homo sapiens
cccagcugcuccuuuauuu

SEQ ID NO: 34179 - RNA, 19 nt, Homo sapiens
ucaagaacgugaagcuaag

SEQ ID NO: 34180 - RNA, 19 nt, Homo sapiens
caagaugucuaaaagaaug

SEQ ID NO: 34181 - RNA, 19 nt, Homo sapiens
acauacagguuaccaaagu

SEQ ID NO: 34182 - RNA, 19 nt, Homo sapiens
cagcugccaugaucacaga

SEQ ID NO: 34183 - RNA, 19 nt, Homo sapiens
gaaacuguauaugguacug

SEQ ID NO: 34184 - RNA, 19 nt, Homo sapiens
gaggcuccauuucaccauu

SEQ ID NO: 34185 - RNA, 19 nt, Homo sapiens
aaguauaucuaacccauuc

SEQ ID NO: 34186 - RNA, 19 nt, Homo sapiens
guggauaaguaugaaauuc

SEQ ID NO: 34187 - RNA, 19 nt, Homo sapiens
gaaggugaaaccaucaugu

SEQ ID NO: 34188 - RNA, 19 nt, Homo sapiens
cauugaaacugauaaacca

SEQ ID NO: 34189 - RNA, 19 nt, Homo sapiens
ugaaacagagaguguaaga

SEQ ID NO: 34190 - RNA, 19 nt, Homo sapiens
ccauuucaccauuugauuu

SEQ ID NO: 34191 - RNA, 19 nt, Homo sapiens
gggccuguccuuccaguuu

SEQ ID NO: 34192 - RNA, 19 nt, Homo sapiens
uauuguuucucgacaguuu

SEQ ID NO: 34193 - RNA, 19 nt, Homo sapiens
auaaagaagacgccaauga

SEQ ID NO: 34194 - RNA, 19 nt, Homo sapiens
gugcuaaaguggagacuac

SEQ ID NO: 34195 - RNA, 19 nt, Homo sapiens
gaagaagguugucaaacua

SEQ ID NO: 34196 - RNA, 19 nt, Homo sapiens
ggcaaaugcuuauuacuua

SEQ ID NO: 34197 - RNA, 19 nt, Homo sapiens
ggaaagagguagucacaga

SEQ ID NO: 34198 - RNA, 19 nt, Homo sapiens
ggucagagcucuaaauugg

SEQ ID NO: 34199 - RNA, 19 nt, Homo sapiens
ggaagaagguugucaaacu

SEQ ID NO: 34200 - RNA, 19 nt, Homo sapiens
gaacuugaacuguuuacua

SEQ ID NO: 34201 - RNA, 19 nt, Homo sapiens
guauggagcugcagaagaa

SEQ ID NO: 34202 - RNA, 19 nt, Homo sapiens
gaaauagaauccaaacuac

SEQ ID NO: 34203 - RNA, 19 nt, Homo sapiens
gcacauucuuagcauauaa

SEQ ID NO: 34204 - RNA, 19 nt, Homo sapiens
ggccguagcugguauauuc

SEQ ID NO: 34205 - RNA, 19 nt, Homo sapiens
gaacuacucagucuccaua

SEQ ID NO: 34206 - RNA, 19 nt, Homo sapiens
ucacaagcauucaguauug

SEQ ID NO: 34207 - RNA, 19 nt, Homo sapiens
ugauaaaccucaugagaaa

SEQ ID NO: 34208 - RNA, 19 nt, Homo sapiens
cagaacaccuuuaaugcua

SEQ ID NO: 34209 - RNA, 19 nt, Homo sapiens
gcaaaguuguuaacggaaa

SEQ ID NO: 34210 - RNA, 19 nt, Homo sapiens
uaacagaacaccuuuaaug

SEQ ID NO: 34211 - RNA, 19 nt, Homo sapiens
ccaauugagugccuaauga

SEQ ID NO: 34212 - RNA, 19 nt, Homo sapiens
gagaacaaaucguggaaga

SEQ ID NO: 34213 - RNA, 19 nt, Homo sapiens
ggagagagcaucauucguu

SEQ ID NO: 34214 - RNA, 19 nt, Homo sapiens
ggaaguaauuggaucugaa

SEQ ID NO: 34215 - RNA, 19 nt, Homo sapiens
caagagaaguuguaaguac

SEQ ID NO: 34216 - RNA, 19 nt, Homo sapiens
agaaauggcucuaaguguu

SEQ ID NO: 34217 - RNA, 19 nt, Homo sapiens
gaacaaaucguggaagaug

SEQ ID NO: 34218 - RNA, 19 nt, Homo sapiens
caauuaggcuugucagguu

SEQ ID NO: 34219 - RNA, 19 nt, Homo sapiens
gggaaugacuauagguaaa

SEQ ID NO: 34220 - RNA, 19 nt, Homo sapiens
ggucauguauucgagcuua

SEQ ID NO: 34221 - RNA, 19 nt, Homo sapiens
gagaaugcccggucaugua

SEQ ID NO: 34222 - RNA, 19 nt, Homo sapiens
gugaaauguuacccaauua

SEQ ID NO: 34223 - RNA, 19 nt, Homo sapiens
caagguuacuggaaacauu

SEQ ID NO: 34224 - RNA, 19 nt, Homo sapiens
cguggaaacuguagaauau

SEQ ID NO: 34225 - RNA, 19 nt, Homo sapiens
ggaagcacgauuuauuuaa

SEQ ID NO: 34226 - RNA, 19 nt, Homo sapiens
gaagaaauggcucuaagug

SEQ ID NO: 34227 - RNA, 19 nt, Homo sapiens
gaggauggcuacccugguu

SEQ ID NO: 34228 - RNA, 19 nt, Homo sapiens
uaacagaccuaggugauuc

SEQ ID NO: 34229 - RNA, 19 nt, Homo sapiens
cuagugaccuaaauagaaa

SEQ ID NO: 34230 - RNA, 19 nt, Homo sapiens
gacaguugcuuaaugaaau

SEQ ID NO: 34231 - RNA, 19 nt, Homo sapiens
gauaaucgaguucacauug

SEQ ID NO: 34232 - RNA, 19 nt, Homo sapiens
gcaggaugauuguagaguu

SEQ ID NO: 34233 - RNA, 19 nt, Homo sapiens
gugagaacuugaacuguuu

SEQ ID NO: 34234 - RNA, 19 nt, Homo sapiens
caaacuagcccacucaugu

SEQ ID NO: 34235 - RNA, 19 nt, Homo sapiens
aaagcgaacuucaagagaa

SEQ ID NO: 34236 - RNA, 19 nt, Homo sapiens
gaagugguaugggacugua

SEQ ID NO: 34237 - RNA, 19 nt, Homo sapiens
uuacagaaguugcagauca

SEQ ID NO: 34238 - RNA, 19 nt, Homo sapiens
gaaauggcucuaaguguug

SEQ ID NO: 34239 - RNA, 19 nt, Homo sapiens
ggaauucaguacuuugcuu

SEQ ID NO: 34240 - RNA, 19 nt, Homo sapiens
uggaauggcucacacagaa

SEQ ID NO: 34241 - RNA, 19 nt, Homo sapiens
gcacuguugugguucauuc

SEQ ID NO: 34242 - RNA, 19 nt, Homo sapiens
gagaaggccuugaaaaguu

SEQ ID NO: 34243 - RNA, 19 nt, Homo sapiens
gaaacucugugucgucaag

SEQ ID NO: 34244 - RNA, 19 nt, Homo sapiens
gcuagugaccuaaauagaa

SEQ ID NO: 34245 - RNA, 19 nt, Homo sapiens
cuaaauugguccuucuauu

SEQ ID NO: 34246 - RNA, 19 nt, Homo sapiens
ugaagcaagugaaguauag

SEQ ID NO: 34247 - RNA, 19 nt, Homo sapiens
gaagguuuauucuuucagu

SEQ ID NO: 34248 - RNA, 19 nt, Homo sapiens
aaggguaagugaagguuua

SEQ ID NO: 34249 - RNA, 19 nt, Homo sapiens
guacaguggcaaaugcuua

SEQ ID NO: 34250 - RNA, 19 nt, Homo sapiens
gagcagauuagauugaauu

SEQ ID NO: 34251 - RNA, 19 nt, Homo sapiens
gguguuguauugcuuguga

SEQ ID NO: 34252 - RNA, 19 nt, Homo sapiens
auagguacauugagacuuu

SEQ ID NO: 34253 - RNA, 19 nt, Homo sapiens
gaacuauaagguacagaaa

SEQ ID NO: 34254 - RNA, 19 nt, Homo sapiens
aaugacaguugcuuaauga

SEQ ID NO: 34255 - RNA, 19 nt, Homo sapiens
ggacagcuguagugaaggu

SEQ ID NO: 34256 - RNA, 19 nt, Homo sapiens
gcagcaggaugauuguaga

SEQ ID NO: 34257 - RNA, 19 nt, Homo sapiens
gcaaagcacaggcgaguuc

SEQ ID NO: 34258 - RNA, 19 nt, Homo sapiens
guagauagcagucauagag

SEQ ID NO: 34259 - RNA, 19 nt, Homo sapiens
gaaagcgaacuucaagaga

SEQ ID NO: 34260 - RNA, 19 nt, Homo sapiens
agaaaucacugaacuacuc

SEQ ID NO: 34261 - RNA, 19 nt, Homo sapiens
gaagaaaucacugaacuac

SEQ ID NO: 34262 - RNA, 19 nt, Homo sapiens
agucauagagacagaauua

SEQ ID NO: 34263 - RNA, 19 nt, Homo sapiens
ugugugcucuuuacuguuu

SEQ ID NO: 34264 - RNA, 19 nt, Homo sapiens
ggauguugcuugauuuuaa

SEQ ID NO: 34265 - RNA, 19 nt, Homo sapiens
gcacacagcgaacuugcaa

SEQ ID NO: 34266 - RNA, 19 nt, Homo sapiens
acaggaaauuacaagguua

SEQ ID NO: 34267 - RNA, 19 nt, Homo sapiens
cuacaaagacauuagcaaa

SEQ ID NO: 34268 - RNA, 19 nt, Homo sapiens
ugacugauuucaauaacug

SEQ ID NO: 34269 - RNA, 19 nt, Homo sapiens
gguaacaagaugugacuuu

SEQ ID NO: 34270 - RNA, 19 nt, Homo sapiens
gcaaaugcuuauuacuuac

SEQ ID NO: 34271 - RNA, 19 nt, Homo sapiens
gaaaugacaguugcuuaau

SEQ ID NO: 34272 - RNA, 19 nt, Homo sapiens
gagaugcucugcuccugau

SEQ ID NO: 34273 - RNA, 19 nt, Homo sapiens
guagaguugucuuggcaaa

SEQ ID NO: 34274 - RNA, 19 nt, Homo sapiens
gauccgagcaucaauuuua

SEQ ID NO: 34275 - RNA, 19 nt, Homo sapiens
caacucauuugugcucuga

SEQ ID NO: 34276 - RNA, 19 nt, Homo sapiens
ugugagaacuugaacuguu

SEQ ID NO: 34277 - RNA, 19 nt, Homo sapiens
gaguuccucuagcugauaa

SEQ ID NO: 34278 - RNA, 19 nt, Homo sapiens
gaaguaauuggaucugaau

SEQ ID NO: 34279 - RNA, 19 nt, Homo sapiens
agugaaauguuacccaauu

SEQ ID NO: 34280 - RNA, 19 nt, Homo sapiens
agaaaugacaguugcuuaa

SEQ ID NO: 34281 - RNA, 19 nt, Homo sapiens
uacucaagcuguuguguuu

SEQ ID NO: 34282 - RNA, 19 nt, Homo sapiens
gaccauuguggaaacauua

SEQ ID NO: 34283 - RNA, 19 nt, Homo sapiens
gguagguguuuguguguga

SEQ ID NO: 34284 - RNA, 19 nt, Homo sapiens
gcuagaguguggaguuugu

SEQ ID NO: 34285 - RNA, 19 nt, Homo sapiens
gaauucaguacuuugcuuu

SEQ ID NO: 34286 - RNA, 19 nt, Homo sapiens
gcacauugaaggaggagaa

SEQ ID NO: 34287 - RNA, 19 nt, Homo sapiens
aaaugacaguugcuuaaug

SEQ ID NO: 34288 - RNA, 19 nt, Homo sapiens
gauugggaauucaguacuu

SEQ ID NO: 34289 - RNA, 19 nt, Homo sapiens
acuuguagcugcuggagua

SEQ ID NO: 34290 - RNA, 19 nt, Homo sapiens
caacaagaagauaugacua

SEQ ID NO: 34291 - RNA, 19 nt, Homo sapiens
gcugauaaaccucaugaga

SEQ ID NO: 34292 - RNA, 19 nt, Homo sapiens
guucucaaguuacucauuc

SEQ ID NO: 34293 - RNA, 19 nt, Homo sapiens
uauggaagcacgauuuauu

SEQ ID NO: 34294 - RNA, 19 nt, Homo sapiens
ucaguguugugaguaaaua

SEQ ID NO: 34295 - RNA, 19 nt, Homo sapiens
gaagaagguugucaaacua

SEQ ID NO: 34296 - RNA, 19 nt, Homo sapiens
ggaaagagguagucacaga

SEQ ID NO: 34297 - RNA, 19 nt, Homo sapiens
ggaagaagguugucaaacu

SEQ ID NO: 34298 - RNA, 19 nt, Homo sapiens
gaacuugaacuguuuacua

SEQ ID NO: 34299 - RNA, 19 nt, Homo sapiens
guauggagcugcagaagaa

SEQ ID NO: 34300 - RNA, 19 nt, Homo sapiens
gcacauucuuagcauauaa

SEQ ID NO: 34301 - RNA, 19 nt, Homo sapiens
ggccguagcugguauauuc

SEQ ID NO: 34302 - RNA, 19 nt, Homo sapiens
gaacuacucagucuccaua

SEQ ID NO: 34303 - RNA, 19 nt, Homo sapiens
ucacaagcauucaguauug

SEQ ID NO: 34304 - RNA, 19 nt, Homo sapiens
ugauaaaccucaugagaaa

SEQ ID NO: 34305 - RNA, 19 nt, Homo sapiens
gcaaaguuguuaacggaaa

SEQ ID NO: 34306 - RNA, 19 nt, Homo sapiens
gagaacaaaucguggaaga

SEQ ID NO: 34307 - RNA, 19 nt, Homo sapiens
ggagagagcaucauucguu

SEQ ID NO: 34308 - RNA, 19 nt, Homo sapiens
agaaauggcucuaaguguu

SEQ ID NO: 34309 - RNA, 19 nt, Homo sapiens
gaacaaaucguggaagaug

SEQ ID NO: 34310 - RNA, 19 nt, Homo sapiens
ggucauguauucgagcuua

SEQ ID NO: 34311 - RNA, 19 nt, Homo sapiens
gagaaugcccggucaugua

SEQ ID NO: 34312 - RNA, 19 nt, Homo sapiens
caagguuacuggaaacauu

SEQ ID NO: 34313 - RNA, 19 nt, Homo sapiens
cguggaaacuguagaauau

SEQ ID NO: 34314 - RNA, 19 nt, Homo sapiens
gaagaaauggcucuaagug

SEQ ID NO: 34315 - RNA, 19 nt, Homo sapiens
gaggauggcuacccugguu

SEQ ID NO: 34316 - RNA, 19 nt, Homo sapiens
uaacagaccuaggugauuc

SEQ ID NO: 34317 - RNA, 19 nt, Homo sapiens
gauaaucgaguucacauug

SEQ ID NO: 34318 - RNA, 19 nt, Homo sapiens
gcaggaugauuguagaguu

SEQ ID NO: 34319 - RNA, 19 nt, Homo sapiens
gugagaacuugaacuguuu

SEQ ID NO: 34320 - RNA, 19 nt, Homo sapiens
caaacuagcccacucaugu

SEQ ID NO: 34321 - RNA, 19 nt, Homo sapiens
uuacagaaguugcagauca

SEQ ID NO: 34322 - RNA, 19 nt, Homo sapiens
gaaauggcucuaaguguug

SEQ ID NO: 34323 - RNA, 19 nt, Homo sapiens
uggaauggcucacacagaa

SEQ ID NO: 34324 - RNA, 19 nt, Homo sapiens
gaaacucugugucgucaag

SEQ ID NO: 34325 - RNA, 19 nt, Homo sapiens
gguguuguauugcuuguga

SEQ ID NO: 34326 - RNA, 19 nt, Homo sapiens
ggacagcuguagugaaggu

SEQ ID NO: 34327 - RNA, 19 nt, Homo sapiens
gcagcaggaugauuguaga

SEQ ID NO: 34328 - RNA, 19 nt, Homo sapiens
gcaaagcacaggcgaguuc

SEQ ID NO: 34329 - RNA, 19 nt, Homo sapiens
guagauagcagucauagag

SEQ ID NO: 34330 - RNA, 19 nt, Homo sapiens
agaaaucacugaacuacuc

SEQ ID NO: 34331 - RNA, 19 nt, Homo sapiens
gaagaaaucacugaacuac

SEQ ID NO: 34332 - RNA, 19 nt, Homo sapiens
agucauagagacagaauua

SEQ ID NO: 34333 - RNA, 19 nt, Homo sapiens
gcacacagcgaacuugcaa

SEQ ID NO: 34334 - RNA, 19 nt, Homo sapiens
acaggaaauuacaagguua

SEQ ID NO: 34335 - RNA, 19 nt, Homo sapiens
cuacaaagacauuagcaaa

SEQ ID NO: 34336 - RNA, 19 nt, Homo sapiens
ugacugauuucaauaacug

SEQ ID NO: 34337 - RNA, 19 nt, Homo sapiens
gagaugcucugcuccugau

SEQ ID NO: 34338 - RNA, 19 nt, Homo sapiens
guagaguugucuuggcaaa

SEQ ID NO: 34339 - RNA, 19 nt, Homo sapiens
gauccgagcaucaauuuua

SEQ ID NO: 34340 - RNA, 19 nt, Homo sapiens
caacucauuugugcucuga

SEQ ID NO: 34341 - RNA, 19 nt, Homo sapiens
ugugagaacuugaacuguu

SEQ ID NO: 34342 - RNA, 19 nt, Homo sapiens
gaguuccucuagcugauaa

SEQ ID NO: 34343 - RNA, 19 nt, Homo sapiens
uacucaagcuguuguguuu

SEQ ID NO: 34344 - RNA, 19 nt, Homo sapiens
gaccauuguggaaacauua

SEQ ID NO: 34345 - RNA, 19 nt, Homo sapiens
gguagguguuuguguguga

SEQ ID NO: 34346 - RNA, 19 nt, Homo sapiens
gcuagaguguggaguuugu

SEQ ID NO: 34347 - RNA, 19 nt, Homo sapiens
gcacauugaaggaggagaa

SEQ ID NO: 34348 - RNA, 19 nt, Homo sapiens
caacaagaagauaugacua

SEQ ID NO: 34349 - RNA, 19 nt, Homo sapiens
gcugauaaaccucaugaga

SEQ ID NO: 34350 - RNA, 19 nt, Homo sapiens
guucucaaguuacucauuc

SEQ ID NO: 34351 - RNA, 19 nt, Homo sapiens
uagaagaaaucacugaacu

SEQ ID NO: 34352 - RNA, 19 nt, Homo sapiens
caggaugauuguagaguug

SEQ ID NO: 34353 - RNA, 19 nt, Homo sapiens
ccauugaguuuguuugcuu

SEQ ID NO: 34354 - RNA, 19 nt, Homo sapiens
guuugugugugauucauuu

SEQ ID NO: 34355 - RNA, 19 nt, Homo sapiens
gguaaaaggucaugcuguu

SEQ ID NO: 34356 - RNA, 19 nt, Homo sapiens
ugaccaauauacugggaaa

SEQ ID NO: 34357 - RNA, 19 nt, Homo sapiens
cagccugccuccacuguga

SEQ ID NO: 34358 - RNA, 19 nt, Homo sapiens
gaagauggaauuggaaugg

SEQ ID NO: 34359 - RNA, 19 nt, Homo sapiens
gaaccagaagcuaaucaga

SEQ ID NO: 34360 - RNA, 19 nt, Homo sapiens
uacaaaggauaaucgaguu

SEQ ID NO: 34361 - RNA, 19 nt, Homo sapiens
cccauuugaucgacaagua

SEQ ID NO: 34362 - RNA, 19 nt, Homo sapiens
cagcagcaguuuacagaag

SEQ ID NO: 34363 - RNA, 19 nt, Homo sapiens
cagaucacauucaguugga

SEQ ID NO: 34364 - RNA, 19 nt, Homo sapiens
gcagcaguuuacagaaguu

SEQ ID NO: 34365 - RNA, 19 nt, Homo sapiens
agaaacagcagcagcaguu

SEQ ID NO: 34366 - RNA, 19 nt, Homo sapiens
cguggaagauggaauugga

SEQ ID NO: 34367 - RNA, 19 nt, Homo sapiens
caaagacauuagcaaagca

SEQ ID NO: 34368 - RNA, 19 nt, Homo sapiens
aacaggaaauuacaagguu

SEQ ID NO: 34369 - RNA, 19 nt, Homo sapiens
caagaagaaauggcucuaa

SEQ ID NO: 34370 - RNA, 19 nt, Homo sapiens
ugaaggaggagaacaaauc

SEQ ID NO: 34371 - RNA, 19 nt, Homo sapiens
ucacagaggaaaucucaga

SEQ ID NO: 34372 - RNA, 19 nt, Homo sapiens
gcacaggcgaguuccucua

SEQ ID NO: 34373 - RNA, 19 nt, Homo sapiens
ucaaguuacucauucuaca

SEQ ID NO: 34374 - RNA, 19 nt, Homo sapiens
uggcuacccugguuguaaa

SEQ ID NO: 34375 - RNA, 19 nt, Homo sapiens
gaacuugcuucccuuuuca

SEQ ID NO: 34376 - RNA, 19 nt, Homo sapiens
cagauaauaugugaccaau

SEQ ID NO: 34377 - RNA, 19 nt, Homo sapiens
ccucaauacucaagcuguu

SEQ ID NO: 34378 - RNA, 19 nt, Homo sapiens
uaacguggaaacuguagaa

SEQ ID NO: 34379 - RNA, 19 nt, Homo sapiens
cagcaucccugucacuuuu

SEQ ID NO: 34380 - RNA, 19 nt, Homo sapiens
gugcuagaguguggaguuu

SEQ ID NO: 34381 - RNA, 19 nt, Homo sapiens
ccacucaugugcugugucu

SEQ ID NO: 34382 - RNA, 19 nt, Homo sapiens
caccuugccucuguauauu

SEQ ID NO: 34383 - RNA, 19 nt, Homo sapiens
agacagaauuagugaagca

SEQ ID NO: 34384 - RNA, 19 nt, Homo sapiens
gcagcccauuccaacaauu

SEQ ID NO: 34385 - RNA, 19 nt, Homo sapiens
aagaagaaauggcucuaag

SEQ ID NO: 34386 - RNA, 19 nt, Homo sapiens
cagauccgagcaucaauuu

SEQ ID NO: 34387 - RNA, 19 nt, Homo sapiens
ucaccuugccucuguauau

SEQ ID NO: 34388 - RNA, 19 nt, Homo sapiens
acacuaaggugaacuugcu

SEQ ID NO: 34389 - RNA, 19 nt, Homo sapiens
uaaucgaguucacauugga

SEQ ID NO: 34390 - RNA, 19 nt, Homo sapiens
gcaacaagaagauaugacu

SEQ ID NO: 34391 - RNA, 19 nt, Homo sapiens
gcauacggaccuucacaga

SEQ ID NO: 34392 - RNA, 19 nt, Homo sapiens
caugugcugugucugcaaa

SEQ ID NO: 34393 - RNA, 19 nt, Homo sapiens
ggccauaccgucugucaug

SEQ ID NO: 34394 - RNA, 19 nt, Homo sapiens
guuacucauucuacaaaga

SEQ ID NO: 34395 - RNA, 19 nt, Homo sapiens
gaagaagguugucaaacua

SEQ ID NO: 34396 - RNA, 19 nt, Homo sapiens
ggaaagagguagucacaga

SEQ ID NO: 34397 - RNA, 19 nt, Homo sapiens
ggaagaagguugucaaacu

SEQ ID NO: 34398 - RNA, 19 nt, Homo sapiens
gaacuugaacuguuuacua

SEQ ID NO: 34399 - RNA, 19 nt, Homo sapiens
guauggagcugcagaagaa

SEQ ID NO: 34400 - RNA, 19 nt, Homo sapiens
gcacauucuuagcauauaa

SEQ ID NO: 34401 - RNA, 19 nt, Homo sapiens
gaacuacucagucuccaua

SEQ ID NO: 34402 - RNA, 19 nt, Homo sapiens
ucacaagcauucaguauug

SEQ ID NO: 34403 - RNA, 19 nt, Homo sapiens
ugauaaaccucaugagaaa

SEQ ID NO: 34404 - RNA, 19 nt, Homo sapiens
gcaaaguuguuaacggaaa

SEQ ID NO: 34405 - RNA, 19 nt, Homo sapiens
gagaacaaaucguggaaga

SEQ ID NO: 34406 - RNA, 19 nt, Homo sapiens
ggagagagcaucauucguu

SEQ ID NO: 34407 - RNA, 19 nt, Homo sapiens
agaaauggcucuaaguguu

SEQ ID NO: 34408 - RNA, 19 nt, Homo sapiens
gaacaaaucguggaagaug

SEQ ID NO: 34409 - RNA, 19 nt, Homo sapiens
ggucauguauucgagcuua

SEQ ID NO: 34410 - RNA, 19 nt, Homo sapiens
gagaaugcccggucaugua

SEQ ID NO: 34411 - RNA, 19 nt, Homo sapiens
caagguuacuggaaacauu

SEQ ID NO: 34412 - RNA, 19 nt, Homo sapiens
cguggaaacuguagaauau

SEQ ID NO: 34413 - RNA, 19 nt, Homo sapiens
gaagaaauggcucuaagug

SEQ ID NO: 34414 - RNA, 19 nt, Homo sapiens
gaggauggcuacccugguu

SEQ ID NO: 34415 - RNA, 19 nt, Homo sapiens
uaacagaccuaggugauuc

SEQ ID NO: 34416 - RNA, 19 nt, Homo sapiens
gauaaucgaguucacauug

SEQ ID NO: 34417 - RNA, 19 nt, Homo sapiens
gcaggaugauuguagaguu

SEQ ID NO: 34418 - RNA, 19 nt, Homo sapiens
gugagaacuugaacuguuu

SEQ ID NO: 34419 - RNA, 19 nt, Homo sapiens
caaacuagcccacucaugu

SEQ ID NO: 34420 - RNA, 19 nt, Homo sapiens
uuacagaaguugcagauca

SEQ ID NO: 34421 - RNA, 19 nt, Homo sapiens
gaaauggcucuaaguguug

SEQ ID NO: 34422 - RNA, 19 nt, Homo sapiens
uggaauggcucacacagaa

SEQ ID NO: 34423 - RNA, 19 nt, Homo sapiens
gaaacucugugucgucaag

SEQ ID NO: 34424 - RNA, 19 nt, Homo sapiens
gguguuguauugcuuguga

SEQ ID NO: 34425 - RNA, 19 nt, Homo sapiens
gcagcaggaugauuguaga

SEQ ID NO: 34426 - RNA, 19 nt, Homo sapiens
ggacagcuguagugaaggu

SEQ ID NO: 34427 - RNA, 19 nt, Homo sapiens
gcaaagcacaggcgaguuc

SEQ ID NO: 34428 - RNA, 19 nt, Homo sapiens
guagauagcagucauagag

SEQ ID NO: 34429 - RNA, 19 nt, Homo sapiens
agaaaucacugaacuacuc

SEQ ID NO: 34430 - RNA, 19 nt, Homo sapiens
gaagaaaucacugaacuac

SEQ ID NO: 34431 - RNA, 19 nt, Homo sapiens
agucauagagacagaauua

SEQ ID NO: 34432 - RNA, 19 nt, Homo sapiens
gcacacagcgaacuugcaa

SEQ ID NO: 34433 - RNA, 19 nt, Homo sapiens
acaggaaauuacaagguua

SEQ ID NO: 34434 - RNA, 19 nt, Homo sapiens
cuacaaagacauuagcaaa

SEQ ID NO: 34435 - RNA, 19 nt, Homo sapiens
ugacugauuucaauaacug

SEQ ID NO: 34436 - RNA, 19 nt, Homo sapiens
gagaugcucugcuccugau

SEQ ID NO: 34437 - RNA, 19 nt, Homo sapiens
guagaguugucuuggcaaa

SEQ ID NO: 34438 - RNA, 19 nt, Homo sapiens
gauccgagcaucaauuuua

SEQ ID NO: 34439 - RNA, 19 nt, Homo sapiens
caacucauuugugcucuga

SEQ ID NO: 34440 - RNA, 19 nt, Homo sapiens
ugugagaacuugaacuguu

SEQ ID NO: 34441 - RNA, 19 nt, Homo sapiens
gaguuccucuagcugauaa

SEQ ID NO: 34442 - RNA, 19 nt, Homo sapiens
uacucaagcuguuguguuu

SEQ ID NO: 34443 - RNA, 19 nt, Homo sapiens
gaccauuguggaaacauua

SEQ ID NO: 34444 - RNA, 19 nt, Homo sapiens
gguagguguuuguguguga

SEQ ID NO: 34445 - RNA, 19 nt, Homo sapiens
gcacauugaaggaggagaa

SEQ ID NO: 34446 - RNA, 19 nt, Homo sapiens
gcuagaguguggaguuugu

SEQ ID NO: 34447 - RNA, 19 nt, Homo sapiens
caacaagaagauaugacua

SEQ ID NO: 34448 - RNA, 19 nt, Homo sapiens
gcugauaaaccucaugaga

SEQ ID NO: 34449 - RNA, 19 nt, Homo sapiens
guucucaaguuacucauuc

SEQ ID NO: 34450 - RNA, 19 nt, Homo sapiens
uagaagaaaucacugaacu

SEQ ID NO: 34451 - RNA, 19 nt, Homo sapiens
caggaugauuguagaguug

SEQ ID NO: 34452 - RNA, 19 nt, Homo sapiens
ccauugaguuuguuugcuu

SEQ ID NO: 34453 - RNA, 19 nt, Homo sapiens
guuugugugugauucauuu

SEQ ID NO: 34454 - RNA, 19 nt, Homo sapiens
gguaaaaggucaugcuguu

SEQ ID NO: 34455 - RNA, 19 nt, Homo sapiens
ugaccaauauacugggaaa

SEQ ID NO: 34456 - RNA, 19 nt, Homo sapiens
cagccugccuccacuguga

SEQ ID NO: 34457 - RNA, 19 nt, Homo sapiens
gaagauggaauuggaaugg

SEQ ID NO: 34458 - RNA, 19 nt, Homo sapiens
gaaccagaagcuaaucaga

SEQ ID NO: 34459 - RNA, 19 nt, Homo sapiens
uacaaaggauaaucgaguu

SEQ ID NO: 34460 - RNA, 19 nt, Homo sapiens
cccauuugaucgacaagua

SEQ ID NO: 34461 - RNA, 19 nt, Homo sapiens
cagcagcaguuuacagaag

SEQ ID NO: 34462 - RNA, 19 nt, Homo sapiens
cagaucacauucaguugga

SEQ ID NO: 34463 - RNA, 19 nt, Homo sapiens
gcagcaguuuacagaaguu

SEQ ID NO: 34464 - RNA, 19 nt, Homo sapiens
agaaacagcagcagcaguu

SEQ ID NO: 34465 - RNA, 19 nt, Homo sapiens
cguggaagauggaauugga

SEQ ID NO: 34466 - RNA, 19 nt, Homo sapiens
caaagacauuagcaaagca

SEQ ID NO: 34467 - RNA, 19 nt, Homo sapiens
aacaggaaauuacaagguu

SEQ ID NO: 34468 - RNA, 19 nt, Homo sapiens
caagaagaaauggcucuaa

SEQ ID NO: 34469 - RNA, 19 nt, Homo sapiens
ugaaggaggagaacaaauc

SEQ ID NO: 34470 - RNA, 19 nt, Homo sapiens
ucacagaggaaaucucaga

SEQ ID NO: 34471 - RNA, 19 nt, Homo sapiens
gcacaggcgaguuccucua

SEQ ID NO: 34472 - RNA, 19 nt, Homo sapiens
ucaaguuacucauucuaca

SEQ ID NO: 34473 - RNA, 19 nt, Homo sapiens
uggcuacccugguuguaaa

SEQ ID NO: 34474 - RNA, 19 nt, Homo sapiens
gaacuugcuucccuuuuca

SEQ ID NO: 34475 - RNA, 19 nt, Homo sapiens
cagauaauaugugaccaau

SEQ ID NO: 34476 - RNA, 19 nt, Homo sapiens
ccucaauacucaagcuguu

SEQ ID NO: 34477 - RNA, 19 nt, Homo sapiens
gugcuagaguguggaguuu

SEQ ID NO: 34478 - RNA, 19 nt, Homo sapiens
uaacguggaaacuguagaa

SEQ ID NO: 34479 - RNA, 19 nt, Homo sapiens
cagcaucccugucacuuuu

SEQ ID NO: 34480 - RNA, 19 nt, Homo sapiens
ccacucaugugcugugucu

SEQ ID NO: 34481 - RNA, 19 nt, Homo sapiens
caccuugccucuguauauu

SEQ ID NO: 34482 - RNA, 19 nt, Homo sapiens
agacagaauuagugaagca

SEQ ID NO: 34483 - RNA, 19 nt, Homo sapiens
gcagcccauuccaacaauu

SEQ ID NO: 34484 - RNA, 19 nt, Homo sapiens
aagaagaaauggcucuaag

SEQ ID NO: 34485 - RNA, 19 nt, Homo sapiens
cagauccgagcaucaauuu

SEQ ID NO: 34486 - RNA, 19 nt, Homo sapiens
ucaccuugccucuguauau

SEQ ID NO: 34487 - RNA, 19 nt, Homo sapiens
acacuaaggugaacuugcu

SEQ ID NO: 34488 - RNA, 19 nt, Homo sapiens
ggccauaccgucugucaug

SEQ ID NO: 34489 - RNA, 19 nt, Homo sapiens
uaaucgaguucacauugga

SEQ ID NO: 34490 - RNA, 19 nt, Homo sapiens
gcaacaagaagauaugacu

SEQ ID NO: 34491 - RNA, 19 nt, Homo sapiens
gcauacggaccuucacaga

SEQ ID NO: 34492 - RNA, 19 nt, Homo sapiens
caugugcugugucugcaaa

SEQ ID NO: 34493 - RNA, 19 nt, Homo sapiens
guuacucauucuacaaaga

SEQ ID NO: 34494 - RNA, 19 nt, Homo sapiens
gaaaucacugaacuacuca

SEQ ID NO: 34495 - RNA, 19 nt, Homo sapiens
gaaagaaacuucgacaaga

SEQ ID NO: 34496 - RNA, 19 nt, Homo sapiens
gcaaaugucagcaagaaua

SEQ ID NO: 34497 - RNA, 19 nt, Homo sapiens
ccacagugcugauggauuu

SEQ ID NO: 34498 - RNA, 19 nt, Homo sapiens
gacaauacgucaggaaaua

SEQ ID NO: 34499 - RNA, 19 nt, Homo sapiens
gcaagaauauuucggugaa

SEQ ID NO: 34500 - RNA, 19 nt, Homo sapiens
gaaaugccuucuaguagug

SEQ ID NO: 34501 - RNA, 19 nt, Homo sapiens
gcugauggauuugagguua

SEQ ID NO: 34502 - RNA, 19 nt, Homo sapiens
gaagaaacagaaagaagaa

SEQ ID NO: 34503 - RNA, 19 nt, Homo sapiens
caggaaauaugaaggagaa

SEQ ID NO: 34504 - RNA, 19 nt, Homo sapiens
acaagagaauggaaaugua

SEQ ID NO: 34505 - RNA, 19 nt, Homo sapiens
agucagaguugaacaggua

SEQ ID NO: 34506 - RNA, 19 nt, Homo sapiens
ugaaaugccuucuaguagu

SEQ ID NO: 34507 - RNA, 19 nt, Homo sapiens
ucacggagaaugcaaauau

SEQ ID NO: 34508 - RNA, 19 nt, Homo sapiens
ccacaaauaccuggcuaua

SEQ ID NO: 34509 - RNA, 19 nt, Homo sapiens
ggagaaugcaaauauauag

SEQ ID NO: 34510 - RNA, 19 nt, Homo sapiens
agaagaguaugauaacgaa

SEQ ID NO: 34511 - RNA, 19 nt, Homo sapiens
ccauuaugcugcuggauug

SEQ ID NO: 34512 - RNA, 19 nt, Homo sapiens
ugauaacgaaccacaaaua

SEQ ID NO: 34513 - RNA, 19 nt, Homo sapiens
gaauggaaauguacaugcu

SEQ ID NO: 34514 - RNA, 19 nt, Homo sapiens
ugagugaaaugccuucuag

SEQ ID NO: 34515 - RNA, 19 nt, Homo sapiens
gcuauagcauaacugaaga

SEQ ID NO: 34516 - RNA, 19 nt, Homo sapiens
cacggagaaugcaaauaua

SEQ ID NO: 34517 - RNA, 19 nt, Homo sapiens
guuauuacaguccagcuua

SEQ ID NO: 34518 - RNA, 19 nt, Homo sapiens
gaguugaacagguaguuaa

SEQ ID NO: 34519 - RNA, 19 nt, Homo sapiens
ggaccacagugcugaugga

SEQ ID NO: 34520 - RNA, 19 nt, Homo sapiens
uaaaggugcacgaagguaa

SEQ ID NO: 34521 - RNA, 19 nt, Homo sapiens
aaagaaacuucgacaagag

SEQ ID NO: 34522 - RNA, 19 nt, Homo sapiens
gauugacaguaguuuauca

SEQ ID NO: 34523 - RNA, 19 nt, Homo sapiens
gcuauauugucgaugauuc

SEQ ID NO: 34524 - RNA, 19 nt, Homo sapiens
gaagacaauacgucaggaa

SEQ ID NO: 34525 - RNA, 19 nt, Homo sapiens
agaagaaacagaaagaaga

SEQ ID NO: 34526 - RNA, 19 nt, Homo sapiens
auaagacaauggacccuuu

SEQ ID NO: 34527 - RNA, 19 nt, Homo sapiens
ggaaauguacaugcuauag

SEQ ID NO: 34528 - RNA, 19 nt, Homo sapiens
gacaagagaauggaaaugu

SEQ ID NO: 34529 - RNA, 19 nt, Homo sapiens
cggagaaugcaaauauaua

SEQ ID NO: 34530 - RNA, 19 nt, Homo sapiens
ugggaagcgugaaccauuu

SEQ ID NO: 34531 - RNA, 19 nt, Homo sapiens
ggggaaaaguccaugaaaa

SEQ ID NO: 34532 - RNA, 19 nt, Homo sapiens
caaaugucagcaagaauau

SEQ ID NO: 34533 - RNA, 19 nt, Homo sapiens
aaacaagacggaaagugaa

SEQ ID NO: 34534 - RNA, 19 nt, Homo sapiens
gagaagcugaggaacgaaa

SEQ ID NO: 34535 - RNA, 19 nt, Homo sapiens
gauaacgaaccacaaauac

SEQ ID NO: 34536 - RNA, 19 nt, Homo sapiens
caagucauagccauaaaug

SEQ ID NO: 34537 - RNA, 19 nt, Homo sapiens
ugaaggagaagcugaggaa

SEQ ID NO: 34538 - RNA, 19 nt, Homo sapiens
caugauugacaguaguuua

SEQ ID NO: 34539 - RNA, 19 nt, Homo sapiens
uacaggauaucacauugga

SEQ ID NO: 34540 - RNA, 19 nt, Homo sapiens
uaugauaacgaaccacaaa

SEQ ID NO: 34541 - RNA, 19 nt, Homo sapiens
gugaaaugccuucuaguag

SEQ ID NO: 34542 - RNA, 19 nt, Homo sapiens
agugaaaugccuucuagua

SEQ ID NO: 34543 - RNA, 19 nt, Homo sapiens
gccaagucauagccauaaa

SEQ ID NO: 34544 - RNA, 19 nt, Homo sapiens
uggagucacugccaaguca

SEQ ID NO: 34545 - RNA, 19 nt, Homo sapiens
cgacuaugacuacucagaa

SEQ ID NO: 34546 - RNA, 19 nt, Homo sapiens
aaacucacagcaugauuga

SEQ ID NO: 34547 - RNA, 19 nt, Homo sapiens
ggaagcaguaacaugcaaa

SEQ ID NO: 34548 - RNA, 19 nt, Homo sapiens
gcaccuggaagcaguaaca

SEQ ID NO: 34549 - RNA, 19 nt, Homo sapiens
uccauguaaugcagaauuu

SEQ ID NO: 34550 - RNA, 19 nt, Homo sapiens
cagaagaguaugauaacga

SEQ ID NO: 34551 - RNA, 19 nt, Homo sapiens
gaggaacgaaagaaacuuc

SEQ ID NO: 34552 - RNA, 19 nt, Homo sapiens
gaaauaugaaggagaagcu

SEQ ID NO: 34553 - RNA, 19 nt, Homo sapiens
gaagcaguaacaugcaaau

SEQ ID NO: 34554 - RNA, 19 nt, Homo sapiens
gacuaugacuacucagaag

SEQ ID NO: 34555 - RNA, 19 nt, Homo sapiens
caagagaauggaaauguac

SEQ ID NO: 34556 - RNA, 19 nt, Homo sapiens
gccauuaugcugcuggauu

SEQ ID NO: 34557 - RNA, 19 nt, Homo sapiens
cagauaaacccaaaagaaa

SEQ ID NO: 34558 - RNA, 19 nt, Homo sapiens
ggugcugucgcucuugaua

SEQ ID NO: 34559 - RNA, 19 nt, Homo sapiens
ggauaucacauuggaguca

SEQ ID NO: 34560 - RNA, 19 nt, Homo sapiens
gaaauguacaugcuauagc

SEQ ID NO: 34561 - RNA, 19 nt, Homo sapiens
gagaauggaaauguacaug

SEQ ID NO: 34562 - RNA, 19 nt, Homo sapiens
aggagaagcugaggaacga

SEQ ID NO: 34563 - RNA, 19 nt, Homo sapiens
caauacgucaggaaauaug

SEQ ID NO: 34564 - RNA, 19 nt, Homo sapiens
gaugauucagucagaguug

SEQ ID NO: 34565 - RNA, 19 nt, Homo sapiens
ugucgaugauucagucaga

SEQ ID NO: 34566 - RNA, 19 nt, Homo sapiens
gagucacugccaagucaua

SEQ ID NO: 34567 - RNA, 19 nt, Homo sapiens
gaaacuucgacaagagaau

SEQ ID NO: 34568 - RNA, 19 nt, Homo sapiens
gaagcugaggaacgaaaga

SEQ ID NO: 34569 - RNA, 19 nt, Homo sapiens
cagcaugauugacaguagu

SEQ ID NO: 34570 - RNA, 19 nt, Homo sapiens
augcaaaugucagcaagaa

SEQ ID NO: 34571 - RNA, 19 nt, Homo sapiens
cuggcuauauugucgauga

SEQ ID NO: 34572 - RNA, 19 nt, Homo sapiens
uaacgaaccacaaauaccu

SEQ ID NO: 34573 - RNA, 19 nt, Homo sapiens
gccuuuaugucugcuguga

SEQ ID NO: 34574 - RNA, 19 nt, Homo sapiens
aaaaguccaugaaaacuca

SEQ ID NO: 34575 - RNA, 19 nt, Homo sapiens
guggugcugucgcucuuga

SEQ ID NO: 34576 - RNA, 19 nt, Homo sapiens
ugaugagucgguccucuuu

SEQ ID NO: 34577 - RNA, 19 nt, Homo sapiens
gauaaacccaaaagaaaga

SEQ ID NO: 34578 - RNA, 19 nt, Homo sapiens
aaaggugcacgaagguaaa

SEQ ID NO: 34579 - RNA, 19 nt, Homo sapiens
ccaagucauagccauaaau

SEQ ID NO: 34580 - RNA, 19 nt, Homo sapiens
uagaagaaacagaaagaag

SEQ ID NO: 34581 - RNA, 19 nt, Homo sapiens
guauauaaaggugcacgaa

SEQ ID NO: 34582 - RNA, 19 nt, Homo sapiens
uggaagcaguaacaugcaa

SEQ ID NO: 34583 - RNA, 19 nt, Homo sapiens
cauguaaugcagaauuuca

SEQ ID NO: 34584 - RNA, 19 nt, Homo sapiens
ucagauaaacccaaaagaa

SEQ ID NO: 34585 - RNA, 19 nt, Homo sapiens
agacaauacgucaggaaau

SEQ ID NO: 34586 - RNA, 19 nt, Homo sapiens
auacucggcucaggccauu

SEQ ID NO: 34587 - RNA, 19 nt, Homo sapiens
aaaacaagacggaaaguga

SEQ ID NO: 34588 - RNA, 19 nt, Homo sapiens
cacaaauaccuggcuauau

SEQ ID NO: 34589 - RNA, 19 nt, Homo sapiens
cuuuaugucugcugugauc

SEQ ID NO: 34590 - RNA, 19 nt, Homo sapiens
caguggaucauaagacaau

SEQ ID NO: 34591 - RNA, 19 nt, Homo sapiens
aaacuucgacaagagaaug

SEQ ID NO: 34592 - RNA, 19 nt, Homo sapiens
aaauccauguaaugcagaa

SEQ ID NO: 34593 - RNA, 19 nt, Homo sapiens
cgucaggaaauaugaagga

SEQ ID NO: 34594 - RNA, 19 nt, Homo sapiens
acagcaugauugacaguag

SEQ ID NO: 34595 - RNA, 19 nt, Homo sapiens
ccucagaacuggucuauuu

SEQ ID NO: 34596 - RNA, 19 nt, Homo sapiens
guacuccuaugcaauauua

SEQ ID NO: 34597 - RNA, 19 nt, Homo sapiens
uagcauagauuugcaguua

SEQ ID NO: 34598 - RNA, 19 nt, Homo sapiens
caaacaagcacuguaauua

SEQ ID NO: 34599 - RNA, 19 nt, Homo sapiens
gcuuagagcuguguugaaa

SEQ ID NO: 34600 - RNA, 19 nt, Homo sapiens
gcacuguaauuauagcuau

SEQ ID NO: 34601 - RNA, 19 nt, Homo sapiens
cgacaaacaagcacuguaa

SEQ ID NO: 34602 - RNA, 19 nt, Homo sapiens
gaagcugccuccgugguuu

SEQ ID NO: 34603 - RNA, 19 nt, Homo sapiens
cacaggaacugguacauuc

SEQ ID NO: 34604 - RNA, 19 nt, Homo sapiens
gagaacacuugaacacaca

SEQ ID NO: 34605 - RNA, 19 nt, Homo sapiens
gaacacacaaggccugauc

SEQ ID NO: 34606 - RNA, 19 nt, Homo sapiens
gaccaccauucccaccaua

SEQ ID NO: 34607 - RNA, 19 nt, Homo sapiens
ggaagaccacgauccucua

SEQ ID NO: 34608 - RNA, 19 nt, Homo sapiens
aggaaccucuuacugcuuu

SEQ ID NO: 34609 - RNA, 19 nt, Homo sapiens
ccucuugcccucugcuuua

SEQ ID NO: 34610 - RNA, 19 nt, Homo sapiens
acaaacaagcacuguaauu

SEQ ID NO: 34611 - RNA, 19 nt, Homo sapiens
uuagagcuguguugaaauc

SEQ ID NO: 34612 - RNA, 19 nt, Homo sapiens
aacaucagcuucacugugu

SEQ ID NO: 34613 - RNA, 19 nt, Homo sapiens
agaccacgauccucuacaa

SEQ ID NO: 34614 - RNA, 19 nt, Homo sapiens
ccaaucagcuccggaacca

SEQ ID NO: 34615 - RNA, 19 nt, Homo sapiens
gcauagauuugcaguuacg

SEQ ID NO: 34616 - RNA, 19 nt, Homo sapiens
uggaaaccguggaguacaa

SEQ ID NO: 34617 - RNA, 19 nt, Homo sapiens
cuggagcuguuaaauuuau

SEQ ID NO: 34618 - RNA, 19 nt, Homo sapiens
gcuggagcuguuaaauuua

SEQ ID NO: 34619 - RNA, 19 nt, Homo sapiens
gcccucugcuuuacucuca

SEQ ID NO: 34620 - RNA, 19 nt, Homo sapiens
ccacaggaacugguacauu

SEQ ID NO: 34621 - RNA, 19 nt, Homo sapiens
acagagagcgugugaacga

SEQ ID NO: 34622 - RNA, 19 nt, Homo sapiens
acgauccucuacaagcuua

SEQ ID NO: 34623 - RNA, 19 nt, Homo sapiens
ccucuuacugcuuucaaua

SEQ ID NO: 34624 - RNA, 19 nt, Homo sapiens
gagcuguguugaaauccau

SEQ ID NO: 34625 - RNA, 19 nt, Homo sapiens
cggccgagaucacagacaa

SEQ ID NO: 34626 - RNA, 19 nt, Homo sapiens
caucuucgccaaccucuuc

SEQ ID NO: 34627 - RNA, 19 nt, Homo sapiens
aaaaucaacucacuguuca

SEQ ID NO: 34628 - RNA, 19 nt, Homo sapiens
ccacgauccucuacaagcu

SEQ ID NO: 34629 - RNA, 19 nt, Homo sapiens
ucuauuuggugucguagga

SEQ ID NO: 34630 - RNA, 19 nt, Homo sapiens
gaacacuugaacacacaga

SEQ ID NO: 34631 - RNA, 19 nt, Homo sapiens
cugguacuccuaugcaaua

SEQ ID NO: 34632 - RNA, 19 nt, Homo sapiens
gaagaccacgauccucuac

SEQ ID NO: 34633 - RNA, 19 nt, Homo sapiens
caacuguuuuguauacuug

SEQ ID NO: 34634 - RNA, 19 nt, Homo sapiens
ugacagagagcgugugaac

SEQ ID NO: 34635 - RNA, 19 nt, Homo sapiens
cacaaggccugaucuucgu

SEQ ID NO: 34636 - RNA, 19 nt, Homo sapiens
uacaagaacaucagcuuca

SEQ ID NO: 34637 - RNA, 19 nt, Homo sapiens
gacaaacaagcacuguaau

SEQ ID NO: 34638 - RNA, 19 nt, Homo sapiens
cagaacuggucuauuuggu

SEQ ID NO: 34639 - RNA, 19 nt, Homo sapiens
gaauccaagucgagaacac

SEQ ID NO: 34640 - RNA, 19 nt, Homo sapiens
ugcuuucaauacacgauua

SEQ ID NO: 34641 - RNA, 19 nt, Homo sapiens
ccaccucugugugugaugu

SEQ ID NO: 34642 - RNA, 19 nt, Homo sapiens
uaagaauccaagucgagaa

SEQ ID NO: 34643 - RNA, 19 nt, Homo sapiens
gcaauauuacucagcuuuu

SEQ ID NO: 34644 - RNA, 19 nt, Homo sapiens
ggucacccugcauuccaua

SEQ ID NO: 34645 - RNA, 19 nt, Homo sapiens
aacccaaacucagugcauu

SEQ ID NO: 34646 - RNA, 19 nt, Homo sapiens
cgacgggcucuaugaagga

SEQ ID NO: 34647 - RNA, 19 nt, Homo sapiens
gaaaccguggaguacaaga

SEQ ID NO: 34648 - RNA, 19 nt, Homo sapiens
agaaaugcgcauccucaug

SEQ ID NO: 34649 - RNA, 19 nt, Homo sapiens
gagaucgugaccaccauuc

SEQ ID NO: 34650 - RNA, 19 nt, Homo sapiens
aaugaggcaguuucuggua

SEQ ID NO: 34651 - RNA, 19 nt, Homo sapiens
aaaccguggaguacaagaa

SEQ ID NO: 34652 - RNA, 19 nt, Homo sapiens
gcagacauaucuucauuaa

SEQ ID NO: 34653 - RNA, 19 nt, Homo sapiens
ggacauagcucuugugaac

SEQ ID NO: 34654 - RNA, 19 nt, Homo sapiens
ccaaggacauguuugauaa

SEQ ID NO: 34655 - RNA, 19 nt, Homo sapiens
agacaaccauucuguauaa

SEQ ID NO: 34656 - RNA, 19 nt, Homo sapiens
ugagacaguuugcuaauuu

SEQ ID NO: 34657 - RNA, 19 nt, Homo sapiens
gagacaguuugcuaauuua

SEQ ID NO: 34658 - RNA, 19 nt, Homo sapiens
ucagugaaaugacagauaa

SEQ ID NO: 34659 - RNA, 19 nt, Homo sapiens
gaaauuggauaucuaacca

SEQ ID NO: 34660 - RNA, 19 nt, Homo sapiens
gggcagacauaucuucauu

SEQ ID NO: 34661 - RNA, 19 nt, Homo sapiens
acaaggaacuggucuguau

SEQ ID NO: 34662 - RNA, 19 nt, Homo sapiens
cauaacccauuuggaauua

SEQ ID NO: 34663 - RNA, 19 nt, Homo sapiens
cagauugucuucccauauu

SEQ ID NO: 34664 - RNA, 19 nt, Homo sapiens
gggcagaauauuaaacuua

SEQ ID NO: 34665 - RNA, 19 nt, Homo sapiens
guagaugaauugagagaug

SEQ ID NO: 34666 - RNA, 19 nt, Homo sapiens
uagcaacgaucgugaaaga

SEQ ID NO: 34667 - RNA, 19 nt, Homo sapiens
aagcauuacuuccagaaua

SEQ ID NO: 34668 - RNA, 19 nt, Homo sapiens
caacgaucgugaaagaauu

SEQ ID NO: 34669 - RNA, 19 nt, Homo sapiens
gaauuaggccucucuggaa

SEQ ID NO: 34670 - RNA, 19 nt, Homo sapiens
gggcuucagucucuucgua

SEQ ID NO: 34671 - RNA, 19 nt, Homo sapiens
cuacuuuacugauaccuuu

SEQ ID NO: 34672 - RNA, 19 nt, Homo sapiens
gcaagacaaccauucugua

SEQ ID NO: 34673 - RNA, 19 nt, Homo sapiens
gaaaugacagauaaacuag

SEQ ID NO: 34674 - RNA, 19 nt, Homo sapiens
uggauuugauagccaauua

SEQ ID NO: 34675 - RNA, 19 nt, Homo sapiens
guaaaugccuggacauagc

SEQ ID NO: 34676 - RNA, 19 nt, Homo sapiens
caagacaaccauucuguau

SEQ ID NO: 34677 - RNA, 19 nt, Homo sapiens
gcaaugugcuugguuuuaa

SEQ ID NO: 34678 - RNA, 19 nt, Homo sapiens
gcaacgaucgugaaagaau

SEQ ID NO: 34679 - RNA, 19 nt, Homo sapiens
ggagauagucaccaccauu

SEQ ID NO: 34680 - RNA, 19 nt, Homo sapiens
guucugugcugguugcaaa

SEQ ID NO: 34681 - RNA, 19 nt, Homo sapiens
uaaccaaggacauguuuga

SEQ ID NO: 34682 - RNA, 19 nt, Homo sapiens
caaaugagcuuucaaaacg

SEQ ID NO: 34683 - RNA, 19 nt, Homo sapiens
cagaugagcugcagaaaau

SEQ ID NO: 34684 - RNA, 19 nt, Homo sapiens
ucugguagaugaauugaga

SEQ ID NO: 34685 - RNA, 19 nt, Homo sapiens
ggaaacaguagaauauaag

SEQ ID NO: 34686 - RNA, 19 nt, Homo sapiens
caaccauucuguauaaacu

SEQ ID NO: 34687 - RNA, 19 nt, Homo sapiens
ccucuucucccgacuauuu

SEQ ID NO: 34688 - RNA, 19 nt, Homo sapiens
cuacaucagccaaacuuaa

SEQ ID NO: 34689 - RNA, 19 nt, Homo sapiens
uuaaaguuaucccuugcua

SEQ ID NO: 34690 - RNA, 19 nt, Homo sapiens
gcagauugucuucccauau

SEQ ID NO: 34691 - RNA, 19 nt, Homo sapiens
guuaucccuugcuacuuua

SEQ ID NO: 34692 - RNA, 19 nt, Homo sapiens
gguuugggcagaauauuaa

SEQ ID NO: 34693 - RNA, 19 nt, Homo sapiens
gauguugguggucaagaua

SEQ ID NO: 34694 - RNA, 19 nt, Homo sapiens
ggauguugguggucaagau

SEQ ID NO: 34695 - RNA, 19 nt, Homo sapiens
aguuaucccuugcuacuuu

SEQ ID NO: 34696 - RNA, 19 nt, Homo sapiens
gauagcaacgaucgugaaa

SEQ ID NO: 34697 - RNA, 19 nt, Homo sapiens
cuucauaacccauuuggaa

SEQ ID NO: 34698 - RNA, 19 nt, Homo sapiens
cgaguauaauguugcuauu

SEQ ID NO: 34699 - RNA, 19 nt, Homo sapiens
gguggucaagauagaauua

SEQ ID NO: 34700 - RNA, 19 nt, Homo sapiens
gagauagucaccaccauuc

SEQ ID NO: 34701 - RNA, 19 nt, Homo sapiens
ugauaguucugcugauguu

SEQ ID NO: 34702 - RNA, 19 nt, Homo sapiens
ggccaucagugaaaugaca

SEQ ID NO: 34703 - RNA, 19 nt, Homo sapiens
gcuauggccaucagugaaa

SEQ ID NO: 34704 - RNA, 19 nt, Homo sapiens
uaugauaguucugcugaug

SEQ ID NO: 34705 - RNA, 19 nt, Homo sapiens
ggacugguuugggcagaau

SEQ ID NO: 34706 - RNA, 19 nt, Homo sapiens
cagguccucuaccggcuua

SEQ ID NO: 34707 - RNA, 19 nt, Homo sapiens
gacaaccauucuguauaaa

SEQ ID NO: 34708 - RNA, 19 nt, Homo sapiens
gauagccaauuaguucugu

SEQ ID NO: 34709 - RNA, 19 nt, Homo sapiens
uagcucuugugaaccuuua

SEQ ID NO: 34710 - RNA, 19 nt, Homo sapiens
gaaauucuccuugggaaaa

SEQ ID NO: 34711 - RNA, 19 nt, Homo sapiens
caaaugcuauggccaucag

SEQ ID NO: 34712 - RNA, 19 nt, Homo sapiens
gaaagaauucaggaaguag

SEQ ID NO: 34713 - RNA, 19 nt, Homo sapiens
uaucauuccugagacaguu

SEQ ID NO: 34714 - RNA, 19 nt, Homo sapiens
ucucuucccucucguuuag

SEQ ID NO: 34715 - RNA, 19 nt, Homo sapiens
cagauaaacuagggcuuca

SEQ ID NO: 34716 - RNA, 19 nt, Homo sapiens
ucauaacccauuuggaauu

SEQ ID NO: 34717 - RNA, 19 nt, Homo sapiens
gcguaaaugccuggacaua

SEQ ID NO: 34718 - RNA, 19 nt, Homo sapiens
ugucaaaugagcuuucaaa

SEQ ID NO: 34719 - RNA, 19 nt, Homo sapiens
ggaugcugcuggcaagaca

SEQ ID NO: 34720 - RNA, 19 nt, Homo sapiens
ggcagacauaucuucauua

SEQ ID NO: 34721 - RNA, 19 nt, Homo sapiens
gcugauguuuuguuuauug

SEQ ID NO: 34722 - RNA, 19 nt, Homo sapiens
cuucccauauugugucuuu

SEQ ID NO: 34723 - RNA, 19 nt, Homo sapiens
aaaugcuucugguagauga

SEQ ID NO: 34724 - RNA, 19 nt, Homo sapiens
gaaaaugcuucugguagau

SEQ ID NO: 34725 - RNA, 19 nt, Homo sapiens
guggaaacaguagaauaua

SEQ ID NO: 34726 - RNA, 19 nt, Homo sapiens
caaggacauguuugauaaa

SEQ ID NO: 34727 - RNA, 19 nt, Homo sapiens
gauaaacuagggcuucagu

SEQ ID NO: 34728 - RNA, 19 nt, Homo sapiens
aagacaaccauucuguaua

SEQ ID NO: 34729 - RNA, 19 nt, Homo sapiens
uguggaaacaguagaauau

SEQ ID NO: 34730 - RNA, 19 nt, Homo sapiens
acacuacucagcucucuug

SEQ ID NO: 34731 - RNA, 19 nt, Homo sapiens
uaguuugccuggagcuuga

SEQ ID NO: 34732 - RNA, 19 nt, Homo sapiens
gccaugggccucacuaucu

SEQ ID NO: 34733 - RNA, 19 nt, Homo sapiens
ccuugcuacuuuacugaua

SEQ ID NO: 34734 - RNA, 19 nt, Homo sapiens
gcugucaaaugagcuuuca

SEQ ID NO: 34735 - RNA, 19 nt, Homo sapiens
ggaacuggucuguaugaag

SEQ ID NO: 34736 - RNA, 19 nt, Homo sapiens
gaaaacucaucaaauucga

SEQ ID NO: 34737 - RNA, 19 nt, Homo sapiens
cugagacaguuugcuaauu

SEQ ID NO: 34738 - RNA, 19 nt, Homo sapiens
uuugauagccaauuaguuc

SEQ ID NO: 34739 - RNA, 19 nt, Homo sapiens
uaaacuagggcuucagucu

SEQ ID NO: 34740 - RNA, 19 nt, Homo sapiens
ggcaagacaaccauucugu

SEQ ID NO: 34741 - RNA, 19 nt, Homo sapiens
gcauguugcuuuuguuauc

SEQ ID NO: 34742 - RNA, 19 nt, Homo sapiens
ugguuugggcagaauauua

SEQ ID NO: 34743 - RNA, 19 nt, Homo sapiens
accaaggacauguuugaua

SEQ ID NO: 34744 - RNA, 19 nt, Homo sapiens
aagaagcagaugcgcauuu

SEQ ID NO: 34745 - RNA, 19 nt, Homo sapiens
gugcuugguuuuaaagaaa

SEQ ID NO: 34746 - RNA, 19 nt, Homo sapiens
gcucuugugaaccuuuaaa

SEQ ID NO: 34747 - RNA, 19 nt, Homo sapiens
uuaauacucagcagauugu

SEQ ID NO: 34748 - RNA, 19 nt, Homo sapiens
agaaagauccaaaacacua

SEQ ID NO: 34749 - RNA, 19 nt, Homo sapiens
gcuuguaccagccagagaa

SEQ ID NO: 34750 - RNA, 19 nt, Homo sapiens
uaauguggaaacaguagaa

SEQ ID NO: 34751 - RNA, 19 nt, Homo sapiens
gcauuuugaugguuggauu

SEQ ID NO: 34752 - RNA, 19 nt, Homo sapiens
gaugggaugucuuugcaua

SEQ ID NO: 34753 - RNA, 19 nt, Homo sapiens
gaauaccagucacauaguu

SEQ ID NO: 34754 - RNA, 19 nt, Homo sapiens
gcaggacuguggagacgua

SEQ ID NO: 34755 - RNA, 19 nt, Homo sapiens
gcauuugccuguaaguuau

SEQ ID NO: 34756 - RNA, 19 nt, Homo sapiens
gagaauguguuugggauga

SEQ ID NO: 34757 - RNA, 19 nt, Homo sapiens
gggaaccacuugacugaga

SEQ ID NO: 34758 - RNA, 19 nt, Homo sapiens
agacguaaauguaaacugu

SEQ ID NO: 34759 - RNA, 19 nt, Homo sapiens
gagaugggaugucuuugca

SEQ ID NO: 34760 - RNA, 19 nt, Homo sapiens
ccuggaaccuucaauuuca

SEQ ID NO: 34761 - RNA, 19 nt, Homo sapiens
gccuguaaguuauuaaaga

SEQ ID NO: 34762 - RNA, 19 nt, Homo sapiens
gaauguguuugggaugaaa

SEQ ID NO: 34763 - RNA, 19 nt, Homo sapiens
guguguguccucuguauua

SEQ ID NO: 34764 - RNA, 19 nt, Homo sapiens
guggagacguaaauguaaa

SEQ ID NO: 34765 - RNA, 19 nt, Homo sapiens
ggcaucaccuuccaagugu

SEQ ID NO: 34766 - RNA, 19 nt, Homo sapiens
ccucgacccuguuucuuau

SEQ ID NO: 34767 - RNA, 19 nt, Homo sapiens
uguguccucuguauuauug

SEQ ID NO: 34768 - RNA, 19 nt, Homo sapiens
gaugggagaugggaugucu

SEQ ID NO: 34769 - RNA, 19 nt, Homo sapiens
gagcgccucuaugagauga

SEQ ID NO: 34770 - RNA, 19 nt, Homo sapiens
ggacuguggagacguaaau

SEQ ID NO: 34771 - RNA, 19 nt, Homo sapiens
gggcuggacucugcuggaa

SEQ ID NO: 34772 - RNA, 19 nt, Homo sapiens
ggaaccacuugacugagau

SEQ ID NO: 34773 - RNA, 19 nt, Homo sapiens
gagaagcugcgaccacugu

SEQ ID NO: 34774 - RNA, 19 nt, Homo sapiens
ugacuuggagaauguguuu

SEQ ID NO: 34775 - RNA, 19 nt, Homo sapiens
gcuggacucugcuggaaag

SEQ ID NO: 34776 - RNA, 19 nt, Homo sapiens
guagauccaugacccuuuu

SEQ ID NO: 34777 - RNA, 19 nt, Homo sapiens
acugauaacuguagcucuu

SEQ ID NO: 34778 - RNA, 19 nt, Homo sapiens
gggaugaaauaacuaucuc

SEQ ID NO: 34779 - RNA, 19 nt, Homo sapiens
aauguaaacugugacucua

SEQ ID NO: 34780 - RNA, 19 nt, Homo sapiens
caaggaguuuguccagagu

SEQ ID NO: 34781 - RNA, 19 nt, Homo sapiens
ggaauaccagucacauagu

SEQ ID NO: 34782 - RNA, 19 nt, Homo sapiens
ucgacccuguuucuuauuu

SEQ ID NO: 34783 - RNA, 19 nt, Homo sapiens
gccuugagcgccucuauga

SEQ ID NO: 34784 - RNA, 19 nt, Homo sapiens
uaaagacugauaacuguag

SEQ ID NO: 34785 - RNA, 19 nt, Homo sapiens
agcauuugccuguaaguua

SEQ ID NO: 34786 - RNA, 19 nt, Homo sapiens
guaggggucugcacacuug

SEQ ID NO: 34787 - RNA, 19 nt, Homo sapiens
gaccuguccaccucaauga

SEQ ID NO: 34788 - RNA, 19 nt, Homo sapiens
uaggaauaccagucacaua

SEQ ID NO: 34789 - RNA, 19 nt, Homo sapiens
acguaaauguaaacuguga

SEQ ID NO: 34790 - RNA, 19 nt, Homo sapiens
ggagaugggaugucuuugc

SEQ ID NO: 34791 - RNA, 19 nt, Homo sapiens
cacuguggcgcucuuauaa

SEQ ID NO: 34792 - RNA, 19 nt, Homo sapiens
ccgccacucucacucaugu

SEQ ID NO: 34793 - RNA, 19 nt, Homo sapiens
cugcugagguggagaagag

SEQ ID NO: 34794 - RNA, 19 nt, Homo sapiens
gggaugucuuugcauaucu

SEQ ID NO: 34795 - RNA, 19 nt, Homo sapiens
uggcaucaccuuccaagug

SEQ ID NO: 34796 - RNA, 19 nt, Homo sapiens
uguggagacguaaauguaa

SEQ ID NO: 34797 - RNA, 19 nt, Homo sapiens
ugggagaugggaugucuuu

SEQ ID NO: 34798 - RNA, 19 nt, Homo sapiens
aggaauaccagucacauag

SEQ ID NO: 34799 - RNA, 19 nt, Homo sapiens
ggaugucuuugcauaucuc

SEQ ID NO: 34800 - RNA, 19 nt, Homo sapiens
cuugagcgccucuaugaga

SEQ ID NO: 34801 - RNA, 19 nt, Homo sapiens
gccucaaguucaaggaguu

SEQ ID NO: 34802 - RNA, 19 nt, Homo sapiens
ucccuggaaccuucaauuu

SEQ ID NO: 34803 - RNA, 19 nt, Homo sapiens
aagccaagguggaguugca

SEQ ID NO: 34804 - RNA, 19 nt, Homo sapiens
gaaccacuugacugagaug

SEQ ID NO: 34805 - RNA, 19 nt, Homo sapiens
agaauguguuugggaugaa

SEQ ID NO: 34806 - RNA, 19 nt, Homo sapiens
ugggaugucuuugcauauc

SEQ ID NO: 34807 - RNA, 19 nt, Homo sapiens
ccuguaaguuauuaaagac

SEQ ID NO: 34808 - RNA, 19 nt, Homo sapiens
cuguggagacguaaaugua

SEQ ID NO: 34809 - RNA, 19 nt, Homo sapiens
gaaccccuccccacauuug

SEQ ID NO: 34810 - RNA, 19 nt, Homo sapiens
aaauguaaacugugacucu

SEQ ID NO: 34811 - RNA, 19 nt, Homo sapiens
uggaaagaccucccuccuu

SEQ ID NO: 34812 - RNA, 19 nt, Homo sapiens
gcuggcaguccgagagcua

SEQ ID NO: 34813 - RNA, 19 nt, Homo sapiens
ggaagccaagguggaguug

SEQ ID NO: 34814 - RNA, 19 nt, Homo sapiens
guaaauguaaacugugacu

SEQ ID NO: 34815 - RNA, 19 nt, Homo sapiens
ccaagaaucugcugaugaa

SEQ ID NO: 34816 - RNA, 19 nt, Homo sapiens
cacuggaucuugaguaaua

SEQ ID NO: 34817 - RNA, 19 nt, Homo sapiens
ggcacuggaucuugaguaa

SEQ ID NO: 34818 - RNA, 19 nt, Homo sapiens
guagaaacaguggaauaua

SEQ ID NO: 34819 - RNA, 19 nt, Homo sapiens
ccacaauccuguacaaacu

SEQ ID NO: 34820 - RNA, 19 nt, Homo sapiens
ugagcgagcugacugacaa

SEQ ID NO: 34821 - RNA, 19 nt, Homo sapiens
gagcagggaucuggguuuc

SEQ ID NO: 34822 - RNA, 19 nt, Homo sapiens
gaaacaguggaauauaaga

SEQ ID NO: 34823 - RNA, 19 nt, Homo sapiens
cugaugaacuccagaagau

SEQ ID NO: 34824 - RNA, 19 nt, Homo sapiens
aaccauaggcuucaaugua

SEQ ID NO: 34825 - RNA, 19 nt, Homo sapiens
gcaagaccacaauccugua

SEQ ID NO: 34826 - RNA, 19 nt, Homo sapiens
cauguucucucuguuguug

SEQ ID NO: 34827 - RNA, 19 nt, Homo sapiens
acaauccuguacaaacuga

SEQ ID NO: 34828 - RNA, 19 nt, Homo sapiens
gcugguauuugccaacaag

SEQ ID NO: 34829 - RNA, 19 nt, Homo sapiens
gggagcggguccaagaauc

SEQ ID NO: 34830 - RNA, 19 nt, Homo sapiens
agaccacaauccuguacaa

SEQ ID NO: 34831 - RNA, 19 nt, Homo sapiens
ggagcagggaucuggguuu

SEQ ID NO: 34832 - RNA, 19 nt, Homo sapiens
gcugaugaacuccagaaga

SEQ ID NO: 34833 - RNA, 19 nt, Homo sapiens
gacaagauucggccucugu

SEQ ID NO: 34834 - RNA, 19 nt, Homo sapiens
accauaggcuucaauguag

SEQ ID NO: 34835 - RNA, 19 nt, Homo sapiens
caauguagaaacaguggaa

SEQ ID NO: 34836 - RNA, 19 nt, Homo sapiens
ccauaggcuucaauguaga

SEQ ID NO: 34837 - RNA, 19 nt, Homo sapiens
gaugcggauucucaugguu

SEQ ID NO: 34838 - RNA, 19 nt, Homo sapiens
gcagggaucuggguuuccu

SEQ ID NO: 34839 - RNA, 19 nt, Homo sapiens
aagcagaugcggauucuca

SEQ ID NO: 34840 - RNA, 19 nt, Homo sapiens
gcagaugcggauucucaug

SEQ ID NO: 34841 - RNA, 19 nt, Homo sapiens
acucagggccucaucuuug

SEQ ID NO: 34842 - RNA, 19 nt, Homo sapiens
agaaucugcugaugaacuc

SEQ ID NO: 34843 - RNA, 19 nt, Homo sapiens
gcuccugccugcauguucu

SEQ ID NO: 34844 - RNA, 19 nt, Homo sapiens
ucucaugguuggcuuggau

SEQ ID NO: 34845 - RNA, 19 nt, Homo sapiens
aggcuucaauguagaaaca

SEQ ID NO: 34846 - RNA, 19 nt, Homo sapiens
ggcuucggguggugcuaua

SEQ ID NO: 34847 - RNA, 19 nt, Homo sapiens
gaagaagcagaugcggauu

SEQ ID NO: 34848 - RNA, 19 nt, Homo sapiens
ggaauauaagaacaucugu

SEQ ID NO: 34849 - RNA, 19 nt, Homo sapiens
uguagaaacaguggaauau

SEQ ID NO: 34850 - RNA, 19 nt, Homo sapiens
gaccacaauccuguacaaa

SEQ ID NO: 34851 - RNA, 19 nt, Homo sapiens
ucuuugugguggacaguaa

SEQ ID NO: 34852 - RNA, 19 nt, Homo sapiens
guccaagaaucugcugaug

SEQ ID NO: 34853 - RNA, 19 nt, Homo sapiens
gggaggccaggacaagauu

SEQ ID NO: 34854 - RNA, 19 nt, Homo sapiens
acaguggaauauaagaaca

SEQ ID NO: 34855 - RNA, 19 nt, Homo sapiens
gaacacucagggccucauc

SEQ ID NO: 34856 - RNA, 19 nt, Homo sapiens
cggcacuacuuccagaaca

SEQ ID NO: 34857 - RNA, 19 nt, Homo sapiens
uccaagaaucugcugauga

SEQ ID NO: 34858 - RNA, 19 nt, Homo sapiens
ggagcggguccaagaaucu

SEQ ID NO: 34859 - RNA, 19 nt, Homo sapiens
agaaacaguggaauauaag

SEQ ID NO: 34860 - RNA, 19 nt, Homo sapiens
gcacuggaucuugaguaau

SEQ ID NO: 34861 - RNA, 19 nt, Homo sapiens
gggagauugucaccaccau

SEQ ID NO: 34862 - RNA, 19 nt, Homo sapiens
cucagggccucaucuuugu

SEQ ID NO: 34863 - RNA, 19 nt, Homo sapiens
caaccauaggcuucaaugu

SEQ ID NO: 34864 - RNA, 19 nt, Homo sapiens
gcuucaauguagaaacagu

SEQ ID NO: 34865 - RNA, 19 nt, Homo sapiens
cauaggcuucaauguagaa

SEQ ID NO: 34866 - RNA, 19 nt, Homo sapiens
gaaguucucugaaauguca

SEQ ID NO: 34867 - RNA, 19 nt, Homo sapiens
gcaaguaaguucugaaaca

SEQ ID NO: 34868 - RNA, 19 nt, Homo sapiens
gcucugaucugacauuuga

SEQ ID NO: 34869 - RNA, 19 nt, Homo sapiens
caacaauccuguacaaguu

SEQ ID NO: 34870 - RNA, 19 nt, Homo sapiens
gcaagucuguuucaucuag

SEQ ID NO: 34871 - RNA, 19 nt, Homo sapiens
gaucugacauuugacauga

SEQ ID NO: 34872 - RNA, 19 nt, Homo sapiens
ucacaugguuaaccucuaa

SEQ ID NO: 34873 - RNA, 19 nt, Homo sapiens
acacaaaguugccaagaug

SEQ ID NO: 34874 - RNA, 19 nt, Homo sapiens
gagagaaucuuucauuuuc

SEQ ID NO: 34875 - RNA, 19 nt, Homo sapiens
ccaguuuccuuaucacuug

SEQ ID NO: 34876 - RNA, 19 nt, Homo sapiens
agacaacaauccuguacaa

SEQ ID NO: 34877 - RNA, 19 nt, Homo sapiens
gaaaugcggauccucaugu

SEQ ID NO: 34878 - RNA, 19 nt, Homo sapiens
ucuaagaccaguauaguaa

SEQ ID NO: 34879 - RNA, 19 nt, Homo sapiens
gagcugcaccgcauuauca

SEQ ID NO: 34880 - RNA, 19 nt, Homo sapiens
ucgagagaaucuuucauuu

SEQ ID NO: 34881 - RNA, 19 nt, Homo sapiens
ggauggcucugaucugaca

SEQ ID NO: 34882 - RNA, 19 nt, Homo sapiens
uaggauggcucugaucuga

SEQ ID NO: 34883 - RNA, 19 nt, Homo sapiens
gaacacaaaguugccaaga

SEQ ID NO: 34884 - RNA, 19 nt, Homo sapiens
ggagaugagggacgccaua

SEQ ID NO: 34885 - RNA, 19 nt, Homo sapiens
gcaagacaacaauccugua

SEQ ID NO: 34886 - RNA, 19 nt, Homo sapiens
ugcuguagauggcuuauuu

SEQ ID NO: 34887 - RNA, 19 nt, Homo sapiens
gaugagggacgccauaauc

SEQ ID NO: 34888 - RNA, 19 nt, Homo sapiens
ggaaacacagcaguucuug

SEQ ID NO: 34889 - RNA, 19 nt, Homo sapiens
cacagcaguucuuggguaa

SEQ ID NO: 34890 - RNA, 19 nt, Homo sapiens
ccucuaacuacaaaucuua

SEQ ID NO: 34891 - RNA, 19 nt, Homo sapiens
ggaaggugcuauccaaaau

SEQ ID NO: 34892 - RNA, 19 nt, Homo sapiens
gaccaguauaguaaacuua

SEQ ID NO: 34893 - RNA, 19 nt, Homo sapiens
gaaaugucagcaaguaagu

SEQ ID NO: 34894 - RNA, 19 nt, Homo sapiens
guagauggcuuauuuugca

SEQ ID NO: 34895 - RNA, 19 nt, Homo sapiens
ugacaugaacacaaaguug

SEQ ID NO: 34896 - RNA, 19 nt, Homo sapiens
caucaccucuuucaauugc

SEQ ID NO: 34897 - RNA, 19 nt, Homo sapiens
gagaugagggacgccauaa

SEQ ID NO: 34898 - RNA, 19 nt, Homo sapiens
uggagacggugacuuacaa

SEQ ID NO: 34899 - RNA, 19 nt, Homo sapiens
cagcaaguaaguucugaaa

SEQ ID NO: 34900 - RNA, 19 nt, Homo sapiens
guaauauguuccaguugca

SEQ ID NO: 34901 - RNA, 19 nt, Homo sapiens
ggaaaugcggauccucaug

SEQ ID NO: 34902 - RNA, 19 nt, Homo sapiens
accaucaccucuuucaauu

SEQ ID NO: 34903 - RNA, 19 nt, Homo sapiens
ccuuaucacuugcuguaga

SEQ ID NO: 34904 - RNA, 19 nt, Homo sapiens
gggaaacacagcaguucuu

SEQ ID NO: 34905 - RNA, 19 nt, Homo sapiens
aaacccauucauaggauua

SEQ ID NO: 34906 - RNA, 19 nt, Homo sapiens
ggaaggagagaaaucaaaa

SEQ ID NO: 34907 - RNA, 19 nt, Homo sapiens
ggacaggaacugguaugug

SEQ ID NO: 34908 - RNA, 19 nt, Homo sapiens
uaagaccaguauaguaaac

SEQ ID NO: 34909 - RNA, 19 nt, Homo sapiens
caccaucaccucuuucaau

SEQ ID NO: 34910 - RNA, 19 nt, Homo sapiens
caggagcugcaccgcauua

SEQ ID NO: 34911 - RNA, 19 nt, Homo sapiens
caaguaaguucugaaacac

SEQ ID NO: 34912 - RNA, 19 nt, Homo sapiens
gaugcuccuuguugacuuc

SEQ ID NO: 34913 - RNA, 19 nt, Homo sapiens
aaaugcggauccucauguu

SEQ ID NO: 34914 - RNA, 19 nt, Homo sapiens
cuggagaaaucaaguugug

SEQ ID NO: 34915 - RNA, 19 nt, Homo sapiens
uugcaagucuguuucaucu

SEQ ID NO: 34916 - RNA, 19 nt, Homo sapiens
gggguuuucucuuuuguuu

SEQ ID NO: 34917 - RNA, 19 nt, Homo sapiens
ugaccaccauucccacugu

SEQ ID NO: 34918 - RNA, 19 nt, Homo sapiens
cccacgagauccaggagaa

SEQ ID NO: 34919 - RNA, 19 nt, Homo sapiens
agaccaguauaguaaacuu

SEQ ID NO: 34920 - RNA, 19 nt, Homo sapiens
ucgccaccaucaccucuuu

SEQ ID NO: 34921 - RNA, 19 nt, Homo sapiens
aaugucaaguucaacguau

SEQ ID NO: 34922 - RNA, 19 nt, Homo sapiens
ggagacggugacuuacaaa

SEQ ID NO: 34923 - RNA, 19 nt, Homo sapiens
acaacaauccuguacaagu

SEQ ID NO: 34924 - RNA, 19 nt, Homo sapiens
cagguaauguaagaaguuc

SEQ ID NO: 34925 - RNA, 19 nt, Homo sapiens
aaacagguaauguaagaag

SEQ ID NO: 34926 - RNA, 19 nt, Homo sapiens
aguggcaaauaaugaguaa

SEQ ID NO: 34927 - RNA, 19 nt, Homo sapiens
acaauccuguacaaguuga

SEQ ID NO: 34928 - RNA, 19 nt, Homo sapiens
caagacaacaauccuguac

SEQ ID NO: 34929 - RNA, 19 nt, Homo sapiens
caauugccacuuucucuuc

SEQ ID NO: 34930 - RNA, 19 nt, Homo sapiens
ugaaaugucagcaaguaag

SEQ ID NO: 34931 - RNA, 19 nt, Homo sapiens
gcaccucaguauguuaaac

SEQ ID NO: 34932 - RNA, 19 nt, Homo sapiens
cgagagaaucuuucauuuu

SEQ ID NO: 34933 - RNA, 19 nt, Homo sapiens
acguggagacggugacuua

SEQ ID NO: 34934 - RNA, 19 nt, Homo sapiens
cuaagaccaguauaguaaa

SEQ ID NO: 34935 - RNA, 19 nt, Homo sapiens
cgacuggagaaaucaaguu

SEQ ID NO: 34936 - RNA, 19 nt, Homo sapiens
uaaccucuaacuacaaauc

SEQ ID NO: 34937 - RNA, 19 nt, Homo sapiens
aaaugucaaguucaacgua

SEQ ID NO: 34938 - RNA, 19 nt, Homo sapiens
cagcaguucuuggguaaaa

SEQ ID NO: 34939 - RNA, 19 nt, Homo sapiens
aacacaaaguugccaagau

SEQ ID NO: 34940 - RNA, 19 nt, Homo sapiens
aguaaguucugaaacacau

SEQ ID NO: 34941 - RNA, 19 nt, Homo sapiens
acagguaauguaagaaguu

SEQ ID NO: 34942 - RNA, 19 nt, Homo sapiens
gacuggagaaaucaaguug

SEQ ID NO: 34943 - RNA, 19 nt, Homo sapiens
gcguuaggauggcucugau

SEQ ID NO: 34944 - RNA, 19 nt, Homo sapiens
ucaauugccacuuucucuu

SEQ ID NO: 34945 - RNA, 19 nt, Homo sapiens
uggaaggagagaaaucaaa

SEQ ID NO: 34946 - RNA, 19 nt, Homo sapiens
gggcucacaugguuaaccu

SEQ ID NO: 34947 - RNA, 19 nt, Homo sapiens
caguugcaccucaguaugu

SEQ ID NO: 34948 - RNA, 19 nt, Homo sapiens
uaucuaagaccaguauagu

SEQ ID NO: 34949 - RNA, 19 nt, Homo sapiens
caagucuguuucaucuagu

SEQ ID NO: 34950 - RNA, 19 nt, Homo sapiens
ucaaugaccgggagaugag

SEQ ID NO: 34951 - RNA, 19 nt, Homo sapiens
aagucuguuucaucuagua

SEQ ID NO: 34952 - RNA, 19 nt, Homo sapiens
gguuuucucuuuuguuugu

SEQ ID NO: 34953 - RNA, 19 nt, Homo sapiens
gaggcuucguuucgguuuc

SEQ ID NO: 34954 - RNA, 19 nt, Homo sapiens
cccaaggucucaucuucgu

SEQ ID NO: 34955 - RNA, 19 nt, Homo sapiens
cuuaucacuugcuguagau

SEQ ID NO: 34956 - RNA, 19 nt, Homo sapiens
uggcucugaucugacauuu

SEQ ID NO: 34957 - RNA, 19 nt, Homo sapiens
uugccacuuucucuucuuu

SEQ ID NO: 34958 - RNA, 19 nt, Homo sapiens
ccugcccgaugccaugaaa

SEQ ID NO: 34959 - RNA, 19 nt, Homo sapiens
ggagcugcaccgcauuauc

SEQ ID NO: 34960 - RNA, 19 nt, Homo sapiens
gaacacagcaguugcaaua

SEQ ID NO: 34961 - RNA, 19 nt, Homo sapiens
gaacaagagugugauguga

SEQ ID NO: 34962 - RNA, 19 nt, Homo sapiens
gaagaaggcccuacaguau

SEQ ID NO: 34963 - RNA, 19 nt, Homo sapiens
caaauucccucuuggugua

SEQ ID NO: 34964 - RNA, 19 nt, Homo sapiens
ggaaacauccgauauaaau

SEQ ID NO: 34965 - RNA, 19 nt, Homo sapiens
gaagacaccagaagaagua

SEQ ID NO: 34966 - RNA, 19 nt, Homo sapiens
gcaauaaccuuggcuuguu

SEQ ID NO: 34967 - RNA, 19 nt, Homo sapiens
gagaaaggcuggucugcuu

SEQ ID NO: 34968 - RNA, 19 nt, Homo sapiens
ggaagaaggcccuacagua

SEQ ID NO: 34969 - RNA, 19 nt, Homo sapiens
gacagucccuuucaaauug

SEQ ID NO: 34970 - RNA, 19 nt, Homo sapiens
aaagagaaguguacauuga

SEQ ID NO: 34971 - RNA, 19 nt, Homo sapiens
agacaaagcuaccacaugu

SEQ ID NO: 34972 - RNA, 19 nt, Homo sapiens
gaaagagaaguguacauug

SEQ ID NO: 34973 - RNA, 19 nt, Homo sapiens
guggaaacauccgauauaa

SEQ ID NO: 34974 - RNA, 19 nt, Homo sapiens
caauaaccuuggcuuguuu

SEQ ID NO: 34975 - RNA, 19 nt, Homo sapiens
gaaguaacucgaacaguga

SEQ ID NO: 34976 - RNA, 19 nt, Homo sapiens
ggaagaaacacucagcuau

SEQ ID NO: 34977 - RNA, 19 nt, Homo sapiens
agacuuauccuuagaaaga

SEQ ID NO: 34978 - RNA, 19 nt, Homo sapiens
ucucauaguuaauggcaua

SEQ ID NO: 34979 - RNA, 19 nt, Homo sapiens
gaagaaacacucagcuauc

SEQ ID NO: 34980 - RNA, 19 nt, Homo sapiens
uggcagaagucaagaagaa

SEQ ID NO: 34981 - RNA, 19 nt, Homo sapiens
ggacuggacccaucuuuca

SEQ ID NO: 34982 - RNA, 19 nt, Homo sapiens
gaccacaguuuggcaauug

SEQ ID NO: 34983 - RNA, 19 nt, Homo sapiens
agugugaugugaaggauua

SEQ ID NO: 34984 - RNA, 19 nt, Homo sapiens
agaaggcccuacaguauug

SEQ ID NO: 34985 - RNA, 19 nt, Homo sapiens
gcaaaagacuuauccuuag

SEQ ID NO: 34986 - RNA, 19 nt, Homo sapiens
gaaguggacagacuaggaa

SEQ ID NO: 34987 - RNA, 19 nt, Homo sapiens
gauaucaacacuccacuga

SEQ ID NO: 34988 - RNA, 19 nt, Homo sapiens
ugacagucccuuucaaauu

SEQ ID NO: 34989 - RNA, 19 nt, Homo sapiens
agaguuauccuucuaaaga

SEQ ID NO: 34990 - RNA, 19 nt, Homo sapiens
acacucagcuaucuacuag

SEQ ID NO: 34991 - RNA, 19 nt, Homo sapiens
uaucaacacuccacugaca

SEQ ID NO: 34992 - RNA, 19 nt, Homo sapiens
uauuggagcuccuuucuca

SEQ ID NO: 34993 - RNA, 19 nt, Homo sapiens
gaagaaaucuacaaaacag

SEQ ID NO: 34994 - RNA, 19 nt, Homo sapiens
guggaaagguacuaugugu

SEQ ID NO: 34995 - RNA, 19 nt, Homo sapiens
gagaaguguacauugauuu

SEQ ID NO: 34996 - RNA, 19 nt, Homo sapiens
ucacaagccuauugacuac

SEQ ID NO: 34997 - RNA, 19 nt, Homo sapiens
gcaaggugauggaagaaac

SEQ ID NO: 34998 - RNA, 19 nt, Homo sapiens
ugacaucccuaaugacagu

SEQ ID NO: 34999 - RNA, 19 nt, Homo sapiens
caagauguggaaauucuaa

SEQ ID NO: 35000 - RNA, 19 nt, Homo sapiens
gguaaucacaagccuauug

SEQ ID NO: 35001 - RNA, 19 nt, Homo sapiens
gaaaggcuggucugcuuga

SEQ ID NO: 35002 - RNA, 19 nt, Homo sapiens
agagaaguguacauugauu

SEQ ID NO: 35003 - RNA, 19 nt, Homo sapiens
cuaaguaaauguggaaaca

SEQ ID NO: 35004 - RNA, 19 nt, Homo sapiens
gagcucaagugcagcaaag

SEQ ID NO: 35005 - RNA, 19 nt, Homo sapiens
uugcugacaucccuaauga

SEQ ID NO: 35006 - RNA, 19 nt, Homo sapiens
uaacccaccuaaguaaaug

SEQ ID NO: 35007 - RNA, 19 nt, Homo sapiens
aagaagaacggaagaauca

SEQ ID NO: 35008 - RNA, 19 nt, Homo sapiens
uuaaagaacaagaguguga

SEQ ID NO: 35009 - RNA, 19 nt, Homo sapiens
ggcaaaagacuuauccuua

SEQ ID NO: 35010 - RNA, 19 nt, Homo sapiens
guaaucacaagccuauuga

SEQ ID NO: 35011 - RNA, 19 nt, Homo sapiens
gaaacacucagcuaucuac

SEQ ID NO: 35012 - RNA, 19 nt, Homo sapiens
gggcggagaccacaguuug

SEQ ID NO: 35013 - RNA, 19 nt, Homo sapiens
agaaagagaaguguacauu

SEQ ID NO: 35014 - RNA, 19 nt, Homo sapiens
uggcauaauuagaaagcua

SEQ ID NO: 35015 - RNA, 19 nt, Homo sapiens
ggaagacaccagaagaagu

SEQ ID NO: 35016 - RNA, 19 nt, Homo sapiens
gggcuacucucaggauuag

SEQ ID NO: 35017 - RNA, 19 nt, Homo sapiens
gcccuacaguauugagaaa

SEQ ID NO: 35018 - RNA, 19 nt, Homo sapiens
gagacaaagcuaccacaug

SEQ ID NO: 35019 - RNA, 19 nt, Homo sapiens
caaaagacuuauccuuaga

SEQ ID NO: 35020 - RNA, 19 nt, Homo sapiens
uaacuuggcaaaagacuua

SEQ ID NO: 35021 - RNA, 19 nt, Homo sapiens
cuacaucacagaagaaauc

SEQ ID NO: 35022 - RNA, 19 nt, Homo sapiens
ggccaauucaucuaaguuu

SEQ ID NO: 35023 - RNA, 19 nt, Homo sapiens
gaacuaaaaggaaagauuc

SEQ ID NO: 35024 - RNA, 19 nt, Homo sapiens
caagaagaacggaagaauc

SEQ ID NO: 35025 - RNA, 19 nt, Homo sapiens
ugacugaaguggacagacu

SEQ ID NO: 35026 - RNA, 19 nt, Homo sapiens
ugaaggaacuaaaaggaaa

SEQ ID NO: 35027 - RNA, 19 nt, Homo sapiens
gguacuauguguccauguc

SEQ ID NO: 35028 - RNA, 19 nt, Homo sapiens
gaaacauccgauauaaauc

SEQ ID NO: 35029 - RNA, 19 nt, Homo sapiens
gaaaaggccaauucaucua

SEQ ID NO: 35030 - RNA, 19 nt, Homo sapiens
uguggaaacauccgauaua

SEQ ID NO: 35031 - RNA, 19 nt, Homo sapiens
ucacagaagaaaucuacaa

SEQ ID NO: 35032 - RNA, 19 nt, Homo sapiens
aagaaacacucagcuaucu

SEQ ID NO: 35033 - RNA, 19 nt, Homo sapiens
uggacaaccuguaucuuuc

SEQ ID NO: 35034 - RNA, 19 nt, Homo sapiens
uaaugacagucccuuucaa

SEQ ID NO: 35035 - RNA, 19 nt, Homo sapiens
ccagaaccauagggauuau

SEQ ID NO: 35036 - RNA, 19 nt, Homo sapiens
gaagaaguaacucgaacag

SEQ ID NO: 35037 - RNA, 19 nt, Homo sapiens
acucagcuaucuacuagga

SEQ ID NO: 35038 - RNA, 19 nt, Homo sapiens
ugccaaggauauuguguau

SEQ ID NO: 35039 - RNA, 19 nt, Homo sapiens
cugggugacucccuguaua

SEQ ID NO: 35040 - RNA, 19 nt, Homo sapiens
gcugacaucccuaaugaca

SEQ ID NO: 35041 - RNA, 19 nt, Homo sapiens
acacagcaguugcaauaac

SEQ ID NO: 35042 - RNA, 19 nt, Homo sapiens
gaaagaaaaggccaauuca

SEQ ID NO: 35043 - RNA, 19 nt, Homo sapiens
gagaagugucagagcauga

SEQ ID NO: 35044 - RNA, 19 nt, Homo sapiens
ugaaaacucuaggcauuaa

SEQ ID NO: 35045 - RNA, 19 nt, Homo sapiens
acaagagugugaugugaag

SEQ ID NO: 35046 - RNA, 19 nt, Homo sapiens
aagaaggcccuacaguauu

SEQ ID NO: 35047 - RNA, 19 nt, Homo sapiens
caagguggcagaagucaag

SEQ ID NO: 35048 - RNA, 19 nt, Homo sapiens
ggucugcuugagaaacuua

SEQ ID NO: 35049 - RNA, 19 nt, Homo sapiens
gcagcaaagagaaguguca

SEQ ID NO: 35050 - RNA, 19 nt, Homo sapiens
ggggaacacuacauuuuga

SEQ ID NO: 35051 - RNA, 19 nt, Homo sapiens
aggcuggucugcuugagaa

SEQ ID NO: 35052 - RNA, 19 nt, Homo sapiens
gaccugcccuuugcugaca

SEQ ID NO: 35053 - RNA, 19 nt, Homo sapiens
ggaaucaggagacaaagcu

SEQ ID NO: 35054 - RNA, 19 nt, Homo sapiens
gauguggaaauucuaacuu

SEQ ID NO: 35055 - RNA, 19 nt, Homo sapiens
ccagaagaaguaacucgaa

SEQ ID NO: 35056 - RNA, 19 nt, Homo sapiens
cacagaagaaaucuacaaa

SEQ ID NO: 35057 - RNA, 19 nt, Homo sapiens
gguggaugcucacacugau

SEQ ID NO: 35058 - RNA, 19 nt, Homo sapiens
cagaagaaaucuacaaaac

SEQ ID NO: 35059 - RNA, 19 nt, Homo sapiens
guccagaaccauagggauu

SEQ ID NO: 35060 - RNA, 19 nt, Homo sapiens
gaucaaaccuuguaucucu

SEQ ID NO: 35061 - RNA, 19 nt, Homo sapiens
ucagagaacuacaggauaa

SEQ ID NO: 35062 - RNA, 19 nt, Homo sapiens
gcacugacauguuucacaa

SEQ ID NO: 35063 - RNA, 19 nt, Homo sapiens
gaacuaugauauccaguau

SEQ ID NO: 35064 - RNA, 19 nt, Homo sapiens
ccacaaacccuucccuaua

SEQ ID NO: 35065 - RNA, 19 nt, Homo sapiens
uggauaaccuuccuucuaa

SEQ ID NO: 35066 - RNA, 19 nt, Homo sapiens
ggacuaaccuaucgagaag

SEQ ID NO: 35067 - RNA, 19 nt, Homo sapiens
gcgaaagaauuuguaguaa

SEQ ID NO: 35068 - RNA, 19 nt, Homo sapiens
ucacagaaauguuaaacug

SEQ ID NO: 35069 - RNA, 19 nt, Homo sapiens
ggucaauacugccuuaaug

SEQ ID NO: 35070 - RNA, 19 nt, Homo sapiens
ccaguaagaugauaaugga

SEQ ID NO: 35071 - RNA, 19 nt, Homo sapiens
gcaaguauuguguauauug

SEQ ID NO: 35072 - RNA, 19 nt, Homo sapiens
ccacaucccuaacaucaug

SEQ ID NO: 35073 - RNA, 19 nt, Homo sapiens
cgagaaggcauguauauug

SEQ ID NO: 35074 - RNA, 19 nt, Homo sapiens
ugaaaaggcucuccaguuu

SEQ ID NO: 35075 - RNA, 19 nt, Homo sapiens
ggggauagaugaauacuaa

SEQ ID NO: 35076 - RNA, 19 nt, Homo sapiens
ggaacuggcugaggugguu

SEQ ID NO: 35077 - RNA, 19 nt, Homo sapiens
gacaaagaccaauccauuu

SEQ ID NO: 35078 - RNA, 19 nt, Homo sapiens
gaccaauacuacuguaaau

SEQ ID NO: 35079 - RNA, 19 nt, Homo sapiens
ugaagucaauccucaguug

SEQ ID NO: 35080 - RNA, 19 nt, Homo sapiens
guacucauaagguucuuua

SEQ ID NO: 35081 - RNA, 19 nt, Homo sapiens
ggauaaccuuccuucuaaa

SEQ ID NO: 35082 - RNA, 19 nt, Homo sapiens
cacaaacccuucccuauag

SEQ ID NO: 35083 - RNA, 19 nt, Homo sapiens
cagcuaaccuggcaguaga

SEQ ID NO: 35084 - RNA, 19 nt, Homo sapiens
ggucauggaacgaacauuu

SEQ ID NO: 35085 - RNA, 19 nt, Homo sapiens
agacaaagaccaauccauu

SEQ ID NO: 35086 - RNA, 19 nt, Homo sapiens
gaagucauaaacagcauuu

SEQ ID NO: 35087 - RNA, 19 nt, Homo sapiens
gagaaggcauguauauugc

SEQ ID NO: 35088 - RNA, 19 nt, Homo sapiens
gaacauuuacacauucuca

SEQ ID NO: 35089 - RNA, 19 nt, Homo sapiens
acaacaaccugauagugaa

SEQ ID NO: 35090 - RNA, 19 nt, Homo sapiens
ucaaaguucugguccacaa

SEQ ID NO: 35091 - RNA, 19 nt, Homo sapiens
cugcaaguauuguguauau

SEQ ID NO: 35092 - RNA, 19 nt, Homo sapiens
uagcagagcugugucagau

SEQ ID NO: 35093 - RNA, 19 nt, Homo sapiens
gaccacggcuggauacucu

SEQ ID NO: 35094 - RNA, 19 nt, Homo sapiens
uaucagcacuggaucuugu

SEQ ID NO: 35095 - RNA, 19 nt, Homo sapiens
ggacagccaguuucauuuc

SEQ ID NO: 35096 - RNA, 19 nt, Homo sapiens
guagucagaaguuuggaua

SEQ ID NO: 35097 - RNA, 19 nt, Homo sapiens
guucacaggguauuaauau

SEQ ID NO: 35098 - RNA, 19 nt, Homo sapiens
gauauugaucgacuuggua

SEQ ID NO: 35099 - RNA, 19 nt, Homo sapiens
ccaauacuacuguaaaugu

SEQ ID NO: 35100 - RNA, 19 nt, Homo sapiens
ugagaacauuuacacauuc

SEQ ID NO: 35101 - RNA, 19 nt, Homo sapiens
gaccaauccauuugaguuu

SEQ ID NO: 35102 - RNA, 19 nt, Homo sapiens
cuaccucacagaaauguua

SEQ ID NO: 35103 - RNA, 19 nt, Homo sapiens
gcaguucacaggguauuaa

SEQ ID NO: 35104 - RNA, 19 nt, Homo sapiens
gcugaggaaauacacaaua

SEQ ID NO: 35105 - RNA, 19 nt, Homo sapiens
caugagagauauugaucga

SEQ ID NO: 35106 - RNA, 19 nt, Homo sapiens
uaccacaacucccaggauu

SEQ ID NO: 35107 - RNA, 19 nt, Homo sapiens
gagcuccaguaagaugaua

SEQ ID NO: 35108 - RNA, 19 nt, Homo sapiens
caucaugcauucacaaggu

SEQ ID NO: 35109 - RNA, 19 nt, Homo sapiens
guuguuccuucacauuuaa

SEQ ID NO: 35110 - RNA, 19 nt, Homo sapiens
guaagaugauaauggaaag

SEQ ID NO: 35111 - RNA, 19 nt, Homo sapiens
aagcacgugugagaauuua

SEQ ID NO: 35112 - RNA, 19 nt, Homo sapiens
gggacuaaccuaucgagaa

SEQ ID NO: 35113 - RNA, 19 nt, Homo sapiens
gaggcuguauguuugauca

SEQ ID NO: 35114 - RNA, 19 nt, Homo sapiens
gcccagaccuuuguguugu

SEQ ID NO: 35115 - RNA, 19 nt, Homo sapiens
uaaccuuccuucuaaacau

SEQ ID NO: 35116 - RNA, 19 nt, Homo sapiens
uguuguuccuucacauuua

SEQ ID NO: 35117 - RNA, 19 nt, Homo sapiens
aauacugccuuaaugagaa

SEQ ID NO: 35118 - RNA, 19 nt, Homo sapiens
acugugcacugacauguuu

SEQ ID NO: 35119 - RNA, 19 nt, Homo sapiens
ucaagcacgugugagaauu

SEQ ID NO: 35120 - RNA, 19 nt, Homo sapiens
ggauggcgagcuccaguaa

SEQ ID NO: 35121 - RNA, 19 nt, Homo sapiens
ggaacgaacauuugaucug

SEQ ID NO: 35122 - RNA, 19 nt, Homo sapiens
caaguauuguguauauugg

SEQ ID NO: 35123 - RNA, 19 nt, Homo sapiens
uacaacaaccugauaguga

SEQ ID NO: 35124 - RNA, 19 nt, Homo sapiens
cagaaauguuaaacugaga

SEQ ID NO: 35125 - RNA, 19 nt, Homo sapiens
cacauucucacaauuguaa

SEQ ID NO: 35126 - RNA, 19 nt, Homo sapiens
cauuugaucugcugauugg

SEQ ID NO: 35127 - RNA, 19 nt, Homo sapiens
guucuuuagcugucacuua

SEQ ID NO: 35128 - RNA, 19 nt, Homo sapiens
gaaguacucauaagguucu

SEQ ID NO: 35129 - RNA, 19 nt, Homo sapiens
acucugaggcuguauguuu

SEQ ID NO: 35130 - RNA, 19 nt, Homo sapiens
caagcacgugugagaauuu

SEQ ID NO: 35131 - RNA, 19 nt, Homo sapiens
gaaaaucaagcacguguga

SEQ ID NO: 35132 - RNA, 19 nt, Homo sapiens
uagcaggaaguacucauaa

SEQ ID NO: 35133 - RNA, 19 nt, Homo sapiens
gugcauccuugaacuguca

SEQ ID NO: 35134 - RNA, 19 nt, Homo sapiens
ggugaccaauacuacugua

SEQ ID NO: 35135 - RNA, 19 nt, Homo sapiens
uuacacauucucacaauug

SEQ ID NO: 35136 - RNA, 19 nt, Homo sapiens
caauacugccuuaaugaga

SEQ ID NO: 35137 - RNA, 19 nt, Homo sapiens
ccagaauuaugaggcauug

SEQ ID NO: 35138 - RNA, 19 nt, Homo sapiens
gagacacugugcacugaca

SEQ ID NO: 35139 - RNA, 19 nt, Homo sapiens
ugaccaauacuacuguaaa

SEQ ID NO: 35140 - RNA, 19 nt, Homo sapiens
gaaggagggcauauugucu

SEQ ID NO: 35141 - RNA, 19 nt, Homo sapiens
gagagauauugaucgacuu

SEQ ID NO: 35142 - RNA, 19 nt, Homo sapiens
ggcaaucgguaccauuagu

SEQ ID NO: 35143 - RNA, 19 nt, Homo sapiens
aggaaguacucauaagguu

SEQ ID NO: 35144 - RNA, 19 nt, Homo sapiens
ugcgaaagaauuuguagua

SEQ ID NO: 35145 - RNA, 19 nt, Homo sapiens
gagaaggagggcauauugu

SEQ ID NO: 35146 - RNA, 19 nt, Homo sapiens
agagaaggagggcauauug

SEQ ID NO: 35147 - RNA, 19 nt, Homo sapiens
ccuuguaucucuucugcaa

SEQ ID NO: 35148 - RNA, 19 nt, Homo sapiens
ggaguagucagaaguuugg

SEQ ID NO: 35149 - RNA, 19 nt, Homo sapiens
caauggcugcgaaagaauu

SEQ ID NO: 35150 - RNA, 19 nt, Homo sapiens
gaacauuugaucugcugau

SEQ ID NO: 35151 - RNA, 19 nt, Homo sapiens
uaucucuucugcaaguauu

SEQ ID NO: 35152 - RNA, 19 nt, Homo sapiens
gcaggaaguacucauaagg

SEQ ID NO: 35153 - RNA, 19 nt, Homo sapiens
guucaauggcugcgaaaga

SEQ ID NO: 35154 - RNA, 19 nt, Homo sapiens
acaaacccuucccuauaga

SEQ ID NO: 35155 - RNA, 19 nt, Homo sapiens
uaaaguuuccccucuauuu

SEQ ID NO: 35156 - RNA, 19 nt, Homo sapiens
gaggaagaggcgaagacua

SEQ ID NO: 35157 - RNA, 19 nt, Homo sapiens
ggcaagagacaaagaccaa

SEQ ID NO: 35158 - RNA, 19 nt, Homo sapiens
agaacuaugauauccagua

SEQ ID NO: 35159 - RNA, 19 nt, Homo sapiens
gggaguagucagaaguuug

SEQ ID NO: 35160 - RNA, 19 nt, Homo sapiens
cgacagcccugauaguuua

SEQ ID NO: 35161 - RNA, 19 nt, Homo sapiens
ggaagaaacuggugauugu

SEQ ID NO: 35162 - RNA, 19 nt, Homo sapiens
gaaauaaagucagauggaa

SEQ ID NO: 35163 - RNA, 19 nt, Homo sapiens
gagcugggcuaaguaaaua

SEQ ID NO: 35164 - RNA, 19 nt, Homo sapiens
gaagugcuguuuauuaauc

SEQ ID NO: 35165 - RNA, 19 nt, Homo sapiens
gaccaaagauggagugaga

SEQ ID NO: 35166 - RNA, 19 nt, Homo sapiens
ggacacagcugggcaggaa

SEQ ID NO: 35167 - RNA, 19 nt, Homo sapiens
gauaaaagauggccauauu

SEQ ID NO: 35168 - RNA, 19 nt, Homo sapiens
guucugugguuucauguua

SEQ ID NO: 35169 - RNA, 19 nt, Homo sapiens
gcaauuagacacuuuggaa

SEQ ID NO: 35170 - RNA, 19 nt, Homo sapiens
caaggaauuucuuaacuuc

SEQ ID NO: 35171 - RNA, 19 nt, Homo sapiens
ggcuguaacuacuuuauaa

SEQ ID NO: 35172 - RNA, 19 nt, Homo sapiens
ccacaguguuugagaacua

SEQ ID NO: 35173 - RNA, 19 nt, Homo sapiens
gcagagauauggcaaacag

SEQ ID NO: 35174 - RNA, 19 nt, Homo sapiens
ggaaauaaagucagaugga

SEQ ID NO: 35175 - RNA, 19 nt, Homo sapiens
caagaaguguaugguuuaa

SEQ ID NO: 35176 - RNA, 19 nt, Homo sapiens
gaagccaacuaugauuauu

SEQ ID NO: 35177 - RNA, 19 nt, Homo sapiens
aaagucagauggaaauuca

SEQ ID NO: 35178 - RNA, 19 nt, Homo sapiens
uaacauguccugcccuauu

SEQ ID NO: 35179 - RNA, 19 nt, Homo sapiens
cagcugggcaggaagauua

SEQ ID NO: 35180 - RNA, 19 nt, Homo sapiens
ucaagaaguguaugguuua

SEQ ID NO: 35181 - RNA, 19 nt, Homo sapiens
caaaucagaagucaucuug

SEQ ID NO: 35182 - RNA, 19 nt, Homo sapiens
ggaauuucuuaacuucuug

SEQ ID NO: 35183 - RNA, 19 nt, Homo sapiens
gcccuuaugcgguuaauuu

SEQ ID NO: 35184 - RNA, 19 nt, Homo sapiens
caaacaggauuggcgcuuu

SEQ ID NO: 35185 - RNA, 19 nt, Homo sapiens
aacauguccugcccuauua

SEQ ID NO: 35186 - RNA, 19 nt, Homo sapiens
gaaagagaaacaguuggua

SEQ ID NO: 35187 - RNA, 19 nt, Homo sapiens
gaagaaggcagagauaugg

SEQ ID NO: 35188 - RNA, 19 nt, Homo sapiens
gauggagccuguggaaaga

SEQ ID NO: 35189 - RNA, 19 nt, Homo sapiens
uagaagccaacuaugauua

SEQ ID NO: 35190 - RNA, 19 nt, Homo sapiens
agaacuauguggcagauau

SEQ ID NO: 35191 - RNA, 19 nt, Homo sapiens
guaaauaggaauugguuuc

SEQ ID NO: 35192 - RNA, 19 nt, Homo sapiens
cauguuaguuaccuuauag

SEQ ID NO: 35193 - RNA, 19 nt, Homo sapiens
aaagagaaacaguugguaa

SEQ ID NO: 35194 - RNA, 19 nt, Homo sapiens
agaaguguaugguuuaaag

SEQ ID NO: 35195 - RNA, 19 nt, Homo sapiens
cucaagaaguguaugguuu

SEQ ID NO: 35196 - RNA, 19 nt, Homo sapiens
caauuaggcuguaacuacu

SEQ ID NO: 35197 - RNA, 19 nt, Homo sapiens
cuuaacuucuugcuucuuu

SEQ ID NO: 35198 - RNA, 19 nt, Homo sapiens
gauguuauacugauguguu

SEQ ID NO: 35199 - RNA, 19 nt, Homo sapiens
ggagcugggcuaaguaaau

SEQ ID NO: 35200 - RNA, 19 nt, Homo sapiens
aaaaugggcucaaccagaa

SEQ ID NO: 35201 - RNA, 19 nt, Homo sapiens
ucaauuaggcuguaacuac

SEQ ID NO: 35202 - RNA, 19 nt, Homo sapiens
guauuuagaagccaacuau

SEQ ID NO: 35203 - RNA, 19 nt, Homo sapiens
gaagaaacuggugauuguu

SEQ ID NO: 35204 - RNA, 19 nt, Homo sapiens
ccauggagcugggcuaagu

SEQ ID NO: 35205 - RNA, 19 nt, Homo sapiens
ggaaugaugagcacacaag

SEQ ID NO: 35206 - RNA, 19 nt, Homo sapiens
uagaaaacaucccagaaaa

SEQ ID NO: 35207 - RNA, 19 nt, Homo sapiens
aaauauaucuacccagacu

SEQ ID NO: 35208 - RNA, 19 nt, Homo sapiens
ggcgggagcuagccaagau

SEQ ID NO: 35209 - RNA, 19 nt, Homo sapiens
gaauaaaggcaguuuucua

SEQ ID NO: 35210 - RNA, 19 nt, Homo sapiens
aaagacaugcuugcucaua

SEQ ID NO: 35211 - RNA, 19 nt, Homo sapiens
ucaggcaauuagacacuuu

SEQ ID NO: 35212 - RNA, 19 nt, Homo sapiens
cuaauacugucaucucaag

SEQ ID NO: 35213 - RNA, 19 nt, Homo sapiens
uuacaaaucagaagucauc

SEQ ID NO: 35214 - RNA, 19 nt, Homo sapiens
ugaagaaggcagagauaug

SEQ ID NO: 35215 - RNA, 19 nt, Homo sapiens
cuagaaagagaaacaguug

SEQ ID NO: 35216 - RNA, 19 nt, Homo sapiens
gaaguguaugguuuaaaga

SEQ ID NO: 35217 - RNA, 19 nt, Homo sapiens
ccaaagauggagugagaga

SEQ ID NO: 35218 - RNA, 19 nt, Homo sapiens
gcagguagaguuggcuuug

SEQ ID NO: 35219 - RNA, 19 nt, Homo sapiens
gaaaacaucccagaaaagu

SEQ ID NO: 35220 - RNA, 19 nt, Homo sapiens
ggugauuguuggugaugga

SEQ ID NO: 35221 - RNA, 19 nt, Homo sapiens
gaacuauguggcagauauc

SEQ ID NO: 35222 - RNA, 19 nt, Homo sapiens
agacaugcuugcucauagu

SEQ ID NO: 35223 - RNA, 19 nt, Homo sapiens
caucuugcuaccaguauuu

SEQ ID NO: 35224 - RNA, 19 nt, Homo sapiens
cuaauucacagugcucuuu

SEQ ID NO: 35225 - RNA, 19 nt, Homo sapiens
gauauggcaaacaggauug

SEQ ID NO: 35226 - RNA, 19 nt, Homo sapiens
gcacacaaggcgggagcua

SEQ ID NO: 35227 - RNA, 19 nt, Homo sapiens
cuacccagauaccgauguu

SEQ ID NO: 35228 - RNA, 19 nt, Homo sapiens
guucagcaaagaccaaaga

SEQ ID NO: 35229 - RNA, 19 nt, Homo sapiens
aagacaugcuugcucauag

SEQ ID NO: 35230 - RNA, 19 nt, Homo sapiens
uuaagcgucuggcucuaau

SEQ ID NO: 35231 - RNA, 19 nt, Homo sapiens
ugucucaccuggacuuaag

SEQ ID NO: 35232 - RNA, 19 nt, Homo sapiens
guuugucacuuuucugaua

SEQ ID NO: 35233 - RNA, 19 nt, Homo sapiens
guguaugguuuaaagaagu

SEQ ID NO: 35234 - RNA, 19 nt, Homo sapiens
acugucaucucaagaagug

SEQ ID NO: 35235 - RNA, 19 nt, Homo sapiens
aaucagaagucaucuugcu

SEQ ID NO: 35236 - RNA, 19 nt, Homo sapiens
agauaccgauguuauacug

SEQ ID NO: 35237 - RNA, 19 nt, Homo sapiens
ggagccaccaguucucaug

SEQ ID NO: 35238 - RNA, 19 nt, Homo sapiens
cuaaguaaauaggaauugg

SEQ ID NO: 35239 - RNA, 19 nt, Homo sapiens
uaaagucagauggaaauuc

SEQ ID NO: 35240 - RNA, 19 nt, Homo sapiens
guccugcccuauuaucugu

SEQ ID NO: 35241 - RNA, 19 nt, Homo sapiens
guugguaacuuuugucaau

SEQ ID NO: 35242 - RNA, 19 nt, Homo sapiens
ggugauggagccuguggaa

SEQ ID NO: 35243 - RNA, 19 nt, Homo sapiens
cggaagaaacuggugauug

SEQ ID NO: 35244 - RNA, 19 nt, Homo sapiens
caagcuagacgugggaaga

SEQ ID NO: 35245 - RNA, 19 nt, Homo sapiens
gaagcaggagccggugaaa

SEQ ID NO: 35246 - RNA, 19 nt, Homo sapiens
gcuaaguaaauaggaauug

SEQ ID NO: 35247 - RNA, 19 nt, Homo sapiens
cuccgucgguucucucauu

SEQ ID NO: 35248 - RNA, 19 nt, Homo sapiens
ugauggagccuguggaaag

SEQ ID NO: 35249 - RNA, 19 nt, Homo sapiens
gguuuaaagaaguguauug

SEQ ID NO: 35250 - RNA, 19 nt, Homo sapiens
aaacaggauuggcgcuuuu

SEQ ID NO: 35251 - RNA, 19 nt, Homo sapiens
ccccagaagucaagcauuu

SEQ ID NO: 35252 - RNA, 19 nt, Homo sapiens
gcacucagucucucuucuc

SEQ ID NO: 35253 - RNA, 19 nt, Homo sapiens
ccagaggagccaccaguuc

SEQ ID NO: 35254 - RNA, 19 nt, Homo sapiens
uaaauucccguuugucacu

SEQ ID NO: 35255 - RNA, 19 nt, Homo sapiens
ugagaacuauguggcagau

SEQ ID NO: 35256 - RNA, 19 nt, Homo sapiens
gcaagcacagcccuuaugc

SEQ ID NO: 35257 - RNA, 19 nt, Homo sapiens
cauggaguguucagcaaag

SEQ ID NO: 35258 - RNA, 19 nt, Homo sapiens
ccugaagaaggcagagaua

SEQ ID NO: 35259 - RNA, 19 nt, Homo sapiens
aagaaacuggugauuguug

SEQ ID NO: 35260 - RNA, 19 nt, Homo sapiens
gcacuucugucccaaugug

SEQ ID NO: 35261 - RNA, 19 nt, Homo sapiens
cagaacggcugcaucaacu

SEQ ID NO: 35262 - RNA, 19 nt, Homo sapiens
cauccaagccuacgacuac

SEQ ID NO: 35263 - RNA, 19 nt, Homo sapiens
guacgugcccaccgucuuc

SEQ ID NO: 35264 - RNA, 19 nt, Homo sapiens
ggacaccgacgucauucuc

SEQ ID NO: 35265 - RNA, 19 nt, Homo sapiens
ccaccgucuucgagaacua

SEQ ID NO: 35266 - RNA, 19 nt, Homo sapiens
cggacucgcuggagaacau

SEQ ID NO: 35267 - RNA, 19 nt, Homo sapiens
aagcacuucugucccaaug

SEQ ID NO: 35268 - RNA, 19 nt, Homo sapiens
gcauccaagccuacgacua

SEQ ID NO: 35269 - RNA, 19 nt, Homo sapiens
agacgugccugcugaucgu

SEQ ID NO: 35270 - RNA, 19 nt, Homo sapiens
ccagaacggcugcaucaac

SEQ ID NO: 35271 - RNA, 19 nt, Homo sapiens
caacugcugcaaggugcua

SEQ ID NO: 35272 - RNA, 19 nt, Homo sapiens
gcaagacgugccugcugau

SEQ ID NO: 35273 - RNA, 19 nt, Homo sapiens
gcucugccaagaccaagga

SEQ ID NO: 35274 - RNA, 19 nt, Homo sapiens
ggagagagcuggccaagau

SEQ ID NO: 35275 - RNA, 19 nt, Homo sapiens
gaaagaagcuggugaucgu

SEQ ID NO: 35276 - RNA, 19 nt, Homo sapiens
cuacgucccuacugucuuu

SEQ ID NO: 35277 - RNA, 19 nt, Homo sapiens
gaacuauauugcggacauu

SEQ ID NO: 35278 - RNA, 19 nt, Homo sapiens
gcaggaagacuaugaucga

SEQ ID NO: 35279 - RNA, 19 nt, Homo sapiens
ggacacagcagggcaggaa

SEQ ID NO: 35280 - RNA, 19 nt, Homo sapiens
agaaggaccugaggcaaga

SEQ ID NO: 35281 - RNA, 19 nt, Homo sapiens
gauggugccugugggaaga

SEQ ID NO: 35282 - RNA, 19 nt, Homo sapiens
cagcagggcaggaagacua

SEQ ID NO: 35283 - RNA, 19 nt, Homo sapiens
cuacugucuuugagaacua

SEQ ID NO: 35284 - RNA, 19 nt, Homo sapiens
gaagaccugccuccucauc

SEQ ID NO: 35285 - RNA, 19 nt, Homo sapiens
gaaccggaucagugccuuu

SEQ ID NO: 35286 - RNA, 19 nt, Homo sapiens
agaacuauauugcggacau

SEQ ID NO: 35287 - RNA, 19 nt, Homo sapiens
gcucagccaagaccaagga

SEQ ID NO: 35288 - RNA, 19 nt, Homo sapiens
gagagcuggccaagaugaa

SEQ ID NO: 35289 - RNA, 19 nt, Homo sapiens
gggcugucccauucucuga

SEQ ID NO: 35290 - RNA, 19 nt, Homo sapiens
ucuccuacccggacacuga

SEQ ID NO: 35291 - RNA, 19 nt, Homo sapiens
ucccuacugucuuugagaa

SEQ ID NO: 35292 - RNA, 19 nt, Homo sapiens
cuucagcaaggaucaguuu

SEQ ID NO: 35293 - RNA, 19 nt, Homo sapiens
gccuuuggcuaccuugagu

SEQ ID NO: 35294 - RNA, 19 nt, Homo sapiens
agagagcuggccaagauga

SEQ ID NO: 35295 - RNA, 19 nt, Homo sapiens
gaucgacugcggccucucu

SEQ ID NO: 35296 - RNA, 19 nt, Homo sapiens
cagggcaggaagacuauga

SEQ ID NO: 35297 - RNA, 19 nt, Homo sapiens
gcgaagagcugcacuguga

SEQ ID NO: 35298 - RNA, 19 nt, Homo sapiens
guaaagcugucuggaauua

SEQ ID NO: 35299 - RNA, 19 nt, Homo sapiens
gaagauagcugaguaggau

SEQ ID NO: 35300 - RNA, 19 nt, Homo sapiens
caaaugagcuagaggaaga

SEQ ID NO: 35301 - RNA, 19 nt, Homo sapiens
gaucugaccuguuuauugu

SEQ ID NO: 35302 - RNA, 19 nt, Homo sapiens
cuacaguguuugagaauua

SEQ ID NO: 35303 - RNA, 19 nt, Homo sapiens
gaacauugaugagagaaga

SEQ ID NO: 35304 - RNA, 19 nt, Homo sapiens
gaugagaagugaauacaug

SEQ ID NO: 35305 - RNA, 19 nt, Homo sapiens
cugauaaucuguugguuua

SEQ ID NO: 35306 - RNA, 19 nt, Homo sapiens
gaguaaagcugucuggaau

SEQ ID NO: 35307 - RNA, 19 nt, Homo sapiens
cuacaaagaucgcauagau

SEQ ID NO: 35308 - RNA, 19 nt, Homo sapiens
acaaaggaaucuaguguaa

SEQ ID NO: 35309 - RNA, 19 nt, Homo sapiens
gaacgugaaaugcaagaua

SEQ ID NO: 35310 - RNA, 19 nt, Homo sapiens
gaaauuauccagcaaaucu

SEQ ID NO: 35311 - RNA, 19 nt, Homo sapiens
gagaagagccagccagaaa

SEQ ID NO: 35312 - RNA, 19 nt, Homo sapiens
gcgaguaccuccaagaaga

SEQ ID NO: 35313 - RNA, 19 nt, Homo sapiens
gagaaucccuaguggaaga

SEQ ID NO: 35314 - RNA, 19 nt, Homo sapiens
gaucuccacuuugauuuaa

SEQ ID NO: 35315 - RNA, 19 nt, Homo sapiens
gggcaaauauggccaaaca

SEQ ID NO: 35316 - RNA, 19 nt, Homo sapiens
aaccagaucugaccuguuu

SEQ ID NO: 35317 - RNA, 19 nt, Homo sapiens
uaguagagcucuccaauca

SEQ ID NO: 35318 - RNA, 19 nt, Homo sapiens
gcgagugcuuucuguauuu

SEQ ID NO: 35319 - RNA, 19 nt, Homo sapiens
gugaauacauggaagaguu

SEQ ID NO: 35320 - RNA, 19 nt, Homo sapiens
gcaaauauggccaaacaga

SEQ ID NO: 35321 - RNA, 19 nt, Homo sapiens
ucgcauagaucaaauagga

SEQ ID NO: 35322 - RNA, 19 nt, Homo sapiens
gaaaucgacacacaaagaa

SEQ ID NO: 35323 - RNA, 19 nt, Homo sapiens
aaacugcgcugcuccaugu

SEQ ID NO: 35324 - RNA, 19 nt, Homo sapiens
gaaagaauaguagcagaaa

SEQ ID NO: 35325 - RNA, 19 nt, Homo sapiens
gaagagccagccagaaauu

SEQ ID NO: 35326 - RNA, 19 nt, Homo sapiens
gaaaauuccuguuccaaga

SEQ ID NO: 35327 - RNA, 19 nt, Homo sapiens
gagagaagaugccacuuac

SEQ ID NO: 35328 - RNA, 19 nt, Homo sapiens
gagcugcacugugauguga

SEQ ID NO: 35329 - RNA, 19 nt, Homo sapiens
guagagcucuccaaucaca

SEQ ID NO: 35330 - RNA, 19 nt, Homo sapiens
cagcaaaucuaucauggau

SEQ ID NO: 35331 - RNA, 19 nt, Homo sapiens
ggucaauguuuccgcagua

SEQ ID NO: 35332 - RNA, 19 nt, Homo sapiens
ggaaagaauaguagcagaa

SEQ ID NO: 35333 - RNA, 19 nt, Homo sapiens
ccacaaagcggauuucaca

SEQ ID NO: 35334 - RNA, 19 nt, Homo sapiens
ugagagaagaugccacuua

SEQ ID NO: 35335 - RNA, 19 nt, Homo sapiens
gagaagaaaccagaucuga

SEQ ID NO: 35336 - RNA, 19 nt, Homo sapiens
aaacugacagcaucugaua

SEQ ID NO: 35337 - RNA, 19 nt, Homo sapiens
guuuagaaguugugugauu

SEQ ID NO: 35338 - RNA, 19 nt, Homo sapiens
gcacuacaaagaucgcaua

SEQ ID NO: 35339 - RNA, 19 nt, Homo sapiens
uuacaacacucaguucuau

SEQ ID NO: 35340 - RNA, 19 nt, Homo sapiens
guucuguucuucauuguga

SEQ ID NO: 35341 - RNA, 19 nt, Homo sapiens
gaaaauagcgucagagaca

SEQ ID NO: 35342 - RNA, 19 nt, Homo sapiens
gaagucacuguguauguuu

SEQ ID NO: 35343 - RNA, 19 nt, Homo sapiens
cgagugcuuucuguauuua

SEQ ID NO: 35344 - RNA, 19 nt, Homo sapiens
gguaaugagugaaggaaag

SEQ ID NO: 35345 - RNA, 19 nt, Homo sapiens
gcauagaucaaauaggaaa

SEQ ID NO: 35346 - RNA, 19 nt, Homo sapiens
guaaccaugucuuugucua

SEQ ID NO: 35347 - RNA, 19 nt, Homo sapiens
gaccagcacuacaaagauc

SEQ ID NO: 35348 - RNA, 19 nt, Homo sapiens
guaggaugguucuaaggaa

SEQ ID NO: 35349 - RNA, 19 nt, Homo sapiens
acugugaccuuagcauuua

SEQ ID NO: 35350 - RNA, 19 nt, Homo sapiens
ggaucuccacuuugauuua

SEQ ID NO: 35351 - RNA, 19 nt, Homo sapiens
gcauguagaccaagugaug

SEQ ID NO: 35352 - RNA, 19 nt, Homo sapiens
uaucgaaugcucagcuuua

SEQ ID NO: 35353 - RNA, 19 nt, Homo sapiens
gaacagacgcagccaaggu

SEQ ID NO: 35354 - RNA, 19 nt, Homo sapiens
caauguuuccgcaguauuu

SEQ ID NO: 35355 - RNA, 19 nt, Homo sapiens
ugaagucacuguguauguu

SEQ ID NO: 35356 - RNA, 19 nt, Homo sapiens
guaauuacaacacucaguu

SEQ ID NO: 35357 - RNA, 19 nt, Homo sapiens
gcacuuggucucuguuguu

SEQ ID NO: 35358 - RNA, 19 nt, Homo sapiens
uacccaagcuuuagagaau

SEQ ID NO: 35359 - RNA, 19 nt, Homo sapiens
gacagcaucugauaaucug

SEQ ID NO: 35360 - RNA, 19 nt, Homo sapiens
gguuugaugucauagaaug

SEQ ID NO: 35361 - RNA, 19 nt, Homo sapiens
cuuucuagcucaucauuaa

SEQ ID NO: 35362 - RNA, 19 nt, Homo sapiens
gaagugaauacauggaaga

SEQ ID NO: 35363 - RNA, 19 nt, Homo sapiens
gcacagccaaagucaugua

SEQ ID NO: 35364 - RNA, 19 nt, Homo sapiens
ggcgagugcuuucuguauu

SEQ ID NO: 35365 - RNA, 19 nt, Homo sapiens
ucaguucuaugucuuacaa

SEQ ID NO: 35366 - RNA, 19 nt, Homo sapiens
gaacuggcacugugaccuu

SEQ ID NO: 35367 - RNA, 19 nt, Homo sapiens
ggugaagucuaaaugaagu

SEQ ID NO: 35368 - RNA, 19 nt, Homo sapiens
gacaaaggaaucuagugua

SEQ ID NO: 35369 - RNA, 19 nt, Homo sapiens
ugaaaucgacacacaaaga

SEQ ID NO: 35370 - RNA, 19 nt, Homo sapiens
agaauuacacggccaguuu

SEQ ID NO: 35371 - RNA, 19 nt, Homo sapiens
gggcauuucuagaguguca

SEQ ID NO: 35372 - RNA, 19 nt, Homo sapiens
gcacugugaccuuagcauu

SEQ ID NO: 35373 - RNA, 19 nt, Homo sapiens
gcacugugaugugaaucuu

SEQ ID NO: 35374 - RNA, 19 nt, Homo sapiens
caaagcggauuucacacau

SEQ ID NO: 35375 - RNA, 19 nt, Homo sapiens
agaauuacguuccuacagu

SEQ ID NO: 35376 - RNA, 19 nt, Homo sapiens
ggcaguugcuacggacuua

SEQ ID NO: 35377 - RNA, 19 nt, Homo sapiens
cagagacccuggacagugu

SEQ ID NO: 35378 - RNA, 19 nt, Homo sapiens
cagaaauuauccagcaaau

SEQ ID NO: 35379 - RNA, 19 nt, Homo sapiens
gcuaaaaccucacugaaca

SEQ ID NO: 35380 - RNA, 19 nt, Homo sapiens
cagaaaagguaaugaguga

SEQ ID NO: 35381 - RNA, 19 nt, Homo sapiens
gaagagcugcacugugaug

SEQ ID NO: 35382 - RNA, 19 nt, Homo sapiens
aaauauggccaaacagauu

SEQ ID NO: 35383 - RNA, 19 nt, Homo sapiens
gcggacagauguuaguaca

SEQ ID NO: 35384 - RNA, 19 nt, Homo sapiens
aaggugaaauccaggaauu

SEQ ID NO: 35385 - RNA, 19 nt, Homo sapiens
gcaggagagauuaagguaa

SEQ ID NO: 35386 - RNA, 19 nt, Homo sapiens
uaggaugguucuaaggaaa

SEQ ID NO: 35387 - RNA, 19 nt, Homo sapiens
uuacguuccuacaguguuu

SEQ ID NO: 35388 - RNA, 19 nt, Homo sapiens
cgagcuuucuuucccauga

SEQ ID NO: 35389 - RNA, 19 nt, Homo sapiens
ucuagagugucauugcuaa

SEQ ID NO: 35390 - RNA, 19 nt, Homo sapiens
uagagaaucccuaguggaa

SEQ ID NO: 35391 - RNA, 19 nt, Homo sapiens
caaagcaaaaggacuauua

SEQ ID NO: 35392 - RNA, 19 nt, Homo sapiens
gagaagugaauacauggaa

SEQ ID NO: 35393 - RNA, 19 nt, Homo sapiens
cagccaaagucauguauac

SEQ ID NO: 35394 - RNA, 19 nt, Homo sapiens
gaagugcacagccaaaguc

SEQ ID NO: 35395 - RNA, 19 nt, Homo sapiens
aaggugaagucuaaaugaa

SEQ ID NO: 35396 - RNA, 19 nt, Homo sapiens
gauuggagcagcuacuuau

SEQ ID NO: 35397 - RNA, 19 nt, Homo sapiens
gaaggugaauguacccuaa

SEQ ID NO: 35398 - RNA, 19 nt, Homo sapiens
ccaccguguucgacaauua

SEQ ID NO: 35399 - RNA, 19 nt, Homo sapiens
gcaacaggauggugucaag

SEQ ID NO: 35400 - RNA, 19 nt, Homo sapiens
gccuaggccuuacgcauuu

SEQ ID NO: 35401 - RNA, 19 nt, Homo sapiens
cuacacaacuaacgcuuuc

SEQ ID NO: 35402 - RNA, 19 nt, Homo sapiens
cgucaucuguuucuccauu

SEQ ID NO: 35403 - RNA, 19 nt, Homo sapiens
aaggaggccugcagagaaa

SEQ ID NO: 35404 - RNA, 19 nt, Homo sapiens
uaaggaggccugcagagaa

SEQ ID NO: 35405 - RNA, 19 nt, Homo sapiens
ccaguccgccguccuauga

SEQ ID NO: 35406 - RNA, 19 nt, Homo sapiens
gccaggcacucgcgaaaca

SEQ ID NO: 35407 - RNA, 19 nt, Homo sapiens
uuacgcauuugcugacuga

SEQ ID NO: 35408 - RNA, 19 nt, Homo sapiens
ccucgcugcucuuggaauu

SEQ ID NO: 35409 - RNA, 19 nt, Homo sapiens
gcugugcgcuaccucgaau

SEQ ID NO: 35410 - RNA, 19 nt, Homo sapiens
gaccaguucauccagcuuu

SEQ ID NO: 35411 - RNA, 19 nt, Homo sapiens
cgccucagcugugccuuaa

SEQ ID NO: 35412 - RNA, 19 nt, Homo sapiens
gcuacacaacuaacgcuuu

SEQ ID NO: 35413 - RNA, 19 nt, Homo sapiens
agacgugccugcucaucug

SEQ ID NO: 35414 - RNA, 19 nt, Homo sapiens
ccaaugagggagccacaga

SEQ ID NO: 35415 - RNA, 19 nt, Homo sapiens
ucauccagcuuuccacaca

SEQ ID NO: 35416 - RNA, 19 nt, Homo sapiens
ggaacacuggguauucuca

SEQ ID NO: 35417 - RNA, 19 nt, Homo sapiens
acaggauggugucaaggaa

SEQ ID NO: 35418 - RNA, 19 nt, Homo sapiens
cugcucaucugcuacacaa

SEQ ID NO: 35419 - RNA, 19 nt, Homo sapiens
gcucauccaagccaagguu

SEQ ID NO: 35420 - RNA, 19 nt, Homo sapiens
ccucagcugugccuuaagg

SEQ ID NO: 35421 - RNA, 19 nt, Homo sapiens
gguccugcauccucuugug

SEQ ID NO: 35422 - RNA, 19 nt, Homo sapiens
cacagaauccugagaaggu

SEQ ID NO: 35423 - RNA, 19 nt, Homo sapiens
cgaaugcucagcccugcaa

SEQ ID NO: 35424 - RNA, 19 nt, Homo sapiens
ucucucccuucuccaauga

SEQ ID NO: 35425 - RNA, 19 nt, Homo sapiens
acacuggguauucucauga

SEQ ID NO: 35426 - RNA, 19 nt, Homo sapiens
gaacacuggguauucucau

SEQ ID NO: 35427 - RNA, 19 nt, Homo sapiens
gcugugccuuaaggacuaa

SEQ ID NO: 35428 - RNA, 19 nt, Homo sapiens
ccucugugccuaggccuua

SEQ ID NO: 35429 - RNA, 19 nt, Homo sapiens
caaugagggagccacagaa

SEQ ID NO: 35430 - RNA, 19 nt, Homo sapiens
aagaugcucucucccuucu

SEQ ID NO: 35431 - RNA, 19 nt, Homo sapiens
guggugccgccucagguua

SEQ ID NO: 35432 - RNA, 19 nt, Homo sapiens
gcucaucugcuacacaacu

SEQ ID NO: 35433 - RNA, 19 nt, Homo sapiens
uuaaggaggccugcagaga

SEQ ID NO: 35434 - RNA, 19 nt, Homo sapiens
gaccaacguuuucgucauc

SEQ ID NO: 35435 - RNA, 19 nt, Homo sapiens
cacaguuguugcugccuau

SEQ ID NO: 35436 - RNA, 19 nt, Homo sapiens
ugccaccacugcccugaug

SEQ ID NO: 35437 - RNA, 19 nt, Homo sapiens
gccacagaauccugagaag

SEQ ID NO: 35438 - RNA, 19 nt, Homo sapiens
gucaucuguuucuccauug

SEQ ID NO: 35439 - RNA, 19 nt, Homo sapiens
acacucuccuacccucaga

SEQ ID NO: 35440 - RNA, 19 nt, Homo sapiens
gccaagugcucaaauauga

SEQ ID NO: 35441 - RNA, 19 nt, Homo sapiens
gcucaaauaugacgacuuc

SEQ ID NO: 35442 - RNA, 19 nt, Homo sapiens
ucucagagcugcaggauga

SEQ ID NO: 35443 - RNA, 19 nt, Homo sapiens
ggagacuguugccuacuua

SEQ ID NO: 35444 - RNA, 19 nt, Homo sapiens
ggccagcccuguugucuuu

SEQ ID NO: 35445 - RNA, 19 nt, Homo sapiens
ggcaggagaugacaaguau

SEQ ID NO: 35446 - RNA, 19 nt, Homo sapiens
ggaagaucauuguguuuag

SEQ ID NO: 35447 - RNA, 19 nt, Homo sapiens
gggcagagauugugcugau

SEQ ID NO: 35448 - RNA, 19 nt, Homo sapiens
gaucugaccuuggaugaca

SEQ ID NO: 35449 - RNA, 19 nt, Homo sapiens
gcaccaaucauguauuuca

SEQ ID NO: 35450 - RNA, 19 nt, Homo sapiens
ccagauagguggguucuag

SEQ ID NO: 35451 - RNA, 19 nt, Homo sapiens
ggacaggcuuggccaugga

SEQ ID NO: 35452 - RNA, 19 nt, Homo sapiens
gggaagugcagcagaagua

SEQ ID NO: 35453 - RNA, 19 nt, Homo sapiens
uggcaccaaucauguauuu

SEQ ID NO: 35454 - RNA, 19 nt, Homo sapiens
ccaaguuccuucuggauca

SEQ ID NO: 35455 - RNA, 19 nt, Homo sapiens
acacuaaccuggcuguugu

SEQ ID NO: 35456 - RNA, 19 nt, Homo sapiens
gaagaucauuguguuuagu

SEQ ID NO: 35457 - RNA, 19 nt, Homo sapiens
cugaguagcugggacuaua

SEQ ID NO: 35458 - RNA, 19 nt, Homo sapiens
gaucaucagccuucauguu

SEQ ID NO: 35459 - RNA, 19 nt, Homo sapiens
cgagcgcgguuucucuuaa

SEQ ID NO: 35460 - RNA, 19 nt, Homo sapiens
gaacuggcccucggaugaa

SEQ ID NO: 35461 - RNA, 19 nt, Homo sapiens
ccacugucucguagaauua

SEQ ID NO: 35462 - RNA, 19 nt, Homo sapiens
ggacugguagcuuggauga

SEQ ID NO: 35463 - RNA, 19 nt, Homo sapiens
gggagacuguugccuacuu

SEQ ID NO: 35464 - RNA, 19 nt, Homo sapiens
gcaaguacaagaagaacau

SEQ ID NO: 35465 - RNA, 19 nt, Homo sapiens
cggaagaucauuguguuua

SEQ ID NO: 35466 - RNA, 19 nt, Homo sapiens
ucagugaccggccagguua

SEQ ID NO: 35467 - RNA, 19 nt, Homo sapiens
ggcggaagaucauuguguu

SEQ ID NO: 35468 - RNA, 19 nt, Homo sapiens
ggucagccuuucccaagug

SEQ ID NO: 35469 - RNA, 19 nt, Homo sapiens
gaagcuggccuccaucgau

SEQ ID NO: 35470 - RNA, 19 nt, Homo sapiens
gagccuuucggaucuauuu

SEQ ID NO: 35471 - RNA, 19 nt, Homo sapiens
caccaugcccagcuaauuu

SEQ ID NO: 35472 - RNA, 19 nt, Homo sapiens
gaucuucuaugugaauuac

SEQ ID NO: 35473 - RNA, 19 nt, Homo sapiens
uagcaaguguggaugaauc

SEQ ID NO: 35474 - RNA, 19 nt, Homo sapiens
ugauaggucaguccagaua

SEQ ID NO: 35475 - RNA, 19 nt, Homo sapiens
gcagagauugugcugauag

SEQ ID NO: 35476 - RNA, 19 nt, Homo sapiens
uaugacgacuuccugaaau

SEQ ID NO: 35477 - RNA, 19 nt, Homo sapiens
gaccgcaaguacaagaaga

SEQ ID NO: 35478 - RNA, 19 nt, Homo sapiens
acaagaugaccaacacuaa

SEQ ID NO: 35479 - RNA, 19 nt, Homo sapiens
ggagcccauucccauugua

SEQ ID NO: 35480 - RNA, 19 nt, Homo sapiens
cggaugaaaugccugacuu

SEQ ID NO: 35481 - RNA, 19 nt, Homo sapiens
aggaugaucugaccuugga

SEQ ID NO: 35482 - RNA, 19 nt, Homo sapiens
uagguggguucuagcaauu

SEQ ID NO: 35483 - RNA, 19 nt, Homo sapiens
caucagccuucauguucuu

SEQ ID NO: 35484 - RNA, 19 nt, Homo sapiens
guggugggcuuccucaaca

SEQ ID NO: 35485 - RNA, 19 nt, Homo sapiens
ucaacaccuucaccaaguu

SEQ ID NO: 35486 - RNA, 19 nt, Homo sapiens
uaaccuggcuguuguuuuc

SEQ ID NO: 35487 - RNA, 19 nt, Homo sapiens
gcaggagcccauucccauu

SEQ ID NO: 35488 - RNA, 19 nt, Homo sapiens
ucauguauuucaccguuug

SEQ ID NO: 35489 - RNA, 19 nt, Homo sapiens
uauuuggucuuucucaugu

SEQ ID NO: 35490 - RNA, 19 nt, Homo sapiens
caugaaggccugagugcaa

SEQ ID NO: 35491 - RNA, 19 nt, Homo sapiens
caaguguggaugaaucaaa

SEQ ID NO: 35492 - RNA, 19 nt, Homo sapiens
gcuguuaccagaagacguu

SEQ ID NO: 35493 - RNA, 19 nt, Homo sapiens
aaacucugcucauccucuu

SEQ ID NO: 35494 - RNA, 19 nt, Homo sapiens
ggaucuauuuggucuuucu

SEQ ID NO: 35495 - RNA, 19 nt, Homo sapiens
ggcagagauugugcugaua

SEQ ID NO: 35496 - RNA, 19 nt, Homo sapiens
gagcgcgguuucucuuaag

SEQ ID NO: 35497 - RNA, 19 nt, Homo sapiens
ucggaucuauuuggucuuu

SEQ ID NO: 35498 - RNA, 19 nt, Homo sapiens
cuucuggguucaagcaauu

SEQ ID NO: 35499 - RNA, 19 nt, Homo sapiens
agaacuggcccucggauga

SEQ ID NO: 35500 - RNA, 19 nt, Homo sapiens
ggccauggauccgcucuca

SEQ ID NO: 35501 - RNA, 19 nt, Homo sapiens
guacucagggagacuguug

SEQ ID NO: 35502 - RNA, 19 nt, Homo sapiens
ccauggauccgcucucaga

SEQ ID NO: 35503 - RNA, 19 nt, Homo sapiens
cccacugucucguagaauu

SEQ ID NO: 35504 - RNA, 19 nt, Homo sapiens
cuuguggaccugucuguua

SEQ ID NO: 35505 - RNA, 19 nt, Homo sapiens
ccaaagugcugggauucca

SEQ ID NO: 35506 - RNA, 19 nt, Homo sapiens
gguggguucuagcaauuuc

SEQ ID NO: 35507 - RNA, 19 nt, Homo sapiens
cagccuuucccaagugaua

SEQ ID NO: 35508 - RNA, 19 nt, Homo sapiens
gcucuccgcccuccuuugu

SEQ ID NO: 35509 - RNA, 19 nt, Homo sapiens
agaacaagaugaccaacac

SEQ ID NO: 35510 - RNA, 19 nt, Homo sapiens
gcacacagugaccagaaca

SEQ ID NO: 35511 - RNA, 19 nt, Homo sapiens
acuaccaggugcuucguuu

SEQ ID NO: 35512 - RNA, 19 nt, Homo sapiens
cauccaaccauguucauca

SEQ ID NO: 35513 - RNA, 19 nt, Homo sapiens
gcggaagaucauuguguuu

SEQ ID NO: 35514 - RNA, 19 nt, Homo sapiens
ccaccaugcccagcuaauu

SEQ ID NO: 35515 - RNA, 19 nt, Homo sapiens
gggcugggguagagacuaa

SEQ ID NO: 35516 - RNA, 19 nt, Homo sapiens
caggagcccauucccauug

SEQ ID NO: 35517 - RNA, 19 nt, Homo sapiens
accaguacguggagaguga

SEQ ID NO: 35518 - RNA, 19 nt, Homo sapiens
cagaucaucagccuucaug

SEQ ID NO: 35519 - RNA, 19 nt, Homo sapiens
cgagagcuacagcguguga

SEQ ID NO: 35520 - RNA, 19 nt, Homo sapiens
guggaugaaucaaaugacu

SEQ ID NO: 35521 - RNA, 19 nt, Homo sapiens
aaguguggaugaaucaaau

SEQ ID NO: 35522 - RNA, 19 nt, Homo sapiens
gcucaccuuugaccucuac

SEQ ID NO: 35523 - RNA, 19 nt, Homo sapiens
ccaaccauguucaucaaaa

SEQ ID NO: 35524 - RNA, 19 nt, Homo sapiens
gggcggaagaucauugugu

SEQ ID NO: 35525 - RNA, 19 nt, Homo sapiens
ucacucccacugucucgua

SEQ ID NO: 35526 - RNA, 19 nt, Homo sapiens
ggagaacuaccaggugcuu

SEQ ID NO: 35527 - RNA, 19 nt, Homo sapiens
ggauuucgaccaguacaau

SEQ ID NO: 35528 - RNA, 19 nt, Homo sapiens
uggcaggagaugacaagua

SEQ ID NO: 35529 - RNA, 19 nt, Homo sapiens
ggaguuugaccgcaaguac

SEQ ID NO: 35530 - RNA, 19 nt, Homo sapiens
aauccaguguucacauuca

SEQ ID NO: 35531 - RNA, 19 nt, Homo sapiens
gcgggugcuuguacugugu

SEQ ID NO: 35532 - RNA, 19 nt, Homo sapiens
ccacacgggcagaucauca

SEQ ID NO: 35533 - RNA, 19 nt, Homo sapiens
gcuacagcgugugauggaa

SEQ ID NO: 35534 - RNA, 19 nt, Homo sapiens
ggaugaaaugccugacuuc

SEQ ID NO: 35535 - RNA, 19 nt, Homo sapiens
uuaaucccaucaacaccuu

SEQ ID NO: 35536 - RNA, 19 nt, Homo sapiens
acagugaccagaacaagau

SEQ ID NO: 35537 - RNA, 19 nt, Homo sapiens
gaagugcagcagaaguaca

SEQ ID NO: 35538 - RNA, 19 nt, Homo sapiens
ccucaucagcuucaaguuc

SEQ ID NO: 35539 - RNA, 19 nt, Homo sapiens
caucaaaacucugcucauc

SEQ ID NO: 35540 - RNA, 19 nt, Homo sapiens
uuaaggagcucuugggaaa

SEQ ID NO: 35541 - RNA, 19 nt, Homo sapiens
gcugagaucugcguugaaa

SEQ ID NO: 35542 - RNA, 19 nt, Homo sapiens
ucaauggccugcagcauga

SEQ ID NO: 35543 - RNA, 19 nt, Homo sapiens
gagggaggcugguggagaa

SEQ ID NO: 35544 - RNA, 19 nt, Homo sapiens
guacagcgaugagaacaug

SEQ ID NO: 35545 - RNA, 19 nt, Homo sapiens
ggaggcagcugaggaagga

SEQ ID NO: 35546 - RNA, 19 nt, Homo sapiens
cgcaagagcucccucaaga

SEQ ID NO: 35547 - RNA, 19 nt, Homo sapiens
auaaagaccucguguugau

SEQ ID NO: 35548 - RNA, 19 nt, Homo sapiens
gggaugagguggcugagau

SEQ ID NO: 35549 - RNA, 19 nt, Homo sapiens
ggagacauggagaaguuua

SEQ ID NO: 35550 - RNA, 19 nt, Homo sapiens
gggaugugcuugauuccuu

SEQ ID NO: 35551 - RNA, 19 nt, Homo sapiens
gacagaccauugagacaga

SEQ ID NO: 35552 - RNA, 19 nt, Homo sapiens
ggguggcgauucauaaaga

SEQ ID NO: 35553 - RNA, 19 nt, Homo sapiens
ucauaaagaccucguguug

SEQ ID NO: 35554 - RNA, 19 nt, Homo sapiens
gcaagagcucccucaagaa

SEQ ID NO: 35555 - RNA, 19 nt, Homo sapiens
ugucaacgcugcugucagu

SEQ ID NO: 35556 - RNA, 19 nt, Homo sapiens
cagaggaggugaacaagac

SEQ ID NO: 35557 - RNA, 19 nt, Homo sapiens
ugcaggagcuggcagaguu

SEQ ID NO: 35558 - RNA, 19 nt, Homo sapiens
gaggugaacaagacucuga

SEQ ID NO: 35559 - RNA, 19 nt, Homo sapiens
aaacucaagugcacaaagg

SEQ ID NO: 35560 - RNA, 19 nt, Homo sapiens
caagagcucccucaagaag

SEQ ID NO: 35561 - RNA, 19 nt, Homo sapiens
gcgagcugcuggcuucuuc

SEQ ID NO: 35562 - RNA, 19 nt, Homo sapiens
gagcugcauucgcuucauc

SEQ ID NO: 35563 - RNA, 19 nt, Homo sapiens
agacagaggaggugaacaa

SEQ ID NO: 35564 - RNA, 19 nt, Homo sapiens
ggacaaagccaagguucuc

SEQ ID NO: 35565 - RNA, 19 nt, Homo sapiens
guaccaggcauaucacaug

SEQ ID NO: 35566 - RNA, 19 nt, Homo sapiens
guucugcgcuaccucuuca

SEQ ID NO: 35567 - RNA, 19 nt, Homo sapiens
agacguaccaggcauauca

SEQ ID NO: 35568 - RNA, 19 nt, Homo sapiens
ugagaucugcguugaaaug

SEQ ID NO: 35569 - RNA, 19 nt, Homo sapiens
cuaccugcaugacgucuug

SEQ ID NO: 35570 - RNA, 19 nt, Homo sapiens
gaagacguaccaggcauau

SEQ ID NO: 35571 - RNA, 19 nt, Homo sapiens
gcgaugagaacaugaugga

SEQ ID NO: 35572 - RNA, 19 nt, Homo sapiens
ccaaguucauggagcacaa

SEQ ID NO: 35573 - RNA, 19 nt, Homo sapiens
cauaaagaccucguguuga

SEQ ID NO: 35574 - RNA, 19 nt, Homo sapiens
ggggagacauggagaaguu

SEQ ID NO: 35575 - RNA, 19 nt, Homo sapiens
guaugagacgcaagucaaa

SEQ ID NO: 35576 - RNA, 19 nt, Homo sapiens
agacgcaagucaaagagau

SEQ ID NO: 35577 - RNA, 19 nt, Homo sapiens
caacgcugcugucaguaac

SEQ ID NO: 35578 - RNA, 19 nt, Homo sapiens
gcuggguggcgauucauaa

SEQ ID NO: 35579 - RNA, 19 nt, Homo sapiens
uggcugagaucugcguuga

SEQ ID NO: 35580 - RNA, 19 nt, Homo sapiens
guaacuacuaccugcauga

SEQ ID NO: 35581 - RNA, 19 nt, Homo sapiens
ucaacgcugcugucaguaa

SEQ ID NO: 35582 - RNA, 19 nt, Homo sapiens
cagagaaaauuccagaaga

SEQ ID NO: 35583 - RNA, 19 nt, Homo sapiens
gcccagagcccagaacauc

SEQ ID NO: 35584 - RNA, 19 nt, Homo sapiens
cgcaacgaguaccugcuua

SEQ ID NO: 35585 - RNA, 19 nt, Homo sapiens
gagcaggaggugucuugga

SEQ ID NO: 35586 - RNA, 19 nt, Homo sapiens
gcaacgaguaccugcuuag

SEQ ID NO: 35587 - RNA, 19 nt, Homo sapiens
gcgcaacgaguaccugcuu

SEQ ID NO: 35588 - RNA, 19 nt, Homo sapiens
aaagaccucguguugauuc

SEQ ID NO: 35589 - RNA, 19 nt, Homo sapiens
gagacauggagaaguuuau

SEQ ID NO: 35590 - RNA, 19 nt, Homo sapiens
cacccaagccucccaagug

SEQ ID NO: 35591 - RNA, 19 nt, Homo sapiens
uaaagaccucguguugauu

SEQ ID NO: 35592 - RNA, 19 nt, Homo sapiens
cauggacucuguguuuaag

SEQ ID NO: 35593 - RNA, 19 nt, Homo sapiens
ggugcaugcuaccgucuuc

SEQ ID NO: 35594 - RNA, 19 nt, Homo sapiens
gcccucuucugcagcuuug

SEQ ID NO: 35595 - RNA, 19 nt, Homo sapiens
acauggacucuguguuuaa

SEQ ID NO: 35596 - RNA, 19 nt, Homo sapiens
agaagacguaccaggcaua

SEQ ID NO: 35597 - RNA, 19 nt, Homo sapiens
cggguacccuugcucagau

SEQ ID NO: 35598 - RNA, 19 nt, Homo sapiens
gcggguacccuugcucaga

SEQ ID NO: 35599 - RNA, 19 nt, Homo sapiens
uggacucuguguuuaagga

SEQ ID NO: 35600 - RNA, 19 nt, Homo sapiens
ggagcuggaagccgagaug

SEQ ID NO: 35601 - RNA, 19 nt, Homo sapiens
ggagcuggcagaguucaug

SEQ ID NO: 35602 - RNA, 19 nt, Homo sapiens
gaagcggcaggccaaguuc

SEQ ID NO: 35603 - RNA, 19 nt, Homo sapiens
gagacgcaagucaaagaga

SEQ ID NO: 35604 - RNA, 19 nt, Homo sapiens
agaagcggcaggccaaguu

SEQ ID NO: 35605 - RNA, 19 nt, Homo sapiens
ggagcauccucgccaagcu

SEQ ID NO: 35606 - RNA, 19 nt, Homo sapiens
agacggccaagaagacgua

SEQ ID NO: 35607 - RNA, 19 nt, Homo sapiens
ggagcugcgggacgagauu

SEQ ID NO: 35608 - RNA, 19 nt, Homo sapiens
ggcugcaggcugaguauga

SEQ ID NO: 35609 - RNA, 19 nt, Homo sapiens
gcacccaagccucccaagu

SEQ ID NO: 35610 - RNA, 19 nt, Homo sapiens
ucauggagcacaaacucaa

SEQ ID NO: 35611 - RNA, 19 nt, Homo sapiens
gcgccugagucacauugca

SEQ ID NO: 35612 - RNA, 19 nt, Homo sapiens
gaguaugagacgcaaguca

SEQ ID NO: 35613 - RNA, 19 nt, Homo sapiens
gccgggagcaccaaagcuu

SEQ ID NO: 35614 - RNA, 19 nt, Homo sapiens
cuccagcccuguccagcaa

SEQ ID NO: 35615 - RNA, 19 nt, Homo sapiens
ccaccgagucccucaaguc

SEQ ID NO: 35616 - RNA, 19 nt, Homo sapiens
gaccgacagaccauugaga

SEQ ID NO: 35617 - RNA, 19 nt, Homo sapiens
acgcugcugucaguaacua

SEQ ID NO: 35618 - RNA, 19 nt, Homo sapiens
gagagcugcauucgcuuca

SEQ ID NO: 35619 - RNA, 19 nt, Homo sapiens
agguggagcuggaauacuc

SEQ ID NO: 35620 - RNA, 19 nt, Homo sapiens
caaacucaagugcacaaag

SEQ ID NO: 35621 - RNA, 19 nt, Homo sapiens
gaaguuaugugcuuuguua

SEQ ID NO: 35622 - RNA, 19 nt, Homo sapiens
gagagcagauuuccaguua

SEQ ID NO: 35623 - RNA, 19 nt, Homo sapiens
ggaugaaacugaccauaua

SEQ ID NO: 35624 - RNA, 19 nt, Homo sapiens
gaugagaccugauuugaaa

SEQ ID NO: 35625 - RNA, 19 nt, Homo sapiens
caacugagaucacugcuaa

SEQ ID NO: 35626 - RNA, 19 nt, Homo sapiens
gaacaagacuuugaacaga

SEQ ID NO: 35627 - RNA, 19 nt, Homo sapiens
ugagaucacugcuaaauuu

SEQ ID NO: 35628 - RNA, 19 nt, Homo sapiens
gaagcugacuugagaauug

SEQ ID NO: 35629 - RNA, 19 nt, Homo sapiens
gaugaagccuacaaauaua

SEQ ID NO: 35630 - RNA, 19 nt, Homo sapiens
ggaaaugaguauccuauuc

SEQ ID NO: 35631 - RNA, 19 nt, Homo sapiens
gagaacacauugcaacuga

SEQ ID NO: 35632 - RNA, 19 nt, Homo sapiens
gaaccuagauauaaagcuu

SEQ ID NO: 35633 - RNA, 19 nt, Homo sapiens
ggaugaagccuacaaauau

SEQ ID NO: 35634 - RNA, 19 nt, Homo sapiens
ggaguuagaugauaagaag

SEQ ID NO: 35635 - RNA, 19 nt, Homo sapiens
ugaaagcgcucguuccaaa

SEQ ID NO: 35636 - RNA, 19 nt, Homo sapiens
gucagaagcuuugaaguua

SEQ ID NO: 35637 - RNA, 19 nt, Homo sapiens
guacgaauuugcaaccaua

SEQ ID NO: 35638 - RNA, 19 nt, Homo sapiens
guacauauccucguaaauu

SEQ ID NO: 35639 - RNA, 19 nt, Homo sapiens
gaaaugagggaaauacaaa

SEQ ID NO: 35640 - RNA, 19 nt, Homo sapiens
gaauaaaacugaccaagaa

SEQ ID NO: 35641 - RNA, 19 nt, Homo sapiens
gaacuucaauccaccaaca

SEQ ID NO: 35642 - RNA, 19 nt, Homo sapiens
ucaaagaguuaaugacuga

SEQ ID NO: 35643 - RNA, 19 nt, Homo sapiens
gcacagaaaugagggaaau

SEQ ID NO: 35644 - RNA, 19 nt, Homo sapiens
gcagacaacuuauccaucu

SEQ ID NO: 35645 - RNA, 19 nt, Homo sapiens
ggaaaggugguauugauaa

SEQ ID NO: 35646 - RNA, 19 nt, Homo sapiens
caaagaagaguuucaagaa

SEQ ID NO: 35647 - RNA, 19 nt, Homo sapiens
gagcagauuuccaguuaug

SEQ ID NO: 35648 - RNA, 19 nt, Homo sapiens
gcugauacaaccacaauua

SEQ ID NO: 35649 - RNA, 19 nt, Homo sapiens
gaaaggugguauugauaau

SEQ ID NO: 35650 - RNA, 19 nt, Homo sapiens
uaaagugccuccaccuauu

SEQ ID NO: 35651 - RNA, 19 nt, Homo sapiens
gaacaagaaaggccagaaa

SEQ ID NO: 35652 - RNA, 19 nt, Homo sapiens
gaaaugaguauccuauuca

SEQ ID NO: 35653 - RNA, 19 nt, Homo sapiens
guuaaugacugaaggagaa

SEQ ID NO: 35654 - RNA, 19 nt, Homo sapiens
ggagagaagaguauauaaa

SEQ ID NO: 35655 - RNA, 19 nt, Homo sapiens
gguauuccuuauucacuua

SEQ ID NO: 35656 - RNA, 19 nt, Homo sapiens
gugaagaaccuagauauaa

SEQ ID NO: 35657 - RNA, 19 nt, Homo sapiens
gagauuaucaugcaacuug

SEQ ID NO: 35658 - RNA, 19 nt, Homo sapiens
ggaaucaguuaaacacaau

SEQ ID NO: 35659 - RNA, 19 nt, Homo sapiens
gaucauggccgcuuaagau

SEQ ID NO: 35660 - RNA, 19 nt, Homo sapiens
gcaauaggaaguuugauga

SEQ ID NO: 35661 - RNA, 19 nt, Homo sapiens
gaaauuucauccuguaaac

SEQ ID NO: 35662 - RNA, 19 nt, Homo sapiens
gaccaggaguuagaugaua

SEQ ID NO: 35663 - RNA, 19 nt, Homo sapiens
guacuggggugacauaaua

SEQ ID NO: 35664 - RNA, 19 nt, Homo sapiens
aaacugaggucuuuacucu

SEQ ID NO: 35665 - RNA, 19 nt, Homo sapiens
cccaagaacuagcaaauga

SEQ ID NO: 35666 - RNA, 19 nt, Homo sapiens
gagauuccauuaguaagaa

SEQ ID NO: 35667 - RNA, 19 nt, Homo sapiens
ucagagagauuccauuagu

SEQ ID NO: 35668 - RNA, 19 nt, Homo sapiens
ugagaagcauaucugguua

SEQ ID NO: 35669 - RNA, 19 nt, Homo sapiens
gauuagauuuggaaggaaa

SEQ ID NO: 35670 - RNA, 19 nt, Homo sapiens
ggaaucaacccaucaaagu

SEQ ID NO: 35671 - RNA, 19 nt, Homo sapiens
gcaacuaaaugugaugaau

SEQ ID NO: 35672 - RNA, 19 nt, Homo sapiens
ggaaauacaaagaaccaaa

SEQ ID NO: 35673 - RNA, 19 nt, Homo sapiens
gauaagaagaugaagaaga

SEQ ID NO: 35674 - RNA, 19 nt, Homo sapiens
gggcuauucugaugagauu

SEQ ID NO: 35675 - RNA, 19 nt, Homo sapiens
ggucagaagcuuugaaguu

SEQ ID NO: 35676 - RNA, 19 nt, Homo sapiens
gaaacacucagcgcaauaa

SEQ ID NO: 35677 - RNA, 19 nt, Homo sapiens
aagcauaucugguuaccuu

SEQ ID NO: 35678 - RNA, 19 nt, Homo sapiens
cagagagauuccauuagua

SEQ ID NO: 35679 - RNA, 19 nt, Homo sapiens
ggaagaugaucccuaugau

SEQ ID NO: 35680 - RNA, 19 nt, Homo sapiens
caacuuagagggaacaaga

SEQ ID NO: 35681 - RNA, 19 nt, Homo sapiens
caaacagaguucauugaug

SEQ ID NO: 35682 - RNA, 19 nt, Homo sapiens
guagagacaugagaagaga

SEQ ID NO: 35683 - RNA, 19 nt, Homo sapiens
aaucuaagaccaugugaua

SEQ ID NO: 35684 - RNA, 19 nt, Homo sapiens
gguauuauaugaguaggaa

SEQ ID NO: 35685 - RNA, 19 nt, Homo sapiens
gaguuucugucuacuacua

SEQ ID NO: 35686 - RNA, 19 nt, Homo sapiens
ucauaccacucuucaauug

SEQ ID NO: 35687 - RNA, 19 nt, Homo sapiens
ggacacaauccacugauga

SEQ ID NO: 35688 - RNA, 19 nt, Homo sapiens
ggaggaaguuaugugcuuu

SEQ ID NO: 35689 - RNA, 19 nt, Homo sapiens
gaagagauugaacauuuga

SEQ ID NO: 35690 - RNA, 19 nt, Homo sapiens
gaagcaccaccuccuuaua

SEQ ID NO: 35691 - RNA, 19 nt, Homo sapiens
ggaaacacucagcgcaaua

SEQ ID NO: 35692 - RNA, 19 nt, Homo sapiens
ucagauacgugauaacaca

SEQ ID NO: 35693 - RNA, 19 nt, Homo sapiens
uauugaagauacaggguua

SEQ ID NO: 35694 - RNA, 19 nt, Homo sapiens
guagaaauugggaaaguaa

SEQ ID NO: 35695 - RNA, 19 nt, Homo sapiens
gaagacaucguggaaguga

SEQ ID NO: 35696 - RNA, 19 nt, Homo sapiens
gcuauucugaugagauuua

SEQ ID NO: 35697 - RNA, 19 nt, Homo sapiens
gcauaucugguuaccuuua

SEQ ID NO: 35698 - RNA, 19 nt, Homo sapiens
cuaaaccaguuguaccuaa

SEQ ID NO: 35699 - RNA, 19 nt, Homo sapiens
gaucacugcuaaauuuaca

SEQ ID NO: 35700 - RNA, 19 nt, Homo sapiens
gagaucacugcuaaauuua

SEQ ID NO: 35701 - RNA, 19 nt, Homo sapiens
gcgaauacagaucacaaua

SEQ ID NO: 35702 - RNA, 19 nt, Homo sapiens
guuauggacugccgccuuu

SEQ ID NO: 35703 - RNA, 19 nt, Homo sapiens
caaaugagauaaggacaca

SEQ ID NO: 35704 - RNA, 19 nt, Homo sapiens
caacuuaaacaggaacaua

SEQ ID NO: 35705 - RNA, 19 nt, Homo sapiens
guaaagccaagucauacua

SEQ ID NO: 35706 - RNA, 19 nt, Homo sapiens
gauauggauccuucagaua

SEQ ID NO: 35707 - RNA, 19 nt, Homo sapiens
caaagaaccaaauacaguu

SEQ ID NO: 35708 - RNA, 19 nt, Homo sapiens
gcugguacauauccucgua

SEQ ID NO: 35709 - RNA, 19 nt, Homo sapiens
gggaggaaguuaugugcuu

SEQ ID NO: 35710 - RNA, 19 nt, Homo sapiens
ucagaagcuuugaaguuaa

SEQ ID NO: 35711 - RNA, 19 nt, Homo sapiens
guaagucaaggaugcaaua

SEQ ID NO: 35712 - RNA, 19 nt, Homo sapiens
guagaaacgacaaacauug

SEQ ID NO: 35713 - RNA, 19 nt, Homo sapiens
aaugacagcagacaacuua

SEQ ID NO: 35714 - RNA, 19 nt, Homo sapiens
caauggaaguaacaguaaa

SEQ ID NO: 35715 - RNA, 19 nt, Homo sapiens
gagaagcccauaccacuau

SEQ ID NO: 35716 - RNA, 19 nt, Homo sapiens
gaacacauugcaacugaga

SEQ ID NO: 35717 - RNA, 19 nt, Homo sapiens
caacaccuaguucagauaa

SEQ ID NO: 35718 - RNA, 19 nt, Homo sapiens
gcuuugaaguuaauggaaa

SEQ ID NO: 35719 - RNA, 19 nt, Homo sapiens
acaagaaaggccagaaaua

SEQ ID NO: 35720 - RNA, 19 nt, Homo sapiens
uagaugguauuccuuauuc

SEQ ID NO: 35721 - RNA, 19 nt, Homo sapiens
gaaagaaacuggauucacu

SEQ ID NO: 35722 - RNA, 19 nt, Homo sapiens
gaaagcagcucccuaagag

SEQ ID NO: 35723 - RNA, 19 nt, Homo sapiens
gaacuuggcauucaacauu

SEQ ID NO: 35724 - RNA, 19 nt, Homo sapiens
gaaacuggauucacuagga

SEQ ID NO: 35725 - RNA, 19 nt, Homo sapiens
ggagcuugcuggagucuua

SEQ ID NO: 35726 - RNA, 19 nt, Homo sapiens
aaacuuagccaccauauuu

SEQ ID NO: 35727 - RNA, 19 nt, Homo sapiens
gaagggaaaguguauuaua

SEQ ID NO: 35728 - RNA, 19 nt, Homo sapiens
aaagaacucucaagcagua

SEQ ID NO: 35729 - RNA, 19 nt, Homo sapiens
gcaaugagauauacuaaac

SEQ ID NO: 35730 - RNA, 19 nt, Homo sapiens
guacuuacauugugccaaa

SEQ ID NO: 35731 - RNA, 19 nt, Homo sapiens
guacacagcuuucaucaac

SEQ ID NO: 35732 - RNA, 19 nt, Homo sapiens
ccucuuggcucuauaauau

SEQ ID NO: 35733 - RNA, 19 nt, Homo sapiens
aagaaaggcuucccaauca

SEQ ID NO: 35734 - RNA, 19 nt, Homo sapiens
auacaacucuugcuuggua

SEQ ID NO: 35735 - RNA, 19 nt, Homo sapiens
caucaucgcuguugugcaa

SEQ ID NO: 35736 - RNA, 19 nt, Homo sapiens
gaagucaucagacaaagaa

SEQ ID NO: 35737 - RNA, 19 nt, Homo sapiens
gccaagggcuucuccaaga

SEQ ID NO: 35738 - RNA, 19 nt, Homo sapiens
gacaaagaauucucaguuc

SEQ ID NO: 35739 - RNA, 19 nt, Homo sapiens
gaaauucccagugguguuu

SEQ ID NO: 35740 - RNA, 19 nt, Homo sapiens
gauaacccuuccuucgaua

SEQ ID NO: 35741 - RNA, 19 nt, Homo sapiens
gcagaagucaucagacaaa

SEQ ID NO: 35742 - RNA, 19 nt, Homo sapiens
aaagagagugagacaauua

SEQ ID NO: 35743 - RNA, 19 nt, Homo sapiens
acuagaagcuuuacaacuu

SEQ ID NO: 35744 - RNA, 19 nt, Homo sapiens
ggauaacccuuccuucgau

SEQ ID NO: 35745 - RNA, 19 nt, Homo sapiens
gccaaaggcugaggaaaug

SEQ ID NO: 35746 - RNA, 19 nt, Homo sapiens
cagaggagccuuucgauau

SEQ ID NO: 35747 - RNA, 19 nt, Homo sapiens
gaacuuguuuagaaaggau

SEQ ID NO: 35748 - RNA, 19 nt, Homo sapiens
cgaaugacagggccuauaa

SEQ ID NO: 35749 - RNA, 19 nt, Homo sapiens
gaauccaacuauaaagugu

SEQ ID NO: 35750 - RNA, 19 nt, Homo sapiens
ugccauagcuuuauaacug

SEQ ID NO: 35751 - RNA, 19 nt, Homo sapiens
cggagaagcuuuacagagu

SEQ ID NO: 35752 - RNA, 19 nt, Homo sapiens
cuagaagcuuuacaacuuu

SEQ ID NO: 35753 - RNA, 19 nt, Homo sapiens
gaaauccaguucaccuaca

SEQ ID NO: 35754 - RNA, 19 nt, Homo sapiens
ucaccgaucuugaugacaa

SEQ ID NO: 35755 - RNA, 19 nt, Homo sapiens
gguauagccuaaccguauu

SEQ ID NO: 35756 - RNA, 19 nt, Homo sapiens
ccuugcagcuccucauaua

SEQ ID NO: 35757 - RNA, 19 nt, Homo sapiens
cuagaaggcuggugaugga

SEQ ID NO: 35758 - RNA, 19 nt, Homo sapiens
ggagggaggcauucaucua

SEQ ID NO: 35759 - RNA, 19 nt, Homo sapiens
acaaagaauucucaguuca

SEQ ID NO: 35760 - RNA, 19 nt, Homo sapiens
ggagggaccagcuaaggaa

SEQ ID NO: 35761 - RNA, 19 nt, Homo sapiens
agacaaagaauucucaguu

SEQ ID NO: 35762 - RNA, 19 nt, Homo sapiens
gacagggccuauaaacuca

SEQ ID NO: 35763 - RNA, 19 nt, Homo sapiens
gcccuuaucccaagucauu

SEQ ID NO: 35764 - RNA, 19 nt, Homo sapiens
ggaaauccgaguuggaguu

SEQ ID NO: 35765 - RNA, 19 nt, Homo sapiens
gacccaaccugcugcacaa

SEQ ID NO: 35766 - RNA, 19 nt, Homo sapiens
caagaggucacugggaaua

SEQ ID NO: 35767 - RNA, 19 nt, Homo sapiens
ucaguuaaccaaacaagaa

SEQ ID NO: 35768 - RNA, 19 nt, Homo sapiens
caaaccagauggcaauguc

SEQ ID NO: 35769 - RNA, 19 nt, Homo sapiens
ggaauuugaccgugggauu

SEQ ID NO: 35770 - RNA, 19 nt, Homo sapiens
aaacuggauucacuaggaa

SEQ ID NO: 35771 - RNA, 19 nt, Homo sapiens
gaucaccauucccaaagau

SEQ ID NO: 35772 - RNA, 19 nt, Homo sapiens
ggaauccaacuauaaagug

SEQ ID NO: 35773 - RNA, 19 nt, Homo sapiens
ggaauaaaaugacaucucu

SEQ ID NO: 35774 - RNA, 19 nt, Homo sapiens
gcagagggacgagcagaaa

SEQ ID NO: 35775 - RNA, 19 nt, Homo sapiens
ccgcaacccuuagaaauca

SEQ ID NO: 35776 - RNA, 19 nt, Homo sapiens
ggauucaguuaaccaaaca

SEQ ID NO: 35777 - RNA, 19 nt, Homo sapiens
uagaaaggauucaguuaac

SEQ ID NO: 35778 - RNA, 19 nt, Homo sapiens
gagaaauccaguucaccua

SEQ ID NO: 35779 - RNA, 19 nt, Homo sapiens
uaagaaagaaacuggauuc

SEQ ID NO: 35780 - RNA, 19 nt, Homo sapiens
ucgaagggaaaguguauua

SEQ ID NO: 35781 - RNA, 19 nt, Homo sapiens
caagagaaauccaguucac

SEQ ID NO: 35782 - RNA, 19 nt, Homo sapiens
aaagaauucucaguucaga

SEQ ID NO: 35783 - RNA, 19 nt, Homo sapiens
aagcagaagucaucagaca

SEQ ID NO: 35784 - RNA, 19 nt, Homo sapiens
cagcaaagaugggcaagag

SEQ ID NO: 35785 - RNA, 19 nt, Homo sapiens
gaauuugaccgugggauug

SEQ ID NO: 35786 - RNA, 19 nt, Homo sapiens
aauccgaguuggaguugua

SEQ ID NO: 35787 - RNA, 19 nt, Homo sapiens
gcuuucacuuugacuauga

SEQ ID NO: 35788 - RNA, 19 nt, Homo sapiens
cuugugccaugaugaauaa

SEQ ID NO: 35789 - RNA, 19 nt, Homo sapiens
ggaagcagaauaugagaag

SEQ ID NO: 35790 - RNA, 19 nt, Homo sapiens
agagagcgcuggcagaucu

SEQ ID NO: 35791 - RNA, 19 nt, Homo sapiens
ugaaagcagcucccuaaga

SEQ ID NO: 35792 - RNA, 19 nt, Homo sapiens
gaaaggcuucccaaucauc

SEQ ID NO: 35793 - RNA, 19 nt, Homo sapiens
ccaugucaguggauucuau

SEQ ID NO: 35794 - RNA, 19 nt, Homo sapiens
ugacagggccuauaaacuc

SEQ ID NO: 35795 - RNA, 19 nt, Homo sapiens
gaaauccgaguuggaguug

SEQ ID NO: 35796 - RNA, 19 nt, Homo sapiens
gaaggcuggugauggaucu

SEQ ID NO: 35797 - RNA, 19 nt, Homo sapiens
ugacuauuguguauucugu

SEQ ID NO: 35798 - RNA, 19 nt, Homo sapiens
gaaugacagggccuauaaa

SEQ ID NO: 35799 - RNA, 19 nt, Homo sapiens
guuuaagaaucuacacaga

SEQ ID NO: 35800 - RNA, 19 nt, Homo sapiens
gaaaggauucaguuaacca

SEQ ID NO: 35801 - RNA, 19 nt, Homo sapiens
gagcacaguguucaugaug

SEQ ID NO: 35802 - RNA, 19 nt, Homo sapiens
ggagcacaguguucaugau

SEQ ID NO: 35803 - RNA, 19 nt, Homo sapiens
ggaguuguaugaucuucag

SEQ ID NO: 35804 - RNA, 19 nt, Homo sapiens
ucagaggagccuuucgaua

SEQ ID NO: 35805 - RNA, 19 nt, Homo sapiens
agaggucacugggaauaaa

SEQ ID NO: 35806 - RNA, 19 nt, Homo sapiens
ccucagaaacaccgaauga

SEQ ID NO: 35807 - RNA, 19 nt, Homo sapiens
gcacaaaaccaccgaugaa

SEQ ID NO: 35808 - RNA, 19 nt, Homo sapiens
cauaggagucagauacaaa

SEQ ID NO: 35809 - RNA, 19 nt, Homo sapiens
caaagucaagggaaaguuc

SEQ ID NO: 35810 - RNA, 19 nt, Homo sapiens
ugaauccuauuuacagaca

SEQ ID NO: 35811 - RNA, 19 nt, Homo sapiens
auacacaucguaacuuuga

SEQ ID NO: 35812 - RNA, 19 nt, Homo sapiens
ggaaaaugcuaaaucugau

SEQ ID NO: 35813 - RNA, 19 nt, Homo sapiens
acaagaggaagcagaauau

SEQ ID NO: 35814 - RNA, 19 nt, Homo sapiens
gggauaacccuuccuucga

SEQ ID NO: 35815 - RNA, 19 nt, Homo sapiens
caaagacccaggaaugaca

SEQ ID NO: 35816 - RNA, 19 nt, Homo sapiens
ggagagcacggccaucauc

SEQ ID NO: 35817 - RNA, 19 nt, Homo sapiens
gaggagagcacggccauca

SEQ ID NO: 35818 - RNA, 19 nt, Homo sapiens
cuucagaucuuaggcacaa

SEQ ID NO: 35819 - RNA, 19 nt, Homo sapiens
gaguuggaguuguaugauc

SEQ ID NO: 35820 - RNA, 19 nt, Homo sapiens
ccugggaccugccuucugu

SEQ ID NO: 35821 - RNA, 19 nt, Homo sapiens
ggauuuggguugcauauuu

SEQ ID NO: 35822 - RNA, 19 nt, Homo sapiens
gaaagaaacuggauucacu

SEQ ID NO: 35823 - RNA, 19 nt, Homo sapiens
gaaacuggauucacuagga

SEQ ID NO: 35824 - RNA, 19 nt, Homo sapiens
ggagcuugcuggagucuua

SEQ ID NO: 35825 - RNA, 19 nt, Homo sapiens
aaacuuagccaccauauuu

SEQ ID NO: 35826 - RNA, 19 nt, Homo sapiens
aaagaacucucaagcagua

SEQ ID NO: 35827 - RNA, 19 nt, Homo sapiens
ccuaggaacuuuauguaua

SEQ ID NO: 35828 - RNA, 19 nt, Homo sapiens
guacacagcuuucaucaac

SEQ ID NO: 35829 - RNA, 19 nt, Homo sapiens
gcuguuacauuucuaaaga

SEQ ID NO: 35830 - RNA, 19 nt, Homo sapiens
aagaaaggcuucccaauca

SEQ ID NO: 35831 - RNA, 19 nt, Homo sapiens
caucaucgcuguugugcaa

SEQ ID NO: 35832 - RNA, 19 nt, Homo sapiens
gaagucaucagacaaagaa

SEQ ID NO: 35833 - RNA, 19 nt, Homo sapiens
gccaagggcuucuccaaga

SEQ ID NO: 35834 - RNA, 19 nt, Homo sapiens
gaaccuacuauauguauga

SEQ ID NO: 35835 - RNA, 19 nt, Homo sapiens
gacaaagaauucucaguuc

SEQ ID NO: 35836 - RNA, 19 nt, Homo sapiens
gcagaagucaucagacaaa

SEQ ID NO: 35837 - RNA, 19 nt, Homo sapiens
aaagagagugagacaauua

SEQ ID NO: 35838 - RNA, 19 nt, Homo sapiens
acuagaagcuuuacaacuu

SEQ ID NO: 35839 - RNA, 19 nt, Homo sapiens
cuucgucucucccuuauuu

SEQ ID NO: 35840 - RNA, 19 nt, Homo sapiens
guaauucaaccugcauuua

SEQ ID NO: 35841 - RNA, 19 nt, Homo sapiens
cgaaugacagggccuauaa

SEQ ID NO: 35842 - RNA, 19 nt, Homo sapiens
cggagaagcuuuacagagu

SEQ ID NO: 35843 - RNA, 19 nt, Homo sapiens
cuagaagcuuuacaacuuu

SEQ ID NO: 35844 - RNA, 19 nt, Homo sapiens
ucaccgaucuugaugacaa

SEQ ID NO: 35845 - RNA, 19 nt, Homo sapiens
ccuugcagcuccucauaua

SEQ ID NO: 35846 - RNA, 19 nt, Homo sapiens
cuagaaggcuggugaugga

SEQ ID NO: 35847 - RNA, 19 nt, Homo sapiens
cgauugagcuucccagagu

SEQ ID NO: 35848 - RNA, 19 nt, Homo sapiens
gauuuggguugcauauuug

SEQ ID NO: 35849 - RNA, 19 nt, Homo sapiens
gaaccaaauaguguuagua

SEQ ID NO: 35850 - RNA, 19 nt, Homo sapiens
ggagggaggcauucaucua

SEQ ID NO: 35851 - RNA, 19 nt, Homo sapiens
acaaagaauucucaguuca

SEQ ID NO: 35852 - RNA, 19 nt, Homo sapiens
agacaaagaauucucaguu

SEQ ID NO: 35853 - RNA, 19 nt, Homo sapiens
gacagggccuauaaacuca

SEQ ID NO: 35854 - RNA, 19 nt, Homo sapiens
gcccuuaucccaagucauu

SEQ ID NO: 35855 - RNA, 19 nt, Homo sapiens
gacccaaccugcugcacaa

SEQ ID NO: 35856 - RNA, 19 nt, Homo sapiens
caagaggucacugggaaua

SEQ ID NO: 35857 - RNA, 19 nt, Homo sapiens
ggaauuugaccgugggauu

SEQ ID NO: 35858 - RNA, 19 nt, Homo sapiens
aaacuggauucacuaggaa

SEQ ID NO: 35859 - RNA, 19 nt, Homo sapiens
gaucaccauucccaaagau

SEQ ID NO: 35860 - RNA, 19 nt, Homo sapiens
ccagaaccaaauaguguua

SEQ ID NO: 35861 - RNA, 19 nt, Homo sapiens
ccuacuauauguaugaaga

SEQ ID NO: 35862 - RNA, 19 nt, Homo sapiens
ggaauaaaaugacaucucu

SEQ ID NO: 35863 - RNA, 19 nt, Homo sapiens
gcagagggacgagcagaaa

SEQ ID NO: 35864 - RNA, 19 nt, Homo sapiens
uaagaaagaaacuggauuc

SEQ ID NO: 35865 - RNA, 19 nt, Homo sapiens
aaagaauucucaguucaga

SEQ ID NO: 35866 - RNA, 19 nt, Homo sapiens
aagcagaagucaucagaca

SEQ ID NO: 35867 - RNA, 19 nt, Homo sapiens
cagcaaagaugggcaagag

SEQ ID NO: 35868 - RNA, 19 nt, Homo sapiens
gaauuugaccgugggauug

SEQ ID NO: 35869 - RNA, 19 nt, Homo sapiens
gcuuucacuuugacuauga

SEQ ID NO: 35870 - RNA, 19 nt, Homo sapiens
gaaaggcuucccaaucauc

SEQ ID NO: 35871 - RNA, 19 nt, Homo sapiens
ccaugucaguggauucuau

SEQ ID NO: 35872 - RNA, 19 nt, Homo sapiens
ugacagggccuauaaacuc

SEQ ID NO: 35873 - RNA, 19 nt, Homo sapiens
cuaggaacuuuauguauac

SEQ ID NO: 35874 - RNA, 19 nt, Homo sapiens
gaaugacagggccuauaaa

SEQ ID NO: 35875 - RNA, 19 nt, Homo sapiens
gaaggcuggugauggaucu

SEQ ID NO: 35876 - RNA, 19 nt, Homo sapiens
caagcugaaccuacuauau

SEQ ID NO: 35877 - RNA, 19 nt, Homo sapiens
caauuacugcuguuacauu

SEQ ID NO: 35878 - RNA, 19 nt, Homo sapiens
gagcacaguguucaugaug

SEQ ID NO: 35879 - RNA, 19 nt, Homo sapiens
ggagcacaguguucaugau

SEQ ID NO: 35880 - RNA, 19 nt, Homo sapiens
gaucuccagugagcgauug

SEQ ID NO: 35881 - RNA, 19 nt, Homo sapiens
agaggucacugggaauaaa

SEQ ID NO: 35882 - RNA, 19 nt, Homo sapiens
ccucagaaacaccgaauga

SEQ ID NO: 35883 - RNA, 19 nt, Homo sapiens
aagcugaaccuacuauaug

SEQ ID NO: 35884 - RNA, 19 nt, Homo sapiens
aagcgacccuccucuuguu

SEQ ID NO: 35885 - RNA, 19 nt, Homo sapiens
caaagucaagggaaaguuc

SEQ ID NO: 35886 - RNA, 19 nt, Homo sapiens
ugaauccuauuuacagaca

SEQ ID NO: 35887 - RNA, 19 nt, Homo sapiens
ggagagcacggccaucauc

SEQ ID NO: 35888 - RNA, 19 nt, Homo sapiens
gaggagagcacggccauca

SEQ ID NO: 35889 - RNA, 19 nt, Homo sapiens
ccugggaccugccuucugu

SEQ ID NO: 35890 - RNA, 19 nt, Homo sapiens
agcaguaacucaucucuca

SEQ ID NO: 35891 - RNA, 19 nt, Homo sapiens
caaagacaaagaauucauc

SEQ ID NO: 35892 - RNA, 19 nt, Homo sapiens
aaagaaacuggauucacua

SEQ ID NO: 35893 - RNA, 19 nt, Homo sapiens
caaauaguguuaguaucca

SEQ ID NO: 35894 - RNA, 19 nt, Homo sapiens
cagcauccuaggaacuuua

SEQ ID NO: 35895 - RNA, 19 nt, Homo sapiens
cugaugucguggacuauuu

SEQ ID NO: 35896 - RNA, 19 nt, Homo sapiens
gcgaaugacagggccuaua

SEQ ID NO: 35897 - RNA, 19 nt, Homo sapiens
gagauaagaaacucagucu

SEQ ID NO: 35898 - RNA, 19 nt, Homo sapiens
cagcucaaccucagaaaca

SEQ ID NO: 35899 - RNA, 19 nt, Homo sapiens
uggcuucccuccucccauu

SEQ ID NO: 35900 - RNA, 19 nt, Homo sapiens
ggacaaaagagaaagaaau

SEQ ID NO: 35901 - RNA, 19 nt, Homo sapiens
ucagaucaccauucccaaa

SEQ ID NO: 35902 - RNA, 19 nt, Homo sapiens
gacaagagagcacuauacu

SEQ ID NO: 35903 - RNA, 19 nt, Homo sapiens
ccaaauaguguuaguaucc

SEQ ID NO: 35904 - RNA, 19 nt, Homo sapiens
uuacugcuguuacauuucu

SEQ ID NO: 35905 - RNA, 19 nt, Homo sapiens
cguggacuauuuacucaga

SEQ ID NO: 35906 - RNA, 19 nt, Homo sapiens
ugaugucguggacuauuua

SEQ ID NO: 35907 - RNA, 19 nt, Homo sapiens
ucagaaacaccgaaugagu

SEQ ID NO: 35908 - RNA, 19 nt, Homo sapiens
ucacuuugacuaugagguu

SEQ ID NO: 35909 - RNA, 19 nt, Homo sapiens
gcugaaccuacuauaugua

SEQ ID NO: 35910 - RNA, 19 nt, Homo sapiens
gagggaggcauucaucuac

SEQ ID NO: 35911 - RNA, 19 nt, Homo sapiens
ggaggaggagcacaguguu

SEQ ID NO: 35912 - RNA, 19 nt, Homo sapiens
ccagugagcgauugagcuu

SEQ ID NO: 35913 - RNA, 19 nt, Homo sapiens
ccugcaggaucuccaguga

SEQ ID NO: 35914 - RNA, 19 nt, Homo sapiens
ccaagggcuucuccaagag

SEQ ID NO: 35915 - RNA, 19 nt, Homo sapiens
gaaccuugagcuuggaaca

SEQ ID NO: 35916 - RNA, 19 nt, Homo sapiens
gcagcuuucacuuugacua

SEQ ID NO: 35917 - RNA, 19 nt, Homo sapiens
guuaguauccaaugacaag

SEQ ID NO: 35918 - RNA, 19 nt, Homo sapiens
ucucuucgucucucccuua

SEQ ID NO: 35919 - RNA, 19 nt, Homo sapiens
uaaacuuagccaccauauu

SEQ ID NO: 35920 - RNA, 19 nt, Homo sapiens
uccggcagcuuucacuuug

SEQ ID NO: 35921 - RNA, 19 nt, Homo sapiens
ggauuuggguugcauauuu

SEQ ID NO: 35922 - RNA, 19 nt, Homo sapiens
gaaagaaacuggauucacu

SEQ ID NO: 35923 - RNA, 19 nt, Homo sapiens
gaaacuggauucacuagga

SEQ ID NO: 35924 - RNA, 19 nt, Homo sapiens
aaacuuagccaccauauuu

SEQ ID NO: 35925 - RNA, 19 nt, Homo sapiens
aaagaacucucaagcagua

SEQ ID NO: 35926 - RNA, 19 nt, Homo sapiens
ccuaggaacuuuauguaua

SEQ ID NO: 35927 - RNA, 19 nt, Homo sapiens
guacacagcuuucaucaac

SEQ ID NO: 35928 - RNA, 19 nt, Homo sapiens
gcuguuacauuucuaaaga

SEQ ID NO: 35929 - RNA, 19 nt, Homo sapiens
aagaaaggcuucccaauca

SEQ ID NO: 35930 - RNA, 19 nt, Homo sapiens
caucaucgcuguugugcaa

SEQ ID NO: 35931 - RNA, 19 nt, Homo sapiens
gaagucaucagacaaagaa

SEQ ID NO: 35932 - RNA, 19 nt, Homo sapiens
gaaccuacuauauguauga

SEQ ID NO: 35933 - RNA, 19 nt, Homo sapiens
gacaaagaauucucaguuc

SEQ ID NO: 35934 - RNA, 19 nt, Homo sapiens
gcagaagucaucagacaaa

SEQ ID NO: 35935 - RNA, 19 nt, Homo sapiens
aaagagagugagacaauua

SEQ ID NO: 35936 - RNA, 19 nt, Homo sapiens
acuagaagcuuuacaacuu

SEQ ID NO: 35937 - RNA, 19 nt, Homo sapiens
cuucgucucucccuuauuu

SEQ ID NO: 35938 - RNA, 19 nt, Homo sapiens
guaauucaaccugcauuua

SEQ ID NO: 35939 - RNA, 19 nt, Homo sapiens
cgaaugacagggccuauaa

SEQ ID NO: 35940 - RNA, 19 nt, Homo sapiens
cggagaagcuuuacagagu

SEQ ID NO: 35941 - RNA, 19 nt, Homo sapiens
cuagaagcuuuacaacuuu

SEQ ID NO: 35942 - RNA, 19 nt, Homo sapiens
ucaccgaucuugaugacaa

SEQ ID NO: 35943 - RNA, 19 nt, Homo sapiens
ccuugcagcuccucauaua

SEQ ID NO: 35944 - RNA, 19 nt, Homo sapiens
cgauugagcuucccagagu

SEQ ID NO: 35945 - RNA, 19 nt, Homo sapiens
gauuuggguugcauauuug

SEQ ID NO: 35946 - RNA, 19 nt, Homo sapiens
gaaccaaauaguguuagua

SEQ ID NO: 35947 - RNA, 19 nt, Homo sapiens
ggagggaggcauucaucua

SEQ ID NO: 35948 - RNA, 19 nt, Homo sapiens
acaaagaauucucaguuca

SEQ ID NO: 35949 - RNA, 19 nt, Homo sapiens
agacaaagaauucucaguu

SEQ ID NO: 35950 - RNA, 19 nt, Homo sapiens
gacagggccuauaaacuca

SEQ ID NO: 35951 - RNA, 19 nt, Homo sapiens
gcccuuaucccaagucauu

SEQ ID NO: 35952 - RNA, 19 nt, Homo sapiens
gacccaaccugcugcacaa

SEQ ID NO: 35953 - RNA, 19 nt, Homo sapiens
caagaggucacugggaaua

SEQ ID NO: 35954 - RNA, 19 nt, Homo sapiens
ggaauuugaccgugggauu

SEQ ID NO: 35955 - RNA, 19 nt, Homo sapiens
aaacuggauucacuaggaa

SEQ ID NO: 35956 - RNA, 19 nt, Homo sapiens
gaucaccauucccaaagau

SEQ ID NO: 35957 - RNA, 19 nt, Homo sapiens
ccagaaccaaauaguguua

SEQ ID NO: 35958 - RNA, 19 nt, Homo sapiens
ccuacuauauguaugaaga

SEQ ID NO: 35959 - RNA, 19 nt, Homo sapiens
ccgcaacccuuagaaauca

SEQ ID NO: 35960 - RNA, 19 nt, Homo sapiens
ggaauaaaaugacaucucu

SEQ ID NO: 35961 - RNA, 19 nt, Homo sapiens
gcagagggacgagcagaaa

SEQ ID NO: 35962 - RNA, 19 nt, Homo sapiens
uaagaaagaaacuggauuc

SEQ ID NO: 35963 - RNA, 19 nt, Homo sapiens
aaagaauucucaguucaga

SEQ ID NO: 35964 - RNA, 19 nt, Homo sapiens
aagcagaagucaucagaca

SEQ ID NO: 35965 - RNA, 19 nt, Homo sapiens
cagcaaagaugggcaagag

SEQ ID NO: 35966 - RNA, 19 nt, Homo sapiens
gaauuugaccgugggauug

SEQ ID NO: 35967 - RNA, 19 nt, Homo sapiens
gaaaggcuucccaaucauc

SEQ ID NO: 35968 - RNA, 19 nt, Homo sapiens
ccaugucaguggauucuau

SEQ ID NO: 35969 - RNA, 19 nt, Homo sapiens
ugacagggccuauaaacuc

SEQ ID NO: 35970 - RNA, 19 nt, Homo sapiens
cuaggaacuuuauguauac

SEQ ID NO: 35971 - RNA, 19 nt, Homo sapiens
gaaugacagggccuauaaa

SEQ ID NO: 35972 - RNA, 19 nt, Homo sapiens
caagcugaaccuacuauau

SEQ ID NO: 35973 - RNA, 19 nt, Homo sapiens
caauuacugcuguuacauu

SEQ ID NO: 35974 - RNA, 19 nt, Homo sapiens
ggaguuguaugaucuucag

SEQ ID NO: 35975 - RNA, 19 nt, Homo sapiens
gagcacaguguucaugaug

SEQ ID NO: 35976 - RNA, 19 nt, Homo sapiens
ggagcacaguguucaugau

SEQ ID NO: 35977 - RNA, 19 nt, Homo sapiens
gaucuccagugagcgauug

SEQ ID NO: 35978 - RNA, 19 nt, Homo sapiens
gcacaaaaccaccgaugaa

SEQ ID NO: 35979 - RNA, 19 nt, Homo sapiens
agaggucacugggaauaaa

SEQ ID NO: 35980 - RNA, 19 nt, Homo sapiens
ccucagaaacaccgaauga

SEQ ID NO: 35981 - RNA, 19 nt, Homo sapiens
aagcugaaccuacuauaug

SEQ ID NO: 35982 - RNA, 19 nt, Homo sapiens
aagcgacccuccucuuguu

SEQ ID NO: 35983 - RNA, 19 nt, Homo sapiens
caaagucaagggaaaguuc

SEQ ID NO: 35984 - RNA, 19 nt, Homo sapiens
auacacaucguaacuuuga

SEQ ID NO: 35985 - RNA, 19 nt, Homo sapiens
ugaauccuauuuacagaca

SEQ ID NO: 35986 - RNA, 19 nt, Homo sapiens
ggagagcacggccaucauc

SEQ ID NO: 35987 - RNA, 19 nt, Homo sapiens
gaggagagcacggccauca

SEQ ID NO: 35988 - RNA, 19 nt, Homo sapiens
cuucagaucuuaggcacaa

SEQ ID NO: 35989 - RNA, 19 nt, Homo sapiens
agcaguaacucaucucuca

SEQ ID NO: 35990 - RNA, 19 nt, Homo sapiens
caaagacaaagaauucauc

SEQ ID NO: 35991 - RNA, 19 nt, Homo sapiens
aaagaaacuggauucacua

SEQ ID NO: 35992 - RNA, 19 nt, Homo sapiens
caaauaguguuaguaucca

SEQ ID NO: 35993 - RNA, 19 nt, Homo sapiens
cagcauccuaggaacuuua

SEQ ID NO: 35994 - RNA, 19 nt, Homo sapiens
cugaugucguggacuauuu

SEQ ID NO: 35995 - RNA, 19 nt, Homo sapiens
gcgaaugacagggccuaua

SEQ ID NO: 35996 - RNA, 19 nt, Homo sapiens
ggacaaaagagaaagaaau

SEQ ID NO: 35997 - RNA, 19 nt, Homo sapiens
gagauaagaaacucagucu

SEQ ID NO: 35998 - RNA, 19 nt, Homo sapiens
cagcucaaccucagaaaca

SEQ ID NO: 35999 - RNA, 19 nt, Homo sapiens
uggcuucccuccucccauu

SEQ ID NO: 36000 - RNA, 19 nt, Homo sapiens
ucagaucaccauucccaaa

SEQ ID NO: 36001 - RNA, 19 nt, Homo sapiens
gacaagagagcacuauacu

SEQ ID NO: 36002 - RNA, 19 nt, Homo sapiens
ccaaauaguguuaguaucc

SEQ ID NO: 36003 - RNA, 19 nt, Homo sapiens
uuacugcuguuacauuucu

SEQ ID NO: 36004 - RNA, 19 nt, Homo sapiens
cguggacuauuuacucaga

SEQ ID NO: 36005 - RNA, 19 nt, Homo sapiens
ugaugucguggacuauuua

SEQ ID NO: 36006 - RNA, 19 nt, Homo sapiens
caaaaccaccgaugaauuc

SEQ ID NO: 36007 - RNA, 19 nt, Homo sapiens
ucagaaacaccgaaugagu

SEQ ID NO: 36008 - RNA, 19 nt, Homo sapiens
gcugaaccuacuauaugua

SEQ ID NO: 36009 - RNA, 19 nt, Homo sapiens
gagggaggcauucaucuac

SEQ ID NO: 36010 - RNA, 19 nt, Homo sapiens
ggaggaggagcacaguguu

SEQ ID NO: 36011 - RNA, 19 nt, Homo sapiens
ccagugagcgauugagcuu

SEQ ID NO: 36012 - RNA, 19 nt, Homo sapiens
ccugcaggaucuccaguga

SEQ ID NO: 36013 - RNA, 19 nt, Homo sapiens
ccaccgcaacccuuagaaa

SEQ ID NO: 36014 - RNA, 19 nt, Homo sapiens
guuaguauccaaugacaag

SEQ ID NO: 36015 - RNA, 19 nt, Homo sapiens
ucucuucgucucucccuua

SEQ ID NO: 36016 - RNA, 19 nt, Homo sapiens
gaugaauuccgauacacau

SEQ ID NO: 36017 - RNA, 19 nt, Homo sapiens
uaaacuuagccaccauauu

SEQ ID NO: 36018 - RNA, 19 nt, Homo sapiens
uagaagcuuuacaacuuuc

SEQ ID NO: 36019 - RNA, 19 nt, Homo sapiens
gaggaggggugccauguca

SEQ ID NO: 36020 - RNA, 19 nt, Homo sapiens
aaacaagcugaaccuacua

SEQ ID NO: 36021 - RNA, 19 nt, Homo sapiens
gcaaagacgcggcugauua

SEQ ID NO: 36022 - RNA, 19 nt, Homo sapiens
gacaggaacuucucaauga

SEQ ID NO: 36023 - RNA, 19 nt, Homo sapiens
gaaagaaacuggauucacu

SEQ ID NO: 36024 - RNA, 19 nt, Homo sapiens
gaaagcagcucccuaagag

SEQ ID NO: 36025 - RNA, 19 nt, Homo sapiens
gaacuuggcauucaacauu

SEQ ID NO: 36026 - RNA, 19 nt, Homo sapiens
gaaacuggauucacuagga

SEQ ID NO: 36027 - RNA, 19 nt, Homo sapiens
aaacuuagccaccauauuu

SEQ ID NO: 36028 - RNA, 19 nt, Homo sapiens
gaagggaaaguguauuaua

SEQ ID NO: 36029 - RNA, 19 nt, Homo sapiens
aaagaacucucaagcagua

SEQ ID NO: 36030 - RNA, 19 nt, Homo sapiens
gcaaugagauauacuaaac

SEQ ID NO: 36031 - RNA, 19 nt, Homo sapiens
ggaggucucuggcaacaaa

SEQ ID NO: 36032 - RNA, 19 nt, Homo sapiens
guacuuacauugugccaaa

SEQ ID NO: 36033 - RNA, 19 nt, Homo sapiens
guacacagcuuucaucaac

SEQ ID NO: 36034 - RNA, 19 nt, Homo sapiens
ccucuuggcucuauaauau

SEQ ID NO: 36035 - RNA, 19 nt, Homo sapiens
ucucagacauucaauauga

SEQ ID NO: 36036 - RNA, 19 nt, Homo sapiens
aagaaaggcuucccaauca

SEQ ID NO: 36037 - RNA, 19 nt, Homo sapiens
auacaacucuugcuuggua

SEQ ID NO: 36038 - RNA, 19 nt, Homo sapiens
caucaucgcuguugugcaa

SEQ ID NO: 36039 - RNA, 19 nt, Homo sapiens
gaagucaucagacaaagaa

SEQ ID NO: 36040 - RNA, 19 nt, Homo sapiens
gacaaagaauucucaguuc

SEQ ID NO: 36041 - RNA, 19 nt, Homo sapiens
gaaauucccagugguguuu

SEQ ID NO: 36042 - RNA, 19 nt, Homo sapiens
gauaacccuuccuucgaua

SEQ ID NO: 36043 - RNA, 19 nt, Homo sapiens
gcagaagucaucagacaaa

SEQ ID NO: 36044 - RNA, 19 nt, Homo sapiens
aaagagagugagacaauua

SEQ ID NO: 36045 - RNA, 19 nt, Homo sapiens
acuagaagcuuuacaacuu

SEQ ID NO: 36046 - RNA, 19 nt, Homo sapiens
ggauaacccuuccuucgau

SEQ ID NO: 36047 - RNA, 19 nt, Homo sapiens
aauaugaucugccauuuca

SEQ ID NO: 36048 - RNA, 19 nt, Homo sapiens
gccaaaggcugaggaaaug

SEQ ID NO: 36049 - RNA, 19 nt, Homo sapiens
ggacaggaacuucucaaug

SEQ ID NO: 36050 - RNA, 19 nt, Homo sapiens
cagaggagccuuucgauau

SEQ ID NO: 36051 - RNA, 19 nt, Homo sapiens
gaacuuguuuagaaaggau

SEQ ID NO: 36052 - RNA, 19 nt, Homo sapiens
cgaaugacagggccuauaa

SEQ ID NO: 36053 - RNA, 19 nt, Homo sapiens
caaagacgcggcugauuau

SEQ ID NO: 36054 - RNA, 19 nt, Homo sapiens
gaauccaacuauaaagugu

SEQ ID NO: 36055 - RNA, 19 nt, Homo sapiens
ugccauagcuuuauaacug

SEQ ID NO: 36056 - RNA, 19 nt, Homo sapiens
cggagaagcuuuacagagu

SEQ ID NO: 36057 - RNA, 19 nt, Homo sapiens
cuagaagcuuuacaacuuu

SEQ ID NO: 36058 - RNA, 19 nt, Homo sapiens
gaaauccaguucaccuaca

SEQ ID NO: 36059 - RNA, 19 nt, Homo sapiens
ucaccgaucuugaugacaa

SEQ ID NO: 36060 - RNA, 19 nt, Homo sapiens
gguauagccuaaccguauu

SEQ ID NO: 36061 - RNA, 19 nt, Homo sapiens
ccuugcagcuccucauaua

SEQ ID NO: 36062 - RNA, 19 nt, Homo sapiens
ucaauaugaucugccauuu

SEQ ID NO: 36063 - RNA, 19 nt, Homo sapiens
ggagggaggcauucaucua

SEQ ID NO: 36064 - RNA, 19 nt, Homo sapiens
acaaagaauucucaguuca

SEQ ID NO: 36065 - RNA, 19 nt, Homo sapiens
agacaaagaauucucaguu

SEQ ID NO: 36066 - RNA, 19 nt, Homo sapiens
gacagggccuauaaacuca

SEQ ID NO: 36067 - RNA, 19 nt, Homo sapiens
gcccuuaucccaagucauu

SEQ ID NO: 36068 - RNA, 19 nt, Homo sapiens
agacgcggcugauuauaau

SEQ ID NO: 36069 - RNA, 19 nt, Homo sapiens
gacccaaccugcugcacaa

SEQ ID NO: 36070 - RNA, 19 nt, Homo sapiens
caagaggucacugggaaua

SEQ ID NO: 36071 - RNA, 19 nt, Homo sapiens
ucaguuaaccaaacaagaa

SEQ ID NO: 36072 - RNA, 19 nt, Homo sapiens
caaaccagauggcaauguc

SEQ ID NO: 36073 - RNA, 19 nt, Homo sapiens
ggaauuugaccgugggauu

SEQ ID NO: 36074 - RNA, 19 nt, Homo sapiens
aaacuggauucacuaggaa

SEQ ID NO: 36075 - RNA, 19 nt, Homo sapiens
gaucaccauucccaaagau

SEQ ID NO: 36076 - RNA, 19 nt, Homo sapiens
ggaauccaacuauaaagug

SEQ ID NO: 36077 - RNA, 19 nt, Homo sapiens
ggaauaaaaugacaucucu

SEQ ID NO: 36078 - RNA, 19 nt, Homo sapiens
gcagagggacgagcagaaa

SEQ ID NO: 36079 - RNA, 19 nt, Homo sapiens
ggauucaguuaaccaaaca

SEQ ID NO: 36080 - RNA, 19 nt, Homo sapiens
uagaaaggauucaguuaac

SEQ ID NO: 36081 - RNA, 19 nt, Homo sapiens
gagaaauccaguucaccua

SEQ ID NO: 36082 - RNA, 19 nt, Homo sapiens
uaagaaagaaacuggauuc

SEQ ID NO: 36083 - RNA, 19 nt, Homo sapiens
gauuagagaggacagcaaa

SEQ ID NO: 36084 - RNA, 19 nt, Homo sapiens
gcuuaguucaguuagauua

SEQ ID NO: 36085 - RNA, 19 nt, Homo sapiens
ucgaagggaaaguguauua

SEQ ID NO: 36086 - RNA, 19 nt, Homo sapiens
caagagaaauccaguucac

SEQ ID NO: 36087 - RNA, 19 nt, Homo sapiens
aaagaauucucaguucaga

SEQ ID NO: 36088 - RNA, 19 nt, Homo sapiens
aagcagaagucaucagaca

SEQ ID NO: 36089 - RNA, 19 nt, Homo sapiens
cagcaaagaugggcaagag

SEQ ID NO: 36090 - RNA, 19 nt, Homo sapiens
gaauuugaccgugggauug

SEQ ID NO: 36091 - RNA, 19 nt, Homo sapiens
cuugugccaugaugaauaa

SEQ ID NO: 36092 - RNA, 19 nt, Homo sapiens
ggaagcagaauaugagaag

SEQ ID NO: 36093 - RNA, 19 nt, Homo sapiens
agagagcgcuggcagaucu

SEQ ID NO: 36094 - RNA, 19 nt, Homo sapiens
ugaaagcagcucccuaaga

SEQ ID NO: 36095 - RNA, 19 nt, Homo sapiens
gaaaggcuucccaaucauc

SEQ ID NO: 36096 - RNA, 19 nt, Homo sapiens
ccaugucaguggauucuau

SEQ ID NO: 36097 - RNA, 19 nt, Homo sapiens
ugacagggccuauaaacuc

SEQ ID NO: 36098 - RNA, 19 nt, Homo sapiens
ugacuauuguguauucugu

SEQ ID NO: 36099 - RNA, 19 nt, Homo sapiens
gaaugacagggccuauaaa

SEQ ID NO: 36100 - RNA, 19 nt, Homo sapiens
guuuaagaaucuacacaga

SEQ ID NO: 36101 - RNA, 19 nt, Homo sapiens
gaaaggauucaguuaacca

SEQ ID NO: 36102 - RNA, 19 nt, Homo sapiens
gagcacaguguucaugaug

SEQ ID NO: 36103 - RNA, 19 nt, Homo sapiens
ggagcacaguguucaugau

SEQ ID NO: 36104 - RNA, 19 nt, Homo sapiens
gaaaggacaggaacuucuc

SEQ ID NO: 36105 - RNA, 19 nt, Homo sapiens
ucagaggagccuuucgaua

SEQ ID NO: 36106 - RNA, 19 nt, Homo sapiens
aaacagacucaacuuccua

SEQ ID NO: 36107 - RNA, 19 nt, Homo sapiens
agaggucacugggaauaaa

SEQ ID NO: 36108 - RNA, 19 nt, Homo sapiens
ccucagaaacaccgaauga

SEQ ID NO: 36109 - RNA, 19 nt, Homo sapiens
cauaggagucagauacaaa

SEQ ID NO: 36110 - RNA, 19 nt, Homo sapiens
caaagucaagggaaaguuc

SEQ ID NO: 36111 - RNA, 19 nt, Homo sapiens
ugaauccuauuuacagaca

SEQ ID NO: 36112 - RNA, 19 nt, Homo sapiens
caagcuuaguucaguuaga

SEQ ID NO: 36113 - RNA, 19 nt, Homo sapiens
ggaaaaugcuaaaucugau

SEQ ID NO: 36114 - RNA, 19 nt, Homo sapiens
acaagaggaagcagaauau

SEQ ID NO: 36115 - RNA, 19 nt, Homo sapiens
gggauaacccuuccuucga

SEQ ID NO: 36116 - RNA, 19 nt, Homo sapiens
caaagacccaggaaugaca

SEQ ID NO: 36117 - RNA, 19 nt, Homo sapiens
ggagagcacggccaucauc

SEQ ID NO: 36118 - RNA, 19 nt, Homo sapiens
gaggagagcacggccauca

SEQ ID NO: 36119 - RNA, 19 nt, Homo sapiens
ccagugguguuucuuaagg

SEQ ID NO: 36120 - RNA, 19 nt, Homo sapiens
caaaggcugaggaaauguu

SEQ ID NO: 36121 - RNA, 19 nt, Homo sapiens
gaaagaaacuggauucacu

SEQ ID NO: 36122 - RNA, 19 nt, Homo sapiens
gaaagcagcucccuaagag

SEQ ID NO: 36123 - RNA, 19 nt, Homo sapiens
gaacuuggcauucaacauu

SEQ ID NO: 36124 - RNA, 19 nt, Homo sapiens
gaaacuggauucacuagga

SEQ ID NO: 36125 - RNA, 19 nt, Homo sapiens
ggagcuugcuggagucuua

SEQ ID NO: 36126 - RNA, 19 nt, Homo sapiens
aaacuuagccaccauauuu

SEQ ID NO: 36127 - RNA, 19 nt, Homo sapiens
gaagggaaaguguauuaua

SEQ ID NO: 36128 - RNA, 19 nt, Homo sapiens
aaagaacucucaagcagua

SEQ ID NO: 36129 - RNA, 19 nt, Homo sapiens
gcaaugagauauacuaaac

SEQ ID NO: 36130 - RNA, 19 nt, Homo sapiens
guacuuacauugugccaaa

SEQ ID NO: 36131 - RNA, 19 nt, Homo sapiens
guacacagcuuucaucaac

SEQ ID NO: 36132 - RNA, 19 nt, Homo sapiens
ccucuuggcucuauaauau

SEQ ID NO: 36133 - RNA, 19 nt, Homo sapiens
aagaaaggcuucccaauca

SEQ ID NO: 36134 - RNA, 19 nt, Homo sapiens
auacaacucuugcuuggua

SEQ ID NO: 36135 - RNA, 19 nt, Homo sapiens
caucaucgcuguugugcaa

SEQ ID NO: 36136 - RNA, 19 nt, Homo sapiens
gaagucaucagacaaagaa

SEQ ID NO: 36137 - RNA, 19 nt, Homo sapiens
gccaagggcuucuccaaga

SEQ ID NO: 36138 - RNA, 19 nt, Homo sapiens
gacaaagaauucucaguuc

SEQ ID NO: 36139 - RNA, 19 nt, Homo sapiens
gaaauucccagugguguuu

SEQ ID NO: 36140 - RNA, 19 nt, Homo sapiens
gauaacccuuccuucgaua

SEQ ID NO: 36141 - RNA, 19 nt, Homo sapiens
gcagaagucaucagacaaa

SEQ ID NO: 36142 - RNA, 19 nt, Homo sapiens
aaagagagugagacaauua

SEQ ID NO: 36143 - RNA, 19 nt, Homo sapiens
acuagaagcuuuacaacuu

SEQ ID NO: 36144 - RNA, 19 nt, Homo sapiens
ggauaacccuuccuucgau

SEQ ID NO: 36145 - RNA, 19 nt, Homo sapiens
gccaaaggcugaggaaaug

SEQ ID NO: 36146 - RNA, 19 nt, Homo sapiens
cagaggagccuuucgauau

SEQ ID NO: 36147 - RNA, 19 nt, Homo sapiens
gaacuuguuuagaaaggau

SEQ ID NO: 36148 - RNA, 19 nt, Homo sapiens
cgaaugacagggccuauaa

SEQ ID NO: 36149 - RNA, 19 nt, Homo sapiens
gaauccaacuauaaagugu

SEQ ID NO: 36150 - RNA, 19 nt, Homo sapiens
ugccauagcuuuauaacug

SEQ ID NO: 36151 - RNA, 19 nt, Homo sapiens
cggagaagcuuuacagagu

SEQ ID NO: 36152 - RNA, 19 nt, Homo sapiens
cuagaagcuuuacaacuuu

SEQ ID NO: 36153 - RNA, 19 nt, Homo sapiens
gaaauccaguucaccuaca

SEQ ID NO: 36154 - RNA, 19 nt, Homo sapiens
ucaccgaucuugaugacaa

SEQ ID NO: 36155 - RNA, 19 nt, Homo sapiens
gguauagccuaaccguauu

SEQ ID NO: 36156 - RNA, 19 nt, Homo sapiens
ccuugcagcuccucauaua

SEQ ID NO: 36157 - RNA, 19 nt, Homo sapiens
cuagaaggcuggugaugga

SEQ ID NO: 36158 - RNA, 19 nt, Homo sapiens
ggagggaggcauucaucua

SEQ ID NO: 36159 - RNA, 19 nt, Homo sapiens
acaaagaauucucaguuca

SEQ ID NO: 36160 - RNA, 19 nt, Homo sapiens
agacaaagaauucucaguu

SEQ ID NO: 36161 - RNA, 19 nt, Homo sapiens
gacagggccuauaaacuca

SEQ ID NO: 36162 - RNA, 19 nt, Homo sapiens
gcccuuaucccaagucauu

SEQ ID NO: 36163 - RNA, 19 nt, Homo sapiens
gacccaaccugcugcacaa

SEQ ID NO: 36164 - RNA, 19 nt, Homo sapiens
caagaggucacugggaaua

SEQ ID NO: 36165 - RNA, 19 nt, Homo sapiens
ucaguuaaccaaacaagaa

SEQ ID NO: 36166 - RNA, 19 nt, Homo sapiens
caaaccagauggcaauguc

SEQ ID NO: 36167 - RNA, 19 nt, Homo sapiens
ggaauuugaccgugggauu

SEQ ID NO: 36168 - RNA, 19 nt, Homo sapiens
aaacuggauucacuaggaa

SEQ ID NO: 36169 - RNA, 19 nt, Homo sapiens
gaucaccauucccaaagau

SEQ ID NO: 36170 - RNA, 19 nt, Homo sapiens
ggaauccaacuauaaagug

SEQ ID NO: 36171 - RNA, 19 nt, Homo sapiens
ggaauaaaaugacaucucu

SEQ ID NO: 36172 - RNA, 19 nt, Homo sapiens
gcagagggacgagcagaaa

SEQ ID NO: 36173 - RNA, 19 nt, Homo sapiens
ggauucaguuaaccaaaca

SEQ ID NO: 36174 - RNA, 19 nt, Homo sapiens
uagaaaggauucaguuaac

SEQ ID NO: 36175 - RNA, 19 nt, Homo sapiens
gagaaauccaguucaccua

SEQ ID NO: 36176 - RNA, 19 nt, Homo sapiens
uaagaaagaaacuggauuc

SEQ ID NO: 36177 - RNA, 19 nt, Homo sapiens
ucgaagggaaaguguauua

SEQ ID NO: 36178 - RNA, 19 nt, Homo sapiens
caagagaaauccaguucac

SEQ ID NO: 36179 - RNA, 19 nt, Homo sapiens
aaagaauucucaguucaga

SEQ ID NO: 36180 - RNA, 19 nt, Homo sapiens
aagcagaagucaucagaca

SEQ ID NO: 36181 - RNA, 19 nt, Homo sapiens
cagcaaagaugggcaagag

SEQ ID NO: 36182 - RNA, 19 nt, Homo sapiens
gaauuugaccgugggauug

SEQ ID NO: 36183 - RNA, 19 nt, Homo sapiens
gcuuucacuuugacuauga

SEQ ID NO: 36184 - RNA, 19 nt, Homo sapiens
cuugugccaugaugaauaa

SEQ ID NO: 36185 - RNA, 19 nt, Homo sapiens
ggaagcagaauaugagaag

SEQ ID NO: 36186 - RNA, 19 nt, Homo sapiens
agagagcgcuggcagaucu

SEQ ID NO: 36187 - RNA, 19 nt, Homo sapiens
ugaaagcagcucccuaaga

SEQ ID NO: 36188 - RNA, 19 nt, Homo sapiens
gaaaggcuucccaaucauc

SEQ ID NO: 36189 - RNA, 19 nt, Homo sapiens
ccaugucaguggauucuau

SEQ ID NO: 36190 - RNA, 19 nt, Homo sapiens
ugacagggccuauaaacuc

SEQ ID NO: 36191 - RNA, 19 nt, Homo sapiens
ugacuauuguguauucugu

SEQ ID NO: 36192 - RNA, 19 nt, Homo sapiens
gaaggcuggugauggaucu

SEQ ID NO: 36193 - RNA, 19 nt, Homo sapiens
gaaugacagggccuauaaa

SEQ ID NO: 36194 - RNA, 19 nt, Homo sapiens
guuuaagaaucuacacaga

SEQ ID NO: 36195 - RNA, 19 nt, Homo sapiens
gaaaggauucaguuaacca

SEQ ID NO: 36196 - RNA, 19 nt, Homo sapiens
gagcacaguguucaugaug

SEQ ID NO: 36197 - RNA, 19 nt, Homo sapiens
ggagcacaguguucaugau

SEQ ID NO: 36198 - RNA, 19 nt, Homo sapiens
ucagaggagccuuucgaua

SEQ ID NO: 36199 - RNA, 19 nt, Homo sapiens
agaggucacugggaauaaa

SEQ ID NO: 36200 - RNA, 19 nt, Homo sapiens
ccucagaaacaccgaauga

SEQ ID NO: 36201 - RNA, 19 nt, Homo sapiens
cauaggagucagauacaaa

SEQ ID NO: 36202 - RNA, 19 nt, Homo sapiens
caaagucaagggaaaguuc

SEQ ID NO: 36203 - RNA, 19 nt, Homo sapiens
ugaauccuauuuacagaca

SEQ ID NO: 36204 - RNA, 19 nt, Homo sapiens
ggaaaaugcuaaaucugau

SEQ ID NO: 36205 - RNA, 19 nt, Homo sapiens
acaagaggaagcagaauau

SEQ ID NO: 36206 - RNA, 19 nt, Homo sapiens
gggauaacccuuccuucga

SEQ ID NO: 36207 - RNA, 19 nt, Homo sapiens
caaagacccaggaaugaca

SEQ ID NO: 36208 - RNA, 19 nt, Homo sapiens
ggagagcacggccaucauc

SEQ ID NO: 36209 - RNA, 19 nt, Homo sapiens
gaggagagcacggccauca

SEQ ID NO: 36210 - RNA, 19 nt, Homo sapiens
ccugggaccugccuucugu

SEQ ID NO: 36211 - RNA, 19 nt, Homo sapiens
ccagugguguuucuuaagg

SEQ ID NO: 36212 - RNA, 19 nt, Homo sapiens
caaaggcugaggaaauguu

SEQ ID NO: 36213 - RNA, 19 nt, Homo sapiens
gagaauaagguuccauugc

SEQ ID NO: 36214 - RNA, 19 nt, Homo sapiens
aacuuggcauucaacauua

SEQ ID NO: 36215 - RNA, 19 nt, Homo sapiens
agaggagccuuucgauauc

SEQ ID NO: 36216 - RNA, 19 nt, Homo sapiens
agcaguaacucaucucuca

SEQ ID NO: 36217 - RNA, 19 nt, Homo sapiens
caaagacaaagaauucauc

SEQ ID NO: 36218 - RNA, 19 nt, Homo sapiens
aaagaaacuggauucacua

SEQ ID NO: 36219 - RNA, 19 nt, Homo sapiens
cugaugucguggacuauuu

SEQ ID NO: 36220 - RNA, 19 nt, Homo sapiens
gcgaaugacagggccuaua

SEQ ID NO: 36221 - RNA, 19 nt, Homo sapiens
ugacaagacugacuacaug

SEQ ID NO: 36222 - RNA, 19 nt, Homo sapiens
ggaaauaaaugccccugaa

SEQ ID NO: 36223 - RNA, 19 nt, Homo sapiens
gggccucacuagccucuaa

SEQ ID NO: 36224 - RNA, 19 nt, Homo sapiens
caggaaaggcgucaagauu

SEQ ID NO: 36225 - RNA, 19 nt, Homo sapiens
ugaaguacauccagcauac

SEQ ID NO: 36226 - RNA, 19 nt, Homo sapiens
gagauaguguccggcauga

SEQ ID NO: 36227 - RNA, 19 nt, Homo sapiens
gacgagagccugcgaaagu

SEQ ID NO: 36228 - RNA, 19 nt, Homo sapiens
gaaggaggguguggaguac

SEQ ID NO: 36229 - RNA, 19 nt, Homo sapiens
ucaagaagcagucguuugu

SEQ ID NO: 36230 - RNA, 19 nt, Homo sapiens
ugaaggaggguguggagua

SEQ ID NO: 36231 - RNA, 19 nt, Homo sapiens
ggaccaagugcacacauug

SEQ ID NO: 36232 - RNA, 19 nt, Homo sapiens
uaaccaugaugccuuaaca

SEQ ID NO: 36233 - RNA, 19 nt, Homo sapiens
gggaccaagugcacacauu

SEQ ID NO: 36234 - RNA, 19 nt, Homo sapiens
caagacugacuacauggua

SEQ ID NO: 36235 - RNA, 19 nt, Homo sapiens
gguguggaguaccggauaa

SEQ ID NO: 36236 - RNA, 19 nt, Homo sapiens
ggaaagccaaauugccaaa

SEQ ID NO: 36237 - RNA, 19 nt, Homo sapiens
aaacucaagucaccucagu

SEQ ID NO: 36238 - RNA, 19 nt, Homo sapiens
cagcauacguacaggaaag

SEQ ID NO: 36239 - RNA, 19 nt, Homo sapiens
gucuaaccaugaugccuua

SEQ ID NO: 36240 - RNA, 19 nt, Homo sapiens
ggaaucucaccaucaagaa

SEQ ID NO: 36241 - RNA, 19 nt, Homo sapiens
gauaguguccggcaugaag

SEQ ID NO: 36242 - RNA, 19 nt, Homo sapiens
caagucaccucaguaccau

SEQ ID NO: 36243 - RNA, 19 nt, Homo sapiens
gaugagcacucggucaacu

SEQ ID NO: 36244 - RNA, 19 nt, Homo sapiens
acgagagccugcgaaagua

SEQ ID NO: 36245 - RNA, 19 nt, Homo sapiens
caucaagucccgcuucaca

SEQ ID NO: 36246 - RNA, 19 nt, Homo sapiens
gccuggccaucaguauuua

SEQ ID NO: 36247 - RNA, 19 nt, Homo sapiens
aguggaaucucaccaucaa

SEQ ID NO: 36248 - RNA, 19 nt, Homo sapiens
agaagagcauccaggagau

SEQ ID NO: 36249 - RNA, 19 nt, Homo sapiens
gagcggagcagccauucuc

SEQ ID NO: 36250 - RNA, 19 nt, Homo sapiens
aggaaaggcgucaagauug

SEQ ID NO: 36251 - RNA, 19 nt, Homo sapiens
cccaagagcccucgaugga

SEQ ID NO: 36252 - RNA, 19 nt, Homo sapiens
ucaagucccgcuucacaga

SEQ ID NO: 36253 - RNA, 19 nt, Homo sapiens
cgacccaggcuaagcuuga

SEQ ID NO: 36254 - RNA, 19 nt, Homo sapiens
cuuaacauguggaguguac

SEQ ID NO: 36255 - RNA, 19 nt, Homo sapiens
ggccaucaguauuuauugc

SEQ ID NO: 36256 - RNA, 19 nt, Homo sapiens
cgccuggccaucaguauuu

SEQ ID NO: 36257 - RNA, 19 nt, Homo sapiens
ucaagaaggacuggaagga

SEQ ID NO: 36258 - RNA, 19 nt, Homo sapiens
gaagagcauccaggagauc

SEQ ID NO: 36259 - RNA, 19 nt, Homo sapiens
guacaggaaaggcgucaag

SEQ ID NO: 36260 - RNA, 19 nt, Homo sapiens
ucaagucaccucaguacca

SEQ ID NO: 36261 - RNA, 19 nt, Homo sapiens
gaaucucaccaucaagaag

SEQ ID NO: 36262 - RNA, 19 nt, Homo sapiens
uggaaucucaccaucaaga

SEQ ID NO: 36263 - RNA, 19 nt, Homo sapiens
gcagcuacagcaucaaguc

SEQ ID NO: 36264 - RNA, 19 nt, Homo sapiens
gaaggacuggaaggacuga

SEQ ID NO: 36265 - RNA, 19 nt, Homo sapiens
gggccgaggaguacgaguu

SEQ ID NO: 36266 - RNA, 19 nt, Homo sapiens
acaaacaagggaccaagug

SEQ ID NO: 36267 - RNA, 19 nt, Homo sapiens
ggaacaaacaagggaccaa

SEQ ID NO: 36268 - RNA, 19 nt, Homo sapiens
cgcugucggucccgucuaa

SEQ ID NO: 36269 - RNA, 19 nt, Homo sapiens
gaguggaaucucaccauca

SEQ ID NO: 36270 - RNA, 19 nt, Homo sapiens
uaaaugccccugaaggaaa

SEQ ID NO: 36271 - RNA, 19 nt, Homo sapiens
cggagaacgaggaggauga

SEQ ID NO: 36272 - RNA, 19 nt, Homo sapiens
ggguguggaguaccggaua

SEQ ID NO: 36273 - RNA, 19 nt, Homo sapiens
gaccuggagagcuucaaga

SEQ ID NO: 36274 - RNA, 19 nt, Homo sapiens
ugacccagccaggaacaaa

SEQ ID NO: 36275 - RNA, 19 nt, Homo sapiens
ggucccgucuaaccaugau

SEQ ID NO: 36276 - RNA, 19 nt, Homo sapiens
ccaucaagaaggacuggaa

SEQ ID NO: 36277 - RNA, 19 nt, Homo sapiens
gugaagcacugaauaaaua

SEQ ID NO: 36278 - RNA, 19 nt, Homo sapiens
ggacaaagaugaugagagu

SEQ ID NO: 36279 - RNA, 19 nt, Homo sapiens
gaacagggauauuguguca

SEQ ID NO: 36280 - RNA, 19 nt, Homo sapiens
ugaaagagcugcaggaaau

SEQ ID NO: 36281 - RNA, 19 nt, Homo sapiens
acagcaagcucaauuauaa

SEQ ID NO: 36282 - RNA, 19 nt, Homo sapiens
aaaggaagguucugaauau

SEQ ID NO: 36283 - RNA, 19 nt, Homo sapiens
gaaaguggauaaagcaaca

SEQ ID NO: 36284 - RNA, 19 nt, Homo sapiens
ggaagguucugaauauaga

SEQ ID NO: 36285 - RNA, 19 nt, Homo sapiens
gaugaugagagucuaauua

SEQ ID NO: 36286 - RNA, 19 nt, Homo sapiens
gaguggaaccugucgauua

SEQ ID NO: 36287 - RNA, 19 nt, Homo sapiens
aaaggaaaccauuguguua

SEQ ID NO: 36288 - RNA, 19 nt, Homo sapiens
uaaaggaagguucugaaua

SEQ ID NO: 36289 - RNA, 19 nt, Homo sapiens
cacaagagaacaagaauaa

SEQ ID NO: 36290 - RNA, 19 nt, Homo sapiens
cuucaacacugccacauuu

SEQ ID NO: 36291 - RNA, 19 nt, Homo sapiens
ccacagaagucccugaaag

SEQ ID NO: 36292 - RNA, 19 nt, Homo sapiens
ggaggaggaugacgaugau

SEQ ID NO: 36293 - RNA, 19 nt, Homo sapiens
gaugagagucuaauuaagu

SEQ ID NO: 36294 - RNA, 19 nt, Homo sapiens
ggacagcaagcucaauuau

SEQ ID NO: 36295 - RNA, 19 nt, Homo sapiens
aguggaaccugucgauuaa

SEQ ID NO: 36296 - RNA, 19 nt, Homo sapiens
gcacguaccacaacaaguc

SEQ ID NO: 36297 - RNA, 19 nt, Homo sapiens
gagccaggguuuccucuuc

SEQ ID NO: 36298 - RNA, 19 nt, Homo sapiens
ggaaauggacaaagaugau

SEQ ID NO: 36299 - RNA, 19 nt, Homo sapiens
gacagcaagcucaauuaua

SEQ ID NO: 36300 - RNA, 19 nt, Homo sapiens
ccagagggaguucuucuuu

SEQ ID NO: 36301 - RNA, 19 nt, Homo sapiens
gaaaaugggcaaauuauca

SEQ ID NO: 36302 - RNA, 19 nt, Homo sapiens
caaagaugaugagagucua

SEQ ID NO: 36303 - RNA, 19 nt, Homo sapiens
gaaggaguggacagaauga

SEQ ID NO: 36304 - RNA, 19 nt, Homo sapiens
ggaaaccauuguguuaaag

SEQ ID NO: 36305 - RNA, 19 nt, Homo sapiens
aggaaaccauuguguuaaa

SEQ ID NO: 36306 - RNA, 19 nt, Homo sapiens
gacgugaagcacugaauaa

SEQ ID NO: 36307 - RNA, 19 nt, Homo sapiens
cgacacaagagaacaagaa

SEQ ID NO: 36308 - RNA, 19 nt, Homo sapiens
ccacgucuccaucucagua

SEQ ID NO: 36309 - RNA, 19 nt, Homo sapiens
ggaguggacagaaugaaug

SEQ ID NO: 36310 - RNA, 19 nt, Homo sapiens
ugacuuccuuccuguucua

SEQ ID NO: 36311 - RNA, 19 nt, Homo sapiens
aaggaagguucugaauaua

SEQ ID NO: 36312 - RNA, 19 nt, Homo sapiens
gaaauggacaaagaugaug

SEQ ID NO: 36313 - RNA, 19 nt, Homo sapiens
ccacauuuccuuauugauc

SEQ ID NO: 36314 - RNA, 19 nt, Homo sapiens
ggaccuuacuggagaucug

SEQ ID NO: 36315 - RNA, 19 nt, Homo sapiens
ccaaucaccauggaccuua

SEQ ID NO: 36316 - RNA, 19 nt, Homo sapiens
gcacugaauaaauagauca

SEQ ID NO: 36317 - RNA, 19 nt, Homo sapiens
ugacucagguuccaguagu

SEQ ID NO: 36318 - RNA, 19 nt, Homo sapiens
aaagugaacagggauauug

SEQ ID NO: 36319 - RNA, 19 nt, Homo sapiens
ugcaggaaauggacaaaga

SEQ ID NO: 36320 - RNA, 19 nt, Homo sapiens
aagaaggaguggacagaau

SEQ ID NO: 36321 - RNA, 19 nt, Homo sapiens
acacaagagaacaagaaua

SEQ ID NO: 36322 - RNA, 19 nt, Homo sapiens
uggaaccugucgauuaaga

SEQ ID NO: 36323 - RNA, 19 nt, Homo sapiens
cacaacaaguccuucuuca

SEQ ID NO: 36324 - RNA, 19 nt, Homo sapiens
aaaccauuguguuaaagga

SEQ ID NO: 36325 - RNA, 19 nt, Homo sapiens
gggcaaauuaucacuaaca

SEQ ID NO: 36326 - RNA, 19 nt, Homo sapiens
ugagagacacuguaaacga

SEQ ID NO: 36327 - RNA, 19 nt, Homo sapiens
gguuguugcuggcccaaug

SEQ ID NO: 36328 - RNA, 19 nt, Homo sapiens
ccacaacaaguccuucuuc

SEQ ID NO: 36329 - RNA, 19 nt, Homo sapiens
agacgugaagcacugaaua

SEQ ID NO: 36330 - RNA, 19 nt, Homo sapiens
ccagaaaaugggcaaauua

SEQ ID NO: 36331 - RNA, 19 nt, Homo sapiens
gaaccugucgauuaagaag

SEQ ID NO: 36332 - RNA, 19 nt, Homo sapiens
caccgacgaugacaagcaa

SEQ ID NO: 36333 - RNA, 19 nt, Homo sapiens
aggguuuccucuucaagua

SEQ ID NO: 36334 - RNA, 19 nt, Homo sapiens
gcaggaaauggacaaagau

SEQ ID NO: 36335 - RNA, 19 nt, Homo sapiens
ucaaguaggucuaaaacau

SEQ ID NO: 36336 - RNA, 19 nt, Homo sapiens
acacugccacauuuccuua

SEQ ID NO: 36337 - RNA, 19 nt, Homo sapiens
gaaagagcugcaggaaaug

SEQ ID NO: 36338 - RNA, 19 nt, Homo sapiens
caacguggucccuagaaca

SEQ ID NO: 36339 - RNA, 19 nt, Homo sapiens
cacagaagucccugaaaga

SEQ ID NO: 36340 - RNA, 19 nt, Homo sapiens
ugccacauuuccuuauuga

SEQ ID NO: 36341 - RNA, 19 nt, Homo sapiens
cccaaugagucccuaguca

SEQ ID NO: 36342 - RNA, 19 nt, Homo sapiens
ucucaguacacaaucauuu

SEQ ID NO: 36343 - RNA, 19 nt, Homo sapiens
gaagcacugaauaaauaga

SEQ ID NO: 36344 - RNA, 19 nt, Homo sapiens
ccaguacucagaagucaga

SEQ ID NO: 36345 - RNA, 19 nt, Homo sapiens
caaagugaacagggauauu

SEQ ID NO: 36346 - RNA, 19 nt, Homo sapiens
ggccugaggaguaugaguu

SEQ ID NO: 36347 - RNA, 19 nt, Homo sapiens
ggugaaaguggauaaagca

SEQ ID NO: 36348 - RNA, 19 nt, Homo sapiens
guuaaaggaagguucugaa

SEQ ID NO: 36349 - RNA, 19 nt, Homo sapiens
aaacgacacaagagaacaa

SEQ ID NO: 36350 - RNA, 19 nt, Homo sapiens
caaugagucccuagucaca

SEQ ID NO: 36351 - RNA, 19 nt, Homo sapiens
gcaacuagaggccagaaaa

SEQ ID NO: 36352 - RNA, 19 nt, Homo sapiens
cucaguacacaaucauuua

SEQ ID NO: 36353 - RNA, 19 nt, Homo sapiens
ggaaccugucgauuaagaa

SEQ ID NO: 36354 - RNA, 19 nt, Homo sapiens
uccaguaguucauucuaau

SEQ ID NO: 36355 - RNA, 19 nt, Homo sapiens
uuccaguaguucauucuaa

SEQ ID NO: 36356 - RNA, 19 nt, Homo sapiens
gacucagguuccaguaguu

SEQ ID NO: 36357 - RNA, 19 nt, Homo sapiens
augggcaaauuaucacuaa

SEQ ID NO: 36358 - RNA, 19 nt, Homo sapiens
cguggucccuagaacaaga

SEQ ID NO: 36359 - RNA, 19 nt, Homo sapiens
uaagaaggaguggacagaa

SEQ ID NO: 36360 - RNA, 19 nt, Homo sapiens
gaaaccauuguguuaaagg

SEQ ID NO: 36361 - RNA, 19 nt, Homo sapiens
ugaugagagucuaauuaag

SEQ ID NO: 36362 - RNA, 19 nt, Homo sapiens
ggcaaauuaucacuaacag

SEQ ID NO: 36363 - RNA, 19 nt, Homo sapiens
gggugaaaguggauaaagc

SEQ ID NO: 36364 - RNA, 19 nt, Homo sapiens
aaggaaaccauuguguuaa

SEQ ID NO: 36365 - RNA, 19 nt, Homo sapiens
aaagaugaugagagucuaa

SEQ ID NO: 36366 - RNA, 19 nt, Homo sapiens
guaaacgacacaagagaac

SEQ ID NO: 36367 - RNA, 19 nt, Homo sapiens
cgugaagcacugaauaaau

SEQ ID NO: 36368 - RNA, 19 nt, Homo sapiens
ggaguggaaccugucgauu

SEQ ID NO: 36369 - RNA, 19 nt, Homo sapiens
uggaggaggaugacgauga

SEQ ID NO: 36370 - RNA, 19 nt, Homo sapiens
gagagucuaauuaaguaca

SEQ ID NO: 36371 - RNA, 19 nt, Homo sapiens
acaaagaugaugagagucu

SEQ ID NO: 36372 - RNA, 19 nt, Homo sapiens
uguaaacgacacaagagaa

SEQ ID NO: 36373 - RNA, 19 nt, Homo sapiens
ccaucucaguacacaauca

SEQ ID NO: 36374 - RNA, 19 nt, Homo sapiens
cuugccaccuggaagaauu

SEQ ID NO: 36375 - RNA, 19 nt, Homo sapiens
agaaggaguggacagaaug

SEQ ID NO: 36376 - RNA, 19 nt, Homo sapiens
uggacagcaagcucaauua

SEQ ID NO: 36377 - RNA, 19 nt, Homo sapiens
gaaggaagguguugauuac

SEQ ID NO: 36378 - RNA, 19 nt, Homo sapiens
ggaagguguugauuacaga

SEQ ID NO: 36379 - RNA, 19 nt, Homo sapiens
ugaaggaagguguugauua

SEQ ID NO: 36380 - RNA, 19 nt, Homo sapiens
ccacaggacuugagaacac

SEQ ID NO: 36381 - RNA, 19 nt, Homo sapiens
caggagcagugugguagua

SEQ ID NO: 36382 - RNA, 19 nt, Homo sapiens
ccccugagcugucccauua

SEQ ID NO: 36383 - RNA, 19 nt, Homo sapiens
uggacgagguguuggauga

SEQ ID NO: 36384 - RNA, 19 nt, Homo sapiens
ccugagcugucccauuaaa

SEQ ID NO: 36385 - RNA, 19 nt, Homo sapiens
ccgcaugggccuugucuuu

SEQ ID NO: 36386 - RNA, 19 nt, Homo sapiens
gacccaagccugcccaaug

SEQ ID NO: 36387 - RNA, 19 nt, Homo sapiens
gcaugggccuugucuuugc

SEQ ID NO: 36388 - RNA, 19 nt, Homo sapiens
ugaaggaccagguguuugu

SEQ ID NO: 36389 - RNA, 19 nt, Homo sapiens
gguguugauuacagaguga

SEQ ID NO: 36390 - RNA, 19 nt, Homo sapiens
cuaccucccucaguuguug

SEQ ID NO: 36391 - RNA, 19 nt, Homo sapiens
acccaagccugcccaaugu

SEQ ID NO: 36392 - RNA, 19 nt, Homo sapiens
ccaggaguaugaguuugug

SEQ ID NO: 36393 - RNA, 19 nt, Homo sapiens
gauuacagagugaagaucu

SEQ ID NO: 36394 - RNA, 19 nt, Homo sapiens
cgagcgcccaggaguauga

SEQ ID NO: 36395 - RNA, 19 nt, Homo sapiens
ggagcagugugguaguacu

SEQ ID NO: 36396 - RNA, 19 nt, Homo sapiens
gcccaggagcucucuagga

SEQ ID NO: 36397 - RNA, 19 nt, Homo sapiens
ugagcugucccauuaaaca

SEQ ID NO: 36398 - RNA, 19 nt, Homo sapiens
gcccaggaguaugaguuug

SEQ ID NO: 36399 - RNA, 19 nt, Homo sapiens
ucagcggccucaagugucu

SEQ ID NO: 36400 - RNA, 19 nt, Homo sapiens
gagcugucccauuaaacau

SEQ ID NO: 36401 - RNA, 19 nt, Homo sapiens
ccaaggaggaugggaucuu

SEQ ID NO: 36402 - RNA, 19 nt, Homo sapiens
guacccacaggacuugaga

SEQ ID NO: 36403 - RNA, 19 nt, Homo sapiens
cuacauggugggcagcuau

SEQ ID NO: 36404 - RNA, 19 nt, Homo sapiens
ugucagcggccucaagugu

SEQ ID NO: 36405 - RNA, 19 nt, Homo sapiens
ucugaaggaccagguguuu

SEQ ID NO: 36406 - RNA, 19 nt, Homo sapiens
gaaguaacauucugcaaau

SEQ ID NO: 36407 - RNA, 19 nt, Homo sapiens
gaaaucaaccacagugaaa

SEQ ID NO: 36408 - RNA, 19 nt, Homo sapiens
caaguggauuggugaaauu

SEQ ID NO: 36409 - RNA, 19 nt, Homo sapiens
caagagacuucacacaaca

SEQ ID NO: 36410 - RNA, 19 nt, Homo sapiens
acacaacacuuauguaugc

SEQ ID NO: 36411 - RNA, 19 nt, Homo sapiens
ggaaaucaaccacagugaa

SEQ ID NO: 36412 - RNA, 19 nt, Homo sapiens
gaacugugaugaauauucc

SEQ ID NO: 36413 - RNA, 19 nt, Homo sapiens
agacuucacacaacacuua

SEQ ID NO: 36414 - RNA, 19 nt, Homo sapiens
gcagggagaaguaacauuc

SEQ ID NO: 36415 - RNA, 19 nt, Homo sapiens
gugaaauagucuccauaaa

SEQ ID NO: 36416 - RNA, 19 nt, Homo sapiens
ucacacaacacuuauguau

SEQ ID NO: 36417 - RNA, 19 nt, Homo sapiens
ccaagcagcgucuccguuu

SEQ ID NO: 36418 - RNA, 19 nt, Homo sapiens
ccaagagacuucacacaac

SEQ ID NO: 36419 - RNA, 19 nt, Homo sapiens
gaguacagcagguguuuga

SEQ ID NO: 36420 - RNA, 19 nt, Homo sapiens
agacuaggcuuuggagguu

SEQ ID NO: 36421 - RNA, 19 nt, Homo sapiens
uggauacaguuauugauga

SEQ ID NO: 36422 - RNA, 19 nt, Homo sapiens
acacaccaguugaagacua

SEQ ID NO: 36423 - RNA, 19 nt, Homo sapiens
gaacaaguggauuggugaa

SEQ ID NO: 36424 - RNA, 19 nt, Homo sapiens
ggacacagccggcaaugac

SEQ ID NO: 36425 - RNA, 19 nt, Homo sapiens
cagugugaaucaguuaaua

SEQ ID NO: 36426 - RNA, 19 nt, Homo sapiens
ggaacugugaugaauauuc

SEQ ID NO: 36427 - RNA, 19 nt, Homo sapiens
aaacugaagccguggagaa

SEQ ID NO: 36428 - RNA, 19 nt, Homo sapiens
gggagagguugauccuaug

SEQ ID NO: 36429 - RNA, 19 nt, Homo sapiens
caggaaagcuugguguuuu

SEQ ID NO: 36430 - RNA, 19 nt, Homo sapiens
gccaggagacgaaacagaa

SEQ ID NO: 36431 - RNA, 19 nt, Homo sapiens
ggccaaccauaacucauuc

SEQ ID NO: 36432 - RNA, 19 nt, Homo sapiens
agggagagguugauccuau

SEQ ID NO: 36433 - RNA, 19 nt, Homo sapiens
ggauacaguuauugaugag

SEQ ID NO: 36434 - RNA, 19 nt, Homo sapiens
gcucagcccuuagcaaucg

SEQ ID NO: 36435 - RNA, 19 nt, Homo sapiens
acaaguggauuggugaaau

SEQ ID NO: 36436 - RNA, 19 nt, Homo sapiens
gaguagaagccgacagaga

SEQ ID NO: 36437 - RNA, 19 nt, Homo sapiens
agacauuucuucggcauuc

SEQ ID NO: 36438 - RNA, 19 nt, Homo sapiens
ggagagguugauccuauga

SEQ ID NO: 36439 - RNA, 19 nt, Homo sapiens
ccaggaaagcuugguguuu

SEQ ID NO: 36440 - RNA, 19 nt, Homo sapiens
acucauuccugaacuugaa

SEQ ID NO: 36441 - RNA, 19 nt, Homo sapiens
ggaacgagggagagguuga

SEQ ID NO: 36442 - RNA, 19 nt, Homo sapiens
ggaugggcagggagaagua

SEQ ID NO: 36443 - RNA, 19 nt, Homo sapiens
aaagugaaauagucuccau

SEQ ID NO: 36444 - RNA, 19 nt, Homo sapiens
ggggaacugugaugaauau

SEQ ID NO: 36445 - RNA, 19 nt, Homo sapiens
cugggaagaugcugaguuc

SEQ ID NO: 36446 - RNA, 19 nt, Homo sapiens
agaccuaccuggcuugcau

SEQ ID NO: 36447 - RNA, 19 nt, Homo sapiens
cuggagugcucagcccuua

SEQ ID NO: 36448 - RNA, 19 nt, Homo sapiens
ggcaaugacgccuucagaa

SEQ ID NO: 36449 - RNA, 19 nt, Homo sapiens
ggguggacgucuucaugga

SEQ ID NO: 36450 - RNA, 19 nt, Homo sapiens
gaacgagggagagguugau

SEQ ID NO: 36451 - RNA, 19 nt, Homo sapiens
gggaguacagcagguguuu

SEQ ID NO: 36452 - RNA, 19 nt, Homo sapiens
ugcaacaguuuccaacaug

SEQ ID NO: 36453 - RNA, 19 nt, Homo sapiens
agugaaauagucuccauaa

SEQ ID NO: 36454 - RNA, 19 nt, Homo sapiens
guacagcagguguuugagu

SEQ ID NO: 36455 - RNA, 19 nt, Homo sapiens
uuuggaaacuucuccuuca

SEQ ID NO: 36456 - RNA, 19 nt, Homo sapiens
acacuaacccaaccaucuu

SEQ ID NO: 36457 - RNA, 19 nt, Homo sapiens
cccaagagacuucacacaa

SEQ ID NO: 36458 - RNA, 19 nt, Homo sapiens
ucaaugagugcaagaucuu

SEQ ID NO: 36459 - RNA, 19 nt, Homo sapiens
uuccugaacuugaagaaca

SEQ ID NO: 36460 - RNA, 19 nt, Homo sapiens
ggggaaaaccucucuguug

SEQ ID NO: 36461 - RNA, 19 nt, Homo sapiens
uaacucauuccugaacuug

SEQ ID NO: 36462 - RNA, 19 nt, Homo sapiens
cuagauccaucagaaacug

SEQ ID NO: 36463 - RNA, 19 nt, Homo sapiens
cugcaacaguuuccaacau

SEQ ID NO: 36464 - RNA, 19 nt, Homo sapiens
cugcgucaaugccauggaa

SEQ ID NO: 36465 - RNA, 19 nt, Homo sapiens
guggauuggugaaauuagg

SEQ ID NO: 36466 - RNA, 19 nt, Homo sapiens
gcagacguggugcugaugu

SEQ ID NO: 36467 - RNA, 19 nt, Homo sapiens
gacuaggcuuuggagguuu

SEQ ID NO: 36468 - RNA, 19 nt, Homo sapiens
ugagugcaagaucuucuaa

SEQ ID NO: 36469 - RNA, 19 nt, Homo sapiens
gaagaacaaguggauuggu

SEQ ID NO: 36470 - RNA, 19 nt, Homo sapiens
uugaagaacaaguggauug

SEQ ID NO: 36471 - RNA, 19 nt, Homo sapiens
gcugggaagaugcugaguu

SEQ ID NO: 36472 - RNA, 19 nt, Homo sapiens
gaaacuucuccuucacaca

SEQ ID NO: 36473 - RNA, 19 nt, Homo sapiens
uuaauauucucgggaacga

SEQ ID NO: 36474 - RNA, 19 nt, Homo sapiens
cguccgaacugccgucaac

SEQ ID NO: 36475 - RNA, 19 nt, Homo sapiens
uggccaaccauaacucauu

SEQ ID NO: 36476 - RNA, 19 nt, Homo sapiens
gaugggcagggagaaguaa

SEQ ID NO: 36477 - RNA, 19 nt, Homo sapiens
cacaccaguugaagacuag

SEQ ID NO: 36478 - RNA, 19 nt, Homo sapiens
guucuuccagugugaauca

SEQ ID NO: 36479 - RNA, 19 nt, Homo sapiens
ucacacaccaguugaagac

SEQ ID NO: 36480 - RNA, 19 nt, Homo sapiens
cuaacuacacucuacaagu

SEQ ID NO: 36481 - RNA, 19 nt, Homo sapiens
gcuacucuguggccaacca

SEQ ID NO: 36482 - RNA, 19 nt, Homo sapiens
ugcugcagcugcccacuga

SEQ ID NO: 36483 - RNA, 19 nt, Homo sapiens
agugcaagaucuucuaaac

SEQ ID NO: 36484 - RNA, 19 nt, Homo sapiens
gagugcaagaucuucuaaa

SEQ ID NO: 36485 - RNA, 19 nt, Homo sapiens
ugaaauuaggagcaacuug

SEQ ID NO: 36486 - RNA, 19 nt, Homo sapiens
auaacucauuccugaacuu

SEQ ID NO: 36487 - RNA, 19 nt, Homo sapiens
cuuccagugugaaucaguu

SEQ ID NO: 36488 - RNA, 19 nt, Homo sapiens
caucaaugagugcaagauc

SEQ ID NO: 36489 - RNA, 19 nt, Homo sapiens
cagacguggugcugaugug

SEQ ID NO: 36490 - RNA, 19 nt, Homo sapiens
aggcagacguggugcugau

SEQ ID NO: 36491 - RNA, 19 nt, Homo sapiens
caguugaagacuaggcuuu

SEQ ID NO: 36492 - RNA, 19 nt, Homo sapiens
uggaguagaagccgacaga

SEQ ID NO: 36493 - RNA, 19 nt, Homo sapiens
gcaauggaaugguuaguug

SEQ ID NO: 36494 - RNA, 19 nt, Homo sapiens
aaacacagaugcagucauu

SEQ ID NO: 36495 - RNA, 19 nt, Homo sapiens
ccucagagauggcaaauuc

SEQ ID NO: 36496 - RNA, 19 nt, Homo sapiens
guauuuaguuggagggaua

SEQ ID NO: 36497 - RNA, 19 nt, Homo sapiens
gagaaguuguuacuacuau

SEQ ID NO: 36498 - RNA, 19 nt, Homo sapiens
guaauucaguccauucuuc

SEQ ID NO: 36499 - RNA, 19 nt, Homo sapiens
ugacugggcuugcgaggaa

SEQ ID NO: 36500 - RNA, 19 nt, Homo sapiens
acacagaugcagucauuua

SEQ ID NO: 36501 - RNA, 19 nt, Homo sapiens
gaucgaaucaccugaaugu

SEQ ID NO: 36502 - RNA, 19 nt, Homo sapiens
caaauaaacaggacaugga

SEQ ID NO: 36503 - RNA, 19 nt, Homo sapiens
agaguuaguugccauguug

SEQ ID NO: 36504 - RNA, 19 nt, Homo sapiens
cagaugcagucauuuaugu

SEQ ID NO: 36505 - RNA, 19 nt, Homo sapiens
gggauaauuugaucgaauc

SEQ ID NO: 36506 - RNA, 19 nt, Homo sapiens
cugacugacugcaauauuu

SEQ ID NO: 36507 - RNA, 19 nt, Homo sapiens
ucacacuacuagauguuaa

SEQ ID NO: 36508 - RNA, 19 nt, Homo sapiens
caucaccucucucccuuug

SEQ ID NO: 36509 - RNA, 19 nt, Homo sapiens
gccaaggaaucacugaaga

SEQ ID NO: 36510 - RNA, 19 nt, Homo sapiens
cgaaucaccugaauguucu

SEQ ID NO: 36511 - RNA, 19 nt, Homo sapiens
gaaaauggcagauauucaa

SEQ ID NO: 36512 - RNA, 19 nt, Homo sapiens
agacaaguaucaggccaua

SEQ ID NO: 36513 - RNA, 19 nt, Homo sapiens
ggagaaguuguuacuacua

SEQ ID NO: 36514 - RNA, 19 nt, Homo sapiens
ggagauguuacuauucaaa

SEQ ID NO: 36515 - RNA, 19 nt, Homo sapiens
ucaccugaauguucuaugu

SEQ ID NO: 36516 - RNA, 19 nt, Homo sapiens
uuagugguguuugcaaaua

SEQ ID NO: 36517 - RNA, 19 nt, Homo sapiens
uagagacggugacguacaa

SEQ ID NO: 36518 - RNA, 19 nt, Homo sapiens
guacuucacacuacuagau

SEQ ID NO: 36519 - RNA, 19 nt, Homo sapiens
gacaguaauucaguccauu

SEQ ID NO: 36520 - RNA, 19 nt, Homo sapiens
guauacuccuauuggauga

SEQ ID NO: 36521 - RNA, 19 nt, Homo sapiens
ggcaaauucacuuggguua

SEQ ID NO: 36522 - RNA, 19 nt, Homo sapiens
gccaugacuuccucagaga

SEQ ID NO: 36523 - RNA, 19 nt, Homo sapiens
ucaccucucucccuuugga

SEQ ID NO: 36524 - RNA, 19 nt, Homo sapiens
cuggagauguuacuauuca

SEQ ID NO: 36525 - RNA, 19 nt, Homo sapiens
caagugggagaaguuguua

SEQ ID NO: 36526 - RNA, 19 nt, Homo sapiens
uuaguuggagggauaauuu

SEQ ID NO: 36527 - RNA, 19 nt, Homo sapiens
ggaggacagacaaguauca

SEQ ID NO: 36528 - RNA, 19 nt, Homo sapiens
gggagaaguuguuacuacu

SEQ ID NO: 36529 - RNA, 19 nt, Homo sapiens
gaaguuguuacuacuauac

SEQ ID NO: 36530 - RNA, 19 nt, Homo sapiens
gaacucgggaaaugagaau

SEQ ID NO: 36531 - RNA, 19 nt, Homo sapiens
ggaaugguuaguugaaaca

SEQ ID NO: 36532 - RNA, 19 nt, Homo sapiens
uagugguguuugcaaauaa

SEQ ID NO: 36533 - RNA, 19 nt, Homo sapiens
ggaggaagaagagcugaga

SEQ ID NO: 36534 - RNA, 19 nt, Homo sapiens
ugcagucauuuauguagua

SEQ ID NO: 36535 - RNA, 19 nt, Homo sapiens
uacuggagauguuacuauu

SEQ ID NO: 36536 - RNA, 19 nt, Homo sapiens
guuuggaacucgggaaaug

SEQ ID NO: 36537 - RNA, 19 nt, Homo sapiens
gaccgaaaauggcagauau

SEQ ID NO: 36538 - RNA, 19 nt, Homo sapiens
uaccuaccauuggauuuaa

SEQ ID NO: 36539 - RNA, 19 nt, Homo sapiens
uauacugacugacugcaau

SEQ ID NO: 36540 - RNA, 19 nt, Homo sapiens
gauuauuggcauauacuga

SEQ ID NO: 36541 - RNA, 19 nt, Homo sapiens
gaaaugaagacuacaucac

SEQ ID NO: 36542 - RNA, 19 nt, Homo sapiens
cagaguuaguugccauguu

SEQ ID NO: 36543 - RNA, 19 nt, Homo sapiens
ggauuuaggaggacagaca

SEQ ID NO: 36544 - RNA, 19 nt, Homo sapiens
ggagggauaauuugaucga

SEQ ID NO: 36545 - RNA, 19 nt, Homo sapiens
ugacugacugcaauauuug

SEQ ID NO: 36546 - RNA, 19 nt, Homo sapiens
ggccauacuggagauguua

SEQ ID NO: 36547 - RNA, 19 nt, Homo sapiens
ucgaaucaccugaauguuc

SEQ ID NO: 36548 - RNA, 19 nt, Homo sapiens
gagggauaauuugaucgaa

SEQ ID NO: 36549 - RNA, 19 nt, Homo sapiens
ugggagaaguuguuacuac

SEQ ID NO: 36550 - RNA, 19 nt, Homo sapiens
gaacaggccaugacuuccu

SEQ ID NO: 36551 - RNA, 19 nt, Homo sapiens
aaauaaacaggacauggaa

SEQ ID NO: 36552 - RNA, 19 nt, Homo sapiens
ggaacucgggaaaugagaa

SEQ ID NO: 36553 - RNA, 19 nt, Homo sapiens
cagcgaaggccaaggaauc

SEQ ID NO: 36554 - RNA, 19 nt, Homo sapiens
gagauggcaaauucacuug

SEQ ID NO: 36555 - RNA, 19 nt, Homo sapiens
gcagucauuuauguaguag

SEQ ID NO: 36556 - RNA, 19 nt, Homo sapiens
auaccuaccauuggauuua

SEQ ID NO: 36557 - RNA, 19 nt, Homo sapiens
uggaaacagucaaguguac

SEQ ID NO: 36558 - RNA, 19 nt, Homo sapiens
caaggaaucacugaagauc

SEQ ID NO: 36559 - RNA, 19 nt, Homo sapiens
ugacugcaauauuuguagu

SEQ ID NO: 36560 - RNA, 19 nt, Homo sapiens
uggguuaccugccuugaag

SEQ ID NO: 36561 - RNA, 19 nt, Homo sapiens
caaauucacuuggguuacc

SEQ ID NO: 36562 - RNA, 19 nt, Homo sapiens
gcuuucuuguguuaaggua

SEQ ID NO: 36563 - RNA, 19 nt, Homo sapiens
accugaauguucuauguaa

SEQ ID NO: 36564 - RNA, 19 nt, Homo sapiens
uacuauaccuaccauugga

SEQ ID NO: 36565 - RNA, 19 nt, Homo sapiens
gauuacaagugggagaagu

SEQ ID NO: 36566 - RNA, 19 nt, Homo sapiens
uuaggaggacagacaagua

SEQ ID NO: 36567 - RNA, 19 nt, Homo sapiens
aaccuuaaauuccaagucu

SEQ ID NO: 36568 - RNA, 19 nt, Homo sapiens
ccaagucugggauuuagga

SEQ ID NO: 36569 - RNA, 19 nt, Homo sapiens
gaagaagagcugagaaaag

SEQ ID NO: 36570 - RNA, 19 nt, Homo sapiens
ggaagaagagcugagaaaa

SEQ ID NO: 36571 - RNA, 19 nt, Homo sapiens
gaugcagucauuuauguag

SEQ ID NO: 36572 - RNA, 19 nt, Homo sapiens
gauuagauggagcaggaaa

SEQ ID NO: 36573 - RNA, 19 nt, Homo sapiens
ugaaaugaagacuacauca

SEQ ID NO: 36574 - RNA, 19 nt, Homo sapiens
agacaguaauucaguccau

SEQ ID NO: 36575 - RNA, 19 nt, Homo sapiens
uaggaggacagacaaguau

SEQ ID NO: 36576 - RNA, 19 nt, Homo sapiens
ccaaggaaucacugaagau

SEQ ID NO: 36577 - RNA, 19 nt, Homo sapiens
caauggaaugguuaguuga

SEQ ID NO: 36578 - RNA, 19 nt, Homo sapiens
ggcaauggaaugguuaguu

SEQ ID NO: 36579 - RNA, 19 nt, Homo sapiens
caccugaauguucuaugua

SEQ ID NO: 36580 - RNA, 19 nt, Homo sapiens
ugaggcaauggaaugguua

SEQ ID NO: 36581 - RNA, 19 nt, Homo sapiens
uggaacaggccaugacuuc

SEQ ID NO: 36582 - RNA, 19 nt, Homo sapiens
gagaccgaauuggcauuuc

SEQ ID NO: 36583 - RNA, 19 nt, Homo sapiens
cgagaccgaauuggcauuu

SEQ ID NO: 36584 - RNA, 19 nt, Homo sapiens
agggauaauuugaucgaau

SEQ ID NO: 36585 - RNA, 19 nt, Homo sapiens
guagagacggugacguaca

SEQ ID NO: 36586 - RNA, 19 nt, Homo sapiens
aggaagaagagcugagaaa

SEQ ID NO: 36587 - RNA, 19 nt, Homo sapiens
gaggaagaagagcugagaa

SEQ ID NO: 36588 - RNA, 19 nt, Homo sapiens
auacuccuauuggaugaaa

SEQ ID NO: 36589 - RNA, 19 nt, Homo sapiens
ccugaauguucuauguaau

SEQ ID NO: 36590 - RNA, 19 nt, Homo sapiens
aagacuacaucaccucucu

SEQ ID NO: 36591 - RNA, 19 nt, Homo sapiens
agagauggcaaauucacuu

SEQ ID NO: 36592 - RNA, 19 nt, Homo sapiens
cacagaugcagucauuuau

SEQ ID NO: 36593 - RNA, 19 nt, Homo sapiens
ggacuacuccuaccucaau

SEQ ID NO: 36594 - RNA, 19 nt, Homo sapiens
acuccuaccucaauucgua

SEQ ID NO: 36595 - RNA, 19 nt, Homo sapiens
gcagugccauacaauuucu

SEQ ID NO: 36596 - RNA, 19 nt, Homo sapiens
cauccggccugcacgagaa

SEQ ID NO: 36597 - RNA, 19 nt, Homo sapiens
gggccaaguuccgcaaaca

SEQ ID NO: 36598 - RNA, 19 nt, Homo sapiens
gacuacuccuaccucaauu

SEQ ID NO: 36599 - RNA, 19 nt, Homo sapiens
ggacaaugcuggaaagaca

SEQ ID NO: 36600 - RNA, 19 nt, Homo sapiens
ugaagaagaugaagcagaa

SEQ ID NO: 36601 - RNA, 19 nt, Homo sapiens
gagcaacccuccucaucuu

SEQ ID NO: 36602 - RNA, 19 nt, Homo sapiens
caaccauccugaagaaguu

SEQ ID NO: 36603 - RNA, 19 nt, Homo sapiens
agacaaccauccugaagaa

SEQ ID NO: 36604 - RNA, 19 nt, Homo sapiens
gaaagacaaccauccugaa

SEQ ID NO: 36605 - RNA, 19 nt, Homo sapiens
cuggagcacuguccucuaa

SEQ ID NO: 36606 - RNA, 19 nt, Homo sapiens
ucgacuggcuccuggauga

SEQ ID NO: 36607 - RNA, 19 nt, Homo sapiens
cuccucaucuuugcuaaua

SEQ ID NO: 36608 - RNA, 19 nt, Homo sapiens
uggcggaacuacuuugaga

SEQ ID NO: 36609 - RNA, 19 nt, Homo sapiens
ggauguggguggccagaag

SEQ ID NO: 36610 - RNA, 19 nt, Homo sapiens
acgcugggcuucaacauca

SEQ ID NO: 36611 - RNA, 19 nt, Homo sapiens
gcaacccuccucaucuuug

SEQ ID NO: 36612 - RNA, 19 nt, Homo sapiens
gggaggacaucgacaccau

SEQ ID NO: 36613 - RNA, 19 nt, Homo sapiens
agaagucccugcgguccua

SEQ ID NO: 36614 - RNA, 19 nt, Homo sapiens
ccucauccuucacucaguu

SEQ ID NO: 36615 - RNA, 19 nt, Homo sapiens
ccucaaccuucaccaaaca

SEQ ID NO: 36616 - RNA, 19 nt, Homo sapiens
gacauuuccagccgcauuu

SEQ ID NO: 36617 - RNA, 19 nt, Homo sapiens
gaagaagaugaagcagaaa

SEQ ID NO: 36618 - RNA, 19 nt, Homo sapiens
ccucaucuuugcuaauaag

SEQ ID NO: 36619 - RNA, 19 nt, Homo sapiens
ugacugaaccacuccagau

SEQ ID NO: 36620 - RNA, 19 nt, Homo sapiens
gaagaugaagcagaaagag

SEQ ID NO: 36621 - RNA, 19 nt, Homo sapiens
caaccuucaccaaacacua

SEQ ID NO: 36622 - RNA, 19 nt, Homo sapiens
ggagcacuguccucuaacg

SEQ ID NO: 36623 - RNA, 19 nt, Homo sapiens
ugacauuuccagccgcauu

SEQ ID NO: 36624 - RNA, 19 nt, Homo sapiens
aaagacaaccauccugaag

SEQ ID NO: 36625 - RNA, 19 nt, Homo sapiens
agaagaugaagcagaaaga

SEQ ID NO: 36626 - RNA, 19 nt, Homo sapiens
gacugaaccacuccagaug

SEQ ID NO: 36627 - RNA, 19 nt, Homo sapiens
gcuccuggaugacauuucc

SEQ ID NO: 36628 - RNA, 19 nt, Homo sapiens
caacccuccucaucuuugc

SEQ ID NO: 36629 - RNA, 19 nt, Homo sapiens
cuacuggcggaacuacuuu

SEQ ID NO: 36630 - RNA, 19 nt, Homo sapiens
gacaaugcuggaaagacaa

SEQ ID NO: 36631 - RNA, 19 nt, Homo sapiens
aagacaaccauccugaaga

SEQ ID NO: 36632 - RNA, 19 nt, Homo sapiens
gaggacaucgacaccaucu

SEQ ID NO: 36633 - RNA, 19 nt, Homo sapiens
gaacaacacgguuuagaaa

SEQ ID NO: 36634 - RNA, 19 nt, Homo sapiens
gaccauacuggaagaauua

SEQ ID NO: 36635 - RNA, 19 nt, Homo sapiens
gugcucaucuuugcuaaua

SEQ ID NO: 36636 - RNA, 19 nt, Homo sapiens
cuaauuugcugcuuucuga

SEQ ID NO: 36637 - RNA, 19 nt, Homo sapiens
ggaacaacacgguuuagaa

SEQ ID NO: 36638 - RNA, 19 nt, Homo sapiens
caacacgguuuagaaagaa

SEQ ID NO: 36639 - RNA, 19 nt, Homo sapiens
gaagacaucagccacauca

SEQ ID NO: 36640 - RNA, 19 nt, Homo sapiens
ggaacuagcggaauuacug

SEQ ID NO: 36641 - RNA, 19 nt, Homo sapiens
acaacacgguuuagaaaga

SEQ ID NO: 36642 - RNA, 19 nt, Homo sapiens
ggacugaaccugcauacca

SEQ ID NO: 36643 - RNA, 19 nt, Homo sapiens
gcacaugauuagaaaauga

SEQ ID NO: 36644 - RNA, 19 nt, Homo sapiens
acacaggguuucaacauca

SEQ ID NO: 36645 - RNA, 19 nt, Homo sapiens
gagggaacaacacgguuua

SEQ ID NO: 36646 - RNA, 19 nt, Homo sapiens
gucaggaacuagcggaauu

SEQ ID NO: 36647 - RNA, 19 nt, Homo sapiens
caucaaaaguguacaauca

SEQ ID NO: 36648 - RNA, 19 nt, Homo sapiens
gcucaucuuugcuaauaag

SEQ ID NO: 36649 - RNA, 19 nt, Homo sapiens
cggaauuacuggaggaaga

SEQ ID NO: 36650 - RNA, 19 nt, Homo sapiens
ugucuaaagcacaugauua

SEQ ID NO: 36651 - RNA, 19 nt, Homo sapiens
uauuuccucugcauaauug

SEQ ID NO: 36652 - RNA, 19 nt, Homo sapiens
gaaggacugaaccugcaua

SEQ ID NO: 36653 - RNA, 19 nt, Homo sapiens
agaccauacuggaagaauu

SEQ ID NO: 36654 - RNA, 19 nt, Homo sapiens
acacuaauuugcugcuuuc

SEQ ID NO: 36655 - RNA, 19 nt, Homo sapiens
ggaauuacuggaggaagaa

SEQ ID NO: 36656 - RNA, 19 nt, Homo sapiens
gcugcuuucugaccaaaug

SEQ ID NO: 36657 - RNA, 19 nt, Homo sapiens
cauuccagcaguagauuua

SEQ ID NO: 36658 - RNA, 19 nt, Homo sapiens
gaaauugcagaaggacuga

SEQ ID NO: 36659 - RNA, 19 nt, Homo sapiens
gcuugcaucugaagacauc

SEQ ID NO: 36660 - RNA, 19 nt, Homo sapiens
gacugaaccugcauaccau

SEQ ID NO: 36661 - RNA, 19 nt, Homo sapiens
ggaugggcuugcucucaau

SEQ ID NO: 36662 - RNA, 19 nt, Homo sapiens
guacacuccagcuguuuga

SEQ ID NO: 36663 - RNA, 19 nt, Homo sapiens
ccagugcucaucuuugcua

SEQ ID NO: 36664 - RNA, 19 nt, Homo sapiens
agagacgggucaggaacua

SEQ ID NO: 36665 - RNA, 19 nt, Homo sapiens
aaucgacagugcagacaga

SEQ ID NO: 36666 - RNA, 19 nt, Homo sapiens
ucaggaacuagcggaauua

SEQ ID NO: 36667 - RNA, 19 nt, Homo sapiens
aaaugucaaugcaaagaag

SEQ ID NO: 36668 - RNA, 19 nt, Homo sapiens
ugaagagacgggucaggaa

SEQ ID NO: 36669 - RNA, 19 nt, Homo sapiens
gaggaugggcuugcucuca

SEQ ID NO: 36670 - RNA, 19 nt, Homo sapiens
gggaacaacacgguuuaga

SEQ ID NO: 36671 - RNA, 19 nt, Homo sapiens
aacacuaauuugcugcuuu

SEQ ID NO: 36672 - RNA, 19 nt, Homo sapiens
gagcugcgggagccgaauu

SEQ ID NO: 36673 - RNA, 19 nt, Homo sapiens
cacuccagcuguuugaaga

SEQ ID NO: 36674 - RNA, 19 nt, Homo sapiens
aggaugggcuugcucucaa

SEQ ID NO: 36675 - RNA, 19 nt, Homo sapiens
uguguacacuccagcuguu

SEQ ID NO: 36676 - RNA, 19 nt, Homo sapiens
cuacacaggguuucaacau

SEQ ID NO: 36677 - RNA, 19 nt, Homo sapiens
cuccugggcuuggauaaug

SEQ ID NO: 36678 - RNA, 19 nt, Homo sapiens
agagggaacaacacgguuu

SEQ ID NO: 36679 - RNA, 19 nt, Homo sapiens
aaacacuaauuugcugcuu

SEQ ID NO: 36680 - RNA, 19 nt, Homo sapiens
gaccaggaggugagaauac

SEQ ID NO: 36681 - RNA, 19 nt, Homo sapiens
ucacaccuacacaggguuu

SEQ ID NO: 36682 - RNA, 19 nt, Homo sapiens
cagcuugcaucugaagaca

SEQ ID NO: 36683 - RNA, 19 nt, Homo sapiens
uacacaggguuucaacauc

SEQ ID NO: 36684 - RNA, 19 nt, Homo sapiens
agacaucagccacaucaca

SEQ ID NO: 36685 - RNA, 19 nt, Homo sapiens
gacaauuccagugggcuuu

SEQ ID NO: 36686 - RNA, 19 nt, Homo sapiens
ccucugcauaauugaaaua

SEQ ID NO: 36687 - RNA, 19 nt, Homo sapiens
gaugggcuugcucucaauu

SEQ ID NO: 36688 - RNA, 19 nt, Homo sapiens
gaauuacuggaggaagaaa

SEQ ID NO: 36689 - RNA, 19 nt, Homo sapiens
aguguacaaucacaagguu

SEQ ID NO: 36690 - RNA, 19 nt, Homo sapiens
cacaggguuucaacaucaa

SEQ ID NO: 36691 - RNA, 19 nt, Homo sapiens
gcuuucugaccaaauguuu

SEQ ID NO: 36692 - RNA, 19 nt, Homo sapiens
cgacagugcagacagaaaa

SEQ ID NO: 36693 - RNA, 19 nt, Homo sapiens
cuagacgaauggagaugca

SEQ ID NO: 36694 - RNA, 19 nt, Homo sapiens
caugaacugggucugcaaa

SEQ ID NO: 36695 - RNA, 19 nt, Homo sapiens
gaagucagaugguuuauuu

SEQ ID NO: 36696 - RNA, 19 nt, Homo sapiens
uaaauaggcuggcaagaua

SEQ ID NO: 36697 - RNA, 19 nt, Homo sapiens
ucaaggagaucguuuauuu

SEQ ID NO: 36698 - RNA, 19 nt, Homo sapiens
gaucagaugucuaacgaua

SEQ ID NO: 36699 - RNA, 19 nt, Homo sapiens
gaaagaaacaugugaguaa

SEQ ID NO: 36700 - RNA, 19 nt, Homo sapiens
gcagagaauuucaggaaua

SEQ ID NO: 36701 - RNA, 19 nt, Homo sapiens
gaucaggacuauaauauug

SEQ ID NO: 36702 - RNA, 19 nt, Homo sapiens
ggagaaauguccucauauu

SEQ ID NO: 36703 - RNA, 19 nt, Homo sapiens
gaagaacucuagccaagaa

SEQ ID NO: 36704 - RNA, 19 nt, Homo sapiens
gcaagcaacugagauuuaa

SEQ ID NO: 36705 - RNA, 19 nt, Homo sapiens
gaagcccucuugcaaagua

SEQ ID NO: 36706 - RNA, 19 nt, Homo sapiens
ccagaggaaucuauaguuu

SEQ ID NO: 36707 - RNA, 19 nt, Homo sapiens
gugcaagacugaauuaaug

SEQ ID NO: 36708 - RNA, 19 nt, Homo sapiens
gaauggcucuggaugagaa

SEQ ID NO: 36709 - RNA, 19 nt, Homo sapiens
uggaagaucugcaaacauu

SEQ ID NO: 36710 - RNA, 19 nt, Homo sapiens
aaacucaacuucuuggauu

SEQ ID NO: 36711 - RNA, 19 nt, Homo sapiens
gagauggacuggccagcua

SEQ ID NO: 36712 - RNA, 19 nt, Homo sapiens
uuacuacccucacccuuua

SEQ ID NO: 36713 - RNA, 19 nt, Homo sapiens
cgaaugagguguggcagua

SEQ ID NO: 36714 - RNA, 19 nt, Homo sapiens
cagggucacuugguaauua

SEQ ID NO: 36715 - RNA, 19 nt, Homo sapiens
cuacaacaaugaagaauuc

SEQ ID NO: 36716 - RNA, 19 nt, Homo sapiens
gaccugaaauuguauagug

SEQ ID NO: 36717 - RNA, 19 nt, Homo sapiens
caacagguagugaaauuaa

SEQ ID NO: 36718 - RNA, 19 nt, Homo sapiens
gaaauugaguacaucaucu

SEQ ID NO: 36719 - RNA, 19 nt, Homo sapiens
gaauggacuuggcucugua

SEQ ID NO: 36720 - RNA, 19 nt, Homo sapiens
ggucagcagucuuccauga

SEQ ID NO: 36721 - RNA, 19 nt, Homo sapiens
gcucucaccuuaucuggaa

SEQ ID NO: 36722 - RNA, 19 nt, Homo sapiens
gaagaauucccugaucuaa

SEQ ID NO: 36723 - RNA, 19 nt, Homo sapiens
gaacacauucagugauaaa

SEQ ID NO: 36724 - RNA, 19 nt, Homo sapiens
ggacuuggcucuguaaagg

SEQ ID NO: 36725 - RNA, 19 nt, Homo sapiens
gagauuggguuuugcuuua

SEQ ID NO: 36726 - RNA, 19 nt, Homo sapiens
ggaaagaaacaugugagua

SEQ ID NO: 36727 - RNA, 19 nt, Homo sapiens
gcaaaucuuucuguaaaca

SEQ ID NO: 36728 - RNA, 19 nt, Homo sapiens
caucaucguucaaguucua

SEQ ID NO: 36729 - RNA, 19 nt, Homo sapiens
gcagcacacucuaugauca

SEQ ID NO: 36730 - RNA, 19 nt, Homo sapiens
ggaaugcucugaccaugag

SEQ ID NO: 36731 - RNA, 19 nt, Homo sapiens
uaaaugcggauacagguua

SEQ ID NO: 36732 - RNA, 19 nt, Homo sapiens
ucgaacacauucagugaua

SEQ ID NO: 36733 - RNA, 19 nt, Homo sapiens
uugauacgauugucuguua

SEQ ID NO: 36734 - RNA, 19 nt, Homo sapiens
gcacacaugcuucuguauu

SEQ ID NO: 36735 - RNA, 19 nt, Homo sapiens
gcgcacacaugcuucugua

SEQ ID NO: 36736 - RNA, 19 nt, Homo sapiens
caugaaacauuguagguau

SEQ ID NO: 36737 - RNA, 19 nt, Homo sapiens
ggaauggacuuggcucugu

SEQ ID NO: 36738 - RNA, 19 nt, Homo sapiens
ucagaaaucuaucacaaca

SEQ ID NO: 36739 - RNA, 19 nt, Homo sapiens
cacaggaacucuuaggaaa

SEQ ID NO: 36740 - RNA, 19 nt, Homo sapiens
ucaggaaucagaaaucaua

SEQ ID NO: 36741 - RNA, 19 nt, Homo sapiens
aguuuaagcuccagacaua

SEQ ID NO: 36742 - RNA, 19 nt, Homo sapiens
gaguuucccuuccuuaugu

SEQ ID NO: 36743 - RNA, 19 nt, Homo sapiens
gaugagaaccagcuccuuu

SEQ ID NO: 36744 - RNA, 19 nt, Homo sapiens
ucaacagggucacuuggua

SEQ ID NO: 36745 - RNA, 19 nt, Homo sapiens
gaaagucggcuguugauac

SEQ ID NO: 36746 - RNA, 19 nt, Homo sapiens
cacacaugcuucuguauuu

SEQ ID NO: 36747 - RNA, 19 nt, Homo sapiens
gugagcagcuuuccacuuc

SEQ ID NO: 36748 - RNA, 19 nt, Homo sapiens
ccacugauggcuccuauaa

SEQ ID NO: 36749 - RNA, 19 nt, Homo sapiens
gaucuugauugcggcuuua

SEQ ID NO: 36750 - RNA, 19 nt, Homo sapiens
gaggcugggugaaguuaaa

SEQ ID NO: 36751 - RNA, 19 nt, Homo sapiens
guagugcccuggcucgaaa

SEQ ID NO: 36752 - RNA, 19 nt, Homo sapiens
gccaguagcuaaagugcaa

SEQ ID NO: 36753 - RNA, 19 nt, Homo sapiens
cauggaaacucaacuucuu

SEQ ID NO: 36754 - RNA, 19 nt, Homo sapiens
agacuuggccauaaagaua

SEQ ID NO: 36755 - RNA, 19 nt, Homo sapiens
ccagaacccuuacucagau

SEQ ID NO: 36756 - RNA, 19 nt, Homo sapiens
gaaccagcuccuuuacuuu

SEQ ID NO: 36757 - RNA, 19 nt, Homo sapiens
ggacccaguuucugugaau

SEQ ID NO: 36758 - RNA, 19 nt, Homo sapiens
gcacccagaugauguggau

SEQ ID NO: 36759 - RNA, 19 nt, Homo sapiens
gaacugaaacauuugaucu

SEQ ID NO: 36760 - RNA, 19 nt, Homo sapiens
gauugcggcuuuaucauuc

SEQ ID NO: 36761 - RNA, 19 nt, Homo sapiens
cugcaaacauuaccuaaau

SEQ ID NO: 36762 - RNA, 19 nt, Homo sapiens
ggaggcagcagauggcuuu

SEQ ID NO: 36763 - RNA, 19 nt, Homo sapiens
ccugacacauucugaguaa

SEQ ID NO: 36764 - RNA, 19 nt, Homo sapiens
gaagaaauggaaugaaucu

SEQ ID NO: 36765 - RNA, 19 nt, Homo sapiens
ugagaagucagaugguuua

SEQ ID NO: 36766 - RNA, 19 nt, Homo sapiens
gaagggaacaguaaauuuu

SEQ ID NO: 36767 - RNA, 19 nt, Homo sapiens
agaaccagcuccuuuacuu

SEQ ID NO: 36768 - RNA, 19 nt, Homo sapiens
cagaggaaucuauaguuua

SEQ ID NO: 36769 - RNA, 19 nt, Homo sapiens
uauucuaugugcacacuua

SEQ ID NO: 36770 - RNA, 19 nt, Homo sapiens
gagugcaaguaucauaauu

SEQ ID NO: 36771 - RNA, 19 nt, Homo sapiens
gagaagggaacaguaaauu

SEQ ID NO: 36772 - RNA, 19 nt, Homo sapiens
gcaaacauuaccuaaauag

SEQ ID NO: 36773 - RNA, 19 nt, Homo sapiens
uaaaacaccuuuccuuaug

SEQ ID NO: 36774 - RNA, 19 nt, Homo sapiens
cagaugaaauugaguacau

SEQ ID NO: 36775 - RNA, 19 nt, Homo sapiens
ugaauaggcugagcuuugu

SEQ ID NO: 36776 - RNA, 19 nt, Homo sapiens
ggaagaucugcaaacauua

SEQ ID NO: 36777 - RNA, 19 nt, Homo sapiens
agaaaucuaucacaacauc

SEQ ID NO: 36778 - RNA, 19 nt, Homo sapiens
gaggguaucuucacuuuug

SEQ ID NO: 36779 - RNA, 19 nt, Homo sapiens
uaucauuccuuuccaguuc

SEQ ID NO: 36780 - RNA, 19 nt, Homo sapiens
ugacauguagcaaagauuu

SEQ ID NO: 36781 - RNA, 19 nt, Homo sapiens
uaaaugugaucaggacuau

SEQ ID NO: 36782 - RNA, 19 nt, Homo sapiens
caaauacgaagcccucuug

SEQ ID NO: 36783 - RNA, 19 nt, Homo sapiens
ccuaaggaguuaaaucuuc

SEQ ID NO: 36784 - RNA, 19 nt, Homo sapiens
ggcaacacauucccuccua

SEQ ID NO: 36785 - RNA, 19 nt, Homo sapiens
caacagggucacuugguaa

SEQ ID NO: 36786 - RNA, 19 nt, Homo sapiens
ccucauuguuggaguguaa

SEQ ID NO: 36787 - RNA, 19 nt, Homo sapiens
ugauaaagcuggguuacug

SEQ ID NO: 36788 - RNA, 19 nt, Homo sapiens
gagagagagugugugugua

SEQ ID NO: 36789 - RNA, 19 nt, Homo sapiens
ugaggaccaugaaacauug

SEQ ID NO: 36790 - RNA, 19 nt, Homo sapiens
gagaucaagaggcagguua

SEQ ID NO: 36791 - RNA, 19 nt, Homo sapiens
cuccugaccugaaauugua

SEQ ID NO: 36792 - RNA, 19 nt, Homo sapiens
gacacaacauugaggguau

SEQ ID NO: 36793 - RNA, 19 nt, Homo sapiens
gccacagucugaaugguuu

SEQ ID NO: 36794 - RNA, 19 nt, Homo sapiens
ugaaacauuugaucuugga

SEQ ID NO: 36795 - RNA, 19 nt, Homo sapiens
ugaauuggcuucuuuggua

SEQ ID NO: 36796 - RNA, 19 nt, Homo sapiens
gaccggaggugccuguuua

SEQ ID NO: 36797 - RNA, 19 nt, Homo sapiens
caacagcuauaguaucaaa

SEQ ID NO: 36798 - RNA, 19 nt, Homo sapiens
ccacauagguauagacaug

SEQ ID NO: 36799 - RNA, 19 nt, Homo sapiens
gcacaucguguuaugaaua

SEQ ID NO: 36800 - RNA, 19 nt, Homo sapiens
uaacaggccuucaguaaag

SEQ ID NO: 36801 - RNA, 19 nt, Homo sapiens
ccaaggaaguagaauauau

SEQ ID NO: 36802 - RNA, 19 nt, Homo sapiens
guggauagcuugcauuaau

SEQ ID NO: 36803 - RNA, 19 nt, Homo sapiens
gaagcaaacuacaaaccaa

SEQ ID NO: 36804 - RNA, 19 nt, Homo sapiens
gaaaucagggugaaaucua

SEQ ID NO: 36805 - RNA, 19 nt, Homo sapiens
ggcaacagcuauaguauca

SEQ ID NO: 36806 - RNA, 19 nt, Homo sapiens
gagaauagcuuuuauguac

SEQ ID NO: 36807 - RNA, 19 nt, Homo sapiens
ggugaaaucuauggaauau

SEQ ID NO: 36808 - RNA, 19 nt, Homo sapiens
cuaaagauauugccaaagu

SEQ ID NO: 36809 - RNA, 19 nt, Homo sapiens
cauggaagguuagaauaua

SEQ ID NO: 36810 - RNA, 19 nt, Homo sapiens
gaacaccaaggaaggauaa

SEQ ID NO: 36811 - RNA, 19 nt, Homo sapiens
uaagaacugugacuucaga

SEQ ID NO: 36812 - RNA, 19 nt, Homo sapiens
guauagacaugauugacaa

SEQ ID NO: 36813 - RNA, 19 nt, Homo sapiens
cgcgauagauggaaaguuu

SEQ ID NO: 36814 - RNA, 19 nt, Homo sapiens
ggaccaaggaaguagaaua

SEQ ID NO: 36815 - RNA, 19 nt, Homo sapiens
ucaccaagaugacauagga

SEQ ID NO: 36816 - RNA, 19 nt, Homo sapiens
uagaugaauuggcuucuuu

SEQ ID NO: 36817 - RNA, 19 nt, Homo sapiens
gaccaaggaucaaguaguc

SEQ ID NO: 36818 - RNA, 19 nt, Homo sapiens
gcaauuggacgacugcauu

SEQ ID NO: 36819 - RNA, 19 nt, Homo sapiens
cauaggacaucuugcagaa

SEQ ID NO: 36820 - RNA, 19 nt, Homo sapiens
gaucaaguagucccaguaa

SEQ ID NO: 36821 - RNA, 19 nt, Homo sapiens
caacagcuauuuuggcaua

SEQ ID NO: 36822 - RNA, 19 nt, Homo sapiens
gcaacgcaauguccaggaa

SEQ ID NO: 36823 - RNA, 19 nt, Homo sapiens
gaacugugacuucagauca

SEQ ID NO: 36824 - RNA, 19 nt, Homo sapiens
ggaaguagaauauauuguc

SEQ ID NO: 36825 - RNA, 19 nt, Homo sapiens
gcuagaguguuuacguuug

SEQ ID NO: 36826 - RNA, 19 nt, Homo sapiens
ggugcuggcuagaguguuu

SEQ ID NO: 36827 - RNA, 19 nt, Homo sapiens
gaccaaggaaguagaauau

SEQ ID NO: 36828 - RNA, 19 nt, Homo sapiens
caguaaagguugaagacaa

(The sequence listing continues in the following parts.)

The invention claimed is:

1. An siRNA molecule effective at silencing MEK1 expression, wherein said siRNA molecule comprises a sense region and an antisense region, wherein said sense region and said antisense region together form a duplex region comprising 19-30 base pairs and said antisense region comprises a sequence that is the complement of SEQ. ID NO. 367.

2. The siRNA molecule of claim 1, wherein said antisense region and said sense region are each 19-25 nucleotides in length.

3. The siRNA molecule of claim 2, wherein said antisense region and said sense region are each 19 nucleotides in length.

4. The siRNA molecule of claim 1, wherein said antisense region is 100% complementary to a region of a target MEK1 mRNA.

5. The siRNA molecule of claim 1, wherein said siRNA molecule comprises at least one overhang region, wherein said overhang region comprises six or fewer nucleotides.

6. The siRNA molecule of claim 1, wherein said siRNA molecule comprises no overhang regions.

7. The siRNA molecule of claim 2, wherein said siRNA molecule comprises at least one overhang region, wherein said overhang region comprises six or fewer nucleotides.

8. The siRNA molecule of claim 2, wherein said siRNA molecule comprises no overhang regions.

9. The siRNA molecule of claim 3, wherein said siRNA molecule comprises at least one overhang region, wherein said overhang region comprises six or fewer nucleotides.

10. The siRNA molecule of claim 3, wherein said siRNA molecule comprises no overhang regions.

11. An siRNA composition comprising the complement of SEQ. ID NO. 367.

12. The siRNA composition of claim 11, further comprising SEQ. ID NO. 367.

13. The siRNA composition of claim 12, wherein said composition comprises a duplex between 19 and 30 base pairs in length.

14. The siRNA composition of claim 13, wherein said duplex is 19 base pairs in length.

15. The siRNA composition of claim 11 further comprising at least one overhang of six or fewer bases.

16. The siRNA composition of claim 12 further comprising at least one overhang of six or fewer bases.

17. The siRNA composition of claim 14 further comprising at least one overhang of six or fewer bases.

18. The siRNA composition of claim 11 wherein said siRNA comprises no overhangs.

19. The siRNA composition of claim 12, wherein said siRNA comprises no overhangs.

20. The siRNA composition of claim 13, wherein said siRNA comprises no overhangs.

\* \* \* \* \*